United States Patent 8,541,208 (PROCESS FOR THE PRODUCTION OF FINE CHEMICALS) - sequence listing, part 10

SEQ ID NO: 43477 - DNA, 1281 bp, Streptomyces tendae
  CDS (1)..(1281)
atgctgaccgtgaacgagaactcccggtacttcgtgccggcccccgcggtgggaagcatcctcgggggcgccgagctggccgcgctgggcgaggtcgtccggtccggcgagagcctctcccaagggcggtggcgggacgcgttcgagcaggcgatgcgcgagcacgtcggcagccggtacgcgatgaccgtcaccagcggaaccgtcgccgtcgcgctcgccgtgcacctgctggacctcgcccccggtgacgaggtcatcgtgaccccgcagaccttcaaggccaccgtcgaccccctgctggcccacgacgtgacggtccgtttctgcgacgtggagccggacaccctgaacgtggacgtcgactcgttcgagtcgctgatcaccccgcggacccgggccctgatcctggtccactacggcggccggccggcccgcatggacgagatcatgcgggtggcccgccggcacggcgtccgggtgatcgaggactgcgcgcacgcgctgggcgccctctaccgcggccggcggccgggcgcgctcggcgacatcgggtgcttcagcttccactccagcaagaacatcacgaccctcggcgagggcggcatgctcaccttcgacgatcccgagtgggccgagcgcctcgaccgcatccgctccaacgccgccgacggggtcctcatcccgtcgccgctgtcggccgggccgtaccagcactcggagccctggatgatgtgggcgggggactcgtacgagaaggagtgcctgcgcatccggcaccccgggagcaacgccacgctcagcgaggccggggcggctgtggggctggtccagctggagcgtctcggggagctggccgggcggcggcggtggatcgccgggcgtctcgcccggacgctggcggagttgccgcaggtgcggctggccgacgtgcccgaggacatccaccacccctaccacctgttcaccttcttcgtccggccgggacagggcgtgagccgcgacgaggtcatccacgccctggaggacgccggggtccaggtgcaggtgcgttacttccccctgcacctgcgccccgagtggcggggccggggccaccggctcggcgagtgtccggtcaccgagcggctctggttccacgagcaggtcaacctgccctgctacccgtcgatgaccgacggccaggtggagcacctggtgctggccctgaagtccgcgctcaccggacggcgggacaccggcgagcgcggcacgtcgagttacgaggaggcccgggcatga

SEQ ID NO: 43478 - protein, 426 aa, Streptomyces tendae
MLTVNENSRYFVPAPAVGSILGGAELAALGEVVRSGESLSQGRWRDAFEQAMREHVGSRYAMTVTSGTVAVALAVHLLDLAPGDEVIVTPQTFKATVDPLLAHDVTVRFCDVEPDTLNVDVDSFESLITPRTRALILVHYGGRPARMDEIMRVARRHGVRVIEDCAHALGALYRGRRPGALGDIGCFSFHSSKNITTLGEGGMLTFDDPEWAERLDRIRSNAADGVLIPSPLSAGPYQHSEPWMMWAGDSYEKECLRIRHPGSNATLSEAGAAVGLVQLERLGELAGRRRWIAGRLARTLAELPQVRLADVPEDIHHPYHLFTFFVRPGQGVSRDEVIHALEDAGVQVQVRYFPLHLRPEWRGRGHRLGECPVTERLWFHEQVNLPCYPSMTDGQVEHLVLALKSALTGRRDTGERGTSSYEEARA

SEQ ID NO: 43479 - DNA, 1188 bp, Bordetella bronchiseptica
  CDS (1)..(1188)
atgagcgacttcctgccctttgccctgcccgatatcggcgaggccgaaatccaagcggtcaccgaatccatgcgttcgggctggctgaccaccggccccaacgcccgcgagttcgaacgcgaattcgcggcctacatgggcgccgacgtggaggccgtggccgtcaattcggccaccgccggcctgcacctggccctggaagccataggggtcggcccgggcgacgaagtcatcaccaccacccacacattcaccgccagcgccgaagtcgcccgctacctgggcgccgaaccggtcctggtcgatatcgacccggccacgctgtgcatctcgcccgccgccatcgaacgcgccatcacgccgcgcacccgcgcaatcgtgccggtgcactacggcggcctgtcctgcgacatggacagcatcctggagatcgcccgcaagcacggcctgaaagtcatcgaggacgccgcccacgcgctgcccgcctcctggcaaggccggcgtatcggcagcctggaaagcgacctgaccgtctacagcttttacgccaccaagacgctggccaccggcgaagggggcatggtggtcacgcgcgaccccgccctcgccaagcgctgccgtgtcatgcggctgcatggcatcgaccgcgacgccttcgatcgcttcacctcgaagaagccggcgtggtactacgaaatcgtcgcccccggcttcaagtacaacatgaccgacacggccgccgcgatgggccgcgtccagttgcaacgcgtgcagcaaatgcgcgaccggcgcgcacagatcgccgcggcctatgaccaggccttcgccgatctgccgctgacactgccccccagccctggccgcacgccgggcgtcgaacgcgcggcccaccgcgacgacgacgagcattcctggcacctgtacgccatccgcatccatccgcaggcgccgctcaagcgcgacgacttcatcgtgcgcatgaccgagaacggcatcggctgcagcgtgcactacgtgccgttgcacctgcagccctattggcgcgaccgatatggcctgacgcctgacatgtacccccattcccaggccgcattcgaaggcatggccagcctgccgatctactcgcgcatgaccgatgccgatgtacagcgcgtcatcgcatcggtacggcaactgctgcacccatga

SEQ ID NO: 43480 - protein, 395 aa, Bordetella bronchiseptica
MSDFLPFALPDIGEAEIQAVTESMRSGWLTTGPNAREFEREFAAYMGADVEAVAVNSATAGLHLALEAIGVGPGDEVITTTHTFTASAEVARYLGAEPVLVDIDPATLCISPAAIERAITPRTRAIVPVHYGGLSCDMDSILEIARKHGLKVIEDAAHALPASWQGRRIGSLESDLTVYSFYATKTLATGEGGMVVTRDPALAKRCRVMRLHGIDRDAFDRFTSKKPAWYYEIVAPGFKYNMTDTAAAMGRVQLQRVQQMRDRRAQIAAAYDQAFADLPLTLPPSPGRTPGVERAAHRDDDEHSWHLYAIRIHPQAPLKRDDFIVRMTENGIGCSVHYVPLHLQPYWRDRYGLTPDMYPHSQAAFEGMASLPIYSRMTDADVQRVIASVRQLLHP

SEQ ID NO: 43481 - DNA, 1101 bp, Bordetella bronchiseptica
  CDS (1)..(1101)
atgcaattcattgacctgaaaacccaataccaagcgctgcgcgacaccatcaacccgcgcatccaggccgtgctggaccacggccagttcatcatgggcccggaagtcaaggaactggaggccgccttgtgcgcctacaccggcgccaagcactgcatcaccgtggcctcgggcaccgaggcgctgctgatctcgctgatggcgctgggcgtgaaggccggcgacgaagtcatcaccacctcgttcaccttcgtggccaccgctgaagtcatcgcgctgctgggcgccaagcccgtgttcgtcgacgtcgaaccggatacctgcaacatcaaggtgtccgagatcgaagcgaagatcaccccgcgcaccaaggccatcatcccggtgtcgctgtacggccaatgcggcgacatggacgaagtcaacgccgtcgcggccaagcacggcctgccggtcatcgaagacgccgcgcagagcttcggcgccacctacaagggccgcaagagctgcaacctgtcgaccatcggctgcaccagcttcttcccgagcaagccgctgggctgctacggcgacggcggcgcgctgttcaccaacgacgacgagctggcgcaagccatgcgcgaaatccgcgtgcacggccaatcgggccgctactaccacacccgcatcggcgtgggcggccgcatggacacgctgcaatgcgccgtggtgctgggcaagctggagcgtttcgattgggaaatcgcccaacgcatcaagatcggcgcgcgctaccagcaactgctggccgatttgcccggcggcgcatgtaccgtaaccgtgcgccccgaccgcgacagcgtctgggcccagttcaccgtcatggtgcccaaccgcgaagccgtcatcgcccagctgaaggaggccggcattcccaccgccgtgcactatccgcgccccatccacgcgcagccggcctatgagcaatacgccgagggcgccggcgccacgccggtttccgacgacctggccgcgcgcgtcatgagcctgccgatgcacccggatctggacgaagccacccaggacaagatcgtcgccgcgttgcgccaggccctgaactga

SEQ ID NO: 43482 - protein, 366 aa, Bordetella bronchiseptica
MQFIDLKTQYQALRDTINPRIQAVLDHGQFIMGPEVKELEAALCAYTGAKHCITVASGTEALLISLMALGVKAGDEVITTSFTFVATAEVIALLGAKPVFVDVEPDTCNIKVSEIEAKITPRTKAIIPVSLYGQCGDMDEVNAVAAKHGLPVIEDAAQSFGATYKGRKSCNLSTIGCTSFFPSKPLGCYGDGGALFTNDDELAQAMREIRVHGQSGRYYHTRIGVGGRMDTLQCAVVLGKLERFDWEIAQRIKIGARYQQLLADLPGGACTVTVRPDRDSVWAQFTVMVPNREAVIAQLKEAGIPTAVHYPRPIHAQPAYEQYAEGAGATPVSDDLAARVMSLPMHPDLDEATQDKIVAALRQALN

SEQ ID NO: 43483 - DNA, 1137 bp, Streptomyces griseus
  CDS (1)..(1137)
ttgagctctttccaggaattgccgcggtggccccagctgacggacgacgacatcgaggcggcggtggcggcgctgcgctccaaccgcctggtggggcaggggaacagcacggtcgaggagttcgaggcggcgctggcggccggccagggagtcgagcacgcggtcgcggtgtccaccggcacggcggccgtgcacctggcgctgcacgccctcgacgtcggcccgggcgacgaggtcatcgtgcccacccacaccttcatcggctccgccagcccggtgacgtacctcggcgcccgcccggttttcgccgacgtcacgccggacacccactgcctggacccggactcggtgaagtccctgatcggggagcgcaccaaagccatcgtcgtggtccacatcaacggcatagccgccgacatggccgctctgaccgctgtggccgccgaggcgggcgtgccggtcatcgaggacgccgcgcaggcgctcggcaccgagatcggcggccggcccatcggcggcttcggggatctcgcctgcgtcagcctcttcgaacagaaggtgatcacctcgggcggcgagggaggcgccgtgctcaccgacaacccggtctacgcggagcgagtgcgccggctgcggagccacggtgaggggcccgtctccggcagcccggggatgatctgggcgcacgaggtcggctacaactaccgcctcacgtccgtccaggcggccgtcggcctcgcccagcacaagcgcctcggcgacctggtcgaagcccgccgtcgcaacgcggcgtacctctccgagcggctggccggcgtcgagggcttggagctgccggtggagccgcccggcaccactcacgcgtactggaagtacgcggtgcgcgtggttccgggggacggacgccgcagcgctgcggacatcgcggcccacctgcgctcgcggggcgtcccggtgctgctgcgctacccgtacccgctgcacaagcagcccgcgttcgccgagtaccacggggtgtccctgccggtcgccgagcggctgtcgcaggaactgctggccctgccctcgcacccgggactggtggagggccacctggaccacgtcgccgaagaggtccgcaaggccgtcgcgagctga

SEQ ID NO: 43484 - protein, 378 aa, Streptomyces griseus
MSSFQELPRWPQLTDDDIEAAVAALRSNRLVGQGNSTVEEFEAALAAGQGVEHAVAVSTGTAAVHLALHALDVGPGDEVIVPTHTFIGSASPVTYLGARPVFADVTPDTHCLDPDSVKSLIGERTKAIVVVHINGIAADMAALTAVAAEAGVPVIEDAAQALGTEIGGRPIGGFGDLACVSLFEQKVITSGGEGGAVLTDNPVYAERVRRLRSHGEGPVSGSPGMIWAHEVGYNYRLTSVQAAVGLAQHKRLGDLVEARRRNAAYLSERLAGVEGLELPVEPPGTTHAYWKYAVRVVPGDGRRSAADIAAHLRSRGVPVLLRYPYPLHKQPAFAEYHGVSLPVAERLSQELLALPSHPGLVEGHLDHVAEEVRKAVAS

SEQ ID NO: 43485 - DNA, 1233 bp, Streptomyces griseus
  CDS (1)..(1233)
gtgccgggaccgggataccgcttcttcggtgacgaggagcgcgccaacgtcatggccgtgctcgaccgctgggccgagagccgcgaggcgttcgacgaccccggcgagggggagtgggtgcgccgcttcgagcaggccgcggccgaccgcttcggcgccgcccactgcctcggcgtcaacagcgggacgtcggccctggtcgcggcgctcgtgggcctcggcataggacccggtgacgaggtcatcgtgcccggatacatgttcgtcgcctccatcgcggcggtcctgcactgcggggcggacgtggtcctcgcggaggtcgacgactccctcaccctggacccggccgacgtacgggccaggatcaccccccggacccgggcggtcatgcccgtgcacatgctgggcgcgcccgccgacatgaccgcgctgcgcgccgtcgccgacgagcacgggctccatctgctggaggactgcgcgcagagcgccggcggcagctaccggggccggcccctgggcaccctgggcagcgcggggaccttctccctcaaccactacaagatgatcacctcgctgcagggcgggttcgtgctcatggacgacccgctggtcttccagcgggcctactccttccacgaccagggctggttcccctaccgccaggaccggggcgagggcgacccgctgctcggcatgaacctggggctcggcgaactgaacgccgccgtggcgctcgcgcagctcggcaagctcgacctgatcctcgaccgcatccgcggcgtcaaacaccggctggtcgcagcgatcggcgaactgcccggcgtgcgccgcaggaccctgcacgacgccgagggggagtgcggcacggtcgcggtgtacgtcttcgaggacgccgcccacgccctcgacgtcgcccgccggctcgggacacgcgtactcctggactcgccgacgcactactacggggggcttccggcactggccgcgttcggccggggcgaccgctccacggtgccgttccgggcccccggcggccgtccctccgcttccttcgaacccggaacgctgcctcgcaccgacgatgtcctcggccgttccatcgccctcgccaccggggtgtccgacgactacctcggccccgggttcggcgtgcacgccgactcctccgccgccgagatcgaccgcgcggccgacgccttccgccgggcggtcaagggcgaggcggtgtcctga

SEQ ID NO: 43486 - protein, 410 aa, Streptomyces griseus
MPGPGYRFFGDEERANVMAVLDRWAESREAFDDPGEGEWVRRFEQAAADRFGAAHCLGVNSGTSALVAALVGLGIGPGDEVIVPGYMFVASIAAVLHCGADVVLAEVDDSLTLDPADVRARITPRTRAVMPVHMLGAPADMTALRAVADEHGLHLLEDCAQSAGGSYRGRPLGTLGSAGTFSLNHYKMITSLQGGFVLMDDPLVFQRAYSFHDQGWFPYRQDRGEGDPLLGMNLGLGELNAAVALAQLGKLDLILDRIRGVKHRLVAAIGELPGVRRRTLHDAEGECGTVAVYVFEDAAHALDVARRLGTRVLLDSPTHYYGGLPALAAFGRGDRSTVPFRAPGGRPSASFEPGTLPRTDDVLGRSIALATGVSDDYLGPGFGVHADSSAAEIDRAADAFRRAVKGEAVS

SEQ ID NO: 43487 - DNA, 1275 bp, Streptomyces griseus
  CDS (1)..(1275)
atggatagttcactggcaatctctggtgggccacgtctgtccaaccgcgagtggccacgttggccacagccgggtgaccgcgcgctgaaaagcctcgaagacgtcctgacaagcgggcgttggaccattagctgcgcctatcagggccgggattcgtatgagcgtcaattcgcgtccgcattcgcggactactgcggctcggcgatgtgcgtgccgatatcgacgggaaccgcttcgctggccatcgccctggaggcctgcggggtcggcgccggcgacgaggtgatcgtccccggactgagctgggtggcctccgcctcggccgttctcggcatcaacgccgtccccgtgctggtggacgtcgacccggccacgtactgcctggacccggcggccaccgaggcggcgatcacggagcggacccgggccatcaccgtggtgcacgcctactcggccgtcgcggacctggacgcgctcctggacatcgcccggcggcacggcctgccgctgatcgaggactgcgcacacgcgcacggcgccgggttccgcggccgtccggtgggggcgcacggtgccgcgggagtcttcagcatgcagggcagcaagctgctgacctgcggcgagggcggtgcgctggtgaccgacgacgcggacgtcgcgctccgtgcggagcacctgcgcgcggacggacgggtggtgcggcgcgagccggtgggcgtgggcgagatggagctggaggagaccggccggatgatgggcagcaacgcctgcctgtcggagttccacgcggcggtactgctggaccagctcgaactgctcgacgggcagaacgcccgccggacccgggcggccgaccacctcaccgaccggttgagcgagctggggatgacggcccaggcgacggccccggggacgaccgcccgcgcctactaccgctatctggtgaggctgcccgacgaagtgctggccgtggcgccggtggaacggttcgcgcacgcgctcacggccgaactgggcttcgcggtgacccagacccaccgtccgctgaacgacaacccgctgaaccgcccctcgtcgcgcaggcggttcgccaccgacgcccgctacctggagcgggtggacccgtcccggttcgaccttccggccgccaagcgcgcccacgagagcgttgtgagcttcagccacgaagtgctcctggctccgctcgacgccatcgacgacatcgcccgggcgttccggaaggtcctggacaacgtccgggaggtttcccgctga

SEQ ID NO: 43488 - protein, 424 aa, Streptomyces griseus
MDSSLAISGGPRLSNREWPRWPQPGDRALKSLEDVLTSGRWTISCAYQGRDSYERQFASAFADYCGSAMCVPISTGTASLAIALEACGVGAGDEVIVPGLSWVASASAVLGINAVPVLVDVDPATYCLDPAATEAAITERTRAITVVHAYSAVADLDALLDIARRHGLPLIEDCAHAHGAGFRGRPVGAHGAAGVFSMQGSKLLTCGEGGALVTDDADVALRAEHLRADGRVVRREPVGVGEMELEETGRMMGSNACLSEFHAAVLLDQLELLDGQNARRTRAADHLTDRLSELGMTAQATAPGTTARAYYRYLVRLPDEVLAVAPVERFAHALTAELGFAVTQTHRPLNDNPLNRPSSRRRFATDARYLERVDPSRFDLPAAKRAHESVVSFSHEVLLAPLDAIDDIARAFRKVLDNVREVSR

SEQ ID NO: 43489 - DNA, 1104 bp, Vibrio cholerae
  CDS (1)..(1104)
atgattcctgtatacgaaccaagtttggatggaaatgagcgtaaatatctaaacgattgcattgattccggttgggtatcctcaagggggaaatatattgatcgcttcgaaactgagtttgcggagtttttaaaagtaaagcacgccacaacagtatctaatggaacagttgcgctacatttggcaatgagcgcgttgggaataactcaaggcgatgaagtgattgtaccaacattcacttatgttgcctcggttaataccatagtccagtgtggtgcgttacccgtttttgctgaaatcgaaggtgagtctctacaagtgagcgtagaggacgttaaacgtaaaataaataaaaagacaaaagcagttatggccgttcacatatatggacaagcttgcgatattcaatctttaagagatctgtgtgatgagcacggcctctatttaattgaagactgtgcagaagcaataggtactgctgttaatggcaaaaaagtaggtacatttggcgatgtgtcaacgtttagtttctttggaaataaaaccatcacatcgggcgagggtggtatggttgtgtcaaactcagacataattatagataaatgtttacgcttaaaaaaccaaggggtagtggcagggaagcgctactggcatgacctagttgcgtataactatagaatgacgaatctatgtgctgcgattggtgttgctcagcttgaaagagttgataaaattataaaggccaagcgtgatatagctgaaatttataggtctgaactcgctggactaccaatgcaagtgcacaaagagtctaatggaactttccactcatattggttgacgtctattatattagaccaagagtttgaagtgcaccgcgatgggttgatgaccttcttagaaaataatgacatcgagtctagaccatttttctatcctgctcacacgctgccaatgtacgagcatttggcagaaaagacagcttttccgttatcaaatagctactctcatcgaggtattaatttacccagttggccagggttatgcgatgatcaagtaaaagaaatttgcaactgtattaaaaattatttcaactgtatttga

SEQ ID NO: 43490 - protein, 367 aa, Vibrio cholerae
MIPVYEPSLDGNERKYLNDCIDSGWVSSRGKYIDRFETEFAEFLKVKHATTVSNGTVALHLAMSALGITQGDEVIVPTFTYVASVNTIVQCGALPVFAEIEGESLQVSVEDVKRKINKKTKAVMAVHIYGQACDIQSLRDLCDEHGLYLIEDCAEAIGTAVNGKKVGTFGDVSTFSFFGNKTITSGEGGMVVSNSDIIIDKCLRLKNQGVVAGKRYWHDLVAYNYRMTNLCAAIGVAQLERVDKIIKAKRDIAEIYRSELAGLPMQVHKESNGTFHSYWLTSIILDQEFEVHRDGLMTFLENNDIESRPFFYPAHTLPMYEHLAEKTAFPLSNSYSHRGINLPSWPGLCDDQVKEICNCIKNYFNCI

SEQ ID NO: 43491 - DNA, 1167 bp, Amycolatopsis mediterranei
  CDS (1)..(1167)
atgaacgcgcgaaaggcaccggaattccctgcgtggccgcagtacgacgacgccgagcggaacggcttggtccgcgcgctcgaacagggtcagtggtggcgcatgggcggggacgaggtgaactccttcgagcgcgagttcgccgcccaccacggcgccgcgcacggcctggcggtcaccaacggcacgcacgcgctggaactcgccctgcaggtcatgggcgtcggcccgggcaccgaggtcatcgtgccggccttcaccttcatctcctcgtcccaggcggcccagcggctcggcgcggtcaccgtcccggtcgacgtcgacgcggccacctacaacctcgacccggaggccgtcgcggccgccgtcaccccgcgcaccaaggtgatcatgccggtgcacatggccgggctgatggccgacatggacgcgctggcgaagatctccgccgacacgggcgtcccgctgctgcaggacgccgcgcacgcgcacggcgcccgctggcagggcaagcgcgtcggcgagctggacagcatcgccacgttcagcttccagaacggcaagctgatgacggcgggcgagggcggcgcggtcgtcttccccgacggcgagaccgaaaagtacgagaccgccttcctccggcacagctgcggccgtccccgcgacgaccgccgctacttccacaagatcgccggctcgaacatgcggctcaacgagttctccgcgtccgtgctgcgcgcgcagctggcccgcctcgacgagcagatcgccgtgcgcgacgagccgtggaccctgctgtcccggctgctcggcgcgatcgacggcgtcgtgccccagggcggcgacgtgcgcgccgaccgcaactcccactacatggccatgttccgcatccccgggctcaccgaggaacggcgcaacgccctggtcgaccggctcgtcgaggccggcctgcccgccttcgccgcgttccgcgcgatctaccgcaccgacgccttctgggagctcggcgcccccgacgagagcgtggacgcgatcgcccggcgctgcccgaacacggacgcgatcagcagcgactgcgtctggctgcaccaccgggtcctgctggccggcgagccggagctgcacgcgaccgccgaaatcatcgccgacgccgtgggccgggcatga

SEQ ID NO: 43492 - protein, 388 aa, Amycolatopsis mediterranei
MNARKAPEFPAWPQYDDAERNGLVRALEQGQWWRMGGDEVNSFEREFAAHHGAAHGLAVTNGTHALELALQVMGVGPGTEVIVPAFTFISSSQAAQRLGAVTVPVDVDAATYNLDPEAVAAAVTPRTKVIMPVHMAGLMADMDALAKISADTGVPLLQDAAHAHGARWQGKRVGELDSIATFSFQNGKLMTAGEGGAVVFPDGETEKYETAFLRHSCGRPRDDRRYFHKIAGSNMRLNEFSASVLRAQLARLDEQIAVRDEPWTLLSRLLGAIDGVVPQGGDVRADRNSHYMAMFRIPGLTEERRNALVDRLVEAGLPAFAAFRAIYRTDAFWELGAPDESVDAIARRCPNTDAISSDCVWLHHRVLLAGEPELHATAEIIADAVGRA

SEQ ID NO: 43493 - DNA, 1167 bp, Actinosynnema pretiosum
  CDS (1)..(1167)
atgggcagttctccggacgcaggaatcgacttcccggcctggccgcagcacgacgacgccgagcgcgcggccctgctgcgcgcgctggaccagggccagtggtggcgggtcggcggcagcgaggtcgacgagttcgagcgcgagttcgccgagtaccacggcgcgggccacgcgctcgccgtcaccaacggcacgcacgcgctggagctggccctccaggtgctcgacgtgggccccggcacggaggtgatcgtgcccgccttcacgttcatctcgtcctcgcaggccgtgcagcgcctcggcgcggtcgccgtgcccgtggacgtcgaccccgacacctactgcctggacgtcgccgccgccgaggacgccgtcacctcccgcacctcggcgatcatgcccgtgcacatggcgggccagttcgccgacatggaccggctcgacaagctgtccgcgagcaccggcgtgccggtcgtgcaggacgccgcccacgcgcacggcgcccactggcgcggcaagcgggtcggcgagctcgggtcgatcgccacgttcagcttccagaacggcaagctgatgacggcgggcgagggcggggccgtcctgttcgccgaccaggcccagtgggagaaggcgttcgtcctgcacagctgcggcaggcccaagggcgaccgcggctacttccacctcacctcgggctcgaacttccggatgaacgagttctccgccgccgtgctgcgcgcccagctcggcaggctggactcgcagatcgcgaccaggcaggcccgctggccggtgctgtccgcgctgctggcggggatcgacggcgtcgtgccgcagaccgtcgacccgcgcagcgaccgcaacccgagctacatggcgatgttccggatgcccggcgtcaccgaggagcggcgcaacgcggtggtggacgagctggtgcggcgcgggatcccggccttcatggcgttccgggcggtctaccgcacccaggcgttctgggagaccggcgcgcccgacctgacccccgaggagctggccgcgcggtgcccggtgtcggaggagatcacccgcgactgcgtgtggctgcaccaccgggtgctgctgggcgccgaggagcaggtgcgccggctggccgcggtcgtggccgacgtggtcgcgggcgcgtga

SEQ ID NO: 43494 - protein, 388 aa, Actinosynnema pretiosum
MGSSPDAGIDFPAWPQHDDAERAALLRALDQGQWWRVGGSEVDEFEREFAEYHGAGHALAVTNGTHALELALQVLDVGPGTEVIVPAFTFISSSQAVQRLGAVAVPVDVDPDTYCLDVAAAEDAVTSRTSAIMPVHMAGQFADMDRLDKLSASTGVPVVQDAAHAHGAHWRGKRVGELGSIATFSFQNGKLMTAGEGGAVLFADQAQWEKAFVLHSCGRPKGDRGYFHLTSGSNFRMNEFSAAVLRAQLGRLDSQIATRQARWPVLSALLAGIDGVVPQTVDPRSDRNPSYMAMFRMPGVTEERRNAVVDELVRRGIPAFMAFRAVYRTQAFWETGAPDLTPEELAARCPVSEEITRDCVWLHHRVLLGAEEQVRRLAAVVADVVAGA

SEQ ID NO: 43495 - DNA, 1188 bp, Bordetella pertussis
  CDS (1)..(1188)
atgagcgacttcctgccctttgccctgcccgatatcggcgaggccgaaatccaagcggtcaccgaatccatgcgttcgggctggctgaccaccggccccaacgcccgcgagttcgaacgcgaattcgcggcctacatcggcgccgacgtggaggccgtggccgtcaattcggccaccgccggcctgcacctggccctggaagccataggggtcggcccgggcgacgaagtcatcaccaccacccacacattcaccgccagcgccgaagtcgcccgctacctgggcgccgaaccggtcctggtcgatatcgacccggccacgctgtgcatctcgcccgccgccatcgaacgcgccatcacgccgcgcacccgcgcaatcgtgccggtgcactacggcggcctgtcctgcgacatggacagcatcctggagatcgcccgcaagcacggcctgaaagtcatcgaggacgccgcccacgcgctgcccgcctcctggcaaggccggcgtatcggcagcctggaaagcgacctgaccgtctacagcttttacgccaccaagacgctggccaccggcgaagggggcatggtggtcacgcgcgaccccgccctcgccaagcgctgccgtgtcatgcggctgcatggcatcgaccgcgacgccttcgatcgcttcacctcgaagaagccggcgtggtactacgaaatcgtcgcccccggcttcaagtacaacatgaccgacacggccgccgcgatgggccgcgtccagttgcagcgcgtgcagcaaatgcgcgaccggcgcgcacagatcgccgcggcctatgaccaggccttcgccgatctgccgctgacactgccccccggccctggccgcacgccgggcgtcgaacgcgtggcccaccgcgatgacgacgagcattcctggcacctgtacgccatccgcatccatccgcaggcgccgctcaagtgcgacgacttcatcgtgcgcatgaccgagaacggcatcggctgcagcgtgcactacgtgccgttgcacctgcagccctattggcgcgaccgatatggcctgacgcctgacatgtacccccattcccaggccgcattcgaaggcatggccagcctgccgatctactcgcgcatgaccgatgccgatgtacagcgcgtcatcgcatcggtacggcaactgctgcgcccatga

SEQ ID NO: 43496 - protein, 395 aa, Bordetella pertussis
MSDFLPFALPDIGEAEIQAVTESMRSGWLTTGPNAREFEREFAAYIGADVEAVAVNSATAGLHLALEAIGVGPGDEVITTTHTFTASAEVARYLGAEPVLVDIDPATLCISPAAIERAITPRTRAIVPVHYGGLSCDMDSILEIARKHGLKVIEDAAHALPASWQGRRIGSLESDLTVYSFYATKTLATGEGGMVVTRDPALAKRCRVMRLHGIDRDAFDRFTSKKPAWYYEIVAPGFKYNMTDTAAAMGRVQLQRVQQMRDRRAQIAAAYDQAFADLPLTLPPGPGRTPGVERVAHRDDDEHSWHLYAIRIHPQAPLKCDDFIVRMTENGIGCSVHYVPLHLQPYWRDRYGLTPDMYPHSQAAFEGMASLPIYSRMTDADVQRVIASVRQLLRP

SEQ ID NO: 43497 - DNA, 1161 bp, Caulobacter crescentus
  CDS (1)..(1161)
gtgacgggcggctttctcccctacggccggcagacgatcgaggaggacgatatcgccgccgtggcggaggccctgcgtggcgatttcctgaccaccggtccgacggtcgaggccttcgagaccgccttcgccgccaaggtcggcgccgatcacgcgatcgccgtttccaacggtacggcgaccctgcatctggcgatgatggcgctgggcataggagagggggatgtctgcgtcgccccgtccgtcacctttctggccaccgccaattgcgcccggtatgtgggcgccgaggtcgtcttcgccgacgtcgatcccgacagtggcctgatgacgcccgacacgctggctcgggccctggccggcgcgcgcgacaagcgcgtcaaggcggtgctgccggtgcacctgcgtggcgacgtctgcgatctgcccgcgctcaaggccatggccagcgcctcgggcgcggtgctcgtcgaggacgccccgcacgccctgggctcgatcgccaccttcgacggtgtcgcccacccggtcggcgacggcgcctattccagcttcgccagcttctcgtttcacccggtcaagacgctcgccacgggtgagggcggcatgctgaccaccaacgatcccgccctggccgccaaggcgcgcttgctgcgctcacatggcatggtgcgccagccgggcggcgacccgtggtggtacgagatgccggagctgggcttcaactaccgcatccccgacgtgctctgcgcgctgggcctgtcgcagcttgcgaaactggaccggttcgttgcgcgacgtcgcgacctgacggcgctttatgcgcgcctgctggcggagcgcgcgccgcgcgcgcggctggcgaccagccccgaccattcggacgccgcgctgcacctgttgaccgtgctgatcgatttcgaggccgagggaatctcgcggcgcaccgttgtcgagagcctcaagacccagggcgtcgggacccaggtccactacattccggtccatcgccagccctactacgcccaacgctatggcgtcgcggacctgcccggcgcggacgcctggtacgcgcgctgcctgacgctgccgctctatccggccatgaccaacggcgacgtcgagcgcgtggtgggcgccctggccacagttctcggttaa

SEQ ID NO: 43498 - protein, 386 aa, Caulobacter crescentus
MTGGFLPYGRQTIEEDDIAAVAEALRGDFLTTGPTVEAFETAFAAKVGADHAIAVSNGTATLHLAMMALGIGEGDVCVAPSVTFLATANCARYVGAEVVFADVDPDSGLMTPDTLARALAGARDKRVKAVLPVHLRGDVCDLPALKAMASASGAVLVEDAPHALGSIATFDGVAHPVGDGAYSSFASFSFHPVKTLATGEGGMLTTNDPALAAKARLLRSHGMVRQPGGDPWWYEMPELGFNYRIPDVLCALGLSQLAKLDRFVARRRDLTALYARLLAERAPRARLATSPDHSDAALHLLTVLIDFEAEGISRRTVVESLKTQGVGTQVHYIPVHRQPYYAQRYGVADLPGADAWYARCLTLPLYPAMTNGDVERVVGALATVLG

SEQ ID NO: 43499 - DNA, 1161 bp, Streptomyces collinus
  CDS (1)..(1161)
atgagcagtggtgtgcaactgggctcggccttccgggtgtggccgcagtacgacgacgcggagcggaccggcctgatccgtgcactggagcagggccagtggtggcgcatgggcggcggagaggtcgagcggttcgagcgggagttcgccgagtaccacggcggcgagcacgcgctggcggtcacgaacggtacgcacgccctcgaactggccctggaggtcatgggtgtcggccccggcaccgaggtgatcgtgccggccttcaccttcatctcctcgtcccaggccgctcagcgtctcggggcggtcgtggtgccggtggacgtggacccggaaacgtactgcatcgatccggccgaggccgcgaaggccatcaccccgaggacccgcgccatcatgccggtacacatggccggccagctcgccgacatggacgccctcgagaaggtggcggccgactccggcgtgccgctgatccaggacgccgcacacgcgcagggtgccacctggaacggccggcggctcggtgagctgggctcggtcgccgcgttctccttccagaacggcaagctgatgacggccggcgagggcggagcggtactgttcccgaccgccgagatggcggagcacgccttcctacggcacagctgcggacgcccgcggaacgaccgcggctacttccaccgcacgtcgggctccaacttccggctcaacgagttctccgcctcggtgctgcgcgcccagctcgcgcgcctggacgggcagatccggacgcgcgaggagcgctggccgctgctgtcctcgctgctcgccgagatccccggcgtggtgcctcagcgactggaccgccggcccgaccgcaacccgcactacatggccatgttccgggtgccccgcatcaccgaggaacggcgcgcgcgggtcgtcgacaccctcgtcgagcgcggtgtccccgcgttcgtcgcgttccgctcggtctaccgcacggacgccttctgggagatgggcgccccggacctgtcggtggacgaactggcccggctgcccccactccgaggcctgacgaccgactgcctgtggctgcaccaccggacgctgctcggcaccgaggagcagatgcacgaggtcgccgccgtcatagccgatgtcctcggctcatga

SEQ ID NO: 43500 - protein, 386 aa, Streptomyces collinus
MSSGVQLGSAFRVWPQYDDAERTGLIRALEQGQWWRMGGGEVERFEREFAEYHGGEHALAVTNGTHALELALEVMGVGPGTEVIVPAFTFISSSQAAQRLGAVVVPVDVDPETYCIDPAEAAKAITPRTRAIMPVHMAGQLADMDALEKVAADSGVPLIQDAAHAQGATWNGRRLGELGSVAAFSFQNGKLMTAGEGGAVLFPTAEMAEHAFLRHSCGRPRNDRGYFHRTSGSNFRLNEFSASVLRAQLARLDGQIRTREERWPLLSSLLAEIPGVVPQRLDRRPDRNPHYMAMFRVPRITEERRARVVDTLVERGVPAFVAFRSVYRTDAFWEMGAPDLSVDELARLPPLRGLTTDCLWLHHRTLLGTEEQMHEVAAVIADVLGS

SEQ ID NO: 43501 - DNA, 1167 bp, Streptomyces fradiae
  CDS (1)..(1167)
gtgacagggctgccgcggcccgccgtccgggtgccgttccacgatctgcgggacgtgcacgcggccacgggggtggagtcggagatcggcggcgcgctgctgcgcgtcgccgcgcgcgggcgctatctgctgggtgccgaactcgccgcgttcgaggagcggttcgccgagtactgcggcaacgcccactgtgtcgccgtgggcagcgggctcgacgacgctcgtctggcgctgtgggcgctcggggtgggcgagggcgacgaggtgatcgtgccctcgcacacgttcatcgcgtcctggctcgcggtgtcggcgacgggtgccaccccggtgccggtcgagcccggtgatcccggcgagccggggcccggggcgttcctgctcgacccggaccggctggaggccgcgctgaccccgcggaccagggccgtgatgcccgtgcatctctacgggcacccggtggatctggacccggtcggggcgttcgcggagccgcacgggctggccgtcgtggaggacgcggcgcaggccacggcccgttaccgcgggaggcggatcggcagcggccaccgcacggcgttcagcttctacccggggaagaacctgggcgcgctcggcgacggcggtgccgtggtcacctcggacccggaactcgcggaccggctgcggctgttgcgcaactacggcgcccgggagaagtaccggcacgaggagcggggcaccaactcccgcctggacgagctgcaggcggccgtgctgtcggtcaagctgccgtacctggacgcctggaacacccgccgccgggagatcgccgcccgctacggcgaggcgctggccggtctgccgggcgtcaccgtgccggagggccgcgtggcggagccggtctggcatcagtacgtgctgcgcagcccgtaccgcgaccggttgcggcggcggctggccgaggcgggggtggagaccctggtccactatccggtggccgtgcacgcgtcgggcgcgtacgcgggcgcggggccgtgtcccgccggcgggctgccgcgcgcggagcgtctggccggtgaggtgctgagcctgcccatcggtcctcatctgccggacgaggcagtcgaagtggtgatcgcggccgtgcagtccgccgcgctggactcctgggaggaaggcccgtga

SEQ ID NO: 43502 - protein, 388 aa, Streptomyces fradiae
MTGLPRPAVRVPFHDLRDVHAATGVESEIGGALLRVAARGRYLLGAELAAFEERFAEYCGNAHCVAVGSGLDDARLALWALGVGEGDEVIVPSHTFIASWLAVSATGATPVPVEPGDPGEPGPGAFLLDPDRLEAALTPRTRAVMPVHLYGHPVDLDPVGAFAEPHGLAVVEDAAQATARYRGRRIGSGHRTAFSFYPGKNLGALGDGGAVVTSDPELADRLRLLRNYGAREKYRHEERGTNSRLDELQAAVLSVKLPYLDAWNTRRREIAARYGEALAGLPGVTVPEGRVAEPVWHQYVLRSPYRDRLRRRLAEAGVETLVHYPVAVHASGAYAGAGPCPAGGLPRAERLAGEVLSLPIGPHLPDEAVEVVIAAVQSAALDSWEEGP

SEQ ID NO: 43503 - DNA, 1149 bp, Streptomyces lincolnensis
  CDS (1)..(1149)
gtgagcgactacatccccttcgccgcgccctgcttcgacaccgccgaggaggaggccgtactgcgcgtcgtgcgcagcggctgggtctccaccggcgccgaggcgcaatccttcgaggaggagttcgcggcgtacatcggcgtcgcccacgccgtggccctcacctcctgcaccgccgcgctgcacgtggcgctcaaggcgtacggcatcggccccggcgacgaggtgatcgtgcccaccatgaccttcgtggccacggccaccagcgtggtccacgccggggcggcgcccgtgctcgcggacgtcggtcccgagcacctcaccttcgaccccgaccaggtcaagtccctgatcaccgaacgcaccaaggcggtcgtgcccgtgcacctgttcggccgcatggccgccatggaacccctgcgcgagctgtgcgacagccacggcctgacgctgctcgaagacgccgcgcacaccctgcccgcacgcgacggggacgcggtcgcgggccgggccggcgacgcgtcggcgttctccttcttcgccacgaagccgatcaccacggccgagggcggaatgctgtgcaccgacgacgcgcgcgtcgccgacgaggcccgccggtggagcctgcacggcctcagccgcggcgccgtcaaccgctaccggccgggtcacagcgccgcgtacgacgtggaccgccccggccacaaatacaacatgtccgacctggccgccgccctgggccgggctcagctcgccaaggccggccggctgcacgcgcggcgcaccgccatcgcggaggtctatctgcgcgaactcgcagggctcgaccgcctggagctgcccgcggcggacaccgccaccaaccgcagctcctggtacctgttcccggtgcgggtgcacgggcaccggcgcgacgcgttccggcagcggctgcacgccctcggggtcggcaccagcgtccacttcgagccgctgcaccgcttcacctggctgcgggaccacgtcgtccgcacgggccagggcttcccggtcgccgacgccgccgcggacacgctcgtctcgctgcccgtcttccccgccatggacgacgccgcggtgtcccgggtcgtggccgccgtccgccgggcccacgacgaggcgggacggtga

SEQ ID NO: 43504 - protein, 382 aa, Streptomyces lincolnensis
MSDYIPFAAPCFDTAEEEAVLRVVRSGWVSTGAEAQSFEEEFAAYIGVAHAVALTSCTAALHVALKAYGIGPGDEVIVPTMTFVATATSVVHAGAAPVLADVGPEHLTFDPDQVKSLITERTKAVVPVHLFGRMAAMEPLRELCDSHGLTLLEDAAHTLPARDGDAVAGRAGDASAFSFFATKPITTAEGGMLCTDDARVADEARRWSLHGLSRGAVNRYRPGHSAAYDVDRPGHKYNMSDLAAALGRAQLAKAGRLHARRTAIAEVYLRELAGLDRLELPAADTATNRSSWYLFPVRVHGHRRDAFRQRLHALGVGTSVHFEPLHRFTWLRDHVVRTGQGFPVADAAADTLVSLPVFPAMDDAAVSRVVAAVRRAHDEAGR

SEQ ID NO: 43505 - DNA, 1314 bp, Yersinia pseudotuberculosis
  CDS (1)..(1314)
atgagtcaagaagaattacgtcaacagattgctgagctggttgctcagtacgctgaaacggctatggcccctaagccatttgaagcaggtaagagtgtcgttccaccttcaggtaaagttattggtaccaaagaactccagttaatggttgaagcttctttagacggttggctaacaacgggccgttttaatgacgcttttgagaaaaaactaggcgagtatttgggcgttccttatgttctgactacaacttctggctcttcagctaacttattggctttgaccgcactgacctcacctaaattaggggtacgggcgttgaagccaggtgacgaagttattactgttgccgcaggttttccaaccacagtaaacccaactattcagaatgggttaattcctgtctttgttgatgttgatattccaacttacaatgtaaatgctagcctgattgaagcggcggttagtgataaaaccaaagctattatgattgcccatacattaggtaatctattcgatctagctgaagttcgccgagtagctgataaatataacctgtggttaattgaagactgctgcgatgcgttgggttccacctacgatggaaaaatggctggtacatttggcgatattggtaccgttagcttctatcccgctcatcatatcaccatgggtgaaggtggggcggtatttacacaatcggcggaactgaagagtatcatcgaatctttccgtgattggggtcgtgattgttattgtgctccaggctgtgacaacacatgtaaaaagcgtttcggccagcaacttggctctttaccattcggttatgatcataaatatacttattcccatttaggctataacctaaaaatcacagatatgcaggctgcctgtggtttggcgcaactagagcccatagaagagtttgttgaaaaacgtaaagctaactttaaataccttaaagacgcactccaatcttgcgctgacttcattgagttaccagaagcgactgaaaattcagatccatcatggtttggtttccctatcactctgaaagaagatagcggagttagccgcattgatctggttaaattccttgatgaagctaaagtgggaactcgcctactatttgccggtaatttaactcgccagccgtatttccatgatgtgaaataccgtgttgttggtgaattgacaaacaccgatagaattatgaatcaaactttctggattggtatttacccaggcctgacacatgatcatttggattatgtcgtgagtaagtttgaagagttctttggtttgaatttttaa

SEQ ID NO: 43506 - protein, 437 aa, Yersinia pseudotuberculosis
MSQEELRQQIAELVAQYAETAMAPKPFEAGKSVVPPSGKVIGTKELQLMVEASLDGWLTTGRFNDAFEKKLGEYLGVPYVLTTTSGSSANLLALTALTSPKLGVRALKPGDEVITVAAGFPTTVNPTIQNGLIPVFVDVDIPTYNVNASLIEAAVSDKTKAIMIAHTLGNLFDLAEVRRVADKYNLWLIEDCCDALGSTYDGKMAGTFGDIGTVSFYPAHHITMGEGGAVFTQSAELKSIIESFRDWGRDCYCAPGCDNTCKKRFGQQLGSLPFGYDHKYTYSHLGYNLKITDMQAACGLAQLEPIEEFVEKRKANFKYLKDALQSCADFIELPEATENSDPSWFGFPITLKEDSGVSRIDLVKFLDEAKVGTRLLFAGNLTRQPYFHDVKYRVVGELTNTDRIMNQTFWIGIYPGLTHDHLDYVVSKFEEFFGLNF

SEQ ID NO: 43507 - DNA, 1131 bp, Campylobacter jejuni
  CDS (1)..(1131)
atgattacttattctcatcaaaatattgatcaaagcgatatagatgcgcttacaaaagctttaaaagatgaaattttaacagggggtaaaaaggtagatgaatttgaagaagcactttgcgaatacataggtgttaagcacgcttgtgtgttaaattcggctacttctgcccttcatcttgcctatacagcactaggcatcaaagaaaaaatcgttttaaccactcctttaaccttcgctgctacggctaatgcggccttaatagctggagctaaggtagagtttatcgacattaaaaatgatggcaatatagatgagaaaaagctcgaagcaaggcttgtaaaaaatagcaccgatataggagctattagcgtggtggattttggaggaaatagtgttgaaatggatgagatttcaaatcttgctaaaaaatacaatatccctttaatcgatgatgcaagccatgctttaggtagcgagtataagggtaaaaaagtgggttctatggcggatttaagtattttttcttttcatcctgttaagcctattaccacttttgaggggggtgctgtagtaagcaataataaagaattaatctccaaaataaaacttttaagaagccatggtatcgttaaaaaaaggctttgggatagcgatatgatagaacttggctataattaccgcttaagtgatgttgcttgtgctttagggataaaccagcttaaaaaactcgatcacaatcttgaaaaacgagaagaaatcacaagtttttacgataaagaatttgaaaaaaatcattatttttccacgataaaaatcaaagactataaaaaaagctcaaggcatttataccctatcttgctttttcctgaattttattgtcaaaaagaagaactttttgaaagcttgcttcatgcaggaattggcgtacaggtacattataaaccaacttatgagtttagtttttataaaaaactcttaggagaaatcagactccaaaatgcagataatttttacaaagccgagcttagcataccttgtcatcaagaaatgaatctaaaagatgcaaaatttgtaaaagatactttatttagcattcttgaaaaagttaaaaagggatattgtggataa

SEQ ID NO: 43508 - protein, 376 aa, Campylobacter jejuni
MITYSHQNIDQSDIDALTKALKDEILTGGKKVDEFEEALCEYIGVKHACVLNSATSALHLAYTALGIKEKIVLTTPLTFAATANAALIAGAKVEFIDIKNDGNIDEKKLEARLVKNSTDIGAISVVDFGGNSVEMDEISNLAKKYNIPLIDDASHALGSEYKGKKVGSMADLSIFSFHPVKPITTFEGGAVVSNNKELISKIKLLRSHGIVKKRLWDSDMIELGYNYRLSDVACALGINQLKKLDHNLEKREEITSFYDKEFEKNHYFSTIKIKDYKKSSRHLYPILLFPEFYCQKEELFESLLHAGIGVQVHYKPTYEFSFYKKLLGEIRLQNADNFYKAELSIPCHQEMNLKDAKFVKDTLFSILEKVKKGYCG

SEQ ID NO: 43509 - DNA, 1218 bp, Streptomyces bikiniensis
  CDS (1)..(1218)
atgaccatgaaacgcaatctcggtgatctcgccgtgttcggcggcccgtcggcgttcctgcaaccacttcacgtggggcggcccaacgtgggcgaccgagcgcggttcctggaccgtgtgaactgggcgctggaccaccagtggctgaccaacggcgggccgctggcccgggagttcgagcagcgcgtggcggaactcgccggcgtgcgctactgcgtgtcgacctgcaacgcgaccgtcgccctccagttgctggcccgcgccgccgatctgtcgggcgaggtcatcatgccgtcgctgaccttcccggcgaccgcccaggcgttccgctggctgggtctgaccccggtcttcgtcgacatcgacccggccaccaactgcctggacccggatctgatcgaggcggcgatcaccccccgtacgagtgcggtcgtgccggtccatctgtggggtcggccctgcgcggtcgaccggctggcgaaggtcgcggccgatcacggtctcaggctcttctacgatgccgcgcacggactcggctgcacgtcggaagggcagccgatcggcggcttcggacaagccgaggtgttcagcttccacgccaccaaggtggtcaacgccttcgagggcggcgcggtggtgaccgatgacgagaggctggcccagcgggtccgcgcgatgcacaacttcggattcacccaggggcgggtgtccacggagaccggcaccaacgggaagatgaccgaagccgccgccgcgatgggactcacctcgctcgacgccttcgaggagacggttcgccggaacgaggccaaccacgacgactaccggtcggaactcgccgggctcgccgggctgaaggtcatggagttcgaccgtgccgagcgcaacaactaccactatctggtcgtggaggtcgacgccgcggtgaccggggtccaccgggacctgctggacgaggtgctgagggcggagaacatcatgtgccagcggtacttctcccccggatgccacgagatggagccctaccgctcggagcggccggtctccctgccccacaccgaacggctcgcgcggaaggtcctcgccctgcccaccggccccaccgtctctcgcgaggacatccgtcgggtctgcgacatcgtgcggctcactctggagcggggacacgaggtgacccgacgggccgacgagcgggtgccctccacgacggctccctga

SEQ ID NO: 43510 - protein, 405 aa, Streptomyces bikiniensis
MTMKRNLGDLAVFGGPSAFLQPLHVGRPNVGDRARFLDRVNWALDHQWLTNGGPLAREFEQRVAELAGVRYCVSTCNATVALQLLARAADLSGEVIMPSLTFPATAQAFRWLGLTPVFVDIDPATNCLDPDLIEAAITPRTSAVVPVHLWGRPCAVDRLAKVAADHGLRLFYDAAHGLGCTSEGQPIGGFGQAEVFSFHATKVVNAFEGGAVVTDDERLAQRVRAMHNFGFTQGRVSTETGTNGKMTEAAAAMGLTSLDAFEETVRRNEANHDDYRSELAGLAGLKVMEFDRAERNNYHYLVVEVDAAVTGVHRDLLDEVLRAENIMCQRYFSPGCHEMEPYRSERPVSLPHTERLARKVLALPTGPTVSREDIRRVCDIVRLTLERGHEVTRRADERVPSTTAP

SEQ ID NO: 43511 - DNA, 1095 bp, Salmonella enterica subsp
  CDS (1)..(1095)
atggaatatattccagtatatcaaccagcattatctggtaaagaaaaagaatatgttaatgattgtattgattcgacttggatttcgtcaaaagggagttatatccagcgctttgaaaaaaaattcgccgagcaaaataatatccagtatgctactactgtcagcaatgggacagtggcattgcatttggctttattagcgttaggtatttctgagggggatgaagttattgttcctacactgacatatatagcctctgtaaatgcaattaaatataccggggcgacaccggttttcgttgattcagatcttcaaacttggcaaatatcagtcgatgatattaaaaataaaataacaagtagaacaaaggctataatgtgtgttcacttgtatgggcatccttgtgatatgagtccaattttagaaattgcgaaggttaataatttatttattattgaagattgtgctgaggcttttggatcaaaatataaagataaatttgtaggtacatttggtgatatttcaacctttagcttttttggtaataaaacgataactacaggtgaaggaggaatggttgtaactaacgataaaacattgtacgatagatgtttgcattttaaagggcaagggttagctgcacacaggcaatactggcatgatgtgatcggctataattacagaatgacaaatatttgcgctgctattgggttagctcagttagagcaagcacaattatttattgctagaaaacgtgagatcgcagaaatttataaaaataatctaacccctctcattgaagtccatcaggaaggaaatgatatatttcatacttactggatggtttctatccttgccagaaatgcagaggaaagagaggtattgagatcttttctttcggaaaaattgacagagacacgtccattattttatcctgttcatacaatgcctatgtattcagataagtatcaaaagcatcctgttgccgaaaatttaggctggagaggtattaacttacctagttttcccaccttatctaacgagcaggttatatacatatgtaacgccataaatgaattttataaggataaataa

SEQ ID NO: 43512 - protein, 364 aa, Salmonella enterica subsp
MEYIPVYQPALSGKEKEYVNDCIDSTWISSKGSYIQRFEKKFAEQNNIQYATTVSNGTVALHLALLALGISEGDEVIVPTLTYIASVNAIKYTGATPVFVDSDLQTWQISVDDIKNKITSRTKAIMCVHLYGHPCDMSPILEIAKVNNLFIIEDCAEAFGSKYKDKFVGTFGDISTFSFFGNKTITTGEGGMVVTNDKTLYDRCLHFKGQGLAAHRQYWHDVIGYNYRMTNICAAIGLAQLEQAQLFIARKREIAEIYKNNLTPLIEVHQEGNDIFHTYWMVSILARNAEEREVLRSFLSEKLTETRPLFYPVHTMPMYSDKYQKHPVAENLGWRGINLPSFPTLSNEQVIYICNAINEFYKDK

SEQ ID NO: 43513 - DNA, 1098 bp, Citrobacter freundii
  CDS (1)..(1098)
atgaaatatattccagtgtatgaaccatctctgacaggcaaagaaaaagagtatgttaacgactgtttagattcaacatggatatcttctaaaggaagttatattcagcgttttgaaacagagttttcaaaacatatctccgcacaatatgcaactacagtgagtaatggcaccgtagcaatacatttggcattaatagcattaggtatttctgagggggatgaggtcatcgttccaacattaacgtacattgcttctgttaatgcgataaattatacaggcgcaattccagtttttgttgactcagacgcagaaacatggcaggtgtcaattgaagatatccgaaataaaataacaaacaaaactaaagctatcatgtgtgttcatttatatgggcagccttgtgacatggatgcaattcttgaaattgcaaacgagttcaatctatttgtaatagaagattgtgcagaagcatttggttcaaaatacaaggataaatacgtcggcacttttggtgatatttcgacatttagtttctttggaaataaaactatcacaactggtgaaggtggtatggttgtgactaatgataaaactttatatgagagatgtgttcattataaaggtcaaggattagctgcccatcgtcaatactggcatgatgtgattggttataattatcgaatgactaatatttgtgcggcaatagggctggctcaattagagcaggcagaaggttttattaatcgtaaaagaaatatcgctgaaatatataaaaaggaactgtttaattctcctgttaaagttcatcaggaaagtgacaatacttttcatacatattggatggtgtcgattttgacaagaacagctgaagagcgtgaagagttgaggaattatttatccgaaaattttattgagactcgcccattattttaccctgtacatactatgccaatgtactcagagaaatatcaaaagcatcctgttgcggaggatcttggatggagaggcatgaatttaccaagttatcctggtatgacagatgagcaggtaatttatatctgtaataaaattaagtgtttttataatgagaagtaa

SEQ ID NO: 43514 - protein, 365 aa, Citrobacter freundii
MKYIPVYEPSLTGKEKEYVNDCLDSTWISSKGSYIQRFETEFSKHISAQYATTVSNGTVAIHLALIALGISEGDEVIVPTLTYIASVNAINYTGAIPVFVDSDAETWQVSIEDIRNKITNKTKAIMCVHLYGQPCDMDAILEIANEFNLFVIEDCAEAFGSKYKDKYVGTFGDISTFSFFGNKTITTGEGGMVVTNDKTLYERCVHYKGQGLAAHRQYWHDVIGYNYRMTNICAAIGLAQLEQAEGFINRKRNIAEIYKKELFNSPVKVHQESDNTFHTYWMVSILTRTAEEREELRNYLSENFIETRPLFYPVHTMPMYSEKYQKHPVAEDLGWRGMNLPSYPGMTDEQVIYICNKIKCFYNEK

SEQ ID NO: 43515 - DNA, 1134 bp, Aeromonas hydrophila
  CDS (1)..(1134)
atgatcccgtacggcagacagtcgatcagcgaagcggatatcgaagccgtggtcgaagtattgaggtcagattttctgacccaggggcctgtggtgccccgcttcgagcaggcagtggcggattactgcggagcccgcttcggggtggcggtcaactcaggtacggccgccctgcatatcgcctgtctggctctgggtgtcggcccgggtgactgggtctggacctcccccatcagctttgtcgcctcggccaactgcgctctctattgcggggctcaggtcgacttcgtcgacatcgagcccgataccggcaacatgtgcgccatggagctggagcacaagctgctcgccgccaaggctcaaggatgtctgcccaaggtggtcatcccggtacacttcgcaggcctgccctgcgacatgcaggagatccaccgcctgggacaggagtacggttttcggatcatcgaggatgcctgccacgccctcggcgcccgctatcagggtgaacccaccggcaacggccgctacagcgacatcaccgtcttcagcttccacccggtgaagatcatcaccaccggcgaaggcggcatggcgatgaccaacgaccctgcgctcgccaaaaccatgagcatgttgcgcagccacggcatcacccgggatccggaagactttatcaatgagccggacggcccctggtactacgagcagcagatgctgggcttcaactaccgcatgaccgacatccaggcggcattggggttgagtcaaatggccaatctggaaagctggatcgccaagcgaggcgagattgcccgtcgttactttgaagcattggcccctgagcgtctgccccgttatttcggtgcggagcggcgcagtgcattccacctgtatgtacaccatgtagcacccgaacagcgcagtaacctgttccagcggctacgcgatcatggtatcggggctaacgtgcactatatgccaatctacaagcagccttggtaccaaaaaggccataagtcccccctgccgatggcagaggtttactattccggggccatcaccctcccactttttccacatttagcaatcgcagaacagcaccaggtattcacattgatagctacagacgcataa

SEQ ID NO: 43516 - protein, 377 aa, Aeromonas hydrophila
MIPYGRQSISEADIEAVVEVLRSDFLTQGPVVPRFEQAVADYCGARFGVAVNSGTAALHIACLALGVGPGDWVWTSPISFVASANCALYCGAQVDFVDIEPDTGNMCAMELEHKLLAAKAQGCLPKVVIPVHFAGLPCDMQEIHRLGQEYGFRIIEDACHALGARYQGEPTGNGRYSDITVFSFHPVKIITTGEGGMAMTNDPALAKTMSMLRSHGITRDPEDFINEPDGPWYYEQQMLGFNYRMTDIQAALGLSQMANLESWIAKRGEIARRYFEALAPERLPRYFGAERRSAFHLYVHHVAPEQRSNLFQRLRDHGIGANVHYMPIYKQPWYQKGHKSPLPMAEVYYSGAITLPLFPHLAIAEQHQVFTLIATDA

SEQ ID NO: 43517 - DNA, 1119 bp, Aeromicrobium erythreum
  CDS (1)..(1119)
atgaccatcgacgtcccgttcctcgacctcgacgcggcctacgtggagcttcgtccccagatcgacgccgcggtgagcggggtcctcgcgtccgggcgctacctgctcggcgcccagaccgaggcgttcgaggcggagttcgctgcggcatgctctgccgcgcactgcgtcacggtcggcagcggctgcgacgcgctggagctcagtctgaccgcactgggcgtcggtcctggtgacgaggtcgtcgtccccgcccacaccttcatcgccacctggctcgccgtctcccgctgcggagcccgccccgtgcccgtggagccgtcacccgacggctacctcgtcgacgtcgaggcggtcgaggccgccatcacgccgcggacggccgccatcctcgtcgtgcacctgtatggcgaggtcgccgatctcgccgcgatccgccgggtcgccgaccgtcacggtctcgctctcgtcgaggacgcggctcagagcacgggtgcccgcggacgagacggcgccgtcgtcggatccgggtccaccgcggctgccttcagcttctatccgggcaagaacctgggcgctctcggtgacggcggggccgtcgtcaccgccgacgacgacctggctcgacgggtccgcctcctgcgcaactacgggtccgtggccaagtacgtgcacgaggtccgaggcacgaacagtcgcctggacgagatccaggcggccgtcctgcgcgcgaagctgccgctgctggacgcatggaacgctcgccgcgcgaccatcgccgcgctctacctcgaccggctcgaggaggcatctggtgtccgcctccccccgcacggaccagggccggtctgcctggcacctcttcgtcgtccggctggccacgaccgggagacgctgcagcgagagctcacccgtcacggagtcgagaccctcgtccactacccgaccccggtgcacctgagcgcggcctacgcggaccacggacaccgagccggttccctcccgcacgccgaacgtctggcccgggaagtgctgagcctgcccatgggcccgcacctcccgctcccggctgccgaacgggtggccgacctggtcgccgtgctcgcggcgcgaccctag

SEQ ID NO: 43518 - protein, 372 aa, Aeromicrobium erythreum
MTIDVPFLDLDAAYVELRPQIDAAVSGVLASGRYLLGAQTEAFEAEFAAACSAAHCVTVGSGCDALELSLTALGVGPGDEVVVPAHTFIATWLAVSRCGARPVPVEPSPDGYLVDVEAVEAAITPRTAAILVVHLYGEVADLAAIRRVADRHGLALVEDAAQSTGARGRDGAVVGSGSTAAAFSFYPGKNLGALGDGGAVVTADDDLARRVRLLRNYGSVAKYVHEVRGTNSRLDEIQAAVLRAKLPLLDAWNARRATIAALYLDRLEEASGVRLPPHGPGPVCLAPLRRPAGHDRETLQRELTRHGVETLVHYPTPVHLSAAYADHGHRAGSLPHAERLAREVLSLPMGPHLPLPAAERVADLVAVLAARP

SEQ ID NO: 43519 - DNA, 1119 bp, Streptomyces griseoruber
  CDS (1)..(1119)
atgaccgtccacgtctgggactacctgcccgagtacgaggccgaacgggaagacctgctcgacgccgtcgacaccgtcttccgatccggccggctgatcctgggggacgccgtcagcggcttcgagaggaagttcgccgcctaccacggactggcccactgcaccggcgtcgacaacggcaccaacgccgtcaagctcggtctcgaagccctgggcgtcggacccggcgacgaggtgatcacggtgtccaacacggcggcccccaccgtggtcgccatcgacggcgccggcgcgacccctgtcttcgtcgacgtccgcgaggacgacttcctgatggacaccgaccaggtggcggccgccgtcacgccccgcacccgtgccctgctgcccgtgcacctgtacggccagtgcgtcgacatggcgccgctgcgcgagctcgcccgccgccacgacctggtgatcctggaggactgcgcccaggcccacggcgcccggcaccacggccggctcgccggcaccatgggggacgccgccgcgttctccttctacccgaccaaggtgctcggcgcctacggcgacgccggcgcggtcctcaccgactcggcggagaccgacgcccggctgcgccggctgcggtactacggcatggccgagcggtactacgttgtgcagaccccggggcacaacagccggctcgacgaggtgcaggccgagatcctgcgccgcaaactgcgccggctggacgactacgttcgcgggcgccgggcggtggccgcccgctacgccgaggaactgggggacctggccgagcggggcctggtgctgccgtccaccgccgagggcaacgaccacgtccactacgtctacgtggtccgccacccccgccgggacgagatcatcgaggggatgaggcgctacggcatctcgctcaacatcagctatccctggccggtgcacaccatgtcgggtttcgcgcacctgagccgcgccccgggcacgctgccggtgaccgagcggctcgcgaaggagatcttctcgctgccgatgtatccctcgttgccggcgagcgtccaggacaaggtcgtcgccgcgctgcgcgaggtgatcctcgccctgtga

SEQ ID NO: 43520 - protein, 372 aa, Streptomyces griseoruber
MTVHVWDYLPEYEAEREDLLDAVDTVFRSGRLILGDAVSGFERKFAAYHGLAHCTGVDNGTNAVKLGLEALGVGPGDEVITVSNTAAPTVVAIDGAGATPVFVDVREDDFLMDTDQVAAAVTPRTRALLPVHLYGQCVDMAPLRELARRHDLVILEDCAQAHGARHHGRLAGTMGDAAAFSFYPTKVLGAYGDAGAVLTDSAETDARLRRLRYYGMAERYYVVQTPGHNSRLDEVQAEILRRKLRRLDDYVRGRRAVAARYAEELGDLAERGLVLPSTAEGNDHVHYVYVVRHPRRDEIIEGMRRYGISLNISYPWPVHTMSGFAHLSRAPGTLPVTERLAKEIFSLPMYPSLPASVQDKVVAALREVILAL

SEQ ID NO: 43521 - DNA, 1107 bp, Escherichia coli
  CDS (1)..(1107)
atgaatatcgaattcttaaatttaaaaaaaataaaccagcgatttgccgatgagattcgtttttcatttgagcgagttttagaatctgggagatatattcaaggtaatgaacttaagatgtttgaggaagagtttgcttctttttgtggcgttaagcattgtatcggggtcgcaaatggccttgatgcgttagttttggttttaaaagcatggaagttaatgaataaatgtaaggacggtgatgaggttatcgttccctcgaatacttttattgcatcaatactggctataacagaatctgggctcaaaccagtattggtggaacctgatcccataacaaataatataacgttatcttctataaggtctgcaattacatctaaaacaaaggttttactacctgtccatctctatggaagcatatgtaatatgtctgaaataatggatattgcaaaagaaaatgattcgcttgtacttgaagacagcgctcaggcacatggcgcagtacataaaggtaagaaggctggagcttggggggatgctgctgctttcagtttttatcccgggaaaaacctaggggccttaggagatgctggggctgtaactacgaatgatagtgatttagccatgattattcgttctcttggcaattatggctcaagcaaaaagtataaccatatctataaaggagttaacagccgtcttgatgaactacaggcggcaattttaagggttaaattaaggtatttagaaacagacattatgcaaaggcgtgcaattgctcgcgattattgtaataatattaaaaataaatatgtattgctaccctgctcatccgtcccggaagagcatgtttggcatctatttgtaataaaaacggacagaagggttgaactgaaaagctatcttgccgctaatggtatacaaacattagaacattatcctgtgccaccacataagcaattggcatataaagagtggtcatccaaatcataccctatatcggaaaaacttcatcagagtgtgttatcattaccacttgatcctacaatgagtgaagaagaggttcgatatgtaattaatataataaatggttttaaaggatga

SEQ ID NO: 43522 - protein, 368 aa, Escherichia coli
MNIEFLNLKKINQRFADEIRFSFERVLESGRYIQGNELKMFEEEFASFCGVKHCIGVANGLDALVLVLKAWKLMNKCKDGDEVIVPSNTFIASILAITESGLKPVLVEPDPITNNITLSSIRSAITSKTKVLLPVHLYGSICNMSEIMDIAKENDSLVLEDSAQAHGAVHKGKKAGAWGDAAAFSFYPGKNLGALGDAGAVTTNDSDLAMIIRSLGNYGSSKKYNHIYKGVNSRLDELQAAILRVKLRYLETDIMQRRAIARDYCNNIKNKYVLLPCSSVPEEHVWHLFVIKTDRRVELKSYLAANGIQTLEHYPVPPHKQLAYKEWSSKSYPISEKLHQSVLSLPLDPTMSEEEVRYVINIINGFKG

SEQ ID NO: 43523 - DNA, 1260 bp, Streptomyces kanamyceticus
  CDS (1)..(1260)
atgagcaagaagctggcgctgttcggcggaactcccgtacggaacgaggagttctacgacggcccgcacatcgggccgcacgatctcgaccgcctcaaatccgtcctcgactcggggaacttcggcggcatccccttccccaacacccaccacaccgccttcgccgacctgttcaccggcaagctcggcgccccgtacggcctgatggtctccaacggcaccatcagtctctccatcgcgctgcgcgccctgggcgtgcgtgccggggacgaggtgatcaccaccggctacacctggatgggcacggccgcggcgatcgtgcacatcaacgccgtccccgtcctggtggacatcgaccccacgacctggtgcatcgacccggcggcggtggaggcggcgatcaccccgcgcaccaaggtgatcgtcccggtccatctgggcaatcagatcgccgacctcgacgcgctgcgggcgatcgccgacaagcacggactcgcgatcctggaggacaccgcgcacgggcacttcgccgagtggcgggggcagtgcgtgggcacccacggggacgcgggcagcttcagcttcgagagcagcaagatcatgactgccggtgagggcggcttcctggtggccagggacgaggacgtgtaccagcggatgatgtcgctggccaactgcggccgcaaggagccgggttacgacggtttcgcgggccgcaccctgggctggaacgcccgcgcgagcgaactgcaggccgccttcatgatcgggcaggtcgagcagcacgacgcgctgcacgccaagcgggcggcgagcgcggcgaagctcaccgcggggctcgccgagatcggcggcttcactcccgtggggaacgacgacccgaggatcacccggcgccagtactacgaggtcatctaccgcttcgaccccgccgcctgggaggggctgcaccgggacgaggtcctctcggcgatccttgccgagggcatcgagctggagggcgacgccttctacccgcccgtacacaagagcgaactgttcgcggtggacgccgtccactggcccatgatcgccgagaggtacggcgatcggatcggcccggacagcgtcgacctgcccgtcgccgaccgcgccgccgccgacgagtccgtgtgggtgcaccacgcgctgctcaccggcgacgacaaggacctcggcgacatcctcgaagccgtcgccaaggtccgcgacaacctgcgagaactgcacgacgcgagctga

SEQ ID NO: 43524 - protein, 419 aa, Streptomyces kanamyceticus
MSKKLALFGGTPVRNEEFYDGPHIGPHDLDRLKSVLDSGNFGGIPFPNTHHTAFADLFTGKLGAPYGLMVSNGTISLSIALRALGVRAGDEVITTGYTWMGTAAAIVHINAVPVLVDIDPTTWCIDPAAVEAAITPRTKVIVPVHLGNQIADLDALRAIADKHGLAILEDTAHGHFAEWRGQCVGTHGDAGSFSFESSKIMTAGEGGFLVARDEDVYQRMMSLANCGRKEPGYDGFAGRTLGWNARASELQAAFMIGQVEQHDALHAKRAASAAKLTAGLAEIGGFTPVGNDDPRITRRQYYEVIYRFDPAAWEGLHRDEVLSAILAEGIELEGDAFYPPVHKSELFAVDAVHWPMIAERYGDRIGPDSVDLPVADRAAADESVWVHHALLTGDDKDLGDILEAVAKVRDNLRELHDAS

SEQ ID NO: 43525 - DNA, 1284 bp, Streptomyces kanamyceticus
  CDS (1)..(1284)
atgcccctgcaaagttcacggcttgcggtcgacaacggaacccccgtccgcggcaagccctggccggtgtggccgcagcccaccgacggcaccctcgacgccctctcccgcgtcctgcgttccggccgctgggccatcagcggcccctaccggggcgtggagtcggccgaacgccgcttcgcccgccggttcgccgactaccaccgcatcgcccactgcgtgcccgcctccagcggtacggcgagcctgatgctggccctggaggcctgtggcgtcggcgcgggagacgaggtcatcctgcccggcgtcacctgggtcgcctccgcctccacggtggtgggcgtcaacgcggtgccggtgttcgccgacatcgacccggacaccctctgcctcgacccggacgccgtcgaggcggccatcaccccggccaccaaggcgatcgtcgtcgtccacctctacgcggccgtcgccgacctcacccgcctcaaggaggtggccgaccggcacggcatcgtgctcatcgaggactgcgcgcaggcccacggcgccgagttcgaaggccacaaggtcggcaccttcggcgcggtcggcaccttcagcatgcagcagagcaaggtcctgaccagcggcgagggcggcgccgccatcaccgccgacccggtgctcgcccgccggatggaacacctgcgcgcggacggccgctgctaccgcgatcaggcgccgccctccggccacatggagctcgtcgagacgggcgagctgatgggcagcaaccgctgcatctccgagttccaggcagcggtcctgaccgagcagctgggcgaactcgaccggttcaacgccctgcgacggcacaacgcggaactcctcgacgcgctgctgaccgacgtcggataccgcccgcagcgcagcacgcccggcaccaccgcccgcacgtactacacctacgtcgccgagctgcccgacgcggaactgcccggcgcggacatcaccaaggtcaccgaggcgctgaccgccgaactcggcttcccggtggcaccggcctactcgccgctcaacgccaaccccctgtacgacccggccagtcgcagccggttcgccctcggaccgcagcacgagaagctcatcgaccccgcccgattcgtgctcccggtgagcggccgcctgacgcgtcggctcgtcaccttccaccacgccgccctgctcggcgacgagtcggacatgagggacatcgcggaagcgttcaccaaggtgctccagcaccgggccgtcctggccgcttga

SEQ ID NO: 43526 - protein, 427 aa, Streptomyces kanamyceticus
MPLQSSRLAVDNGTPVRGKPWPVWPQPTDGTLDALSRVLRSGRWAISGPYRGVESAERRFARRFADYHRIAHCVPASSGTASLMLALEACGVGAGDEVILPGVTWVASASTVVGVNAVPVFADIDPDTLCLDPDAVEAAITPATKAIVVVHLYAAVADLTRLKEVADRHGIVLIEDCAQAHGAEFEGHKVGTFGAVGTFSMQQSKVLTSGEGGAAITADPVLARRMEHLRADGRCYRDQAPPSGHMELVETGELMGSNRCISEFQAAVLTEQLGELDRFNALRRHNAELLDALLTDVGYRPQRSTPGTTARTYYTYVAELPDAELPGADITKVTEALTAELGFPVAPAYSPLNANPLYDPASRSRFALGPQHEKLIDPARFVLPVSGRLTRRLVTFHHAALLGDESDMRDIAEAFTKVLQHRAVLAA

SEQ ID NO: 43527 - DNA, 1110 bp, Thiobacillus ferrooxidans
  CDS (1)..(1110)
atgactcaaaatacagcaattcccatggtcgatttgcgcgcgcattttgcgccgctgcgggatgaaatattgacggggatagggaagattctggacgatgccagctttatcctgggaaatcaggggcgtgcgctggaggcggaggtagcgggtctctccggtgttgcccacggtgtgggctgcgcctccggtacggacgccctgatgctggccctgcgtgccctggagatcggccccggcgacgaggtgatcgtcccgaccttcacgttcatcgcgactgcggaagcggttctttacgtgggcgccacgccggtttttgtggatgtggatgatcgtttttacgccatgaccatcgccggtatcgaggccgccattacgccgcggaccaaagcgatcatccccgtacatctctacggattgccggcagatatgcccggcatcatggcgcttgctcagaagcatggcttgcgggtgattgaggattgtgcccaggccattggtgcccaaattaacggacaaggagtgggcagttttggcgacatcggttgtttttctttctttcccagcaaaaatcttggcgctgccggagacggcggcatggtggtgacggcggatgcggagctggaacgcaaattgcgcggtctgcgcaaccatggttcctggcagacctaccatcatgacgtattgggctataacagtcgtctcgacgaaatgcaggcggtgattcttcgggcggagttcccacatctcgcggcctataacgacggacggcggcgggcggcagggtggtacgccgagcatctggtgggtctcgacctgcaattgccggaagctccagcaggttatcaccacgtattccatcagttcaccattcagttgaatgcgcgggatgcggtgaagaccgccctccatgccgaaggcattgccagcgccatttactatccgattccaggacaccagcaaaagatgtttgcacaccaggcccaaacccattgtccggtggcagagcatctggcggagcgggtgctctccctgcccatgttcccggaactgcgtgaggagcagatagccaggatcgctaccgtgatccgtcgcaccctgcacggctag

SEQ ID NO: 43528 - protein, 369 aa, Thiobacillus ferrooxidans
MTQNTAIPMVDLRAHFAPLRDEILTGIGKILDDASFILGNQGRALEAEVAGLSGVAHGVGCASGTDALMLALRALEIGPGDEVIVPTFTFIATAEAVLYVGATPVFVDVDDRFYAMTIAGIEAAITPRTKAIIPVHLYGLPADMPGIMALAQKHGLRVIEDCAQAIGAQINGQGVGSFGDIGCFSFFPSKNLGAAGDGGMVVTADAELERKLRGLRNHGSWQTYHHDVLGYNSRLDEMQAVILRAEFPHLAAYNDGRRRAAGWYAEHLVGLDLQLPEAPAGYHHVFHQFTIQLNARDAVKTALHAEGIASAIYYPIPGHQQKMFAHQAQTHCPVAEHLAERVLSLPMFPELREEQIARIATVIRRTLHG

SEQ ID NO: 43529 - DNA, 1122 bp, Escherichia coli
  CDS (1)..(1122)
ttgaggggaaagaaaatgattgattttttgaatttaaaaagaataaatgctcaatatgaaatggaattaaaagatgcttgctccagagttattgattctggttggtatattatggggacggagttaaagacatttgaggaaaaatttgcaaattggtgtggagttaagcatgttattggtgttgccaatggcttagatgcactaatccttgttcttcgggcttggaaagaaatggggaaattaaatgacggagatgaaattattgtacctgccaatacatatattgcatctgttttggcaataactgaaaataatctagtccctgtattgactgaaccagatcctttgacattcaacttaagtgcgggtgggattcgtaaagtaattacagggaaaacaaaagcaattttgccagtgcatttgtatggacaaatatctccaatggcagaaataatggagattgcggcagagtttggtttattggttttagaggattgcgctcaagctcatggttcctctattgatggacgcaaagctggcagttggggtcatgcagctggattcagtttctatccaggaaaaaatcttggcgctttaggtgacgcaggtgcgataacaacgagtgatgatcaacttgcagatattttgacagctattagaaattatggttctcatgaaaaatataaaaacaaatatcaaggcttaaatagtcgattggatgaaatgcaggcggcatttttgaatgtcaagttaaaatatcttgatagggaaaataaattaagacgtgcaatagctaaaaaatatattgaagaaatcaagaatccactaatttcactgcctgtaattgctggcaatgaaatgtctcatgtatggcatctttttgttatcagaacttcagagcgtgattctttgcaaaaacatttgaaaactgaaggtattactacattagtgcattacccaatagcgcctcataatcaagaagcatataaagaatatagttttttatctctccctttaactgagagaatacatagagaagtcttatcgctgccaatggatccgacaatgagcatcgacgatattaatatggtaattgaagcgattaatagatggaaaagctaa

SEQ ID NO: 43530 - protein, 373 aa, Escherichia coli
MRGKKMIDFLNLKRINAQYEMELKDACSRVIDSGWYIMGTELKTFEEKFANWCGVKHVIGVANGLDALILVLRAWKEMGKLNDGDEIIVPANTYIASVLAITENNLVPVLTEPDPLTFNLSAGGIRKVITGKTKAILPVHLYGQISPMAEIMEIAAEFGLLVLEDCAQAHGSSIDGRKAGSWGHAAGFSFYPGKNLGALGDAGAITTSDDQLADILTAIRNYGSHEKYKNKYQGLNSRLDEMQAAFLNVKLKYLDRENKLRRAIAKKYIEEIKNPLISLPVIAGNEMSHVWHLFVIRTSERDSLQKHLKTEGITTLVHYPIAPHNQEAYKEYSFLSLPLTERIHREVLSLPMDPTMSIDDINMVIEAINRWKS

SEQ ID NO: 43531 - DNA, 1173 bp, Micromonospora echinospora
  CDS (1)..(1173)
gtggatcggctgcggaccgtcatcgagagccgcaacctcggcggcatccccttcccgaacaccatgcaccagcagttcgccgagcggttcaccgccaagctcggggcgaagtacggcctcctggcgaccaacggcacggtgaccctctcgatggcgctgcgcgcgctcgggatccatgccggtgacgaggtgatcaccaccgccttcacctgggtcgggacggtcgccggcatcgtgcacgtcaacgccgtgccggtgctggcggacatctccgacgacaactggtgcatcgacccggtgaaggtcgaggaggcgatcaccgaccggaccagggcgatcatggtggtgcacctgggcaaccaggtcgccgacatggacgcgctgctggacatctgccgccggcacaacctgctgctcatcgaggactgcgcgcacgcgcacttcgcggagtggcggggccggtgcgtcggcaccatcggcgacgccggcagctacagcttcgagaccagcaagatcatgacctcgggcgagggtggcttcctggtcaccgcaaccgaggaggcgttccaccgggcgatgtccctggcgcacgtcggccgcaaggaggccccgtacgacaggttcccgggccgggtcttcggctggaaccaccgggccaccgagatgcaggcggccgtcctgctggggcagctcgaccggtacgacgccctcgacaagcagcggaccgcgatggcggagatgctgacccaggggctggtcgagatcggcggcttcaagccgctggcggaggacccccgggtcacccgccggcagcgttacgagctgctcttccggttcgacaccgaggcctgggacgggctccaccgggacaaggtgctggaggcgatcctcgccgagggcgtcgagttcgaggggaacaccttctacccgccgatgcaccgcgacgagctgttccacatcaccgccgacgactggccggcgatccgggagcgctacggcgagaagatcgagccggacgcgttccacctgccggtggcggagcgggtggccttcgacgaagcggtgtggatccaccactccctgctgtcggtggagccggaggacgtacaggacatgctggatgcggtggtcaaggtccgggacaatctgggggcgctgaagaagagcctatga

SEQ ID NO: 43532 - protein, 390 aa, Micromonospora echinospora
MDRLRTVIESRNLGGIPFPNTMHQQFAERFTAKLGAKYGLLATNGTVTLSMALRALGIHAGDEVITTAFTWVGTVAGIVHVNAVPVLADISDDNWCIDPVKVEEAITDRTRAIMVVHLGNQVADMDALLDICRRHNLLLIEDCAHAHFAEWRGRCVGTIGDAGSYSFETSKIMTSGEGGFLVTATEEAFHRAMSLAHVGRKEAPYDRFPGRVFGWNHRATEMQAAVLLGQLDRYDALDKQRTAMAEMLTQGLVEIGGFKPLAEDPRVTRRQRYELLFRFDTEAWDGLHRDKVLEAILAEGVEFEGNTFYPPMHRDELFHITADDWPAIRERYGEKIEPDAFHLPVAERVAFDEAVWIHHSLLSVEPEDVQDMLDAVVKVRDNLGALKKSL

SEQ ID NO: 43533 - DNA, 1263 bp, Micromonospora echinospora
  CDS (1)..(1263)
gtgacccttcttgccgtcaatggtggttcccctatacgttcgcagcagtggccgttgtggcccgctcctgcgcccggcgccctcgacgccctgaatgaggttctccattccggtcggtgggccatcagcgggccatatcaggggaagcagagcttcgagcggcgattcgcagcggcgttcgccgagttccacgagatcgggcactgtgtgccgacctccagcgggacggccagcctcatggtcgcgctcgaggcatgcggggtcggtgccggtgacgaggttatcatcccgggcctgacctgggtcgccaacgcatccaccgtcgccggggtcaacgcggtgcccgtcccggtcgacgtggatccgcagaccctctgtctcgacccggcggccgtcgagcgggcgatcaccccgcgaaccgcggccatcgtcgtggtccacctctactccgccgtggcggacctggacgcgttgaccgcgatcgccgagcggcacgagatcccgctgatcgaggactgcgcgcaggcacacggcgcgcgctaccgcgaccgtcgggtcggcacgttcggcgccttcggcaccttcagcatgcagcacagcaaggtcctgaccagcggtgagggcggtgccgtcatcaccggggacgccgcactctcccggcgggccgagcacctgcgggcggacggccgcacctacacgccggacgagcccgccgtgggagagatggaactggcccagaccgccgagctgatgggcagcaaccggtgcctgtcggagttccaggcggcgctcctcctcggtcagctcgaacttctcgacgagcagaacgaacggcggcgggccaacgcggccctgctcgacgagggtctcggcgcgctcggcatccagccccaggtctcctcgcccggcaccaccgagcgcacctactacgagtgggccggtcggatcgaagacgacgggatcgggcagatcggcgtcgagcggatcgccccggcggtcgccgccgaactctccggcgcggccatctacgccagctacccgccgatgaaccacaaccggctctaccagcccgccacgcgggcgcggttcaagggcatcgccggactcgacctgaccggctactcgttgccggtcgccgaggacgccggccagcgggtcgtcaccatccaccactcggcgctgctcggcgacgagtcggacatgaaggacatcgttcgcgccttcgagaaggtgttcgcgaatcaccgggaactacgcggctga

SEQ ID NO: 43534 - protein, 420 aa, Micromonospora echinospora
MTLLAVNGGSPIRSQQWPLWPAPAPGALDALNEVLHSGRWAISGPYQGKQSFERRFAAAFAEFHEIGHCVPTSSGTASLMVALEACGVGAGDEVIIPGLTWVANASTVAGVNAVPVPVDVDPQTLCLDPAAVERAITPRTAAIVVVHLYSAVADLDALTAIAERHEIPLIEDCAQAHGARYRDRRVGTFGAFGTFSMQHSKVLTSGEGGAVITGDAALSRRAEHLRADGRTYTPDEPAVGEMELAQTAELMGSNRCLSEFQAALLLGQLELLDEQNERRRANAALLDEGLGALGIQPQVSSPGTTERTYYEWAGRIEDDGIGQIGVERIAPAVAAELSGAAIYASYPPMNHNRLYQPATRARFKGIAGLDLTGYSLPVAEDAGQRVVTIHHSALLGDESDMKDIVRAFEKVFANHRELRG

SEQ ID NO: 43535 - DNA, 1251 bp, Azospirillum brasilense
  CDS (1)..(1251)
gtgatgggcggaccggcgttcccaccgccgctgcccttcctgccttatgggcgccaggacgtcgatcaggccgacatcgatgcggtgaccacggtcctgcgcggcgactggctgacccaggggccggcggtggaggcgttcgagcgggcgctgtgcgagcgcaccggggcggctcatgcggtgtcctgtgccaacgggaccgccgccctgcatctggccgccctcgcgctggggctcggccccggcgacgcggtggtggtgccctccgtcaccttcctcgccaccgccaacgccgcccgctatgcgggggcggaggtcgccttcgccgatgtcgatcccgaaaccggcctaatggggccggagcaggcggaagcggcgatggagcgggccgcccgcgccggctggcgggtacgcgccctggtgcccgtgcactttgccggccagaccgcggacaggaccgggctcggcgcgctcgccgctcgccacggactggcggtcatcgaggacgcctgccacgccatcggcagcgtagacgtgatgccggatgggcgcgccctgccggtcggttccggcgccttcggcacgctcaccgccttttccttccaccccgtgaagaccatcgcggcgggcgagggaggggccgtgaccaccaacgatgcggatctcgccgcccggctgcgccgcttccgcaaccatggcatggagcgtgagccggcgggattcgaggaccacgaggccgccttcgccgccgaggggatcgctaatccctggtattacgagatggcggagccaggcttcaattaccgtctgaccgacatccactccgcactcgccctcagccaactcggacgactggacgccttcgtggagcggcgacgtcacctgatggacctttatgctgagcggctgtcccaactcgcccccctggtcctgcccgccgcctgcgttccctggtgccgtccggcctggcatctctgcgccgtccgcatcgattttgccgccagcgggcggacacgggcgcaggttatggccgatctgcggacacgcggcatcggcagccaggtccactacattccggttcaccgccagccttactggcgcaggcgctacggcgacctcgccctgcccggcgccgaggcccattacgcccggacgctgtcgctgcccctgttcccggccatgacggatgccgacgtggagcgggtcgccgtagccctggccggaacgctggggcttcgcgctccggcgtga

SEQ ID NO: 43536 - protein, 416 aa, Azospirillum brasilense
MMGGPAFPPPLPFLPYGRQDVDQADIDAVTTVLRGDWLTQGPAVEAFERALCERTGAAHAVSCANGTAALHLAALALGLGPGDAVVVPSVTFLATANAARYAGAEVAFADVDPETGLMGPEQAEAAMERAARAGWRVRALVPVHFAGQTADRTGLGALAARHGLAVIEDACHAIGSVDVMPDGRALPVGSGAFGTLTAFSFHPVKTIAAGEGGAVTTNDADLAARLRRFRNHGMEREPAGFEDHEAAFAAEGIANPWYYEMAEPGFNYRLTDIHSALALSQLGRLDAFVERRRHLMDLYAERLSQLAPLVLPAACVPWCRPAWHLCAVRIDFAASGRTRAQVMADLRTRGIGSQVHYIPVHRQPYWRRRYGDLALPGAEAHYARTLSLPLFPAMTDADVERVAVALAGTLGLRAPA

SEQ ID NO: 43537 - DNA, 1167 bp, uncultured bacterium 440
  CDS (1)..(1167)
atgataccatacggaaaacatcatattgatattgatgatataaaatctgtcagcaaagttttaaaaagtgaaaatcttacacaaggccctttaataaaaacctttgaaaatgcaatctcaaaatatgtagggtcaaaatatgcagttgctgtaacaagttgtactgccgggatgcatctagcggcgattgtgtctaatatgaaaaaaggaaaaactttactcacttcagcgattacttttgtttctactgcaaattcatcactattttgtggagctaaaactattttcgctgacgtagattcaaatataaatatatcagctcaagaagtttataaaattttttcaaaaaaaaagattaatgccttagcaccagttcattttggtggcttaccatgtgacatgaaaaaattaaaaaaaattgcagacaaacataaagctataatttacgaagatgctgctcacgcatttggctctactttcttggacggctcgagggttggttcatgtaaatattctgacatgacaattttttcttttcatccagttaaatcaattgctacaggcgagggaggtgttattacgacaaatagcaaaaaaatctataataaacttcttcttttaagaaatagtggtattgaaaaaaatagtagtaattttatttataaaaataaatctagagaaaaaaaaaatactaatccttggtattatgaaatgcaagaattaggttatcattatagaattaccgacattcaatgtgctttgggtttatcacaattaaaaaaggttaatcaattcttaattaaaagaaagcaattagcaaaaaggtatgattttgaattaaaaaatttaaaaaactgtaaaattatccaggaaggtttaagaaataatagtagtaatcatttatatatattaaaagtaaattttaaaaaacttggtgtatctagaggaaaattaatgaaactatttaaagataaagaaattggtacccaagttcattatattccggttccttctcatccatatttcaaaaaaaaaggatataaatataataatttgccaaattcttatgaatattacgagggggctctctcaatacccctttattatgatctaagcaaaaaacaacaaacacatgttattcatgctgttaaaaaattaatcggatag

SEQ ID NO: 43538 - protein, 388 aa, uncultured bacterium 440
MIPYGKHHIDIDDIKSVSKVLKSENLTQGPLIKTFENAISKYVGSKYAVAVTSCTAGMHLAAIVSNMKKGKTLLTSAITFVSTANSSLFCGAKTIFADVDSNINISAQEVYKIFSKKKINALAPVHFGGLPCDMKKLKKIADKHKAIIYEDAAHAFGSTFLDGSRVGSCKYSDMTIFSFHPVKSIATGEGGVITTNSKKIYNKLLLLRNSGIEKNSSNFIYKNKSREKKNTNPWYYEMQELGYHYRITDIQCALGLSQLKKVNQFLIKRKQLAKRYDFELKNLKNCKIIQEGLRNNSSNHLYILKVNFKKLGVSRGKLMKLFKDKEIGTQVHYIPVPSHPYFKKKGYKYNNLPNSYEYYEGALSIPLYYDLSKKQQTHVIHAVKKLIG

SEQ ID NO: 43539 - DNA, 1092 bp, Aneurinibacillus thermoaerophilus
  CDS (1)..(1092)
atgattccttttttggatttaagacaaataaatatgagatatcaaaaagagattcaacaagcaatgaatagagtgcttgaatcgggatggtatattttagggggagaagtggatgattttgaaagaaagtttgccagttattgtggtgcaaaatattgtattggggtagcaaatggactagatgctttaacattgattattagagcatatgatataggattaggagatgaggtaatagttccttccaatacctatattgcttctattcttgctatttcagcaaatggtgctactcctgttttggttgaaccagatataaatacatacaatattgatcccctaaaaattgaagagaaaataacttcgcgtacaaaagcgattatggttgttcatttatatggacaatcatgcgatatggaatcaatcaatttgatagctaaaaaatataatttaaaagtaatagaagattgtgcacaagcgcacggagccatttataatggaaaacgggtaggaagtcttggagatgcggctggctttagtttttatccagggaaaaatttaggagcattaggtgacggtggcgcgatcacaacaaacgatgctgaactagctgaacgcttaaatgttttacgtaattatggttcacataaaaagtatgaaaatctttttaaaggtgttaatagtcgcttagatgaattacaagcggcgatccttagtataaaactttcttacttggatgatgataatcaaagaagacgggaaattgcagcatattatttagaacatataaagaatccgtttattcatttgccaactgttacggatgataaggctcatgtttggcatttatttgtagttcgagtaaaggaaagagaagcatttcagtactatttggcagaacaaaacattcaaacccttattcattatccgattccgccacataaacaaaaggcttatagtgagtggcagcaagaaagctttccgatttctgaacaaatacatagtgaggttgttagtttgcccataagcccagttatgagtagagaggaagtcgaaagggttgtggaggctgttaacaggtatggatactag

SEQ ID NO: 43540 - protein, 363 aa, Aneurinibacillus thermoaerophilus
MIPFLDLRQINMRYQKEIQQAMNRVLESGWYILGGEVDDFERKFASYCGAKYCIGVANGLDALTLIIRAYDIGLGDEVIVPSNTYIASILAISANGATPVLVEPDINTYNIDPLKIEEKITSRTKAIMVVHLYGQSCDMESINLIAKKYNLKVIEDCAQAHGAIYNGKRVGSLGDAAGFSFYPGKNLGALGDGGAITTNDAELAERLNVLRNYGSHKKYENLFKGVNSRLDELQAAILSIKLSYLDDDNQRRREIAAYYLEHIKNPFIHLPTVTDDKAHVWHLFVVRVKEREAFQYYLAEQNIQTLIHYPIPPHKQKAYSEWQQESFPISEQIHSEVVSLPISPVMSREEVERVVEAVNRYGY

SEQ ID NO: 43541 - DNA, 1059 bp, Streptomyces diastaticus
  CDS (1)..(1059)
atgtcgttcaagtatcccgtgtccaggcccgctctggagggcaacgagctggcgtatctgaccggtgccgtcgaggacgggtggatttcctcccagggcccgatggtcgggcggttcgagcgtgccttcgccgactacaacggcatcgcgcacggcgtttcctgttcctcgggaacggcggcgctcaccctcgcgctgcgggcgctgggcatcggcccgggggacgaggtcatcgtcccggaattcacgatgatcgcctcggcatgggcggtcacctacaccggcgccacgcccgtgttcgtggactgcggggacgacctcaacatcgacgtcacccgtatcgaggagaagatcacggcgcgcacgaaggccgtgatgccggtgcacatctacggccggcggtgcgacatggacgcgatcatggacattgcgtaccagtacaacctgcgggtcgtggaggacagcgccgaagcgcacggcattcggccggtcggtgacatcgcgtgctactcgctgttcgccaacaaaatcatcacggcgggggagggcggtatctgcctcaccgacgacccgaaactcgccgggcagatgcagcacttgcgggccatggcgttcaccaaggaccacagtttcctgcacaagaaggtggcgtacaactaccgcatgacggccatgcaggccgccgtcgcgctcgcccagaccgagcgcctggacgacatcctcgaagtgcgccgcggaatcgagaagcgctacgacgaggggctggccgatgtccccggtatcacgctgatgccgccgcgggacgtgctgtggatgtacgacctgcgcgccgaacgccgcgaggaactgcgggaattcctggccggggagtccatcgagacccggctgttcttcaagccgatgagccggcagcccatgtacttccaccccgactggccctcgctcaaggcgaacaccttcgccgaggacggactgtacctgcccacccacaccggactgaccgccggcgaccaggacttcgtgatcgaccgggtccgcgccttctacggcgtcggctga

SEQ ID NO: 43542 - protein, 352 aa, Streptomyces diastaticus
MSFKYPVSRPALEGNELAYLTGAVEDGWISSQGPMVGRFERAFADYNGIAHGVSCSSGTAALTLALRALGIGPGDEVIVPEFTMIASAWAVTYTGATPVFVDCGDDLNIDVTRIEEKITARTKAVMPVHIYGRRCDMDAIMDIAYQYNLRVVEDSAEAHGIRPVGDIACYSLFANKIITAGEGGICLTDDPKLAGQMQHLRAMAFTKDHSFLHKKVAYNYRMTAMQAAVALAQTERLDDILEVRRGIEKRYDEGLADVPGITLMPPRDVLWMYDLRAERREELREFLAGESIETRLFFKPMSRQPMYFHPDWPSLKANTFAEDGLYLPTHTGLTAGDQDFVIDRVRAFYGVG

SEQ ID NO: 43543 - DNA, 1098 bp, Clostridium thermosaccharolyticum
  CDS (1)..(1098)
atgaaaatatcatttgcaagctttaaacctatgcatgatgaaatagaatatgaaataaagtttaaatttgaagaaatttacaaaagaaattggtttatattaggagatgaagataaaaaattcgaacaagaatttgcagattattgcaatgttaactattgtattggctgtggaaatggattagatgcattacatttaattttaaaggggtatgatataggttttggcgatgaagttattgtcccatccaatacttttatagctacggctcttgctgtttcatatacaggagcaaagccgatttttgtagaaccagatattagaacatataatattgatcctagtttaattgagtcggctatcacagaaaagactaaagccataattgctgttcatttgtatggacaaccagcagatatggatgaaataaaaagaatagctaaaaaatataaccttaagttaatagaagatgctgctcaagcacatggttcactatataagggaatgaaagtaggaagtcttggtgatgcggcaggtttcagcttttatccagctaaaaatttaggttctttaggtgatggtggtgcagtagttacaaatgacaaggatttagcagaaaaaattaaagcattatctaattatggttctgaaaagaaatatcatcatatttataaaggatttaattcaagattagatgaattacaggcaggatttttaagagttaaattaaaatatttagataaatggaatgaagagagaagaaaaattgcacaaaaatatatagctggtattaataatccaaatgttataataccagttgaagctgattacgcaaaacatgtatggtatacatttgttataagatcagaaaaaagagatgaattgcaaaaatatttaaataataatggaattggtacactcatccattatccaataccaattcatcttcaacaggcatataaagatttaggatttaaaaccggaaattttcccatcgcggaaaagatagcaaatgaaatattaagtataccaatttggtatggaatgaaaaatgaagagattgaatatgtaattgataaaataaatgcatggaaataa

SEQ ID NO: 43544 - protein, 365 aa, Clostridium thermosaccharolyticum
MKISFASFKPMHDEIEYEIKFKFEEIYKRNWFILGDEDKKFEQEFADYCNVNYCIGCGNGLDALHLILKGYDIGFGDEVIVPSNTFIATALAVSYTGAKPIFVEPDIRTYNIDPSLIESAITEKTKAIIAVHLYGQPADMDEIKRIAKKYNLKLIEDAAQAHGSLYKGMKVGSLGDAAGFSFYPAKNLGSLGDGGAVVTNDKDLAEKIKALSNYGSEKKYHHIYKGFNSRLDELQAGFLRVKLKYLDKWNEERRKIAQKYIAGINNPNVIIPVEADYAKHVWYTFVIRSEKRDELQKYLNNNGIGTLIHYPIPIHLQQAYKDLGFKTGNFPIAEKIANEILSIPIWYGMKNEEIEYVIDKINAWK

SEQ ID NO: 43545 - DNA, 1104 bp, Shigella dysenteriae
  CDS (1)..(1104)
atggaaaagccaatctttgtaacgcaacctaatttaccaccgctagaggagtttataccatatctggaaatcatttggcagaataagcaatttacaaataatggtccaatgcatcaaaaattagaaaaaaaattatgcgagtttcttggtgttgaatacattagtctatttaataatgggactattgcgcttataaccgcagtacaggctttgggtgttaaaggcgaagtaattaccacaccatattcctttgtagcaactgcacactccttggtcttaaatgggcttaaacctgtttttgtcgatattgatcccaaaaccttaaatatcgatccgagaagaattgaagaggcgattacccctgaaacgcaggcaataatgccggtgcactgctatgggaatccttgcgatacacaagctattgctgatattgcgcaaaaatataatttaaaggtcatttatgatgctgcgcatgcctttggcgttgaagatgatgatggaagtgttcttcgccatggagatctaagtgtcttaagtttccatgcaactaaagtgttcagcacttttgaaggcggagctattgtgtgtaatagtaaagaaatgaaagaaaaaattgatagactaaaaaactttggttatatcgatgaaactaacatcaatatcattggctctaatggaaaaatgagcgaagttaatgctgctttcggcttgctacaattagaacatatggatacttttctacgtggtcgaatgaatgctgacatgttttatcggcagaaacttaaagatatcactggtataagcatagtaattcccagcggccagaaaatatcgaatttttcatatttccctatattggttgaatctgattttccgttatctcgtgatgaactatttaattatctgaagaaccagaatatttttgcaagacgttatttttatcctgttataccagattttcaagcgtatttgaatgtaggtgaagtctgtgatgtcaagaatgcccgtgaaatagcctcgaaagtgctttgcctaccgatgcatgcagaattgagctctgatatcttagaatatattgtaagtacgattagggagattaaatga

SEQ ID NO: 43546 - protein, 367 aa, Shigella dysenteriae
MEKPIFVTQPNLPPLEEFIPYLEIIWQNKQFTNNGPMHQKLEKKLCEFLGVEYISLFNNGTIALITAVQALGVKGEVITTPYSFVATAHSLVLNGLKPVFVDIDPKTLNIDPRRIEEAITPETQAIMPVHCYGNPCDTQAIADIAQKYNLKVIYDAAHAFGVEDDDGSVLRHGDLSVLSFHATKVFSTFEGGAIVCNSKEMKEKIDRLKNFGYIDETNINIIGSNGKMSEVNAAFGLLQLEHMDTFLRGRMNADMFYRQKLKDITGISIVIPSGQKISNFSYFPILVESDFPLSRDELFNYLKNQNIFARRYFYPVIPDFQAYLNVGEVCDVKNAREIASKVLCLPMHAELSSDILEYIVSTIREIK

SEQ ID NO: 43547 - DNA, 1086 bp, Yersinia enterocolitica
  CDS (1)..(1086)
atgataataccaatatatcagcctagcctaggtggaaaagaaaaggagtatgtaaataaatgtcttgataccacttggatatcctcaaaaggggagtttatatctaagtttgaagaatccttctccaaatatataggtgccaaatattccactactgtatgtaatggaacggttgctttacacttagctttagaagctttagggattggagtaggcgatgaagttattgttccgtcattgacttatattgcttcggttaatactatcatgcagacgggggcaaaagtagtatttgttgattcagaattagacacttggaatatagatatacaggatgttcgcagaaagataacatgtaaaaccaaggctattatggttgtacatttatatgggcttccatgtaatatggatagtattaaatctctttgcgacaataatagtttattattaattgaagattgtgctgaagcttttggatctaaacttaatggacgacatgtaggtacctttggtgatgttagtacatttagtttttttggcaataagacaataactacaggtgaaggggggatggtagtttgtcgagataaagaaatttatgaaaaggcatgccatttaaaaaatcaaggtgtatcggcctcccgtgaatattggcatgatatattagcatttaattataggatgacaaatatttgtgctgctataggtttagctcaactagaaagggcagatcaaattattgagaaaaaacgctcaatttcagattggtataaattatatttaaaagatctccctctctccatacatcatgagtatgatggtgctacacattcatactggatgtgctctattttggttaatgattctaatcaacgagatcctttaagaaaatatttgaagggacataatatagaaacaagacctgtttttcctccatctcatctaatgccgcattgttttagtccagaggtgttcccaatagctgagagtattagtatcagtgggattaatttacctagctatcctgatttaattgaggaagacataaagatgatttctgtgcatattagaaatttctttagttaa

SEQ ID NO: 43548 - protein, 361 aa, Yersinia enterocolitica
MIIPIYQPSLGGKEKEYVNKCLDTTWISSKGEFISKFEESFSKYIGAKYSTTVCNGTVALHLALEALGIGVGDEVIVPSLTYIASVNTIMQTGAKVVFVDSELDTWNIDIQDVRRKITCKTKAIMVVHLYGLPCNMDSIKSLCDNNSLLLIEDCAEAFGSKLNGRHVGTFGDVSTFSFFGNKTITTGEGGMVVCRDKEIYEKACHLKNQGVSASREYWHDILAFNYRMTNICAAIGLAQLERADQIIEKKRSISDWYKLYLKDLPLSIHHEYDGATHSYWMCSILVNDSNQRDPLRKYLKGHNIETRPVFPPSHLMPHCFSPEVFPIAESISISGINLPSYPDLIEEDIKMISVHIRNFFS

SEQ ID NO: 43549 - DNA, 1275 bp, Streptomyces tenebrarius
  CDS (1)..(1275)
atgcccgtccacctcgcgatcaacaacggaacacccgtgcgcacccggccgtggccggtctggccccagcccgccaggggcgcgctcgacgcgctggagcgcgtgctgcgctcgggccgctgggcgatcagcggcccctaccggggcatcgagtcggccgagcgccgcttcgccagggacttcgccgcctacaacggggtcgcgcactgcgtccccgccgccagcggcacggccagcctcatgctcgcgctggagtcctgcggcgtgggcgtcggcgacgaggtcatcgcccccggcctgtcctgggtggcctcggcctccaccatcgtcggcgtcaacgccgtccccgtcctggtcgacatcgacccgaggaccctgtgcctggacccggccgcggtcgaggccgccatcacccccgccacgaaggccgtcgtcgtcgtgcacctgtactccgccgtggccgacctcgacgcgctgcgcgcggtcgccgaccggcacgggctgccgctgatcgaggactgcgcacaggcccacggggccgagcaccggggtcgcaaggtcggctccgtcggcgacgtcggcacgttcagcatgcagcacagcaaggtgctcaccagcggcgagggcggggccgcgatcaccaactccgccgagctggcccgcaggatggagcacctgcgcgccgacggccgctgctaccccgacaccgcccccgcgccgggccgcatggaactggtggagaccggggagctgatgggcagcaaccgctgcctgtcggagttccaggccgccgtcctcgtcgaacagctcagggaactggacgagcagaacgccctgcgccgccgcaacgccgaactgctcaacaccctcctcgccgagcaggggctgcgcccgcaggccacctcgccgggcaccacgtcccgcacctactacgtctacgcggcggagctgcccgacgacgcgttcgtcggcctcccgatcaccacggtgaccgaggcgctcaccgccgaactcggtttccccatctcgccggcgtacgcgccgctgcacaccaaccggctctacgcgccggcctcccgccgtcggttcgcgctcggcgaggagcacgagaagcggatcgaccccgcccggttccacctgccggtgtgcgagcggctcacccggcgcctgatcaccttccaccacgccgcgttgctgggcgacgagtccgacatgcacgacatcgccgccgccgtcgccaaggtgctgcggcaccacggggagctgcgggcctga

SEQ ID NO: 43550 - protein, 424 aa, Streptomyces tenebrarius
MPVHLAINNGTPVRTRPWPVWPQPARGALDALERVLRSGRWAISGPYRGIESAERRFARDFAAYNGVAHCVPAASGTASLMLALESCGVGVGDEVIAPGLSWVASASTIVGVNAVPVLVDIDPRTLCLDPAAVEAAITPATKAVVVVHLYSAVADLDALRAVADRHGLPLIEDCAQAHGAEHRGRKVGSVGDVGTFSMQHSKVLTSGEGGAAITNSAELARRMEHLRADGRCYPDTAPAPGRMELVETGELMGSNRCLSEFQAAVLVEQLRELDEQNALRRRNAELLNTLLAEQGLRPQATSPGTTSRTYYVYAAELPDDAFVGLPITTVTEALTAELGFPISPAYAPLHTNRLYAPASRRRFALGEEHEKRIDPARFHLPVCERLTRRLITFHHAALLGDESDMHDIAAAVAKVLRHHGELRA

SEQ ID NO: 43551 - DNA, 1392 bp, Micromonospora echinospora
  CDS (1)..(1392)
atggtcggcctgtcctgcaagcccggcttggccggtttttgcacgtcgacactggtgattgtgtctggcacacttggccggggccgcgatctaacggttgccgcagtctggcttggggaggacgtgaaagtgacccttcttgccgtcaatggtggttcccctatacgttcgcagcagtggccgttgtggcccgctcctgcgcccggcgccctcgacgccctgaatgaggttctccattccggtcggtgggccatcagcgggccatatcaggggaagcagagcttcgagcggcgattcgcagcggcgttcgccgagttccacgagatcgggcactgtgtgccgacctccagcgggacggccagcctcatggtcgcgctcgaggcatgcggggtcggtgccggtgacgaggttatcatcccgggcctgacctgggtcgccaacgcatccaccgtcgccggggtcaacgcggtgcccgtcccggtcgacgtggatccgcagaccctctgtctcgacccggcggccgtcgagcgggcgatcaccccgcgaaccgcggccatcgtcgtggtccacctctactccgccgtggcggacctggacgcgttgaccgcgatcgccgagcggcacgagatcccgctgatcgaggactgcgcgcaggcacacggcgcgcgctaccgcgaccgtcgggtcggcacgttcggcgccttcggcaccttcagcatgcagcacagcaaggtcctgaccagcggtgagggcggtgccgtcatcaccggggacgccgcactctcccggcgggccgagcacctgcgggcggacggccgcacctacacgccggacgagcccgccgtgggagagatggaactggcccagaccgccgagctgatgggcagcaaccggtgcctgtcggagttccaggcggcgctcctcctcggtcagctcgaacttctcgacgagcagaacgaacggcggcgggccaacgcggccctgctcgacgagggtctcggcgcgctcggcatccagccccaggtctcctcgcccggcaccaccgagcgcacctactacgagtgggccggtcggatcgaagacgacgggatcgggcagatcggcgtcgagcggatcgccccggcggtcgccgccgaactctccggcgcggccatctacgccagctacccgccgatgaaccacaaccggctctaccagcccgccacgcgggcgcggttcaagggcatcgccggactcgacctgaccggctactcgttgccggtcgccgaggacgccggccagcgggtcgtcaccatccaccactcggcgctgctcggcgacgagtcggacatgaaggacatcgttcgcgccttcgagaaggtgttcgcgaatcaccgggaactacgcggctga

SEQ ID NO: 43552 - protein, 463 aa, Micromonospora echinospora
MVGLSCKPGLAGFCTSTLVIVSGTLGRGRDLTVAAVWLGEDVKVTLLAVNGGSPIRSQQWPLWPAPAPGALDALNEVLHSGRWAISGPYQGKQSFERRFAAAFAEFHEIGHCVPTSSGTASLMVALEACGVGAGDEVIIPGLTWVANASTVAGVNAVPVPVDVDPQTLCLDPAAVERAITPRTAAIVVVHLYSAVADLDALTAIAERHEIPLIEDCAQAHGARYRDRRVGTFGAFGTFSMQHSKVLTSGEGGAVITGDAALSRRAEHLRADGRTYTPDEPAVGEMELAQTAELMGSNRCLSEFQAALLLGQLELLDEQNERRRANAALLDEGLGALGIQPQVSSPGTTERTYYEWAGRIEDDGIGQIGVERIAPAVAAELSGAAIYASYPPMNHNRLYQPATRARFKGIAGLDLTGYSLPVAEDAGQRVVTIHHSALLGDESDMKDIVRAFEKVFANHRELRG

SEQ ID NO: 43553 - DNA, 1257 bp, Micromonospora echinospora
  CDS (1)..(1257)
atgacgcagaaactggccatcctcggtggcgaccccgtccggacccggccctggcccgagtggccgcacgtcggcccggaggacgtggatcggctgcggaccgtcatcgagagccgcaacctcggcggcatccccttcccgaacaccatgcaccagcagttcgccgagcggttcaccgccaagctcggggcgaagtacggcctcctggcgaccaacggcacggtgaccctctcgatggcgctgcgcgcgctcgggatccatgccggtgacgaggtgatcaccaccgccttcacctgggtcgggacggtcgccggcatcgtgcacgtcaacgccgtgccggtgctggcggacatctccgacgacaactggtgcatcgacccggtgaaggtcgaggaggcgatcaccgaccggaccagggcgatcatggtggtgcacctgggcaaccaggtcgccgacatggacgcgctgctggacatctgccgccggcacaacctgctgctcatcgaggactgcgcgcacgcgcacttcgcggagtggcggggccggtgcgtcggcaccatcggcgacgccggcagctacagcttcgagaccagcaagatcatgacctcgggcgagggtggcttcctggtcaccgcaaccgaggaggcgttccaccgggcgatgtccctggcgcacgtcggccgcaaggaggccccgtacgacaggttcccgggccgggtcttcggctggaaccaccgggccaccgagatgcaggcggccgtcctgctggggcagctcgaccggtacgacgccctcgacaagcagcggaccgcgatggcggagatgctgacccaggggctggtcgagatcggcggcttcaagccgctggcggaggacccccgggtcacccgccggcagcgttacgagctgctcttccggttcgacaccgaggcctgggacgggctccaccgggacaaggtgctggaggcgatcctcgccgagggcgtcgagttcgaggggaacaccttctacccgccgatgcaccgcgacgagctgttccacatcaccgccgacgactggccggcgatccgggagcgctacggcgagaagatcgagccggacgcgttccacctgccggtggcggagcgggtggccttcgacgaagcggtgtggatccaccactccctgctgtcggtggagccggaggacgtacaggacatgctggatgcggtggtcaaggtccgggacaatctgggggcgctgaagaagagcctatga

SEQ ID NO: 43554 - protein, 418 aa, Micromonospora echinospora
MTQKLAILGGDPVRTRPWPEWPHVGPEDVDRLRTVIESRNLGGIPFPNTMHQQFAERFTAKLGAKYGLLATNGTVTLSMALRALGIHAGDEVITTAFTWVGTVAGIVHVNAVPVLADISDDNWCIDPVKVEEAITDRTRAIMVVHLGNQVADMDALLDICRRHNLLLIEDCAHAHFAEWRGRCVGTIGDAGSYSFETSKIMTSGEGGFLVTATEEAFHRAMSLAHVGRKEAPYDRFPGRVFGWNHRATEMQAAVLLGQLDRYDALDKQRTAMAEMLTQGLVEIGGFKPLAEDPRVTRRQRYELLFRFDTEAWDGLHRDKVLEAILAEGVEFEGNTFYPPMHRDELFHITADDWPAIRERYGEKIEPDAFHLPVAERVAFDEAVWIHHSLLSVEPEDVQDMLDAVVKVRDNLGALKKSL

SEQ ID NO: 43555 - DNA, 1173 bp, Escherichia coli O157
  CDS (1)..(1173)
gtggacaggtattcaatggcggaaggaaaagcaatgtcagaatttttgcctttttcgagaccagcaatgggcgtggaggaactcgctgcagttaaagaggttctcgaatccggttggatcacaaccggtccgaagaatcacgcgcttgaacaagccttttgccagttgacgggaaatcagcatgccatcgcggtcagttcagccaccgccggaatgcatatcacgctaatggcgttggaaattggcaagggcgatgaagtgattacgccttccctgacctgggtttcaaccctcaatatgatttccttgcagggtgcaacgccggtaatggtggatgtcgatcgcgatacgctgatggtcacgcctgaagcgatcgaatcagccattacgccacgcactaaagccatcattccggtgcattatgccggtgcgccagcagatattaacgccattcgcgccattggcgaacgttacggcatcgcagttatcgaagatgctgcccatgccgtaggtacgtattacaaagggcgacatattggcgcaaaaggtaccgctattttttcatttcatgccattaaaaatattacctgtgcggaaggaggcctgattgttactgataatgaaaatattgcccgccagctacggatgctgaaatttcacggcctgggtgtcgatgcctatgacagacaaacctggggccgtgcaccgcaggctgaagtcttaacgccgggctataagtacaatctgaccgatattaacgccgcgattgccctgacacagttagccaaattagagcacctcaacacccgtcggcgcgaaattgcccagcaatatcagcaagcactggcagctctcccctttcagccattaagccttcccgcctggccgcacgttcacgcctggcatctgtttattattcgtgtcgatgaacaacgttgtggtatcagtcgcgatgcgttgatggaagcgttaaaagaaagaggtattggtaccgggttacatttccgcgccgctcacacacaaaaatattatcgcgagcgttttccctcgctgtcgttaccgaataccgaatggaatagcgaacgcatctgttctttgccgctgttcccggatatgactaccgccgatgccgaccgtgtcatcacagcccttcagcaactcgcaggacaataa

SEQ ID NO: 43556 - protein, 390 aa, Escherichia coli O157
MDRYSMAEGKAMSEFLPFSRPAMGVEELAAVKEVLESGWITTGPKNHALEQAFCQLTGNQHAIAVSSATAGMHITLMALEIGKGDEVITPSLTWVSTLNMISLQGATPVMVDVDRDTLMVTPEAIESAITPRTKAIIPVHYAGAPADINAIRAIGERYGIAVIEDAAHAVGTYYKGRHIGAKGTAIFSFHAIKNITCAEGGLIVTDNENIARQLRMLKFHGLGVDAYDRQTWGRAPQAEVLTPGYKYNLTDINAAIALTQLAKLEHLNTRRREIAQQYQQALAALPFQPLSLPAWPHVHAWHLFIIRVDEQRCGISRDALMEALKERGIGTGLHFRAAHTQKYYRERFPSLSLPNTEWNSERICSLPLFPDMTTADADRVITALQQLAGQ

SEQ ID NO: 43557 - DNA, 1131 bp, Streptomyces sp
  CDS (1)..(1131)
atgaccacctacgtctgggactacctcccggagtacgagaacgaacgcgacgacctcatcgacgcggtggacaccgtcttccgctccggccgcctcatcctcggcccgtcggtcgagggcttcgagagcgagttcgccgcctaccacggcctcgcgcactgcgccggcgtggacaacggcaccaacgccgtgaagctcggcctccaggccctcggcgtcggccccggcgacgaggtcatcaccgtctccaacaccgccgcgcccaccgtcgtcgccatcgacggcaccggagccacccccgtgttcgtggacatccgcgaacaggacttcctgatggacaccgaccagggggcggcggccatcaccccccggaccaaggtcctgctgcccgtccacctctacggccagtgcgtggacatggccccgctggagcgcctcgccgcacagcacggcctgaagatcctcgaggactgcgcccagtcgcacggcgcccaccaccacggccggacggcgggcaccatcggcgacgccgcggccttctccttctacccgaccaaggtcctcggcgcgtacggcgacgccggcgcggtcgtcaccgacgacccggaggtcgacgccgccctgcggcgcctgcgctactacggcatggcggagacctactacgtcgtccagacccccggacacaactcccgcctcgacgaggtgcaggccgagatcctccggcgcaagctccgccgcctcgacacctacatcgagggccgccgggcggtcgcccgccgctacgaggaggggctcggggacctcgtcgcgccggacgggctccggctgcccgtcaccgccgagggcaacgaccacgtccactacgtctacgtcgtccgccacccccggcgcgacgagatcatcgagcggctcaagggctacggcatctcgctgaacatcagctacccctggccggtgcacacgatgagcggcttcgcacacctcggatacgccccgggctcgctgcccgtgaccgagcggctggccggcgagatcttctccctgccgatgtacccctcgctctccgaggacgtccaggacaaggtgatctccgccctgcgggaggtcctcaccgaggggacccggtcatga

SEQ ID NO: 43558 - protein, 376 aa, Streptomyces sp
MTTYVWDYLPEYENERDDLIDAVDTVFRSGRLILGPSVEGFESEFAAYHGLAHCAGVDNGTNAVKLGLQALGVGPGDEVITVSNTAAPTVVAIDGTGATPVFVDIREQDFLMDTDQGAAAITPRTKVLLPVHLYGQCVDMAPLERLAAQHGLKILEDCAQSHGAHHHGRTAGTIGDAAAFSFYPTKVLGAYGDAGAVVTDDPEVDAALRRLRYYGMAETYYVVQTPGHNSRLDEVQAEILRRKLRRLDTYIEGRRAVARRYEEGLGDLVAPDGLRLPVTAEGNDHVHYVYVVRHPRRDEIIERLKGYGISLNISYPWPVHTMSGFAHLGYAPGSLPVTERLAGEIFSLPMYPSLSEDVQDKVISALREVLTEGTRS

SEQ ID NO: 43559 - DNA, 1104 bp, Rhizobium leguminosarum bv
  CDS (1)..(1104)
atgaaagttcctttcgctgatcttcatctccaatatctctcgctaaaggaggagatcgatgctgcaattgcttcagtcatccggtcttcctcgtttatcagggggccattcgttcagaagttcgaggacgaatttgccgcgcccgtcggcgccccttattgcatctcatgtgctaatggaacggactcactcttcatcgccatgcgcgcgctaggcgtcagacttggggatgaagttattacgactgcccattcgtggatttcaactaccgagaccatttcacaggccggcggcaatgttgtcttctgcgacaccgacgcttcgacatacacaatcgatcctgttcaaatcgaagcgaggatcacgcctcgaacggttggcatcatcccggttcatctctatggccaaccggccgatatgactgctatcatggcgatcgcccggaagcacggtctctgggtcatagaggattgtgctcaatcccatcttgctgagattgatgggcaggtcgtcgggagcttcggggatgtcgcttcctattctttctacccgggaaagaaccttggcgcgatgggcgacgcaggcgccattacctgcaaggacaaatcacttgccgatcggatggcaatgtttgcgcggcatggcgggctttcaaagggcgaccaccagatcgaaggcataaatagccgcctcgacggactgcaggccgcgattctgtcggtgaagctgccgcgtctgcctgaatggactgcaaagcggcaggaatgggcgaggcgatatgcgcgcgccctcgaggatattggtcagctggaactgcctgaaacggcagccggacgaaatcacgtctatcacctgtttgtgatcaagcacgagcggcgcgatgccctggccgcccacctcaatcatgccggcatccaaactgtggtcaactatccaatatcgctgccgttcctaccggcttacgaacgccttggccatcggccggaagattttcccaacgcgtttggaaatcaatccaagattctttcaattccgattttccctgaaatgacagaagctcaactcctgtacgtcgtagatacgatcaggggattcgccgagtga

SEQ ID NO: 43560 - protein, 367 aa, Rhizobium leguminosarum bv
MKVPFADLHLQYLSLKEEIDAAIASVIRSSSFIRGPFVQKFEDEFAAPVGAPYCISCANGTDSLFIAMRALGVRLGDEVITTAHSWISTTETISQAGGNVVFCDTDASTYTIDPVQIEARITPRTVGIIPVHLYGQPADMTAIMAIARKHGLWVIEDCAQSHLAEIDGQVVGSFGDVASYSFYPGKNLGAMGDAGAITCKDKSLADRMAMFARHGGLSKGDHQIEGINSRLDGLQAAILSVKLPRLPEWTAKRQEWARRYARALEDIGQLELPETAAGRNHVYHLFVIKHERRDALAAHLNHAGIQTVVNYPISLPFLPAYERLGHRPEDFPNAFGNQSKILSIPIFPEMTEAQLLYVVDTIRGFAE

SEQ ID NO: 43561 - DNA, 1143 bp, Campylobacter coli
  CDS (1)..(1143)
atgtttgaaaaagaaatttcttttataaaaagtctttttaataaagaaaatatcgccctacatgagccttgctttataggcaatgagaaaaaatatctcttagaatgtatcgataacggttttgtttcaagcgtaggagaatttgtaacgcgttttgaagaagctttaaaagaaaaaaccaaagcacgctttgtcatcgctacaaatacaggcacagcagctcttcatatcgctttactagctaatggtatcgatgaaaactgcgaagtcatcactcaaagcataagctttgtcgcaacggcaaatgctattgcttacacaggagctagggctatttttttagatatcgatgaaaatactttaagtttaggccctaaagctttacaaaattttttagaaaatcacagctatcaaaaagatggctttacttacaataaaatcacacataagcgcatcaaagcttgtgttgtaatgcacacttttggccttagtgctgacatagaaaagctttgcgaaatttgtaaaaattataatatttttttaatcgaagatgccgccgaagctttaggaagcacttataaaaacaaagctttaggtacttttggaaaatgtggaattttaagttttaatggaaacaaaatcatcacaggtggaagtggcggagcgattttatgcgatgatgaaaatttggcaaatcttgcaaagcatttaagtactactgctaaaatacctcatccttatgaatacgatcatgatatcataggctataattatagactgtgcaatataaatgccgcaattttacttgcgggacttgaaaagctagatttcttcctagaaaacaaaagagaattggcacaaatttataaggaattttttacaaatcataaagcttgtaaatttatagatgaaagaaaaaattcaaaaagcaatttttggctcaacgctttatgttttaaagatggaaatttaagaaatacatttttacaagaatgtttagaaaacaatatttttgcgcgtcctgtatggaaaagcttacctagccttaaaccttttcaaacttggcaaaaagatgagcttttaaatactcaaaaattagaaaaatgtttggtaaatttacctagcagtgtaagattaaactag

SEQ ID NO: 43562 - protein, 380 aa, Campylobacter coli
MFEKEISFIKSLFNKENIALHEPCFIGNEKKYLLECIDNGFVSSVGEFVTRFEEALKEKTKARFVIATNTGTAALHIALLANGIDENCEVITQSISFVATANAIAYTGARAIFLDIDENTLSLGPKALQNFLENHSYQKDGFTYNKITHKRIKACVVMHTFGLSADIEKLCEICKNYNIFLIEDAAEALGSTYKNKALGTFGKCGILSFNGNKIITGGSGGAILCDDENLANLAKHLSTTAKIPHPYEYDHDIIGYNYRLCNINAAILLAGLEKLDFFLENKRELAQIYKEFFTNHKACKFIDERKNSKSNFWLNALCFKDGNLRNTFLQECLENNIFARPVWKSLPSLKPFQTWQKDELLNTQKLEKCLVNLPSSVRLN

SEQ ID NO: 43563 - DNA, 1401 bp, Pseudomonas aeruginosa
  CDS (1)..(1401)
atgactccgtcatgggccttttcgttcgcagggactgtacctgtgtcgctggagggtatgttccgcaaggtctacggaaacacgggagaatttgtcagaagtttgactgccgactcgcgccgcagcgcctgtggaacagccaggggccgcgcgaccaggggctttgacctgcatcaggctctttgggtacgggccttgcatagagtggcgtgctcgggtttttcgccctttactcgcctgagtatccattcatcagggccctacatgaacaacaagacgatcccggtcaccagcccgctgctgccgcccctggaagagttcatcccctacctggaaaagatctgggagagccgtttcctgaccaacgggggcgacatgcaccatgcgttggaagaggccctgtgcgagtacctgggggtgaagcacatcgtgctcttcgccaacgccaccctggcgctcatcaccgcgctgcaggcattgcgggtgaccggcgaggtgatcaccacgccgtactcctccgtcgccaccagccacgcgctgctgtggaacgggctcaagccgatcttcgtggacatcgaccaggactccatgaatctcgacccgtcgcggatcgaggcggcgatcaccccgcagaccaccgcgatcctgccggtgcattgctacggcaacccctgcgatgtcgaggcgatccagcggatcgccgatatccaccacctgaaggtcatctacgatgccgcgcatgccttcgccgtgcgcgacgccggcggcagcgtactgcgccacggcgacctgagcatcctcagcttccatgccaccaaggtgttcaacaccttcgagggcggtgcgatcatctgctcggacgaaaacacccggcaacgcctcaaccaccttaagaatttcggcttcgtcgacgaggtcacggtggtcatgcccggcatcaacggcaagctcaacgaggtcggcgctgccttcgggctgctgcaactcaagcacgtcgaccaggccctggagcagcgcagggagatcgccgagcgctatcggcgcctgctggccggcgtccctggcatccagtgcctccggcctggtacccagaccttcgccagcaacgcctatttcccgatcctggtggaagacgattttccgctttcgcgcgacgagctgtaccagcgcctgcgcgacagggatgtgctggtgcggcgctacttctacccactcatcagcgacttccccatgtaccattcgctgccctcggcggcgcccgccaatcttccggtggcgcggtcgatttcctcgcgagtgctgtgcctgccgatctatcccgggctggccgccgcagacgtcgagttcgtcgccggcctgatcgcttccgccgccatgccgcggcggcgggcatcaagttga

SEQ ID NO: 43564 - protein, 466 aa, Pseudomonas aeruginosa
MTPSWAFSFAGTVPVSLEGMFRKVYGNTGEFVRSLTADSRRSACGTARGRATRGFDLHQALWVRALHRVACSGFSPFTRLSIHSSGPYMNNKTIPVTSPLLPPLEEFIPYLEKIWESRFLTNGGDMHHALEEALCEYLGVKHIVLFANATLALITALQALRVTGEVITTPYSSVATSHALLWNGLKPIFVDIDQDSMNLDPSRIEAAITPQTTAILPVHCYGNPCDVEAIQRIADIHHLKVIYDAAHAFAVRDAGGSVLRHGDLSILSFHATKVFNTFEGGAIICSDENTRQRLNHLKNFGFVDEVTVVMPGINGKLNEVGAAFGLLQLKHVDQALEQRREIAERYRRLLAGVPGIQCLRPGTQTFASNAYFPILVEDDFPLSRDELYQRLRDRDVLVRRYFYPLISDFPMYHSLPSAAPANLPVARSISSRVLCLPIYPGLAAADVEFVAGLIASAAMPRRRASS

SEQ ID NO: 43565 - DNA, 1140 bp, Shigella flexneri
  CDS (1)..(1140)
atgtcagaatttttgcctttttcgcgaccagcaatgggcgtggaggaactcgctgcagttaaagaggttctcgaatccggttggatcacaaccggtccgaagaatcaggcgcttgagcaagccttttgccagttgacgggaaatcagcatgccatcgcggtcagttcagccaccgccggaatgcatatcacgctaatggcgttggaaattggcaagggcgatgaagtgattacgccttccctgacctgggtttcaaccctcaatatgatttccttgctgggtgcaacgccggtaatggtggatgtcgaccgcgatacgctgatggtcacgcctgaagcgatcgaatcagccattacgccacgcactaaagccatcattccggtgcattatgccggtgcgccagcagatattgacgccattcgcgccattggcgaacgttacggcatcgcagttatcgaagatgctgcccatgccgtcggtacgtattacaaagggcgacatattggcgcaaaaggtaccgctattttttcatttcatgccattaaaaatattacctgtgctgaaggtggcctgattgtaactgataatgaaaaccttgcccgccagctacggatgctgaaatttcacggtctgggtgtcgatgcctatgacagacaaacctggggccgtgcaccgcaggctgaagtcttaacaccgggctataagtacaatctgaccgatattaacgccgcgattgccctgacacagttagtcaaattagagcacctcaacacccgtcggcgcgaaattgcccagcaatatcagcaagcactggcagctctcccctttcagccattaagccttcccgcctggccgcacgttcacgcctggcatctgtttattattcgtgtcgatgaacaacgttgtggtatcagtcgcgatgcgttgatggaagcgttaaaagaaagaggcattggtaccgggttacatttccgcgccgctcacacacaaaaatattatcgcgagcgttttcccacgctgtcgttaccgaataccgaatggaatagcgaacgcatctgttcgttgccgctgttcccggatatgactaccgccgatgccgaccgcgtcatcacagcccttcagcaactcgcaggacaataa

SEQ ID NO: 43566 - protein, 379 aa, Shigella flexneri
MSEFLPFSRPAMGVEELAAVKEVLESGWITTGPKNQALEQAFCQLTGNQHAIAVSSATAGMHITLMALEIGKGDEVITPSLTWVSTLNMISLLGATPVMVDVDRDTLMVTPEAIESAITPRTKAIIPVHYAGAPADIDAIRAIGERYGIAVIEDAAHAVGTYYKGRHIGAKGTAIFSFHAIKNITCAEGGLIVTDNENLARQLRMLKFHGLGVDAYDRQTWGRAPQAEVLTPGYKYNLTDINAAIALTQLVKLEHLNTRRREIAQQYQQALAALPFQPLSLPAWPHVHAWHLFIIRVDEQRCGISRDALMEALKERGIGTGLHFRAAHTQKYYRERFPTLSLPNTEWNSERICSLPLFPDMTTADADRVITALQQLAGQ

SEQ ID NO: 43567 - DNA, 1149 bp, Micromonospora griseorubida
  CDS (1)..(1149)
gtgacgctcgtggcttcctccgctgacgcgttgtccgccaccaccccgacggtgccctttctcgacgtcggagcggcctaccacgagctgcgcgacgagatcgacgcggcctgtcgccgggtgctcgcctccggctggtacctgctcggcccggagatcgaggccttcgaggcggagttcgccgcctactgcggatccggatactgcgtcgcggtcaacagtggctgtgacgccctggaactggccctgcgcggtctcggcatcgggccgggtgacgaggtggtcgtcccgtcacacaccttcgtcgcctcctggctggcggtcaccgccaccggtgcgaccccggtgccggtcgagccggacgcgcaccggcccaccatcgccgccgaactcgtcgaggcggcgatcacaccacgtaccagggcgatcctgccggtccacctgtacggggagccggccgacctggacgcgctccacgacgtcgccgaccggcacggtctgcacgtcgtggaggacgccgcacaggccgtcggcgcccggtaccggggccggcggatcggagccgcgcccggtgtcgtcgcgttcagtttctatccgggcaagaacctgggcgcgttcggcgacggtggcgcggtcgtcaccgacgacccgcaactcgccgcccgggtaaggctgctgcgcaactacggttcggcccgcaagtacgagcacgagatgcagggccgcaactcacggctcgacgagatccaggcggcggtgctgcgggtcaagctgccccacctggaccgctggaaccgacggcgggcggcggtggcccagcggtacctgaccgggctcgccgggtgccccgggatccggcttccgcaaccgccgcgggacaccgatccggcctggcacctgttcgtggtccgggcggcccgccgggaggacctacgccggcacctggcccgggccggaatcgacacgctggtccactacccggtgccggtgcaccgttccggcgcgtacgcctcgacgcccctgccgcccggcggcctgccccgggccgagcggctggccgacgaggtgctcagcctgccgatcggcccgcacctgggcaccgcccacgtcgaccgggtgatcgaggtcgtgcgcgcctgggccgggtga

SEQ ID NO: 43568 - protein, 382 aa, Micromonospora griseorubida
MTLVASSADALSATTPTVPFLDVGAAYHELRDEIDAACRRVLASGWYLLGPEIEAFEAEFAAYCGSGYCVAVNSGCDALELALRGLGIGPGDEVVVPSHTFVASWLAVTATGATPVPVEPDAHRPTIAAELVEAAITPRTRAILPVHLYGEPADLDALHDVADRHGLHVVEDAAQAVGARYRGRRIGAAPGVVAFSFYPGKNLGAFGDGGAVVTDDPQLAARVRLLRNYGSARKYEHEMQGRNSRLDEIQAAVLRVKLPHLDRWNRRRAAVAQRYLTGLAGCPGIRLPQPPRDTDPAWHLFVVRAARREDLRRHLARAGIDTLVHYPVPVHRSGAYASTPLPPGGLPRAERLADEVLSLPIGPHLGTAHVDRVIEVVRAWAG

SEQ ID NO: 43569 - DNA, 1110 bp, Streptomyces sp
  CDS (1)..(1110)
atgaccacgcgtgtatgggactacctggcggagtaccgagccgagcgggcggacatcctcgacgccgtcgaaacggtcttcgagtcgggccagttggtgctcggcgcgagtgtgcgcggcttcgagaaggagttcgccgcctaccacggagtggaccactgcgtgggtgtcgacaacggaacgaacgccatcaagctcgctctccaggcccttggtgtcggccccggcgacgaggtgatcacggtgtccaacaccgccgcccccaccgtcgtcgccatcgactccaccggcgccacccccgtcttcgtcgacgtccgcgaggacgacttcctcatggacacgagccaggtcgaggcggccgtcaccgaacgcacccgctgtctgctcccggtccacctgtacggccagtgcgtcgacatggcgccgctgaaggagatcgccgcccggcacgggctggtcgtcctggaggactgcgcccaggcccatggcgcccggcagggcgacaccatggccggcaccaccggtgacgccgccgccttctccttctacccgaccaaggtcctcggcgcgtacggcgacggcggcgccacgatcaccggcgacgcgtccgtggccgcccgcctgcgacgcctgcgctactacggcatggacgagcgctactacaccctggagacccccgcccacaacagccgcctggacgaactccacgccgagatcctccgccgcaaacttcggcgcctcgacacctacgtcaagggccgccgtgccgtcgccgaacgctacgccgagggcctcgccgacaccgacctcgtcctgccgcgcacggtccccggcaacgaacacgtctactacgtgtacgtcgtccgccacccccggcgtgacgccgtcatcgagcgcctcaaggcccacgacgtccacctcaacatcagctatccgtggccggtgcacaccatgacgggcttcgcccacctcggctacgccaagggctcgctcccggtgaccgaggcactggccggcgagatcttctcgctgccgatgtacccctcgctcgcccccgacctccaggacaaggtcatccacgccgtacgcgaggtgctcgccacgctgtga

SEQ ID NO: 43570 - protein, 369 aa, Streptomyces sp
MTTRVWDYLAEYRAERADILDAVETVFESGQLVLGASVRGFEKEFAAYHGVDHCVGVDNGTNAIKLALQALGVGPGDEVITVSNTAAPTVVAIDSTGATPVFVDVREDDFLMDTSQVEAAVTERTRCLLPVHLYGQCVDMAPLKEIAARHGLVVLEDCAQAHGARQGDTMAGTTGDAAAFSFYPTKVLGAYGDGGATITGDASVAARLRRLRYYGMDERYYTLETPAHNSRLDELHAEILRRKLRRLDTYVKGRRAVAERYAEGLADTDLVLPRTVPGNEHVYYVYVVRHPRRDAVIERLKAHDVHLNISYPWPVHTMTGFAHLGYAKGSLPVTEALAGEIFSLPMYPSLAPDLQDKVIHAVREVLATL

SEQ ID NO: 43571 - DNA, 1104 bp, Escherichia coli
  CDS (1)..(1104)
atggaaaagccaatctttgtaacgcaacctaatttaccaccgctagaggagtttataccatatctggaaatcatttggcagaataagcaatttacaaataatggtccaatgcatcaaaaattagaaaaaaaattatgcgagtttcttggtgttgaatacattagtctatttaataatgggactattgcgcttataaccgcagtacaggctttgggtgttaaaggcgaagtaattaccacaccatattcctttgtagcaactgcacactccttggtcttaaatgggcttaaacctgtttttgtcgatattgattccaaaaccttaaatatcgatccgagaagaattgaagaggcgattacccctgaaacgcaggcaataatgccggtgcactgctatgggaatccttgcgatacacaagctattgctgatattgcgcaaaaatataatttaaaggtcatttatgatgctgcgcatgcctttggcgttgaagatgatgatggaagtgttcttcgccatggagatctaagtgtcttaagtttccatgcaactaaagtgttcagcacttttgaaggcggagctattgtgtgtaatagtaaagaaatgaaagaaaaaattgatagactaaaaaactttggttatatcgatgaaactaacatcaatatcattggctctaatggaaaaatgagcgaagttaatgctgctttcggcttgctacaattagaacatatggatacttttctacgtggtcgaatgaatgctgacatgttttatcggcagaaacttaaagatatcactggtataagcatagtaattcccagcggccagaaaatatcgaatttttcatatttccctatattggttgaatctgattttccgttatctcgtgatgaactatttaattatctgaagaaccagaatatttttgcaagacgttatttttatcctgttataccagattttcaagcgtatttgaatgtaggtgaagtctgtgatgtcaagaatgcccgtgaaatagcctcgaaagtgctttgcctaccgatgcatgcagaattgagctctgatatcttagaatatattgtaagtacgattagggagattaaatga

SEQ ID NO: 43572 - protein, 367 aa, Escherichia coli
MEKPIFVTQPNLPPLEEFIPYLEIIWQNKQFTNNGPMHQKLEKKLCEFLGVEYISLFNNGTIALITAVQALGVKGEVITTPYSFVATAHSLVLNGLKPVFVDIDSKTLNIDPRRIEEAITPETQAIMPVHCYGNPCDTQAIADIAQKYNLKVIYDAAHAFGVEDDDGSVLRHGDLSVLSFHATKVFSTFEGGAIVCNSKEMKEKIDRLKNFGYIDETNINIIGSNGKMSEVNAAFGLLQLEHMDTFLRGRMNADMFYRQKLKDITGISIVIPSGQKISNFSYFPILVESDFPLSRDELFNYLKNQNIFARRYFYPVIPDFQAYLNVGEVCDVKNAREIASKVLCLPMHAELSSDILEYIVSTIREIK

SEQ ID NO: 43573 - DNA, 1257 bp, Bacillus circulans
  CDS (1)..(1257)
atgaccattccatttgaccattggccagaatggcctcaacactccgatcgtacccgccgaaaaattgaagaagtgtttcagtcgaacagatgggcgataagcggatattggacgggcgaggaaagcatggaacggaaattcgccaaggcgtttgcggatttcaacggggtcccatactgtgtgccgacgacgagcggctccacggctttaatgcttgcccttgaagcgctcggaataggcgaaggggacgaagtcattgttcccagcctcacttggattgcaaccgctaccgccgtattaaacgtgaatgcgcttcctgtttttgtggacgttgaggcggatacgtattgtattgatcctcaattgataaagtcggccattacggataaaacgaaagccattatcccggtccatttgttcggaagtatggcgaatatggatgaaataaacgaaatcgcgcaagaacacaacctttttgtgattgaagactgcgcgcaaagccacggttccgtatggaacaaccagcgtgccggaacgataggagatataggggcgttcagctgtcagcagggcaaagtgttaacggccggagaaggggggattatcgtgacgaaaaatccccgtttatttgaactcatccaacaattgagagcggattccagggtttattgcgatgattcctccgaattgatgcacggtgacatgcagctggtaaaaaaaggggacattcaaggctccaactattgcttgtccgaatttcaatcggccatccttctggatcaacttcaggagctggatgacaagaacgcgatccgggaaaagaacgccatgttcttgaacgatgccttaagcaaaattgacggcattaaggtgatgaagcgccctcctcaagtcagcagacaaacttattacggctatgtattccggttcgatccggtgaaattcggcgggttgaatgcggatcagttctgtgaaattcttcgcgaaaagctcaatatggggacgttttacctgcatccgccgtatctccccgtacacaaaaatccgttgttctgcccctggacaaagaaccgttatttgaaatcggttcgtaagacagaagcttattggagagggcttcattacccggtctccgaacgtgcttccgggcaatccatcgttatccaccatgctattttactggctgaaccctcgcatctgtcgcttctggtcgatgccgtagccgaacttgcccggaaattttgcgtgactcattaa

SEQ ID NO: 43574 - protein, 418 aa, Bacillus circulans
MTIPFDHWPEWPQHSDRTRRKIEEVFQSNRWAISGYWTGEESMERKFAKAFADFNGVPYCVPTTSGSTALMLALEALGIGEGDEVIVPSLTWIATATAVLNVNALPVFVDVEADTYCIDPQLIKSAITDKTKAIIPVHLFGSMANMDEINEIAQEHNLFVIEDCAQSHGSVWNNQRAGTIGDIGAFSCQQGKVLTAGEGGIIVTKNPRLFELIQQLRADSRVYCDDSSELMHGDMQLVKKGDIQGSNYCLSEFQSAILLDQLQELDDKNAIREKNAMFLNDALSKIDGIKVMKRPPQVSRQTYYGYVFRFDPVKFGGLNADQFCEILREKLNMGTFYLHPPYLPVHKNPLFCPWTKNRYLKSVRKTEAYWRGLHYPVSERASGQSIVIHHAILLAEPSHLSLLVDAVAELARKFCVTH

SEQ ID NO: 43575 - DNA, 1083 bp, Pseudomonas aeruginosa
  CDS (1)..(1083)
gtgattgactttattgacctgcgggcgcagcaggcacgtattaaagataagctcgacctcgcaattgcccgggtacttgagcatggacaatatatacttggtcccgaggtggctgagttagagcaaaagctggccgattatgtcggggttcggcactgtatcagtgtagctaacgggacagatgccctgcagattgcgctgatggcattgaatgtaggggctggcgatgaagttattaccccgggattcaattatatagccactgcggaaacagctgcattactaggggcaacaccggtttatgtcgatgttgaccctcgctcatataatctagatccaaagctgctgaaagcagctatcacagcaagaactaaagcgattattcctgtatcgttgtatgggcagtgtgccgattttgacgagattaatgagattgcagcggagtatggtatccctgttattgaggatgctgctcagagttttggtgcaatctataaaggaaggcgctcctgtagtttgactaaaattgcatgcaccagctttttccctagtaaaccattgggttgttacggtgatggtggagcaattttcacggaagatgacggcttggccgaggtcatgcgccaaatagctcgacatggccaagaccgtcgctatcatcatatccgggtgggagtaaatagccgccttgataccttgcaggcagctatccttctttcaaagatggaagtttttgatgaggaaatgcagttacgccaaagagtagcacaacgttacagttctttattgcaggctgcagggcttgactctatgccctacattgagccgtataatgttagtgcttgggctcaatatactattcgtgtgaatgaacggtataatgttcagagctatcttaaagatgcaggtatcccaactgctgttcattatcctatccccctgaataaacagccggcggtttctaacgacaaagcatatctgccagttggggatatggttgcagaagaggtattgagtcttccaatgcacccttatctcactggcgaagcaattgagactattgttaaggctctcgtcaaatga

SEQ ID NO: 43576 - protein, 360 aa, Pseudomonas aeruginosa
MIDFIDLRAQQARIKDKLDLAIARVLEHGQYILGPEVAELEQKLADYVGVRHCISVANGTDALQIALMALNVGAGDEVITPGFNYIATAETAALLGATPVYVDVDPRSYNLDPKLLKAAITARTKAIIPVSLYGQCADFDEINEIAAEYGIPVIEDAAQSFGAIYKGRRSCSLTKIACTSFFPSKPLGCYGDGGAIFTEDDGLAEVMRQIARHGQDRRYHHIRVGVNSRLDTLQAAILLSKMEVFDEEMQLRQRVAQRYSSLLQAAGLDSMPYIEPYNVSAWAQYTIRVNERYNVQSYLKDAGIPTAVHYPIPLNKQPAVSNDKAYLPVGDMVAEEVLSLPMHPYLTGEAIETIVKALVK

SEQ ID NO: 43577 - DNA, 1233 bp, Streptomyces globisporus
  CDS (1)..(1233)
atgagcggcggcccggtgcgtctggactccctacccacgccctacttcagcgaaccgctgcacgtgggacgcccgaacgtgggctcccgcgaccgtttgatggaacggatcgacggggcgctggagcgcctgtggttcaccaatgacggccccctggtccgggagttcgaggcccgtgtggccgagctgacccaggtcaggcactgcgtcgccgtatcgaacgccaccaccggcatccaggtcgccgcgaaggccctgggcatcggtcctggggacgaggtgatcgtgccctccttcacctgggtcgccaccgcccacgcactggactggatcggtgcggtgcctgtcttctgcgaactggacgaggagaccggaaccgcggacgtggcacacgtggagcggctcatcggcccgcgtacccgcgccatcctggacgtgcacgtcttcggcagaccggcccggatcgacgagctgaccaagctggccgccgagcacgggctgcacctgctcttcgatgccgcccacgccttcggctgcacctaccggtcgaagccgatcggcggcttcggcacggcggagatcttcagcttccaggcgacgaagttcgtgaacagcttcgagggcggggcgatcgtcaccgacgacgacgccctggccgaccggctccgggccatgcgccaccaggggctcaacgccgcgcatgagatcaccgggagcggaacggtcgcgcggatgcacgagatcagcgcggccatgggcctcacctccctggagtccgccgatcacttcaccgcgatcaaccggcgcaactaccgtctgtacgagcagtacctcgacggactgcccggcgtccgggtccgcccgcaggatccgaacgagctgtcgaactgccagtacgtcgtcatcgaggtggacgccgtccgcgccgggctgcaccgcgacgaactccaggcggtgctccaacggcacaacgtcctggcccgcgcctacttcagccccggctgccacagctgcgagccctaccggtccgacctcgcgcgccacgcgcccgatccgctcccgaaggtggaggcgctcaccgagcgggtgctgtcgctgcccaccggtacggcggtggggccggaggaggtgcggggggtctgccgcattctgcgggcggccgtcgacgggagtgccgtgccggaaatccacgagagcacagagggagatgcaggcggccgtccggcgaggtga

SEQ ID NO: 43578 - protein, 410 aa, Streptomyces globisporus
MSGGPVRLDSLPTPYFSEPLHVGRPNVGSRDRLMERIDGALERLWFTNDGPLVREFEARVAELTQVRHCVAVSNATTGIQVAAKALGIGPGDEVIVPSFTWVATAHALDWIGAVPVFCELDEETGTADVAHVERLIGPRTRAILDVHVFGRPARIDELTKLAAEHGLHLLFDAAHAFGCTYRSKPIGGFGTAEIFSFQATKFVNSFEGGAIVTDDDALADRLRAMRHQGLNAAHEITGSGTVARMHEISAAMGLTSLESADHFTAINRRNYRLYEQYLDGLPGVRVRPQDPNELSNCQYVVIEVDAVRAGLHRDELQAVLQRHNVLARAYFSPGCHSCEPYRSDLARHAPDPLPKVEALTERVLSLPTGTAVGPEEVRGVCRILRAAVDGSAVPEIHESTEGDAGGRPAR

SEQ ID NO: 43579 - DNA, 1113 bp, Escherichia coli
  CDS (1)..(1113)
atgaaaaaaatagacttcctaaatctaaaaatgatgaatcaaccttatcgagcggatatactaaatgcaataactaaagttgttgattcggggtggtatattcaaggtgaagaagtcagaaatttcgaacatgagtttgcatcatttattggttcgaagtattgtgtcggtgttgccaatggcttagatgcattgagcattaccttaaaagcatggatattattaggcaaaattaaagaaggggatgaggtaatagttccagcaaatacatttattgcaactgtattagctatcacccaaaatcatcttaaaccaatatttgtagaaccagatgaagaaacattcaacattaatgttgatatgattagaaatgtcatcacggagaagactaaagttattatacctgttcatctttatgggcaggtggcagaaatgaataaaattcgtgaattagctgaccttcatgatctgttgattttggaggactctgcgcaagcacatggagccatgtataataaccttaaggcaggaaaccttggtgatgcaggcgcttttagtttctacccaggtaaaaacttgggggcattaggggatgctggtgctgtagtgactgacaatcaagagctggcagaaactataagagcaattggtaattatggtgcacatgtaaaatataaacatgatgtacaaggggttaatagccgtctagatgagattcaagcagcgattctacgggttaaattaaaatatataaacaatgaaatagaatctagaagaataatagcaaataactatttaacaaaaataatcaatccaattatcagattgcctaaaatagataataatgcagaattatcacatgtatggcatctctttgttataaaaacaaatgaaaggaataaactacaagattatttagctaaacatagtgttcaaacattgatccattatccaattcctatacataagcagttagcgtataataatctgaatacatattcttatccgataactgagaaattacatgatgaaatattatcacttccaattggtagctttttatctattgaagatgctgactatatagtatcattaattaatgaatttgaatag

SEQ ID NO: 43580 - protein, 370 aa, Escherichia coli
MKKIDFLNLKMMNQPYRADILNAITKVVDSGWYIQGEEVRNFEHEFASFIGSKYCVGVANGLDALSITLKAWILLGKIKEGDEVIVPANTFIATVLAITQNHLKPIFVEPDEETFNINVDMIRNVITEKTKVIIPVHLYGQVAEMNKIRELADLHDLLILEDSAQAHGAMYNNLKAGNLGDAGAFSFYPGKNLGALGDAGAVVTDNQELAETIRAIGNYGAHVKYKHDVQGVNSRLDEIQAAILRVKLKYINNEIESRRIIANNYLTKIINPIIRLPKIDNNAELSHVWHLFVIKTNERNKLQDYLAKHSVQTLIHYPIPIHKQLAYNNLNTYSYPITEKLHDEILSLPIGSFLSIEDADYIVSLINEFE

SEQ ID NO: 43581 - DNA, 1161 bp, Pseudomonas aeruginosa
  CDS (1)..(1161)
atgattccttacggtcgccaggatattacacaggcagatatcgatgctgtcgttggtgtgttgaaatcagatttccttacgcaggggccaatggtgccccgctttgaacaggcagttgcacagcacgtgggtgcatcgtatgcgcttgcagtcaacagcgcaacatcggcattgcatattgcttgtctggcgttaggtcttggtgctggcgactgtttgtggacaactccagttacttttgtggcttctgcaaactgtggattgtattgtggggcggaggtcgacttcgttgatattgatccccatacctacaatctttgtccagaggcgtttaggcgaaagttagagcaggcgtcgcttgaggggcgtctaccgaaggtactggttgtggtgcatctatgtggtcagccttctgatatgcgctcgattcatatgctggccaagcaatatggagtgaagattatcgaggacgcctctcatgctattggtgggaagtaccgaggcgagttcattggaaatggtcgatacagtgatataactgttttcagctttcatccagttaagatcattaccaccgcagagggagggatggtcttaactaatgatgctgaattagcacgaaagatggagctattgcgcagtcatggtattacccgtgagccggagagaatgactcacgcgcctgaggggccttggtattatcagcaaatagaattaggtttcaattatcgtatgacagaactgcaggctgcgcttggtcttacgcagatgcagcgccttgatgaatatgtcgaagcccgtcacttgttagctcagcgttataatcagtttttggctcatcttccgattactttaccataccagcatgaagatagttactcgggtttccatctttatgtgattcgtctgcagttagaaaaaatttctcctactcatcgtcaagtttttgagtctctgcgggaacagggtgtaggggttaatctgcactatattccggttcatactcagccctattacaagaaaatggggtttatcgaggatgatttcccaaatgccatggcctattatcacgaggctatcagccttcccatattccaaatgatgagtcatgaacagcagaatgaggtggtgctggcggtcgagagagctatacaatcatga

SEQ ID NO: 43582 - protein, 386 aa, Pseudomonas aeruginosa
MIPYGRQDITQADIDAVVGVLKSDFLTQGPMVPRFEQAVAQHVGASYALAVNSATSALHIACLALGLGAGDCLWTTPVTFVASANCGLYCGAEVDFVDIDPHTYNLCPEAFRRKLEQASLEGRLPKVLVVVHLCGQPSDMRSIHMLAKQYGVKIIEDASHAIGGKYRGEFIGNGRYSDITVFSFHPVKIITTAEGGMVLTNDAELARKMELLRSHGITREPERMTHAPEGPWYYQQIELGFNYRMTELQAALGLTQMQRLDEYVEARHLLAQRYNQFLAHLPITLPYQHEDSYSGFHLYVIRLQLEKISPTHRQVFESLREQGVGVNLHYIPVHTQPYYKKMGFIEDDFPNAMAYYHEAISLPIFQMMSHEQQNEVVLAVERAIQS

SEQ ID NO: 43583 - DNA, 1080 bp, Pseudomonas aeruginosa
  CDS (1)..(1080)
atgattgaattcatcgacctgaagaaccagcaagcgcgtatcaaggacaagatcgatgccggtatccagcgcgtgctgagacacgggcagtacattcttggcccggaagtcactgagcttgaggatcgcctcgccgatttcgtcggcgctaagtactgcatcagttgcgccaacggtactgacgctctacagattgtgcagatggccttgggtgttggcccaggtgacgaagtaatcacccctggttttacttatgttgcgacagcggagaccgtcgcgcttttgggagccaagccggtttacgtggatattgatccacgcacctacaatcttgatccgcagttgctggaggctgcgatcacaccgcgtacgaaggctatcattcctgtttcgctgtatggccagtgtgcagacttcgatgcaatcaacggcattgcctccaaatatggtatccctgtcattgaggatgctgcacagagcttcggtgcttcgtacaagggtaagcgttcttgtaatctgagtaccgttgcctgcaccagcttcttcccgagcaaaccgttgggttgctatggggatggtggagcgatcttcactaacgacgatgaactggctactgctattcgtcaaattgcccggcatggtcaggaccgccgctatcatcacattcgtgtgggggtgaatagtcggttggacacattgcaggctgcgattcttctaccgaagcttgaaattttcgaggaggagattgcgttgcgccagaaggtagccgcggagtatgacctatcactgaaacaggtcggtatcggcacgccgtttattgaagtgaataacatcagtgtttatgcccagtatacggtgcgtatggataatcgagagtctgttcaggcttctttgaaagctgccggggttccaactgctgtgcattaccctattccgcttaataagcagcctgctgttgcggatgagaaagcgaaactaccagtgggtgacaaggctgctactcaagtaatgagcctacccatgcatccctatctggatacggcatccatcaaaatcatctgtgctgcgttgacgaattga

SEQ ID NO: 43584 - protein, 359 aa, Pseudomonas aeruginosa
MIEFIDLKNQQARIKDKIDAGIQRVLRHGQYILGPEVTELEDRLADFVGAKYCISCANGTDALQIVQMALGVGPGDEVITPGFTYVATAETVALLGAKPVYVDIDPRTYNLDPQLLEAAITPRTKAIIPVSLYGQCADFDAINGIASKYGIPVIEDAAQSFGASYKGKRSCNLSTVACTSFFPSKPLGCYGDGGAIFTNDDELATAIRQIARHGQDRRYHHIRVGVNSRLDTLQAAILLPKLEIFEEEIALRQKVAAEYDLSLKQVGIGTPFIEVNNISVYAQYTVRMDNRESVQASLKAAGVPTAVHYPIPLNKQPAVADEKAKLPVGDKAATQVMSLPMHPYLDTASIKIICAALTN

SEQ ID NO: 43585 - DNA, 1161 bp, Pseudomonas aeruginosa
  CDS (1)..(1161)
atgattccttatggccggcaggagattacccaggcggatatcgacgcggtagtcgaggttcttaaatctgatttccttactcagggtcctatggttccccgttttgaacagaccgttgcggaacacgtaggggcgcgacacgctattgcggtgaatagcgcgacttctgctttgcatattgcttgtctagctttgggcctgggtgttggggattggttatggacgtcgccggtcacctttgtggcatcggccaattgcggcctttattgtggggcaaaagttgattttgtcgacatcgatccggcaacttataatatctgcccaaaggctctttctgaaaagcttgaagttgcaaggaaagatgggtgtgtgccgaaagtcttggttgttgtccatctctgcgggcaaccatgtgatatgaaggccatccgtgacttggcagaccaatatggcttcaagatcatcgaggatgcttcccatgccattggtgggcgctatctaggagagtatattggcaactgccgctatagcgatataaccatattcagttttcatcctgtgaaaattattacaaccgcagaaggcgggatggctttgaccaatgatgatggtttggccagtcgcatggttttgttgcgtagtcatggcattacacgtgtacccgaacagatgactcattcccctgacggcccttggtattatcagcaagtggacctgggcttcaactatcgcatgacggagttgcaagcggcgttaggtttaagtcagatgtctcgtttgaatgagtatgtcgagcgtcgccataaattggctcaacgttataacgaaaaattgtccaatttgccgctgaatacaccttggcaggatccgaggagctactctggattacatctctatgtcatacgtctcaagctaagcgagatagagaaaactcaccttgaagtgttcgagtctttgaggaagcagggtgtcggggtgaatttgcattacattcctgtacatactcagcctttttatgagcgcatggggttttctgttggagattttccggaagctgaagcttactatcgcgaagcgattagtttgcctatgtaccataccttgtctctggagcagcaggataaggttgtagaagccttggaacaggcgcttcttaaatga

SEQ ID NO: 43586 - protein, 386 aa, Pseudomonas aeruginosa
MIPYGRQEITQADIDAVVEVLKSDFLTQGPMVPRFEQTVAEHVGARHAIAVNSATSALHIACLALGLGVGDWLWTSPVTFVASANCGLYCGAKVDFVDIDPATYNICPKALSEKLEVARKDGCVPKVLVVVHLCGQPCDMKAIRDLADQYGFKIIEDASHAIGGRYLGEYIGNCRYSDITIFSFHPVKIITTAEGGMALTNDDGLASRMVLLRSHGITRVPEQMTHSPDGPWYYQQVDLGFNYRMTELQAALGLSQMSRLNEYVERRHKLAQRYNEKLSNLPLNTPWQDPRSYSGLHLYVIRLKLSEIEKTHLEVFESLRKQGVGVNLHYIPVHTQPFYERMGFSVGDFPEAEAYYREAISLPMYHTLSLEQQDKVVEALEQALLK

SEQ ID NO: 43587 - DNA, 1215 bp, Pseudomonas aeruginosa
  CDS (1)..(1215)
gtgagtgctgtgctgaatacacctttttctccgtggccatcattttccgaagaggaggccaatgccgttcgagatgttgtcctgtccaacagggtcaattactggaccggccaggagtgccgcgagtttgaaaaagaatttgcgacctgggccgactccaggttcgctgtcgctctcgctaatggaaccgttgccttggatgtagcactgaaggcccttgggatcggagttggcgatgaggtggtggtgacctcgcgaacattcctggcctctgcttcttccatcgtcaatatcggggccgttccagtattcgccgatgtcgacctggatacccagaacgtgaccgttgactccatccgtgctgtcctgaccgagcgcaccaaggcgatcatctgtgttcacctggcaggatggccgtgcgacatggacccgatcatggcgttggccgaggagcatgggctgaaggtggtcgaggattgtgcccaggcgcatggagctcgttataaagggcgttcggttggctccattggacacattagtgcttggtcgttctgccaggacaagataatgaccacgggaggagagggcggtatggtcactaccgacgaccgcgaactctggtcccgcatgtggtcgtacaaggatcacggaaagagttgggaggcggtctacgagcgggagcacgcgccgggtttccgttggctgcatgaaagtttcggtacgaatttccggatgatggaggtccaggctgtcatcggtcgtatccagctacgccggatgggcgactggcatgtccgccggcttgcgaatgcgcagcgcatctgggagaaagcccggaatctacctgggttacgagtaccgatcattcctgaaggtatcgaacacgctgcttataagtgctacgtattcgtggatccgccgcgtttggctgaggggtggacgcgtgatcgtatactgtccgaaatcgtcgcccgcggtgtgccgtgcttttctggctcatgctccgagatttatcttgaaaaggcgttcgattcgacggggtggcggccggaagtacgcttgcccaacgcggtgacgctgggtgaggacagcctcatgttcttggtccatccaaccttgagcgagagcgagattcagagaacactcgatgtgctggaggcagtcatgctggaggcctgccgggattctcaggtcgcgggggcgagtatcgggtaa

SEQ ID NO: 43588 - protein, 404 aa, Pseudomonas aeruginosa
MSAVLNTPFSPWPSFSEEEANAVRDVVLSNRVNYWTGQECREFEKEFATWADSRFAVALANGTVALDVALKALGIGVGDEVVVTSRTFLASASSIVNIGAVPVFADVDLDTQNVTVDSIRAVLTERTKAIICVHLAGWPCDMDPIMALAEEHGLKVVEDCAQAHGARYKGRSVGSIGHISAWSFCQDKIMTTGGEGGMVTTDDRELWSRMWSYKDHGKSWEAVYEREHAPGFRWLHESFGTNFRMMEVQAVIGRIQLRRMGDWHVRRLANAQRIWEKARNLPGLRVPIIPEGIEHAAYKCYVFVDPPRLAEGWTRDRILSEIVARGVPCFSGSCSEIYLEKAFDSTGWRPEVRLPNAVTLGEDSLMFLVHPTLSESEIQRTLDVLEAVMLEACRDSQVAGASIG

SEQ ID NO: 43589 - DNA, 1080 bp, Pseudomonas aeruginosa
  CDS (1)..(1080)
atgattgaattcatcgacctgaagaaccagcaagcgcgtatcaaggacaagatcgatgccggtatccagcgcgtgctgagtcacgggcagtacattcttggcccggaagtcactgagcttgaggatcgcctcgccgatttcgtcggcgctaagtactgcatcagttgcgccaacggtactgacgctctacagattgtgcagatggccttgggtgttggcccaggtgacgaagtaatcactcctggttttacttatgttgcgacagcggagaccgtcgcgcttttgggagccaagccggtttacgtggatattgatccacgcacctacaatcttgatccgcagttgctggaggctgcgatcacaccgcgtacgaaggctatcattcctgtttcgctgtatggccagtgtgcagacttcgatgcaatcaacgccattgcctccaaatatggtatccctgtcattgaggatgctgcacagagcttcggtgcttcgtacaagggtaagcgttcttgtaatctgagtaccgttgcctgcaccagcttcttcccgagcaaaccgttgggttgctatggggatggtggagcgatcttcactaacgacgatgaactggctactgctattcgtcaaattgcccggcatggtcaggaccgccgctatcatcacattcgtgtgggggtgaatagtcggttggacacattgcaggctgcgattcttctaccgaagcttgaaattttcgaggaggagattgcgttgcgccagaaggtagccgcggagtatgacctatcactgaaacaggtcggtatcggcacgccgtttattgaagtgaataacatcagtgtttatgcccagtatacggtgcgtatggataatcgggagtctgttcaggcttctttgaaagctgccggggttccaactgctgtgcattaccctattccgcttaataagcagcctgctgttgcggatgagaaagcgaaactaccagtgggtgacaaggctgctactcaagtaatgagcctacccatgcatccctatctggatacggcatccatcaaaatcatctgtgctgcgttgacgaattga

SEQ ID NO: 43590 - protein, 359 aa, Pseudomonas aeruginosa
MIEFIDLKNQQARIKDKIDAGIQRVLSHGQYILGPEVTELEDRLADFVGAKYCISCANGTDALQIVQMALGVGPGDEVITPGFTYVATAETVALLGAKPVYVDIDPRTYNLDPQLLEAAITPRTKAIIPVSLYGQCADFDAINAIASKYGIPVIEDAAQSFGASYKGKRSCNLSTVACTSFFPSKPLGCYGDGGAIFTNDDELATAIRQIARHGQDRRYHHIRVGVNSRLDTLQAAILLPKLEIFEEEIALRQKVAAEYDLSLKQVGIGTPFIEVNNISVYAQYTVRMDNRESVQASLKAAGVPTAVHYPIPLNKQPAVADEKAKLPVGDKAATQVMSLPMHPYLDTASIKIICAALTN

SEQ ID NO: 43591 - DNA, 1152 bp, Pseudomonas aeruginosa
  CDS (1)..(1152)
atgtttgatgcgttaattgattttgttcgtgagcaataccgcactcatgatttcattcctttgcatgctccggttttttctggaaatgaaaagaagtacgttgtcgaaactgtagattcgacttttgtgtcgagcgtaggcgctttcgttgaaaagttcgaaaataatatagcaacctatactgggtcgccgagagcagtagctacggttaacggtacggcagctttacatgtttctttattgcttgcgggggttaaagccggtgatttggttatcactcagccccttacatttgtcgctacatgcaatgcgattgcatattgcggcgcagagcctgtgttcattgatgtagaccgacataccctgggtctttctccgctagcgctcgcagcttggctggacgagcatgcccgtttggataatgatggagtatgtaggaccaaggttggagatcgtatattacgtgcttgtttgccaatgcatactttcggccacccggttgagttggacgccttgcttgaggtttgtgggcgttgggggttgattgtgattgaagatgctgccgaatcactcggaagtctctacaaaggtcgtcatactggtactttcggttcactcggcacattaagctttaatggcaataaaatcatcaccactggtggtgggggcatggtcctggcgggggaagagttaggagctagagccaaacatatcactacaactgccaaaaaacctcatgcatttgaatatgtacatgatgaagttggctacaattatcgccttcctaacctgaatgctgctctaggatgtgcgcagttagaaaatttagagtcgtttgtagcatccaaacgtttgctggcatcccgttataaagaattcttcgctaggcactccgttgaatttgtcatagaacctttgggatgtcgctccaattactggttaaatgcgattctttgcgagaatcagaggcagagggattctctcttggagataactaataaggttggagttatgactcgacctatttggaaactcatgacgcatcttcccgtatatgagaagtaccgacggggtgagttgacgaatgctttatggctagaagagcgggtggtaaaccttccgagtagcgtattgccggagccgtttccttga

SEQ ID NO: 43592 - protein, 383 aa, Pseudomonas aeruginosa
MFDALIDFVREQYRTHDFIPLHAPVFSGNEKKYVVETVDSTFVSSVGAFVEKFENNIATYTGSPRAVATVNGTAALHVSLLLAGVKAGDLVITQPLTFVATCNAIAYCGAEPVFIDVDRHTLGLSPLALAAWLDEHARLDNDGVCRTKVGDRILRACLPMHTFGHPVELDALLEVCGRWGLIVIEDAAESLGSLYKGRHTGTFGSLGTLSFNGNKIITTGGGGMVLAGEELGARAKHITTTAKKPHAFEYVHDEVGYNYRLPNLNAALGCAQLENLESFVASKRLLASRYKEFFARHSVEFVIEPLGCRSNYWLNAILCENQRQRDSLLEITNKVGVMTRPIWKLMTHLPVYEKYRRGELTNALWLEERVVNLPSSVLPEPFP

SEQ ID NO: 43593 - DNA, 1140 bp, Streptomyces narbonensis
  CDS (1)..(1140)
gtgaccgcccgcaccgagaccggccgggtccccttcctcgacctcaaggccgcctacgaggaactgcgcccggagaccgacgccgccatcgcccgcgtactcgactcggggcgctacctcctcggccccgaactcgaagccttcgaagccgagttcgccacctactgcgagaccgaccacgccgtcggcgtgaacagcggcatggacgccctccagctcgcgctccgcggcctcggcatcggacccggggacgaggtgatcgtcccctcgcacacgtacatcgccagctggctcgcggtctccgccaccggcgcgacccccgtgcccgtcgagccgaacgaggaccaccccaccctcgacccgctgctcgtcgagaaggcgatcaccccccgcacccgggcgctgctccccgtccacctctacgggcaccccgccgacctggacgccctccgcgacctcgccgaccggcacggcctgcacatcgtcgaggacgccgcccaggcccacggcgcccgctaccggggccggcggatcggcgccggtgcgtcggtggccgcgttcagcttctacccgggcaagaacctcggctgcttcggcgacggcggcgccgtcgtcaccggcgaccccgcgctcgccgaacggctccggatgctccgcaactacggctcccggcagaagtacagccacgagacgaagggcaccaactcccgcctggacgagatacaggccgccgtcctgcggatccggctcgcccacctcgacagctggaacggccgcaggtcgacgctggccgccgaatacctctccggactcgccggcctccccggcatcgccctgccggtcaccgcgcccggcaccgaccccgtctggcacctcttcaccgtgcgcaccgaccgccgcgacgagctccgcgaccacctcgactcccgcggcgtcgacaccctcacccactacccggtgccggtgcacctctcgcccgcctacgcgggccaagcacccccggaaggctcgctcccgcgggccgagagtttcgcccggcaggtcctcagcctgccgatcggcccgcacctggagcgcacgcaggcgctccgggtgatcgacgccgtgcgcgaatgggccgagcaggccggccggccctag

SEQ ID NO: 43594 - protein, 379 aa, Streptomyces narbonensis
MTARTETGRVPFLDLKAAYEELRPETDAAIARVLDSGRYLLGPELEAFEAEFATYCETDHAVGVNSGMDALQLALRGLGIGPGDEVIVPSHTYIASWLAVSATGATPVPVEPNEDHPTLDPLLVEKAITPRTRALLPVHLYGHPADLDALRDLADRHGLHIVEDAAQAHGARYRGRRIGAGASVAAFSFYPGKNLGCFGDGGAVVTGDPALAERLRMLRNYGSRQKYSHETKGTNSRLDEIQAAVLRIRLAHLDSWNGRRSTLAAEYLSGLAGLPGIALPVTAPGTDPVWHLFTVRTDRRDELRDHLDSRGVDTLTHYPVPVHLSPAYAGQAPPEGSLPRAESFARQVLSLPIGPHLERTQALRVIDAVREWAEQAGRP

SEQ ID NO: 43595 - DNA, 1167 bp, Actinosynnema pretiosum
  CDS (1)..(1167)
gtgcacctgaaggccccgcagaagctggagttccccgcctggccgcagttcgactcgaccgagcgcgaggccctgctgcgcacgctcgacagcggccggtggtggcggatcaccggggacgaggtcgtctcgttcgagcgggagttcgcgcaggcccacggcgcccggcacgcgctcgccgtcaccacgggcacgcacgccctcgaactcgtcctggaggtcatgggcgccgggcctggcaccgaggtgatcgtgcccgcgttcaccttcatctcctcctcgcaggccgcccagcggctcggcgcggtcgtcgtccccgtcgacgtcgacccggacacctactgcgtcgacccggccgccgtgcgggccgcgatcaccgagcgcaccagggcgatcatgcccgtgcacatggcgggccagctcgccgacatggacgcgctgcgcgccctgtccgccgagaccggcgtcccgctgctccaggacgccgcgcacgcccacggcgcgcggtggcgcggcgagcccctcggcgcgctcggctcgatcgccgccttcagcttccagaacggcaagctgatgaccgcgggcgagggcggcgccgtgctgctcccggacggggaccagcacgaggaggcgttcctgcgccacgcctgcgggcgcccgctcgccgaccgggcctaccaccaccgcacggccgggtcgaacttccgcatgaacgagttctccgccgcgctgctgcgcgcccagctcggcaggctccagcagcagaccgacgtgcgcgagcggcactggcccgtgctgtcgcggctgctcgccgaggtgcccggcgtcgtcccgcaggggaccgacccgcgctgcgaccgcaacccgcactacatggccatgttccaggtccccggcatcggcgaggagcgccgcgcccgcctggtcgacgcgctggtcgagcgcggagtcccggcgttcgccgggttccgcgcgatctaccgcaccgccgcgttctgggagcgcgccgcccccgacaccacggtggacgccctcgcccgcgcctgcccggtcacggaagcgctcagcagcgactgcgtgtggctgcaccaccgggtgctgctgggggcggaggagcagatgccgctggtggcggaggccgtcgcctgcgcgctggaggaggcctga

SEQ ID NO: 43596 - protein, 388 aa, Actinosynnema pretiosum
MHLKAPQKLEFPAWPQFDSTEREALLRTLDSGRWWRITGDEVVSFEREFAQAHGARHALAVTTGTHALELVLEVMGAGPGTEVIVPAFTFISSSQAAQRLGAVVVPVDVDPDTYCVDPAAVRAAITERTRAIMPVHMAGQLADMDALRALSAETGVPLLQDAAHAHGARWRGEPLGALGSIAAFSFQNGKLMTAGEGGAVLLPDGDQHEEAFLRHACGRPLADRAYHHRTAGSNFRMNEFSAALLRAQLGRLQQQTDVRERHWPVLSRLLAEVPGVVPQGTDPRCDRNPHYMAMFQVPGIGEERRARLVDALVERGVPAFAGFRAIYRTAAFWERAAPDTTVDALARACPVTEALSSDCVWLHHRVLLGAEEQMPLVAEAVACALEEA

SEQ ID NO: 43597 - DNA, 1284 bp, Streptomyces hygroscopicus
  CDS (1)..(1284)
atgtggggcggtaagagcggtgcctaccgtgaacgtcgcacatccggccatgtgccccgccccgctctatgccgtccgtcggccatcggccgagaaatattcgaaatgaagatttggagacgcatgaacgcgcgacggacaccagagttccccacctggccgcagtacgacgacggcgagcgcaccggcctgatccgggccctggagcagggccagtggtggcgcatgggaggctcggaggtggactccttcgagggtgagttcgcggacttccacggcgccccacacgctttggccgtcaccaacggcacccacgccctggagttggcgttgcagtgtctgggcgtcgggccgggcaccgaggtcatcgtgccggccttcaccttcatctcctcctcccaggccgctcagcggctgggagcggttgccgtccccgtcgacgtcgatctcgatacctacaacatcgacgtggctgccgcggcttccgccgtcacccccctcaccaaggcgatcatgcctgtgcacatggcggggctcatcgccgacatggacgcgctcggcgaactctccgccgacaccggtgtgcctcttctccaggacgccgcccacgcacacggtgcccgctggcagggcaaacgggtgggcgagttgggtacggtcgcctcgttcagcttccagaacggcaagctgatgaccgccggcgagggcggtgcgctgctcctgcccgacgaggagacctacgaggccgcgttcctgcggcacagttgtggccggtcacgtaccgaccgccgatacatgcaccagaccgccggcacgaacatgcggctcaacgagttctccgcggccgtgctccgcgcccagctgggccgcctcgacgcccagatcacgctccgcgatcagcgctggacgctgctgtcccggctgctcggtgagatcgacggcgtcgtaccccagggcagcgacccgcgcgccgaccggaactcccactacatggcgatgttccggatccccggcatatccgaggaggcccgcaacgccctcgtcgacacgctcgtcgaggccggcctgcccgccttcgccgccttccgggcgatctaccgcaccgacgcgttctgggagacggccgcgcccgacaccaccgtcgacaagctcgccgaaagctgcccgcacaccgaggcgatcagcaccgactgcatctggctgcaccatcgagtgctgctcgcctcggaggaggccctccacaccacagccgagatcatcgccgacgccgtggccgcacggtga

SEQ ID NO: 43598 - protein, 427 aa, Streptomyces hygroscopicus
MWGGKSGAYRERRTSGHVPRPALCRPSAIGREIFEMKIWRRMNARRTPEFPTWPQYDDGERTGLIRALEQGQWWRMGGSEVDSFEGEFADFHGAPHALAVTNGTHALELALQCLGVGPGTEVIVPAFTFISSSQAAQRLGAVAVPVDVDLDTYNIDVAAAASAVTPLTKAIMPVHMAGLIADMDALGELSADTGVPLLQDAAHAHGARWQGKRVGELGTVASFSFQNGKLMTAGEGGALLLPDEETYEAAFLRHSCGRSRTDRRYMHQTAGTNMRLNEFSAAVLRAQLGRLDAQITLRDQRWTLLSRLLGEIDGVVPQGSDPRADRNSHYMAMFRIPGISEEARNALVDTLVEAGLPAFAAFRAIYRTDAFWETAAPDTTVDKLAESCPHTEAISTDCIWLHHRVLLASEEALHTTAEIIADAVAAR

SEQ ID NO: 43599 - DNA, 1281 bp, Streptomyces ansochromogenes
  CDS (1)..(1281)
atgctgaccgtgaacgggaactcccggtacctcgtgccggcccccgcggtgggaagcatcctcgggggcgccgagctggccgcgctgggcgaggtcgtccggtccggcgagagcctctcgcaagggcggtggcgggaggcgttcgagcaggcgatgcgcgagcacgtcggcagccggtacgcgatgaccgtcaccagcggaaccgtcgccgtcgcgctcgccgtgcacctgctggacctcgcccccggcgacgaggtcatcgtgaccccgcagaccttcaaggccaccgccgaccccctgctggcccacgacgtgacggtccgtttctgcgacgtggagccggacaccctgaacgtggacgtcgactcgttcgagtcgctgatcaccccgcggacccgggccctgatcctggtccactacggcggccggccggcccgcatggacgagatcatgcgggtggcccgtcggcacggcgtccgggtgatcgaggactgcgcgcacgcgctgggcgccctctaccgtggccggcggccgggcgtgctcggcgacatcgggtgcttcagcttccactccagcaagaacatcacgaccctcggcgagggcggcatgctcaccttcgacgatcccgagtgggccgagcgcctcgaccgcatccgctccaacgccgccgacggggtcctcatcccgtcgccgctgtcggccgggccgtacgagcactcggagccctggatgatgtgggcgggggactcgtacgagaaggagtgcctgcgcatccggcaccccgggagcaacgccacgctcagcgaggccggggcggctgtggggctcgtccagctggagcgtctcggggagctggccgggcggcggcgatggatcgccgggcgcctcgcccggacgctggcggaggtgccgcaggtgcggctggccgacgtgcccgaggacgtcctccacccctaccacctgttcaccttcttcgtccggccgggacagggcgtgagccgcgacgaggtcatccacgccctggcggacgccggggtccaggtgcaggtgcgttacttccccttgcacctgcgccccgagtggcggggtcggggccaccggctcggcgagtgtccggtcaccgagcggctctggttccacgagcaggtcaccctgccctgctacccgtcgatgaccgacggccaggtggagcacctggtgctggccctgaagtccgcgctcaccggacggcgggacaccggcgagcgcggcacgtcgagttacgaggaggcccgggcatga

SEQ ID NO: 43600 - protein, 426 aa, Streptomyces ansochromogenes
MLTVNGNSRYLVPAPAVGSILGGAELAALGEVVRSGESLSQGRWREAFEQAMREHVGSRYAMTVTSGTVAVALAVHLLDLAPGDEVIVTPQTFKATADPLLAHDVTVRFCDVEPDTLNVDVDSFESLITPRTRALILVHYGGRPARMDEIMRVARRHGVRVIEDCAHALGALYRGRRPGVLGDIGCFSFHSSKNITTLGEGGMLTFDDPEWAERLDRIRSNAADGVLIPSPLSAGPYEHSEPWMMWAGDSYEKECLRIRHPGSNATLSEAGAAVGLVQLERLGELAGRRRWIAGRLARTLAEVPQVRLADVPEDVLHPYHLFTFFVRPGQGVSRDEVIHALADAGVQVQVRYFPLHLRPEWRGRGHRLGECPVTERLWFHEQVTLPCYPSMTDGQVEHLVLALKSALTGRRDTGERGTSSYEEARA

SEQ ID NO: 43601 - DNA, 1260 bp, Streptomyces virginiae
  CDS (1)..(1260)
gtgacggcggcgcagcgctacctggtgccgttccagcgccgggggagcatcgtgggccaggccgacctggcggcgctcgcctcggtcgtgcactcggcggagccgctgtcggcgggggtgtggcgcgagcggttcgagcagcgcttccgggaggtcaccggggcccgccacgcgctgtcggtgaccagcgggacggtggctctggagctggccgtccggctgctcgacctgcagcccggcgacgaggtgatcgccaccccgcagacgttccaggcgacggtgcagccgttgctcgaccacgacgtcaccgtgcggttctgcgacgtcgacccggacaccctgaacatggacccgcaggtcctggattcgctgatcaccgaccggacgaaggccatcctgctggtgcactacggcggccttccggcggacatggcggccatcctggcccgggcccgccgtgcgggcgtcgtggtggtggaggactgcgcgcacggctggggcgcttcctaccagggggacagccccggcgcgctcggcgacatcgggtgcttcagcttccactcgacgaagaacatcaccacgctcggcgaggggggcatgatcacgctgaaccgggccgactgggccgagcgggtcgagcggctgcggggcaacgaggtggacggggtgttcgccccggtgcccggcttcgcggacgacgagcccgcgctgctgccgtggatgcgcttctccgccgacgtctaccgccgccaggccgtcggtatccggggagcgggcaccaacgccaccatgtccgaggccgccgcggcggtcgggctggtccagctggatgcgctggagcggttcaccgagcgccgtcggtggatcgcggcccggctggacgccgccgtctcggcgtttccccggcacccgcctccaacgcacgccggaggcagcacccacgcctaccacctgtacacgttcttcgtcacggccgggcgtgagggtgcgcgagattcgtgcgcgcccctggaccgcaggggcgtggaggttcagctgcggtacttcccgctgcacctgctgcccgaagtggcggctgcgcggccacggtccgggcgagtgccgcaggccgagcgggtctggttcgacgagcacctgaacctgccctgccacccggggctcaccgacgagcaggtcgaccaccttgtcgagtcggtcaccgctgcgatgcacgaggccacggccctcgccaggacgggccggccgctggcggtccgatga

SEQ ID NO: 43602 - protein, 419 aa, Streptomyces virginiae
MTAAQRYLVPFQRRGSIVGQADLAALASVVHSAEPLSAGVWRERFEQRFREVTGARHALSVTSGTVALELAVRLLDLQPGDEVIATPQTFQATVQPLLDHDVTVRFCDVDPDTLNMDPQVLDSLITDRTKAILLVHYGGLPADMAAILARARRAGVVVVEDCAHGWGASYQGDSPGALGDIGCFSFHSTKNITTLGEGGMITLNRADWAERVERLRGNEVDGVFAPVPGFADDEPALLPWMRFSADVYRRQAVGIRGAGTNATMSEAAAAVGLVQLDALERFTERRRWIAARLDAAVSAFPRHPPPTHAGGSTHAYHLYTFFVTAGREGARDSCAPLDRRGVEVQLRYFPLHLLPEVAAARPRSGRVPQAERVWFDEHLNLPCHPGLTDEQVDHLVESVTAAMHEATALARTGRPLAVR

SEQ ID NO: 43603 - DNA, 1158 bp, Vibrio cholerae
  CDS (1)..(1158)
atgcattttatcccatttaacaaaccaccagtgactggcaatgaactaaaatatatttctcaagctgtttctggtgataagttatctggggatggaccattcgcaaaacaatgtgaggtatggcttgaaaagcatactcaaacaaaaaaagctttactcacaccttcttgcactcatgcactcgagcttgctgctttactgattgatattcaagctggtgatgaagtgattatgccaagctttactttcgttagtactgcaaatgcatttgtcctacgtggagccaaaattgtctttgtcgatattcgcccagacactatgaacattgatgaaaccaaaattgaatcagccattaccgctagaacaaaagcgatagtaccagtccactacgcaggagtcagctgtgatatgggtacaataatggcaatcgcgaataagtataaactatttgttatagaagatgccgcacaagggatgatgtctacatataaagatcaacctttgggctctattggtcatatggccgcatttagttttcatgagacaaaaaactacacgtctggaggagaaggaggcgcactcctgattaacgaccaacgttttattcaacgtgcagaaattttgcgagagaaaggaactaacagaagtttatttttcaaaggtatggtggataaatacacatgggttgatataggtagcagcatgctgccaagcgaaatacaagcggcatatctgtatgctcaaatggagcaggctgtagaaatcaatcatactcgcctcaatatttggaacagctatctaaatgccttttctaaatatcaagagtctggcgtaatcgaactcccatcaatcccggcgaactgtcaacacaatgctcatatgttttacataaaactacataatgttgatataagagataaatttattattcatatgaagaataatagtgttctgacggtatttcattatttacctctacatagcacagtagcgggaagaaaatttagctattttcatggtgaagatatccatacaacaaaagaaagtgagaaattagttagactcccgctatactttaatcttaaagaagaagatatgtatcgaataattgatatagcatgtgattttttagacagttattctggtaataaaaaatga

SEQ ID NO: 43604 - protein, 385 aa, Vibrio cholerae
MHFIPFNKPPVTGNELKYISQAVSGDKLSGDGPFAKQCEVWLEKHTQTKKALLTPSCTHALELAALLIDIQAGDEVIMPSFTFVSTANAFVLRGAKIVFVDIRPDTMNIDETKIESAITARTKAIVPVHYAGVSCDMGTIMAIANKYKLFVIEDAAQGMMSTYKDQPLGSIGHMAAFSFHETKNYTSGGEGGALLINDQRFIQRAEILREKGTNRSLFFKGMVDKYTWVDIGSSMLPSEIQAAYLYAQMEQAVEINHTRLNIWNSYLNAFSKYQESGVIELPSIPANCQHNAHMFYIKLHNVDIRDKFIIHMKNNSVLTVFHYLPLHSTVAGRKFSYFHGEDIHTTKESEKLVRLPLYFNLKEEDMYRIIDIACDFLDSYSGNKK

SEQ ID NO: 43605 - DNA, 1101 bp, Bordetella avium
  CDS (1)..(1101)
atgcaattcattgatctgaaaaaacagtaccaggcactgcgcgatcccatcaacacgcgcatccagcaggttctcgaccacggccaatacatcatggggccagaggtcaaagaactcgaaacggccctgtccgcctataccggcgccaagcattgcatcaccgtcgcctccggcaccgaagcgttgctcatcgccttgatggccttgggtatcaaggcgggcgacgaagtcatcacgacgtcgttcacctttgtggcgactgccgaggtgatcgcgctgctgggcgccgtgccggtgttcgtcgatgtcgaacccgacacctgcaatatccgggttgacgagatcgaagcgcgcatcacaccgcgcaccaaggccattattccggtatcgctctacggccagtgcggcgatatggacgaggtcaacgccatcgccgataaatacggcatcaccgtcattgaagacgctgcacagagctttggcgcgacctacaagggcaagaagagctgtaatctgtccaccattggctgtaccagcttcttcccgagcaaaccgctaggctgttatggcgacggcggcgcgctgttcacgaacgacgatgcgctcgcccaggccatgcgcgaaatccgcgtacatggccagtccgcccgctactatcacacccgtatcggcgtgggtggccgcatggacacgctgcaatgcgcggtcgtgctgggcaaactcgaacgctttgactgggaagtcgaacaacgcctacgcatcggcgcgcgctatcaggccctcttggcggatctgccagccggcgcgcgcacggtcaccgtacgccctgaccgcgacagcgtttgggcgcaattcacagtcatcgtgcccaatcgggccgccgtcgtggaacaactcaaggccgccggcatcccgacagccatccactatccgcgaccgatccacaagcagccggcttacgaacactttgccagcgagcacggcacgcccaactccgacctcctggccgaccaggtgctcagcctgcctatgcacccggatctggacgaagccacgcaagacaagattgtggccgtattgcgcgaggccctcgccggatga

SEQ ID NO: 43606 - protein, 366 aa, Bordetella avium
MQFIDLKKQYQALRDPINTRIQQVLDHGQYIMGPEVKELETALSAYTGAKHCITVASGTEALLIALMALGIKAGDEVITTSFTFVATAEVIALLGAVPVFVDVEPDTCNIRVDEIEARITPRTKAIIPVSLYGQCGDMDEVNAIADKYGITVIEDAAQSFGATYKGKKSCNLSTIGCTSFFPSKPLGCYGDGGALFTNDDALAQAMREIRVHGQSARYYHTRIGVGGRMDTLQCAVVLGKLERFDWEVEQRLRIGARYQALLADLPAGARTVTVRPDRDSVWAQFTVIVPNRAAVVEQLKAAGIPTAIHYPRPIHKQPAYEHFASEHGTPNSDLLADQVLSLPMHPDLDEATQDKIVAVLREALAG

SEQ ID NO: 43607 - DNA, 1179 bp, Bordetella avium
  CDS (1)..(1179)
atggcattccttccttttgcgcaacccgacatcggcgaagccgagatcgacgccgccgtccaggccatgcgttcgggatggctcaccaccggacccaatgcccgcgccttcgagcaggaattcagcgcattccttggcgaagggctggaagccatcgctgtcaattcggctaccgccggcctgcatctggcgcttgaagccatcggcatcggtgctggcgatgaagtcatcacaacgacgcacacttttacggccagtgccgaagtcgtgcgctatctgggtggcgagcccgtgctggttgacatcgatcccgccacgttctgcatctcgccgtccgccatcgaagcggccatcacgccgcgcaccaaagccatcatccccgtgcattacggcggcctgtcctgtgacatgagcgccattctggcgatcgccgccaaacatagcctgcgggtcatcgaagatgcggcccacgcgctgccctgtacctggaacggccagctgatcggtcaactgggcagcgacgccacggtctacagcttctatgccaccaagacgctcgccacgggcgaaggcggcatggtggtcacccgcaatgcacagctctccaagcgttgccgcgtgatgcgtctgcacggcatcgaccgcgacgcctttgaccgtttcacttcgagcaagcccgcctggtattacgagatcgtcgcgcccggattcaaatacaacctgcccgatccggccgctgccatcggacgggtgcaattgcagcgagtgcgcgccatgcgcgaccgccgtgccgacatcgcggcgcgttatgacagcgctttcgccgatctgccggtacaactgccgccctgcccggctaaactggccgcaggtggcgtctatcaagccagcgacctgcattcttggcatctttacgtactgcgcctgacgccggatgccccctgtgcacgcgacgacttcattgcagggatgtccgagcgcggcatcggctgcagcgtgcattatgtgccgttgcacctgcaaccctattggcgtgatcgttattccttgcgcgctgacatgttcccggcctcgcagacaacctatgagcgcatggtcagcttgccgatctactccaaaatgaacgacgccgacgtcgatcgcgttatcgaggccgtacgtagcttgttgcaatcgtga

SEQ ID NO: 43608 - protein, 392 aa, Bordetella avium
MAFLPFAQPDIGEAEIDAAVQAMRSGWLTTGPNARAFEQEFSAFLGEGLEAIAVNSATAGLHLALEAIGIGAGDEVITTTHTFTASAEVVRYLGGEPVLVDIDPATFCISPSAIEAAITPRTKAIIPVHYGGLSCDMSAILAIAAKHSLRVIEDAAHALPCTWNGQLIGQLGSDATVYSFYATKTLATGEGGMVVTRNAQLSKRCRVMRLHGIDRDAFDRFTSSKPAWYYEIVAPGFKYNLPDPAAAIGRVQLQRVRAMRDRRADIAARYDSAFADLPVQLPPCPAKLAAGGVYQASDLHSWHLYVLRLTPDAPCARDDFIAGMSERGIGCSVHYVPLHLQPYWRDRYSLRADMFPASQTTYERMVSLPIYSKMNDADVDRVIEAVRSLLQS

SEQ ID NO: 43609 - DNA, 1167 bp, Kitasatospora sp
  CDS (1)..(1167)
atgagtgcccaaggacgtccggccccggagttcccggtctggccgcagtatgacgatgccgagcgcgaaggactgctcagggcgctggagcagggccagtggtggcggatgggcggcaaggaggtcgacaccttcgagcaggagttcgccgactaccacggcgccgccaaggcgctcgccgtcaccaacggtacccacgcgctggagatcgccctccagctgctcggggtcggcccgggcaccgaggtgatcgtgcccgcgttcacgttcatctcctcctcccaggccgcccagcggctcggcgccaccgcggtgccggtcgacatcgacctcgacacctacaacctgagccccgaggcggccgccgccgcgatcaccccgcggacccgcgcgatcatgccggtccacatcgccggccagatcgccgacctggacgccctcgacgagctcgccgccgactcgggcgtctcgatcgtgcaggacgccgcgcacgcccacggcgcccgctggcgcggccgccgggtcggcgagctgggctcgatcgccgcgttcagcttccagaacggcaagctgatgacggccggcgagggcggcgccgtcaccttcccggagaccgcccagtacgacgaggcgttcctgcggcacagctgcggccgcccgccgacggaccggaagtacttccaccagacctccggttccaacttccggctcaacgagttctccgcgagcgtgctgcgcgcccagctcgctcgtctggacagccagatcagcgtccgcgaggagcgctccaaactgctcaagagcctgctgacggagatccccggcgtggtgccgcagggccacgacgagcgggccgaccgcgtcccgcactacatggcgatgttccgggtgcccggcctcggcgaggaccggcgcaacgccctggtcgacgacctgatcgcgcgcggcctgcccgccttcgtggtcttccgcgccatctaccgctcggacggcttctgggagtcggccgcgcccgacaccaccgtcgacgagctggccaaggcctgccccaacagcgaggcgctcaccgccgacggcatctggctgcaccaccgcaccctcctcgcgagcgagggggcgatcgaggacaccgcccagatcattgccgacgccctggccgcggtgtga

SEQ ID NO: 43610 - protein, 388 aa, Kitasatospora sp
MSAQGRPAPEFPVWPQYDDAEREGLLRALEQGQWWRMGGKEVDTFEQEFADYHGAAKALAVTNGTHALEIALQLLGVGPGTEVIVPAFTFISSSQAAQRLGATAVPVDIDLDTYNLSPEAAAAAITPRTRAIMPVHIAGQIADLDALDELAADSGVSIVQDAAHAHGARWRGRRVGELGSIAAFSFQNGKLMTAGEGGAVTFPETAQYDEAFLRHSCGRPPTDRKYFHQTSGSNFRLNEFSASVLRAQLARLDSQISVREERSKLLKSLLTEIPGVVPQGHDERADRVPHYMAMFRVPGLGEDRRNALVDDLIARGLPAFVVFRAIYRSDGFWESAAPDTTVDELAKACPNSEALTADGIWLHHRTLLASEGAIEDTAQIIADALAAV

SEQ ID NO: 43611 - DNA, 1092 bp, Leptospira interrogans
  CDS (1)..(1092)
atgatcgaatatgaaaatttacgtttagcgaatgaacgcttttttgacgagtataaaactaaacttttagaaaccatagaaagcggatggtatatattaggaaaagaagtttctaactttgaaagtcaatttgcagaatacaatggaaatagatattgtattggggtaggaaatggtctagatgcgttgatactcgccttaaaggcgttaggtttagaagagaattctgaaattatagttccttcaaatacgtatatagcttctatattagcaattttgcatgcaggtttgaaacccgttttagttgaaccagatattcgaacctataacattgatccccaaaagatagaggaaaaaataaattttaaaacaaaagggattttgatcgtacatctgtatggtaaaccttgtgaaatggattctattttaaagacaaaagaaaaaaataatctgtttctagtggaagattgtgcgcagtctcatggggccttgtataagaataaaaaaacgggaacgtttggagaaatgagtggattcagtttttaccccactaaaaatttaggagctcttggggatgcgggtgcggttgtaactgataatgatttatatcacgacgagattcggaaattaagaaattatggttcttcaatcaagtataaaaatgatttggtcggatataactctcgtttagatgaattacaagcaacaattttaagtatcaagctgaaacatttggatgtaatgaacgagcataaaagaagtttggcgaaaatttatctagaaaatctaaaagaagattttattaaaccaatagtcgacgaagaagtttacgacgtatatcatatctttaatattcgtcatacaaaacgtgacgatttgcgagactatctgttaaaaaatggcgtaaaaacagaagttcattacccaattcctcctcataaacaaatagcgatgaaggacgtaatcttatacgcagagggcgagtttgcgatctcagaagagattcatcgtacaactcttagtcttcctatttcaacttttcatacagaagaagatgtttataaaattgtagaaattatgaatagattttaa

SEQ ID NO: 43612 - protein, 363 aa, Leptospira interrogans
MIEYENLRLANERFFDEYKTKLLETIESGWYILGKEVSNFESQFAEYNGNRYCIGVGNGLDALILALKALGLEENSEIIVPSNTYIASILAILHAGLKPVLVEPDIRTYNIDPQKIEEKINFKTKGILIVHLYGKPCEMDSILKTKEKNNLFLVEDCAQSHGALYKNKKTGTFGEMSGFSFYPTKNLGALGDAGAVVTDNDLYHDEIRKLRNYGSSIKYKNDLVGYNSRLDELQATILSIKLKHLDVMNEHKRSLAKIYLENLKEDFIKPIVDEEVYDVYHIFNIRHTKRDDLRDYLLKNGVKTEVHYPIPPHKQIAMKDVILYAEGEFAISEEIHRTTLSLPISTFHTEEDVYKIVEIMNRF

SEQ ID NO: 43613 - DNA, 1110 bp, Streptomyces galilaeus
  CDS (1)..(1110)
atgacgactctcgtctgggactacctacaggaatacgagaacgaacgcgccgacattctggacgccgtggagacggtcttcagctcgggccggctcgtcctcggtgacagcgtccgcggattcgaggaggagttcgccgcctaccacggcgcggcgcactgcgtcggtgtcgacaacggcaccaacgcgatcaagctggccctccaggcgctcggcgtcggccccggcgacgaggtcgtcaccgtgtccaacaccgcggcccccacgatcgtggccatcgactcggtgggcgccaccccggtgttcgtcgacatccacgcggacagctacctcatggacaccgagcaggtcgaggccgcgatcacgccccggacccggtgcctgctgcccgtccacctctacgggcagtgcgtcgacctggctccgctggagcggctcgccgcggagcacgacctgttcctcgtcgaggactgcgcgcaggcccacggtgcccgccgcgccggccggctcgccggcaccaccggcgacgccgccgccttctccttctaccccacgaaggtgctcggcgcctacggcgacggaggcgccgtactgacctcgcgggacgacgcccaccacgcgctgcgccgactgcgctactacggcatggaggagcggtactacgtcgtcggcacccccggccacaacgcccgcctcgacgaggtccaggccgagatcctgcagcgcaagctgcgccggctcgacacctacatcgaggggcggcgggccgtcgcccggagctacgaggacgggctcggcgacaccgccctggtgctcccgcacaccgtccccggcaacgagaacgtgtactacgtctacacggtgcgccacccgcggcgcgacgacatcatcaaggccctcaaggcgtacgacatcgagctgaacatcagctatccctggccggtgcacaccatgtccgggttcgcccacctcggctacggcaagggctcgctgcccgtcaccgaggacctggccggccagatcttctcgctgccgatgtacccggcgctcccgccggacgcccaggacaaggtgatcagcgcggtgcgtgacgtgctggacagcctctga

SEQ ID NO: 43614 - protein, 369 aa, Streptomyces galilaeus
MTTLVWDYLQEYENERADILDAVETVFSSGRLVLGDSVRGFEEEFAAYHGAAHCVGVDNGTNAIKLALQALGVGPGDEVVTVSNTAAPTIVAIDSVGATPVFVDIHADSYLMDTEQVEAAITPRTRCLLPVHLYGQCVDLAPLERLAAEHDLFLVEDCAQAHGARRAGRLAGTTGDAAAFSFYPTKVLGAYGDGGAVLTSRDDAHHALRRLRYYGMEERYYVVGTPGHNARLDEVQAEILQRKLRRLDTYIEGRRAVARSYEDGLGDTALVLPHTVPGNENVYYVYTVRHPRRDDIIKALKAYDIELNISYPWPVHTMSGFAHLGYGKGSLPVTEDLAGQIFSLPMYPALPPDAQDKVISAVRDVLDSL

SEQ ID NO: 43615 - DNA, 1110 bp, Amycolatopsis balhimycina
  CDS (1)..(1110)
atgaccacgcgtgtatgggactaccaggccgaataccggaacgagcggctcgacctgctggacgcggtcgagacggtcttcgactcggggcagctcgtgctcggggcgagcgtgcgtggcttcgaggcggaattcgccgcgtaccacggggtcgggcactgcgttggcctcgacaacgggacgaacgcgatcaagctcggcctgcaggcgctgggtgtcgggccgggcgacgaggtgatcacggtgtccaacaccgccgccccgaccgtggtcgccatcgacggcaccggcgccacgccggtcttcgtcgacgtccgcgaggacgacttcctgatggacaccggccaggtcgcggccgcgatcaccgagcgcaccaagtgcctgctgcccgtgcacctatacggacagtgcgtggacatggctccgctgaaggacctcgccgcgaagcatggactgtccattttggaggactgtgcccaggcgcacggggcccggcagaacggaacggtcgcgggctcgaccggtgacgcggccgcgttctccttctacccgaccaaggtgctcggggcgtacggcgacggcggcgcgaccatcacctccgacgaatccgtggaccggcggctgcggcggctgcgctactacggcatggacaagcagtactacacgctggaaacgccggcccacaacagccggctggacgaggtccaggccgagatcctgcggcgcaagctcaagcggctcgacacctacgtcgccgcccgccaggccatcgcccagcgctacgtcgacggactgggcgacacggagctgaagctgccgcggaccgtccccggcaacgagcacgtgtactacgtgtacgtcgtgcgccacccgcgacgtgacgacatcatcgagcgcctcaaggcgtacgacatccacttgaacatcagctatccgtggccggtgcacaccatgaccggtttcgcccacctcggctacgcgaccggcgcgttcccggtcaccgaaaaactggccggcgagatcttctcgctgccgatgtaccccgcgctttccgccgacctgcaggacaaggtcatccatgcggtgcgcgaggtggtgtccaccctctga

SEQ ID NO: 43616 - protein, 369 aa, Amycolatopsis balhimycina
MTTRVWDYQAEYRNERLDLLDAVETVFDSGQLVLGASVRGFEAEFAAYHGVGHCVGLDNGTNAIKLGLQALGVGPGDEVITVSNTAAPTVVAIDGTGATPVFVDVREDDFLMDTGQVAAAITERTKCLLPVHLYGQCVDMAPLKDLAAKHGLSILEDCAQAHGARQNGTVAGSTGDAAAFSFYPTKVLGAYGDGGATITSDESVDRRLRRLRYYGMDKQYYTLETPAHNSRLDEVQAEILRRKLKRLDTYVAARQAIAQRYVDGLGDTELKLPRTVPGNEHVYYVYVVRHPRRDDIIERLKAYDIHLNISYPWPVHTMTGFAHLGYATGAFPVTEKLAGEIFSLPMYPALSADLQDKVIHAVREVVSTL

SEQ ID NO: 43617 - DNA, 1059 bp, Streptomyces nodosus
  CDS (1)..(1059)
atgtcctatacgtatccggtctccatgccgtggctgaagggccgcgagctggagtatgtgacggaggccgtcagcggcggctggatctcgtcgcagggcccctacgtccggcagttcgaggaggcgttcgccgcctacaacgacatgccgcacggtgtcgcctgttcctcgggcaccaccgcgctgacgctggcgctgcgggcgctgggcgtcggccccggcgacgaggtgatcgtcccggagttcaccatgatcgcgaccgcctgggcggtcacctacacgggggcgaccccggtgttcgtggactgcggcgacgacctgaacatcgatgtctcccgcatcgaggagaagatcaccccgcgcaccaaggtgatcatgccggtgcacatctacggccggcagtgcgacatggacgccatcatgaacctggcgtacgagtacaacctgcgggtcgtcgaggactcggcggaggcgcacggggtgcggccggtgggcgacatcgcctgcttctcgctgttcgccaacaagatcatcacggcgggtgagggcggggtgtgcgtgacccgggacgcccatctggccgagcagatggcgcatctgcgggccatggcgttcaccaaggaccacagcttcctgcacaagaagctggcctacaactaccgcatgaccaacatgcaggccgcggtggcgctcgcgcagaccgagcagctggacaccatcctcgcgacccgccgcgacatcgagaagcgctacgacgaggcgctgcgggacgtgcccggcatcacgctgatgccggcccgcgacgtgctgtggatgtacgacctgcgggccgagcgcagcgaggagctgcgcgcgtacctggccgaccagggcgtcgagacccgggtgttcttcaagccgatgagccgtcagccgggctactacgacgcgaactggccgtcgctgaacgcctcccggttcagcgaggacgggttctatctgccgacgcacaccgggctgaccgcgcaggaccaggagttcatcaccgaccgggtacgcgccttctacggagtcctgtga

SEQ ID NO: 43618 - protein, 352 aa, Streptomyces nodosus
MSYTYPVSMPWLKGRELEYVTEAVSGGWISSQGPYVRQFEEAFAAYNDMPHGVACSSGTTALTLALRALGVGPGDEVIVPEFTMIATAWAVTYTGATPVFVDCGDDLNIDVSRIEEKITPRTKVIMPVHIYGRQCDMDAIMNLAYEYNLRVVEDSAEAHGVRPVGDIACFSLFANKIITAGEGGVCVTRDAHLAEQMAHLRAMAFTKDHSFLHKKLAYNYRMTNMQAAVALAQTEQLDTILATRRDIEKRYDEALRDVPGITLMPARDVLWMYDLRAERSEELRAYLADQGVETRVFFKPMSRQPGYYDANWPSLNASRFSEDGFYLPTHTGLTAQDQEFITDRVRAFYGVL

SEQ ID NO: 43619 - DNA, 1224 bp, Bacteroides fragilis
  CDS (1)..(1224)
atgaaaatacctttttcaccaccttatattgacgaggcggtcatcaacgaagtcgttgattcgttacgttccggttggatcacatccggtccgaaagtgaaggctttggaggaagaaattaaatctttctcaggagcaaaagaagtgctttgtgtcaattcctggacatcaggagctattatgatgttgcgttggctgggagtgaaggagggcgatgaagtgattgttcctgcctatacttacagtgcaacggcattggctgtgctccatgccggagccaaaccggtaatggtggattccggaactgattttaatatttcggtggaggctgttcgtaaagctattactcctaaaacaaaggcgattatacccgtagatattgctggttttccctgcgattatgaaagaatcatggcactggtgcaggaaccagaaatggtaaaactgttccgttcggaatctcctgtgcaagaaaaattgggacgcatcttggtgatgaatgatgctgcccactctttgggagcacgttacagtagccgtcagcgtaccggttgtgaaactgatgtggctatcttttcacttcatgccgtgaaaaatgtgactactgccgaaggtggggccatttgcctgaatctgcctaagccgttcgataatacggagttgtataaagagctacggatgacaagcttgaactgccagaccaaggatgctttttcgaaatctaaagccggaggatggcgttatgatattgtcggtttcgggatgaaaatcaatatggccgatgtaaatgccgccataggactggcacagatacgagaatatccggaattgctgaaagaacgaaagcgggtgtttaatgcttatagcgatgctttttcggcttgtgactgggccatcgttccgccttctgtggatggggaaaaggaaagctcttatcacatttatgctttgcgtattaaggactttaccgaagaacaacgcgaccggatgattgatgaaatcgctaaaagtgaagtggctgtcaatgtgcactttataccgatgccgatgttgtcgttcttcaaatcgatgggatatgatataaaggattatccacaggcttatcagaactttaagagcgagatatcattgccgatatatccccaattggatagtgaaaaattgaatttcattattgaaaccgtaaaggcggcctatgcgaccgtaattgcagaaaaccgatag

SEQ ID NO: 43620 - protein, 407 aa, Bacteroides fragilis
MKIPFSPPYIDEAVINEVVDSLRSGWITSGPKVKALEEEIKSFSGAKEVLCVNSWTSGAIMMLRWLGVKEGDEVIVPAYTYSATALAVLHAGAKPVMVDSGTDFNISVEAVRKAITPKTKAIIPVDIAGFPCDYERIMALVQEPEMVKLFRSESPVQEKLGRILVMNDAAHSLGARYSSRQRTGCETDVAIFSLHAVKNVTTAEGGAICLNLPKPFDNTELYKELRMTSLNCQTKDAFSKSKAGGWRYDIVGFGMKINMADVNAAIGLAQIREYPELLKERKRVFNAYSDAFSACDWAIVPPSVDGEKESSYHIYALRIKDFTEEQRDRMIDEIAKSEVAVNVHFIPMPMLSFFKSMGYDIKDYPQAYQNFKSEISLPIYPQLDSEKLNFIIETVKAAYATVIAENR

SEQ ID NO: 43621 - DNA, 1104 bp, Xanthomonas campestris
  CDS (1)..(1104)
atggacgctctgattcctgtcaactcgctttcccgccacatcgctcccttgcaggacaagctgtcccagatcgccggcgacatcatcgccagcggctactacgtcctcggcccgaacgtgaaggccttcgagcaggagttcgccggctactgtggcgcccgccactgcgtcagcgtcgccaacggcaccgacgccctggaactctcgctgaaggcactgggcattggccagggcgatcgggtcgccgtggtggccaatgccgccatgtacggcaccagcgccgttctggcctgtggtgcggcgccgatcttcgtcgataccggtgcaggcacgggattgatgtccgtcgccgcactggaggctgcgctcgcgggcaagaccacgcccaaggccgtgatcgtgacccatctgtacggtcagttggccgagatcgaggccatcgtcgcgctctgccacgcacgcggcatcaaggtggtggaagattgcgcacaggcgcatggcgcagagcgcaatggccgacgcgccggcagcttcggcgatattgcctctttcagtttctacccgaccaagaatctgggcgcactgggcgatggcggcgcgatcgtgaccggcgatgatgccctagccacccgtgcagcacagcttcgccagtacggatggacggccaagtacaccaacagcctgcgcggcggtcgcaacagccgcctcgacgagctgcaggccgcaatgctgcggcatatgctcacctcgctggatggctggaacctacgccgccgcgacatcgccaaccgctacgcgcgggggttgtccaacccgaagattgcatccgctggcgtggtcggtgccgacaatgtggcccatctgtacgtcgtgcgctgcgaccagcgcgatgcactgcgcgcccacctgcaggctgccggcgtgcagaccgaggtccactacccgctgtgcgatcatcgccagccctgtcatgagggcgcttttgattctgtggcgctccccaataccgaggccgatgcgatctgcgtgatgacgctgccgtgcttcccggagctgaccgacgaagaagtcgaccaggtcatcgacgcatgcaaccgtttctga

SEQ ID NO: 43622 - protein, 367 aa, Xanthomonas campestris
MDALIPVNSLSRHIAPLQDKLSQIAGDIIASGYYVLGPNVKAFEQEFAGYCGARHCVSVANGTDALELSLKALGIGQGDRVAVVANAAMYGTSAVLACGAAPIFVDTGAGTGLMSVAALEAALAGKTTPKAVIVTHLYGQLAEIEAIVALCHARGIKVVEDCAQAHGAERNGRRAGSFGDIASFSFYPTKNLGALGDGGAIVTGDDALATRAAQLRQYGWTAKYTNSLRGGRNSRLDELQAAMLRHMLTSLDGWNLRRRDIANRYARGLSNPKIASAGVVGADNVAHLYVVRCDQRDALRAHLQAAGVQTEVHYPLCDHRQPCHEGAFDSVALPNTEADAICVMTLPCFPELTDEEVDQVIDACNRF

SEQ ID NO: 43623 - DNA, 1401 bp, Pseudomonas aeruginosa
  CDS (1)..(1401): r means g or a
atgactccgtcatgggccttttcgttcgcagggactggacctgtgtcgctggagggtatgttccgcaaggtctacggaaacacgggagaatttgtcagaagtttgactgccgattcgcgccgcagcgcctgtggaacagccaggggtcgcgcgaccaggggctttgacctgcatcaggctctttgggtacggrccttgcatagagtggcgtgctcgggtttttcgccctttactcgcctgagtatccattcatcagggccctacatgaacaacaagacgatcccggtcaccagcccgctgctgccgcccctggaagagttcatcccctacctggaaaagatctgggagagccgcttcctgaccaacgggggcgacatgcaccatgcgttggaagaggccctgtgcgaatacctgggggtgaagcacatcgtgctcttcgccaacgccaccctggcgctcatcaccgcgctgcaggcattgcgggtgaccggcgaggtgatcaccacgccgtactccttcgtcgccaccagccacgcgctgctgtggaacgggctcaagccgatcttcgtggacatcgatcaggactccatgaatctcgacccgtcgcggatcgaggcggcgatcaccccgcagaccaccgcgatcctgccggtgcattgctacggcaacccctgcgatgtcgaggcgatccagcggatcgccgatatccaccacctgaaggtcatctacgatgccgcgcatgccttcgccgtgcgcgacgccggcggcagcgtgctgcgccacggcgacctgagcatcctcagcttccatgccaccaaggtgttcaacaccttcgagggcggtgcgatcatctgctcggacgaaaacacccggcaacgcctcaaccaccttaagaatttcggcttcgtcgacgaggtcacggtggtcatgcccggcatcaacggcaagctcaacgaggtcggcgctgccttcgggctgctgcaactcaagcacgtcgaccaggccctggagcagcgcagggagatcgccgagcgctatcggcgcctgctggccggcgtccctggcatccagtgcctccggcctggtacccagaccttcgccaacaacgcctatttcccgatcctggtggaagacgattttccgctttcgcgcgacgagctgtaccagcgcctgcgcgacagggatgtgctggtgcggcgctacttctacccactcatcagcgacttccccatgtaccattcgctgccctcggcggcgcccgccaatcttccggtggcgcggtcgatttcctcgcgagtgctgtgcctgccgatctatcccgggctggccgccgcagacgtcgagttcgtcgccggcctgatcgcttccgccgccatgccgcggcggcgagcatcaagttga

SEQ ID NO: 43624 - protein, 466 aa, Pseudomonas aeruginosa
  misc_feature (65)..(65): Xaa can be Ala or Thr
MTPSWAFSFAGTGPVSLEGMFRKVYGNTGEFVRSLTADSRRSACGTARGRATRGFDLHQALWVRXLHRVACSGFSPFTRLSIHSSGPYMNNKTIPVTSPLLPPLEEFIPYLEKIWESRFLTNGGDMHHALEEALCEYLGVKHIVLFANATLALITALQALRVTGEVITTPYSFVATSHALLWNGLKPIFVDIDQDSMNLDPSRIEAAITPQTTAILPVHCYGNPCDVEAIQRIADIHHLKVIYDAAHAFAVRDAGGSVLRHGDLSILSFHATKVFNTFEGGAIICSDENTRQRLNHLKNFGFVDEVTVVMPGINGKLNEVGAAFGLLQLKHVDQALEQRREIAERYRRLLAGVPGIQCLRPGTQTFANNAYFPILVEDDFPLSRDELYQRLRDRDVLVRRYFYPLISDFPMYHSLPSAAPANLPVARSISSRVLCLPIYPGLAAADVEFVAGLIASAAMPRRRASS

SEQ ID NO: 43625 - DNA, 1389 bp, Saccharopolyspora spinosa
  CDS (1)..(1389)
atgcagagccggaaaaccagagcgctggggaaagggcgcgccagagtgacttcgtgtgacgacacttgcgctaccgctactgagatggtgccggatgccaaggaccggatattggcatccgtacgcgattaccaccgcgaacaggaatccccgaccttcgtggctggatcgacgccgatccggccatcgggcgccgtgctcgacgaggacgaccgggtggcactggtggaagccgcgctggagctccggatcgccgcgggcgggaatgcacggcgattcgagagcgagttcgcccgcttcttcggcctccgcaaggctcatctcgtcaactccggttcgtcggccaatctcctggcactgagttcgcttacctcccccaaactcggcgaggcacgactgcggcccggcgacgaagtgatcactgcggcggtcggcttccccacgacgatcaatccggcggtccaaaacggactcgtcccggtattcgtcgacgtggaactgggcacctacaacgcaacgccagaccgcatcaaggccgccgtcacggaacggacgcgagccatcatgctggcgcacaccctgggcaaccccttcgccgctgacgaaatcgcggagatcgcaaaagaacacgagctgttcctcgtcgaagacaactgtgatgcggtgggatccacctaccggggacggctgaccggaaccttcggcgacctgacaacggtcagcttctatcctgcccatcacatcaccagcggcgagggtggctgcgtgttgaccggcagcctggaattggctcgcatcatcgagtcgctgcgtgactggggacgggattgctggtgcgagcccggcgtggacaacacctgccgcaagaggttcgactaccacctcggtacccttccaccgggctacgaccacaagtacacgttctcccacgtcggttacaacctcaagaccaccgacctgcaggccgcacttgcgctgagccagttgagcaagatttccgcattcgggtcggcacgccgccgtaactggcgacggttgcgcgaagggctgtccgggttgccgggcctgctgctgccggtagccacaccgcacagcgacccgagctggttcgggtttgcgatcaccatcagtgcggacgccgggttcacccgtgccgccctggtgaacttcctggaatcccgcaacatcggcacccgactgctgttcggcggtaacatcacccggcacccggccttcgagcaggtgcggtaccggatcgccgacgcgctcaccaacagcgacatcgtcaccgaccgaaccttctgggtcggcgtctacccaggcataacggaccaaatgatcgactacgtcgtcgaatcaatcgctgaattcgtggccaagagttcctag

SEQ ID NO: 43626 - protein, 462 aa, Saccharopolyspora spinosa
MQSRKTRALGKGRARVTSCDDTCATATEMVPDAKDRILASVRDYHREQESPTFVAGSTPIRPSGAVLDEDDRVALVEAALELRIAAGGNARRFESEFARFFGLRKAHLVNSGSSANLLALSSLTSPKLGEARLRPGDEVITAAVGFPTTINPAVQNGLVPVFVDVELGTYNATPDRIKAAVTERTRAIMLAHTLGNPFAADEIAEIAKEHELFLVEDNCDAVGSTYRGRLTGTFGDLTTVSFYPAHHITSGEGGCVLTGSLELARIIESLRDWGRDCWCEPGVDNTCRKRFDYHLGTLPPGYDHKYTFSHVGYNLKTTDLQAALALSQLSKISAFGSARRRNWRRLREGLSGLPGLLLPVATPHSDPSWFGFAITISADAGFTRAALVNFLESRNIGTRLLFGGNITRHPAFEQVRYRIADALTNSDIVTDRTFWVGVYPGITDQMIDYVVESIAEFVAKSS

SEQ ID NO: 43627 - DNA, 1158 bp, Saccharopolyspora spinosa
  CDS (1)..(1158)
gtgatcaacctgcaccagccgatcctcggcaccgaagaactcgacgcgatcgcggaggtgttcgcctccaactggatcgggctcgggccgcgcacccggacgttcgaggccgaattcgcccaccacctgggagtggatcccgaacaggtcgtgttcctcaactcggggactgccgcgctgttccttaccgtgcaggtgctcgacctcggcccaggcgacgacgtggtacttccttcgataagcttcgtggcggcggccaacgccatcgcatcctccggtgcccgcccggtgttctgcgacgtcgacccccggacgttgaaccccacgctggatgatgtggcgagggccatcacgccggcgaccaaggccgtattgctgctccactatggaggatcgccgggagaagtcaccgcgatcgccgatttctgccgtgaaaagggcctcatgctcatcgaggactccgcctgcgcggtggcatcgtccgtgcacggcaccgcttgcggaacctttggtgacctggccacgtggagtttcgatgcgatgaagatcctggtcaccggggatgggggcatgttctacgcggcggatccggagctggcgcaccgcgcaagacgactcgcctaccacggtcttgagcagatgagcggattcgattcggccaagtcttccaaccgctggtgggatattcgcgtcgaagacatcggccagcggctgatcgggaacgacatgacggcagcgcttggcagcgtgcagctgcgcaaactgccagaattcatcaacaggcgtagagaaatcgctacgcagtacgaccggttgctttccgatgtgccgggtgtcctcctaccgccgacgctaccggatgggcacgtctcgtcacactacttctactgggtccagctggctccggagatccgcgaccaggtggcgcagcaaatgctggaacgcggcatctacacgagctaccgctacccgcccctgcacaaggtccccatctaccgcgcggactgcaagctgccttctgcggaggacgcctgccgcagaacactcctgctaccactgcacccaagccttgacgacgccgaggtgcgcacggtggctgacgagttccagaaggccgtcgaacaccacatcagccaaagatcaccactccgaaagtga

SEQ ID NO: 43628 - protein, 385 aa, Saccharopolyspora spinosa
MINLHQPILGTEELDAIAEVFASNWIGLGPRTRTFEAEFAHHLGVDPEQVVFLNSGTAALFLTVQVLDLGPGDDVVLPSISFVAAANAIASSGARPVFCDVDPRTLNPTLDDVARAITPATKAVLLLHYGGSPGEVTAIADFCREKGLMLIEDSACAVASSVHGTACGTFGDLATWSFDAMKILVTGDGGMFYAADPELAHRARRLAYHGLEQMSGFDSAKSSNRWWDIRVEDIGQRLIGNDMTAALGSVQLRKLPEFINRRREIATQYDRLLSDVPGVLLPPTLPDGHVSSHYFYWVQLAPEIRDQVAQQMLERGIYTSYRYPPLHKVPIYRADCKLPSAEDACRRTLLLPLHPSLDDAEVRTVADEFQKAVEHHISQRSPLRK

SEQ ID NO: 43629 - DNA, 1059 bp, Streptomyces natalensis
  CDS (1)..(1059)
atgtcgttcaagtaccccgtgtccaggcccactctggacggccgggagctggagtatgtgaccggtgccgtcggggacggctggatctcgtcccagggcccgatggtcgcgcggttcgagcgtgccttcgcggactacaacggcgtcgcgcacggcgtgtcctgttcgtccgggacggcggcgctcacgctggcgctgcgggcgctgggtatcggcccgggggacgaggtgatcgttccggagttcacgatggtcgcctcggcatgggcggtcacctacaccggtgcgacgcccgtgttcgtggactgcggagacgacctcaatatcgatgtcacgcgtatcgaggagaagatcacggcgcggacgaaggccgtgatgcccgtccacatctatgggcggcggtgcgatatggacgccgtgatggatatcgcgcaccagtacaacctgcgggtcgtggaggacagtgccgaggcccacggtgtccgcccggtcggggacatcgcgtgctactcgctgttcgccaacaaaatcatcacggcgggcgagggcggcatctgcctcaccgacgaccccaggctggccgggcagctggcgcatctgcgcgccatggcgttcaccaaggaccacagtttcctgcacaagaaggtcgcctacaacttccggatgacggcgatgcaggccgccgtcgcgctcgcccaggtcgagcggctggacgacatcctcgccacgcggcgggagatcgagcggcgctatgacgaggggctcgccggagttcccggtatcacgctgatgccgccgcgggacgtgctgtggatgtacgacctgcgggccgaacgccgcgaggagctacgggagttcctggccggtgagtcgatcgagacccggctgttcttcaagccgatgagccggcagcccatgtacttccaccccgactggccctcgctcaaggcgcatacgttcgccgaggacgggctgtatctgcccacccacaccggactgtccgccaccgaccaggacttcgtgatcgaccgggtccgcgcgttctacggcgcgagctga

SEQ ID NO: 43630 - protein, 352 aa, Streptomyces natalensis
MSFKYPVSRPTLDGRELEYVTGAVGDGWISSQGPMVARFERAFADYNGVAHGVSCSSGTAALTLALRALGIGPGDEVIVPEFTMVASAWAVTYTGATPVFVDCGDDLNIDVTRIEEKITARTKAVMPVHIYGRRCDMDAVMDIAHQYNLRVVEDSAEAHGVRPVGDIACYSLFANKIITAGEGGICLTDDPRLAGQLAHLRAMAFTKDHSFLHKKVAYNFRMTAMQAAVALAQVERLDDILATRREIERRYDEGLAGVPGITLMPPRDVLWMYDLRAERREELREFLAGESIETRLFFKPMSRQPMYFHPDWPSLKAHTFAEDGLYLPTHTGLSATDQDFVIDRVRAFYGAS

SEQ ID NO: 43631 - DNA, 1059 bp, Streptomyces griseus
  CDS (1)..(1059)
atggccttcacccatcccgtctcccggcccgctctggacggccgggaactggagtacgtctccgacgccgtctccggcggctggatctcctcccagggaccgtacgtccggcgtttcgaggaagccttcgccgagtggaacggcgtggcgcacggggtggcctgctcctccggcaccgccgccctcaccctggcgctgcgcgcgctgaacatcggcccgggtgacgaggtgatcgtgccggagttcacgatggtcgcctccgcgtgggcggtgacctacaccggcgccaccccggtcttcgtggactgcggcgacgacctgaacatcgacgtcacccgcatcgaggagaagatcactccgcgcacccgggcggtcatgccggtgcacgtctacggccggcgctgcgacatggacgccgtgatggacctcgccctgcagtacaacctgcgggtggtggaggactcggcggaggcgcacggggtccgcccggtcggcgacatcgcctgcttctcgctcttcgccaacaagatcatcacggccggcgaggggggcgtctgcctcaccgacgatccccggctcgccgaacagctggcccatctgcgggcgatggccttcacccgcgaccacagcttcctgcacaagaaactggcctacaactaccggatgacggccatgcagggcgccgtcgccctggcccagaccgagcggctcgacgagatcctcgccacccgccgggagatcgaggcccgctacgacgcggggctcaaggacctccccggcatcaccctgatgcccgcccgcgacgtcctgtggatgtacgacctgcgtgccgagcgccgcgaggaactccgcgcccacctggacgaacgcggcatcgagacccggctgttcttcaagccgatgagccgccagcccggctacctcgacccggtgtggccgacgctcaacgcccaccggttcagcgaggacggcctgtacctgcccacccacaccgggctgaccgccgccgaccaggagtacatcaccggcgccgtccgggacttctaccgcgcgggctga

SEQ ID NO: 43632 - protein, 352 aa, Streptomyces griseus
MAFTHPVSRPALDGRELEYVSDAVSGGWISSQGPYVRRFEEAFAEWNGVAHGVACSSGTAALTLALRALNIGPGDEVIVPEFTMVASAWAVTYTGATPVFVDCGDDLNIDVTRIEEKITPRTRAVMPVHVYGRRCDMDAVMDLALQYNLRVVEDSAEAHGVRPVGDIACFSLFANKIITAGEGGVCLTDDPRLAEQLAHLRAMAFTRDHSFLHKKLAYNYRMTAMQGAVALAQTERLDEILATRREIEARYDAGLKDLPGITLMPARDVLWMYDLRAERREELRAHLDERGIETRLFFKPMSRQPGYLDPVWPTLNAHRFSEDGLYLPTHTGLTAADQEYITGAVRDFYRAG

SEQ ID NO: 43633 - DNA, 1155 bp, Plesiomonas shigelloides
  CDS (1)..(1155)
atgaaaaattttattccttttgcgttacctgaaattggcgaagaagaaattgcagaggtaattgactctttacgttcaggttggattacgacaggtcctaaggctaagcaatttgaacaagaattttctaattacctaggagcgaacgttcaatcattagctgttaactctgctacgtcgggcttacatttggctcttgaagctgttggcgtaaaacctggagaccaagttattgtcccatcatatacattcactgctactgccgaaattgtcaggtaccttggtgctgatcctgtaattgttgatgtagatcgtaaaacatttaatatatcagttgatgccattgagaaggctattactaataaaacaaaggcgattattccagtacacttcgctggattagcttgtgacatggattcaatcttatcaattgctaaaaaatatgacctaaaggttgtcgaggatgccgctcatgcatttcctacaacatataaaggaagtaagataggaacgcttgattcagatgctacggtttttagcttctacgccaataaaactatgacaaccggtgaaggcggaatggttgtttcaaaaaataaagatataattgagcgttgtaaggtaatgcgtttacatggaatcagtcgtgacgcttttgaccggtaccagtctaaaactccttcttggttttatgaggttgtagctccagggtttaaatacaatatgcctgatatctgtgcggcaatcggtattcatcaacttagaaagatcgatgattttcagaaaaaacgtcaacgaatggcaaaaatttacgatgatgcgttaaaagaattgccacttgaattgcctgaatggcctactaatgctagtgatattcatgcttggcatctatatcctatccgcttaaaaactgattcggctattaatcgcgatgattttattaagaagttatcagatcttggaattggttgttctgtccattttataccgttgcataagcaaccggtttggcgtgatacatataatttgaacgccagtgactttccagtttctgaggagtgttatttaaatgaaatatctattcctctttatactaaaatgacggatcaagatcagttgttcgttatcgaatcgattagacaattatttatgtaa

SEQ ID NO: 43634 - protein, 384 aa, Plesiomonas shigelloides
MKNFIPFALPEIGEEEIAEVIDSLRSGWITTGPKAKQFEQEFSNYLGANVQSLAVNSATSGLHLALEAVGVKPGDQVIVPSYTFTATAEIVRYLGADPVIVDVDRKTFNISVDAIEKAITNKTKAIIPVHFAGLACDMDSILSIAKKYDLKVVEDAAHAFPTTYKGSKIGTLDSDATVFSFYANKTMTTGEGGMVVSKNKDIIERCKVMRLHGISRDAFDRYQSKTPSWFYEVVAPGFKYNMPDICAAIGIHQLRKIDDFQKKRQRMAKIYDDALKELPLELPEWPTNASDIHAWHLYPIRLKTDSAINRDDFIKKLSDLGIGCSVHFIPLHKQPVWRDTYNLNASDFPVSEECYLNEISIPLYTKMTDQDQLFVIESIRQLFM

SEQ ID NO: 43635 - DNA, 1125 bp, Micromonospora megalomicea subsp
  CDS (1)..(1125)
gtgaccacctacgtctggtcctatctgttggagtacgagagggaacgagccgacatcctcgatgcggtgcagaaggtcttcgccagtggcagcctgatcctcggtcagagtgtggagaacttcgagaccgagtacgcccgctaccacgggatcgcgcactgcgtgggcgtcgacaacggcaccaacgctgtgaaactcgcgctggagtcggtaggtgtcggacgcgacgacgaggtcgtcacggtctccaacaccgccgcccccacagtcctggccatcgacgagatcggcgcccggccggtcttcgtggacgtccgcgacgaggactacctcatggacaccgacctggtggaggcggcggtcaccccgcgtaccaaggccatcgtcccggtgcacctgtacgggcagtgcgtggacatgacagccctgcgggaactggccgaccggcggggcctcaagctcgtggaggactgcgcccaggcccacggtgcccggcgggacggtcggctggccgggacgatgagcgacgcggcggccttctcgttctacccgacgaaggtcctcggcgcctacggcgacggcggcgcggtcgtcaccaacgacgacgagacagcccgcgccctgcgacggctgcggtactacgggatggaggaggtctactacgtcacccggaccccgggtcacaacagccgcctcgacgaggtgcaggccgagatcctgcggcgcaaactgacccggctcgacgcgtacgtcgcgggtcggcgggcggtcgcccagcggtacgtcgacgggctcgccgacctccaagactcgcacggcctcgaactcccagtggtcaccgacggcaacgaacacgtcttctacgtgtacgtcgtccgccacccgcgccgcgacgagatcatcaagcgtctccgggacgggtacgacatctccctgaacatcagctacccctggccggtgcacaccatgaccggcttcgcccacctcggtgtcgcgtcggggtcgctgccggtcaccgaacggctggccggcgagatcttctcccttcccatgtacccctccctccctcacgacctgcaggacagggtgatcgaggcggtgcgggaggtcatcaccgggctgtga

SEQ ID NO: 43636 - protein, 374 aa, Micromonospora megalomicea subsp
MTTYVWSYLLEYERERADILDAVQKVFASGSLILGQSVENFETEYARYHGIAHCVGVDNGTNAVKLALESVGVGRDDEVVTVSNTAAPTVLAIDEIGARPVFVDVRDEDYLMDTDLVEAAVTPRTKAIVPVHLYGQCVDMTALRELADRRGLKLVEDCAQAHGARRDGRLAGTMSDAAAFSFYPTKVLGAYGDGGAVVTNDDETARALRRLRYYGMEEVYYVTRTPGHNSRLDEVQAEILRRKLTRLDAYVAGRRAVAQRYVDGLADLQDSHGLELPVVTDGNEHVFYVYVVRHPRRDEIIKRLRDGYDISLNISYPWPVHTMTGFAHLGVASGSLPVTERLAGEIFSLPMYPSLPHDLQDRVIEAVREVITGL

SEQ ID NO: 43637 - DNA, 1305 bp, Streptomyces galilaeus
  CDS (1)..(1305)
atgacgtcggacaccaaggctctggtcctggagcaggttcgcgagtatcaccggcagcagcagccagggaatttccagcccggagtgacgcccatcctctcctcgggcgccgtcctggacgaggaggaccgggtcgccctggtggaggccgccctggatctgcggatcgcggccggagcccactcccggcgcttcgagagcaaattcgcccgccacatcggcgtacgcaaggcgcacctggtgaactcggggtcctcggcgaacctgctggcgctctctgcgctgacctctccccggctcggtgagcagcggctgcgtccgggtgacgaggtgatcacggtggccggcggattccccaccacggtgaacccgatcctccagaacgggctgacgcccgtgttcgtggacctggaactcggtacgtacaacacaacggtggagcacgtgcgggcggcgatctcggaccggacccgggccatcatgatcgcgcacaccctcggcaacccctaccaggtggcggagatccagcaactggccaccgagcacgagctgttcctgatcgaggacaactgcgacgcggtgggctcgacctaccagggacgtatgacggggaccttcggggacctggcaacggtcagtttctatcctgcccaccacatcaccacgggcgaggggggctgcgtactgacccgcaacctcgaactggcccgcatcgtcgagtcgttccgcgactggggccgggactgctggtgcgaaccgggcgaggacaacacctgcctcaagcggttcgactaccagctgggtaatctccccaagggctacgaccacaagtacatcttctcccacatcggttacaacctgaaggcgaccgatctgcaaggggcgctggcactcagccagttgaacaagctgccggagttcggcgcggcccggcggcgcaactggcagcggctgcgggacgggctcgccgacgtccccggtctgctgctgccggtcgcgacaccgggcagcgatcccagctggttcgggttcgtgatcacggtcctgcccgacgccacctacacccgccgtgacctggtcgccttcctggaggaacggcggatcggcacacggcggctgttcggcggcaacctcacccgccatccggcgtacctcggcacgccgcaccgggtggcgggcgatctgcgcaactccgacatcatcaccgagcagagcttctggatcggggtgtatccgggcatcacggaggagatgaccgactacatgcgggagtccatcgtcgagttcgtcaccaagaacggctga

SEQ ID NO: 43638 - protein, 434 aa, Streptomyces galilaeus
MTSDTKALVLEQVREYHRQQQPGNFQPGVTPILSSGAVLDEEDRVALVEAALDLRIAAGAHSRRFESKFARHIGVRKAHLVNSGSSANLLALSALTSPRLGEQRLRPGDEVITVAGGFPTTVNPILQNGLTPVFVDLELGTYNTTVEHVRAAISDRTRAIMIAHTLGNPYQVAEIQQLATEHELFLIEDNCDAVGSTYQGRMTGTFGDLATVSFYPAHHITTGEGGCVLTRNLELARIVESFRDWGRDCWCEPGEDNTCLKRFDYQLGNLPKGYDHKYIFSHIGYNLKATDLQGALALSQLNKLPEFGAARRRNWQRLRDGLADVPGLLLPVATPGSDPSWFGFVITVLPDATYTRRDLVAFLEERRIGTRRLFGGNLTRHPAYLGTPHRVAGDLRNSDIITEQSFWIGVYPGITEEMTDYMRESIVEFVTKNG

SEQ ID NO: 43639 - DNA, 1059 bp, Streptomyces noursei
  CDS (1)..(1059)
atgtcctttacgtatccggtgtccatgccgtggctccagggccgcgagctcgactatgtgacggaggccgtcggcggcggctggatctcttcgcaggggccgtacgtcaggcggttcgaggaggcgttcgccgcgtacaacgacgtgccgttcggcgtcgcctgctcctccggcaccacggcgctgacgctggcgctgcgcgcgctgggcgtcggccccggtgacgaggtgatcgtcccggagttcacgatgatcgcgtccgcctgggcggtgacctacaccggtgccacgccggtgttcgtggactgcggcgacgacctgaacatcgacgtgtcccgcatcgaggagaagatcaccccgcgcaccaaagtgatcatgccggtgcacatctacggccggcagtgcgacatggacgccgtgctgaacctggcgtacgagtacaacctgcgggtggtggaggactccgccgaggcgcacggggtgcggccgcggggcgacatcgcctgtttctcgctcttcgccaacaagatcatctcggccggcgagggcggcgtctgcctgacccacgacccgcacctggccgagcagatggcccatctgcgggcgatggcgttcaccaaggaccacagcttcctgcacaagaagctggcctacaacttccggatgaccaacatgcaggccgcggtggcgctcgcgcagaccgagcagctggacaccatcctcgccctgcgccgcgacatcgagaagcgctacgacgaggcgctgcgcgacatccccggcatcacgctgatgccgccgcgcgacgtgctgtggatgtacgacctgcgggccgagcggcgggacgagctgtgcgcgtacctcgccggcgagggcatcgagacccgggtcttcttcaagccgatgagccgtcagcccggttacttctccgccgactggcccgcgttgaacgcggcccggctcagcgccgacggcttctatctgccgacgcacaccggactgaccgcacaggagcaggagttcatcaccggccggatccgcgcgttctacggagtggcatga

SEQ ID NO: 43640 - protein, 352 aa, Streptomyces noursei
MSFTYPVSMPWLQGRELDYVTEAVGGGWISSQGPYVRRFEEAFAAYNDVPFGVACSSGTTALTLALRALGVGPGDEVIVPEFTMIASAWAVTYTGATPVFVDCGDDLNIDVSRIEEKITPRTKVIMPVHIYGRQCDMDAVLNLAYEYNLRVVEDSAEAHGVRPRGDIACFSLFANKIISAGEGGVCLTHDPHLAEQMAHLRAMAFTKDHSFLHKKLAYNFRMTNMQAAVALAQTEQLDTILALRRDIEKRYDEALRDIPGITLMPPRDVLWMYDLRAERRDELCAYLAGEGIETRVFFKPMSRQPGYFSADWPALNAARLSADGFYLPTHTGLTAQEQEFITGRIRAFYGVA

SEQ ID NO: 43641 - DNA, 1107 bp, Streptomyces antibioticus
  CDS (1)..(1107)
atggacgttccgttcctggacctccgggccgcctacctggagctcaagcacgacatcgacgccgcgaccggccgcgtcctggactccgggcgctacctcctgggccccgaactcgccgcgttcgagacggagtgggccgcctactgcggggcccggcactgcgtggcggtgggcagcgggtgcgacgccctggaactggcgctgcgcgccatggacatcgggccgggtgacgaggtgatcgtcccggcgcacaccttcgccgcgacctggctcgccgtctcggcgacgggtgcggagcccgtcgcggtggaaccggagcctgcgacgttcaccctggacccggagcgcgtcgaggctgcgatcacctcccgcacccgggtgatcctcccggtgcacctgtacgggcatccggcggacctggcggcgttgtccgaggtcgccgagcggcacggcgtgcggatcctggaggacgccgcccaggcgcacggtgcgcaggcgtacggccggcgggtgggcgcgtggtccaccaccgccttcagcttctacccgggcaagaacctgggcggcttcggtgacggcggcgccgtggtgacggacgacgcggagctggcggagcgggtgcgcctgctgcgcaactacgggtcgcgggagaagtaccggcacgaggtccgggccaccaactcccggctggacgagctgcaagcggccgttctgcgggtcaagctcgcccacctggacgcctggaccgagcgccgggccgcggtggcggcgcgctatctcgacgggctcgccggcctggacgggatcgtgctgccgaggccggcgccgtgggcggaccccgtgtggcacctgttcgtgattcgttccgcggaccggtccgcgctgcgggagcggctggcggcagccggcgtcgagacgctgatccactacccggtgccggtgcaccggtcggaggcgtacgccggcagccggctcgccgcccgcgcacagcccgtggcggagcggctcgcccgggaggtgctgagcctgcccatcggcccgcacctgtccgacgacgccgtcaaggcggtgatcgaggcggtacggggcgcggtggccgcctgctga

SEQ ID NO: 43642 - protein, 368 aa, Streptomyces antibioticus
MDVPFLDLRAAYLELKHDIDAATGRVLDSGRYLLGPELAAFETEWAAYCGARHCVAVGSGCDALELALRAMDIGPGDEVIVPAHTFAATWLAVSATGAEPVAVEPEPATFTLDPERVEAAITSRTRVILPVHLYGHPADLAALSEVAERHGVRILEDAAQAHGAQAYGRRVGAWSTTAFSFYPGKNLGGFGDGGAVVTDDAELAERVRLLRNYGSREKYRHEVRATNSRLDELQAAVLRVKLAHLDAWTERRAAVAARYLDGLAGLDGIVLPRPAPWADPVWHLFVIRSADRSALRERLAAAGVETLIHYPVPVHRSEAYAGSRLAARAQPVAERLAREVLSLPIGPHLSDDAVKAVIEAVRGAVAAC

SEQ ID NO: 43643 - DNA, 1182 bp, Streptomyces antibioticus
  CDS (1)..(1182)
atgaaacgaggcgtgcacgacctggccctcttcggcggcgacgcggccttcctccagcccctctacatggggcgccccaacaccggtgaccgcaaacgcctgctggaccgcctggaatgggccctggacaaccggtggctgaccaacggcggcccgctcgtccgggagttcgagcagcgcatcgccgacctggccggtgtacgcaactgcgtcgccacctgcaacgccaccgcgggactccaactgctgctgcgcgaagcggaggtcaccggcgaagtgatcatgccgtcgatgaccttcgtcgccaccgcccacgccgtccggtggctcggactgcgccccgtcttctgcgacatcgacccggacaccggctgcctcgatcccaaactcgtcgaagccgccgtcaccccccgcaccggcgcgatcctcggcgtccacctctggggccggcccagtccggtcgacgaactcgccgccatagccgccgagcacggactgaagctcttctacgacgccgcccacgccctcggatgcacctcacggcagcgccggctcggctccttcggcgacgccgaggtcttcagcttccacgccaccaaggtcgtcaactccttcgagggcggcggcatcgtcaccgacgacgacaccccggccgacgcgctgcgcgcgctgcacaacttcggcctgggccacgacggcgtcggcgccggcatcaacgccaagatgagcgaggcggccgccgccatgggcctgacctccctggaggcgttcgccgacgcggtcgcgagcaaccgcgccaactacgagctctaccggcaggaactctccggcctccccggcgtccggctatcgagctacgacccggcggaacgcaacaactaccactacgtcatcgccctgatcgacgccggcgtcaccggactccaccgggacctcctgctcaccctcctgcgcgcggagaacgtcgtcgcgcagccctatttctcccccggatgccaccagcgcgagccctaccgcaccgagcacccggtctccctgccgcacaccgaacacctcgccgagcaggtcatcgccctgcccaccggtcccgcggtctcccgcgaggacatccggcgcgtctgcgacatcatccgggtcgccgccgcgcacgggccgcggatcaccgcccaggccggcgcctag

SEQ ID NO: 43644 - protein, 393 aa, Streptomyces antibioticus
MKRGVHDLALFGGDAAFLQPLYMGRPNTGDRKRLLDRLEWALDNRWLTNGGPLVREFEQRIADLAGVRNCVATCNATAGLQLLLREAEVTGEVIMPSMTFVATAHAVRWLGLRPVFCDIDPDTGCLDPKLVEAAVTPRTGAILGVHLWGRPSPVDELAAIAAEHGLKLFYDAAHALGCTSRQRRLGSFGDAEVFSFHATKVVNSFEGGGIVTDDDTPADALRALHNFGLGHDGVGAGINAKMSEAAAAMGLTSLEAFADAVASNRANYELYRQELSGLPGVRLSSYDPAERNNYHYVIALIDAGVTGLHRDLLLTLLRAENVVAQPYFSPGCHQREPYRTEHPVSLPHTEHLAEQVIALPTGPAVSREDIRRVCDIIRVAAAHGPRITAQAGA

SEQ ID NO: 43645 - DNA, 1161 bp, Rhizobium meliloti
  CDS (1)..(1161)
atgataccttacggtcgtcaggatatcacgcaggcggacatcgacgcggttgcagaggtgctccgttccgattttcttacgcaagggccagcggtgcctcgttttgagaacgcccttgttgattacacgggtgcaaagtttgcattagcggcaaacagtgcaacatcagcacttcatgtagcttgcctagcgttgggcctcggtccaggagactggttgtggacttcgccattgacgttcgtggcgtctgccaattgtgcactttactgcggagccaaggtggacttcgttgacgtggatccgcgaacctataatctttgcccagcgaaactagagcgcaagttaatcgttgccgaacgcgatggaactcttcccaagatcgttgtgctcgtgcatttcgctggccagccgtgcgctattgccgaattccatgagctcggtaagcggtacgggttcaggatcattgaggacgcttcacacgctgttggtggtaggtatcggggcgaacccatcggcaattgccgctacagtgatgtcaccgtcttcagcttccacccggtaaagatcgtcaccactgcggaaggaggcgcggctctgaccaacagcaaggagcttgcagaaagaatagcgttatttcgtagtcacggaattacacgcgatccggcagtaatgacccatgaaccggacgggccttggtattatcagcaggtggaacttggatacaactaccgtttgactgatatgcaagcggctttggggctgagtcagatggttcgcctcgacgaatatgtcgcaaggcgtcacaccctggctcggcgatatgataagtcgcttgtcgaactccccgtggtgacgccatggcagcaccctgacagctattccggcctgcacctttatgtggtccgcctggaacgtacgaagatttctaaatctcaccgagcgttcttcgaggggctccgtgcacggggcattggtgtgaacctgcactatattccggttcatacgcagccctattattcgaaaatgggcttccgaaagggcgactatcctgaagcggaacggtattacgaggaggcaatcacactgccgttatacccgacaatgactgaagcgcaacaggaccaggtcgtggcggcgctcactgcggaactggcaacgtga

SEQ ID NO: 43646 - protein, 386 aa, Rhizobium meliloti
MIPYGRQDITQADIDAVAEVLRSDFLTQGPAVPRFENALVDYTGAKFALAANSATSALHVACLALGLGPGDWLWTSPLTFVASANCALYCGAKVDFVDVDPRTYNLCPAKLERKLIVAERDGTLPKIVVLVHFAGQPCAIAEFHELGKRYGFRIIEDASHAVGGRYRGEPIGNCRYSDVTVFSFHPVKIVTTAEGGAALTNSKELAERIALFRSHGITRDPAVMTHEPDGPWYYQQVELGYNYRLTDMQAALGLSQMVRLDEYVARRHTLARRYDKSLVELPVVTPWQHPDSYSGLHLYVVRLERTKISKSHRAFFEGLRARGIGVNLHYIPVHTQPYYSKMGFRKGDYPEAERYYEEAITLPLYPTMTEAQQDQVVAALTAELAT

SEQ ID NO: 43647 - DNA, 1164 bp, Aeromonas punctata
  CDS (1)..(1164)
gtgattccatacggtaaacaagagatcacccagcaagatattgatggcgtggttgcggtgttacaatctgattttctaactcagggaccaaaagtccctgaatttgaaaaatatttaacaacccatactggcgcagcgtatgcgttggctgtaaatagtgctacttcggcactacacattgcctgtttggctttgggtcttggtcctggcgattttttatggacaagcccagttacttttgttgcatcagcaaattgcggtttgtattgtggcgccaaagtcgattttgtacatatagatccagatacatataatctgtgtccgaagcaattggagaaaaagctaattgcagctaatgccaacggtaccttacccaagatagtcgttcctgttcatttatgtggccaaccttgtgacatggaagcgatttcccgtctggcaactgaatatggctttaaagttatcgaggatgcatcacatgctatcggcggtagttatttaaacgaacccattggcaattgtcgatacagcgacattacggtatttagtttccatccggttaaaattatcactactgctgaaggtggcgcagtggtaactaaccaaaaagatttagctgataaaatggccttgttacgtagccatggtatcacccgtgatatcgagcagatgaaaggcgaaagtcatggtggttggtattatcaacagattgacttgggctttaactaccgaatgaccgagttacaagctgcattagggatcacccaaatacaacgccttgatgaatttatcgctgctcgtcatcgcttggctgaccgttataacagacttttgaagcggttaccgatagtcttaccattccagttagaaaatacccattccggattgcatctttacgttatacgacttcagcttaataatatttcattaacgcaccgagaggtttttgaagcgttacgtgaaaatggtatcggggtgaatgttcattacatacctgtacatacacagccttattacgaagatatgggattcaaatctggtgattttcctgaggcagagcaatattatcgtgaagctatttctttgccgatgttccacggcatgacagaagagcagcaagataaagtagtatgcgtattgtctgagatattggaagggaaataa

SEQ ID NO: 43648 - protein, 387 aa, Aeromonas punctata
MIPYGKQEITQQDIDGVVAVLQSDFLTQGPKVPEFEKYLTTHTGAAYALAVNSATSALHIACLALGLGPGDFLWTSPVTFVASANCGLYCGAKVDFVHIDPDTYNLCPKQLEKKLIAANANGTLPKIVVPVHLCGQPCDMEAISRLATEYGFKVIEDASHAIGGSYLNEPIGNCRYSDITVFSFHPVKIITTAEGGAVVTNQKDLADKMALLRSHGITRDIEQMKGESHGGWYYQQIDLGFNYRMTELQAALGITQIQRLDEFIAARHRLADRYNRLLKRLPIVLPFQLENTHSGLHLYVIRLQLNNISLTHREVFEALRENGIGVNVHYIPVHTQPYYEDMGFKSGDFPEAEQYYREAISLPMFHGMTEEQQDKVVCVLSEILEGK

SEQ ID NO: 43649 - DNA, 1215 bp, Streptococcus suis
  CDS (1)..(1215)
atgacaaaaagacaaaatattccattttcaccaccagatattacccaagctgaaattgatgaagttattgacacactaaaatctggttggattacaacaggaccaaagacaaaagagctagaacgtcggctatcagtatttacaggaaccaataaaactgtgtgtttaaattctgctactgcaggattggaactagtcttacgaattcttggtgttggacccggagatgaagttattgttcctgctatgacctatactgcctcatgtagtgtcattactcatgtaggagcaactcctgtgatggttgatattcaaaaaaacagctttgagatggaatatgatgctttggaaaaagcgattactccgaaaacaaaagttatcattcctgttgatctagctggtattccttgtgattatgataagatttataccatcgtagaaaacaaacgctctttgtatgttgcttctgataataaatggcagaaactttttgggcgagttattatcctatctgatagtgcacactcactaggtgctagttataagggaaaaccagcgggttccctagcagattttacctcattttctttccatgcagttaagaattttacaactgctgaaggaggtagtgtgacatggagatcacatcctgatttggatgacgaagagatgtataaagagtttcagatttactctcttcatggtcagacaaaggatgcattagctaagacacaattagggtcatgggaatatgacattgttattcctggttacaagtgtaatatgacagatattatggcaggtatcggtcttgtgcaattagaacgttacccatctttgttgaatcgtcgcagagaaatcattgagaaatacaatgctggctttgaggggacttcgattaagccgttggtacacctgacggaagataaacaatcgtctatgcacttgtatatcacgcatctacaaggctatactttagaacaacgaaatgaagtcattcaaaaaatggctgaagcaggtattgcgtgcaatgttcactacaaaccattacctcttctcacagcctacaagaatcttggttttgaaatgaaagattttccgaatgcctatcagtattttgaaaatgaagttacactgcctcttcataccaacttgagtgatgaagatgtggagtatgtgatagaaatgtttttaaaaattgttagtagagattag

SEQ ID NO: 43650 - protein, 404 aa, Streptococcus suis
MTKRQNIPFSPPDITQAEIDEVIDTLKSGWITTGPKTKELERRLSVFTGTNKTVCLNSATAGLELVLRILGVGPGDEVIVPAMTYTASCSVITHVGATPVMVDIQKNSFEMEYDALEKAITPKTKVIIPVDLAGIPCDYDKIYTIVENKRSLYVASDNKWQKLFGRVIILSDSAHSLGASYKGKPAGSLADFTSFSFHAVKNFTTAEGGSVTWRSHPDLDDEEMYKEFQIYSLHGQTKDALAKTQLGSWEYDIVIPGYKCNMTDIMAGIGLVQLERYPSLLNRRREIIEKYNAGFEGTSIKPLVHLTEDKQSSMHLYITHLQGYTLEQRNEVIQKMAEAGIACNVHYKPLPLLTAYKNLGFEMKDFPNAYQYFENEVTLPLHTNLSDEDVEYVIEMFLKIVSRD

SEQ ID NO: 43651 - DNA, 1131 bp, Bacteroides fragilis
  CDS (1)..(1131)
atgaacaaacgaatctggctttcgcttgctcacatgggtggccgtgagcaagactttataaaagaggcctttgatacgaactgggttgtccctttgggacctaacgtggatgcctttgagcaatctttggttgaatatttgcatgaagaccgctatgtagtggctttgagtgccggaacggctgcacttcacttgggcttgattcttctggatgtgaagcccggtgatgaagtgatctgccaaagctttacttttgctgcctctgccaatccgatttcttatctggaggccaaacctgtttttgtggacagtgagaaggatacctggaatatggatccggtattgctcgaggaggctataaaggaccgtttgcgcaagacgggtaagctcccgaaggctattatccctgtccacctttacggtatgcctgccaagatggacgagatcatggatattgcgggtcgttatggtatctccgtattggaggatgccgcggaggctttgggttcggaactgaacggacggaagtgcggcacattcggtgaactggccgctctctctttcaatggcaacaagatgatcacgacttccgggggaggtgctctgatctgtcgtacggaggaagaggcgaagcaaacaaagttctacgctacgcaggctcgtgatgccgctccgcattaccagcatacccatatcggttacaattaccgtatgagcaacatctgtgcgggtatcggtcgtgggcagatgtacgttctggaagatcatattgcccgtcgccgtgccattcactctttgtatgttgatttgctgaaagatgtggcgggtattacggtcatggagaaccctgattcgcggtttgcttccaacttttggcttacttgtattctggttgatccgaagcttgcgggtaagagtcgtgaggatatccgtttgaggctggactccgagaacatagagacgcgtcctctgtggaagccgatgcatcttcagcctgtgttcacggatgctccgttctatgggaatggtacgagtgagaggttgttcgatatcggcctgtgtctgccttcgggacctacactgacagatgaggatatcaggagagtggtggatacgattaggaagatgtag

SEQ ID NO: 43652 - protein, 376 aa, Bacteroides fragilis
MNKRIWLSLAHMGGREQDFIKEAFDTNWVVPLGPNVDAFEQSLVEYLHEDRYVVALSAGTAALHLGLILLDVKPGDEVICQSFTFAASANPISYLEAKPVFVDSEKDTWNMDPVLLEEAIKDRLRKTGKLPKAIIPVHLYGMPAKMDEIMDIAGRYGISVLEDAAEALGSELNGRKCGTFGELAALSFNGNKMITTSGGGALICRTEEEAKQTKFYATQARDAAPHYQHTHIGYNYRMSNICAGIGRGQMYVLEDHIARRRAIHSLYVDLLKDVAGITVMENPDSRFASNFWLTCILVDPKLAGKSREDIRLRLDSENIETRPLWKPMHLQPVFTDAPFYGNGTSERLFDIGLCLPSGPTLTDEDIRRVVDTIRKM

SEQ ID NO: 43653 - DNA, 1176 bp, Acinetobacter lwoffii
  CDS (1)..(1176)
atgttgaacacggcattcgaaccatggccaagttttacgcaagaagaagcagacgcagttaaagatgtattactttcaaataaagtaaattactggacagggcaagaatgccgagagtttgaaaaggagttcgcaacatttgctggcactcaatatgcggtggctttaaccaatggtacagttgctctagatgtggctttaaaagctctgggaattggagctggtgatgatgtaattgttacttcacgaactttccttgcctcagccagttcaattgttaccgctggtgctaatcctatctttgctgatgttgagctggactctcaaaatatttcacgagctaccattgaagcggtactgactccgagaaccaaagcgattatttgtgtgcacttggcgggctggatgtgtgatatgaatccgatcatgcagctggctgaagaaaaggggctgtatgttattgaagattgcgcgcaagcgcatggtgcacagtataaaggtaaaccagcgggttcaattgggcatatttcagcttggtctttttgccaagataaaattatgaccacaggtggcgaaggtggcatggtcacgaccaatgatgaaagcctttggaagaaaatgtggtcttataaagatcatggtaagaattttgatagtatttataataaacaacatccccccggttttcgttggttacatgactcatttggaaccaattggcgtatgatggaaatgcaggcagtgattggtcgtattcaactgacacgtatggcagagtggacacaaaaacgaactgagaatgcagaaaaaattctaaaagcttttgccgattctccatattttacagttcacttaccttcgaatgattatgtgcatgcgcattataaatgctatgtacaagtcaatttggctgcattacctgaaggttggtcacgggacagaatcatgcaagagattaattcgcaaaatgtgccttgctttagtggttcttgttctgaggtgtatttggaacacgcttttgataatacgccgtggcgccctgaacagcggttggaaaatgcgcaacaacttggtgagacaagtttaatgtttttggtacatccgacattaagtgaagatagcattacaaaaacagtagtggctattcagaacgtgatccaagcaattgatgattaa

SEQ ID NO: 43654 - protein, 391 aa, Acinetobacter lwoffii
MLNTAFEPWPSFTQEEADAVKDVLLSNKVNYWTGQECREFEKEFATFAGTQYAVALTNGTVALDVALKALGIGAGDDVIVTSRTFLASASSIVTAGANPIFADVELDSQNISRATIEAVLTPRTKAIICVHLAGWMCDMNPIMQLAEEKGLYVIEDCAQAHGAQYKGKPAGSIGHISAWSFCQDKIMTTGGEGGMVTTNDESLWKKMWSYKDHGKNFDSIYNKQHPPGFRWLHDSFGTNWRMMEMQAVIGRIQLTRMAEWTQKRTENAEKILKAFADSPYFTVHLPSNDYVHAHYKCYVQVNLAALPEGWSRDRIMQEINSQNVPCFSGSCSEVYLEHAFDNTPWRPEQRLENAQQLGETSLMFLVHPTLSEDSITKTVVAIQNVIQAIDD

SEQ ID NO: 43655 - DNA, 1182 bp, Streptomyces antibioticus
  CDS (1)..(1182)
atgaaacgaggcgtgcacgacctggccctcttcggcggcgacgcggccttcctccagcccctctacatggggcgccccaacaccggtgaccgcaaacgcctgctggaccgcctggaatgggccctggacaaccggtggctgaccaacggcggcccgctcgtccgggagttcgagcagcgcatcgccgacctggccggtgtacgcaactgcgtcgccacctgcaacgccaccgcgggactccaactgctgctgcgcgaagcggaggtcaccggcgaagtgatcatgccgtcgatgaccttcgtcgccaccgcccacgccgtccggtggctcggactgcgccccgtcttctgcgacatcgacccggacaccggctgcctcgaccccaaactcgtcgaagccgccgtcaccccccgcaccggcgcgatcctcggcgtccacctctggggccggcccagccgggtcgacgaactcgccgccatagccgccgagcacggactgaagctcttctacgacgccgcccacgccctcggatgcacctcacggcagcgccggctcggctccttcggcgacgccgaggtcttcagcttccacgccaccaaggtcgtcaactccttcgagggcggcggcatcgtcaccgacgacgacacccgcgccgagcgcctgcgcgcgctgcacaacttcggcctgggccacgacggcgtcggcgccggcatcaacgccaagatgagcgaggcggccgccgccatgggcctgacctccctggaggcgttcgccgacgcggtcgcgagcaaccgcgccaactacgagctctaccggcaggaactctccggcctccccggcgtccggctcatcgactacgacccggcggaacgcaacaactaccactacgtcatcgccctgatcgacgccggcgtcaccggactccaccgggacctcctgctcaccctcctgcgcgcggagaacgtcgtcgcgcagccctatttctcccccggatgccaccagcgcgagccctaccgcaccgagcacccggtctccctgccgcacaccgaacacctcgccgagcaggtcatcgccctgcccaccggtcccgcggtctcccgcgaggacatccgacgcgtctgcgacatcatccgggtcgccgccgcgcacggaccgcggatcaccgcccaggccggcgcctag

SEQ ID NO: 43656 - protein, 393 aa, Streptomyces antibioticus
MKRGVHDLALFGGDAAFLQPLYMGRPNTGDRKRLLDRLEWALDNRWLTNGGPLVREFEQRIADLAGVRNCVATCNATAGLQLLLREAEVTGEVIMPSMTFVATAHAVRWLGLRPVFCDIDPDTGCLDPKLVEAAVTPRTGAILGVHLWGRPSRVDELAAIAAEHGLKLFYDAAHALGCTSRQRRLGSFGDAEVFSFHATKVVNSFEGGGIVTDDDTRAERLRALHNFGLGHDGVGAGINAKMSEAAAAMGLTSLEAFADAVASNRANYELYRQELSGLPGVRLIDYDPAERNNYHYVIALIDAGVTGLHRDLLLTLLRAENVVAQPYFSPGCHQREPYRTEHPVSLPHTEHLAEQVIALPTGPAVSREDIRRVCDIIRVAAAHGPRITAQAGA

SEQ ID NO: 43657 - DNA, 1155 bp, Shigella sonnei
  CDS (1)..(1155)
atgaaaaattttattccttttgcgttacctgaaattggcgaagaagaaattgcagaggtaattgactctttacgttcaggttggattacgacaggtcctaaggctaagcaatttgaacaagaattttctaattacctaggagcgaacgttcaatcattagctgttaactctgctacgtcgggcttacatttggctcttgaagctgttggcgtaaagccgggagaccaagttattgtcccatcatatacattcactgctactgccgaaattgtcaggtaccttggtgctgatcctgtaattgttgatgtagatcgtaaaacatttaatatatcagttgatgccattgagaaggctattactaatgaaacaaaggcgattattccagtacacttcgctggattagcttgtgacatggattcaatcttatcaattgctaaaaaatatgacctaaaggttgtcgaggatgccgctcatgcatttcctacaacatataaaggaagtaagataggaacgcttgattcagatgctacggtttttagcttctacgccaataaaactatgacaaccggtgaaggcggaatggttgtttcaaaaaataaagatataattgagcgttgtaaggtaatgcgtttacatggaatcagtcgtgacgcttttgaccggtaccagtctaaaactccttcttggttttatgaggttgtagctccagggtttaaatacaatatgcctgatatctgtgcggcaatcggtattcatcaacttagaaagatcgatgattttcagaaaaaacgtcaacgaatggcaaaaatttacgatgatgcgttaaaagaattgccacttgaattgcctgaatggcctactaatgctagtgatattcatgcttggcatctatatcctatccgcttaaaaactgattcggctattaatcgcgatgattttattaagaagttatcagatcttggaattggttgttctgtccattttataccgttgcataagcaaccggtttggcgtgatacatataatttgaacgccagtgactttccagtttctgaggagtgttatttaaatgaaatatctattcctctttatactaaaatgacggatcaagatcagttgttcgttatcaaatcgattagacaattatttatgtaa

SEQ ID NO: 43658 - protein, 384 aa, Shigella sonnei
MKNFIPFALPEIGEEEIAEVIDSLRSGWITTGPKAKQFEQEFSNYLGANVQSLAVNSATSGLHLALEAVGVKPGDQVIVPSYTFTATAEIVRYLGADPVIVDVDRKTFNISVDAIEKAITNETKAIIPVHFAGLACDMDSILSIAKKYDLKVVEDAAHAFPTTYKGSKIGTLDSDATVFSFYANKTMTTGEGGMVVSKNKDIIERCKVMRLHGISRDAFDRYQSKTPSWFYEVVAPGFKYNMPDICAAIGIHQLRKIDDFQKKRQRMAKIYDDALKELPLELPEWPTNASDIHAWHLYPIRLKTDSAINRDDFIKKLSDLGIGCSVHFIPLHKQPVWRDTYNLNASDFPVSEECYLNEISIPLYTKMTDQDQLFVIKSIRQLFM

SEQ ID NO: 43659 - DNA, 1155 bp, Plesiomonas shigelloides
  CDS (1)..(1155)
atgaaaaattttattccttttgcgttacctgaaattggcgaagaagaaattgcagaggtaattgactctttacgttcaggttggattacgacaggtcctaaggctaagcaatttgaacaagaattttctaattacctaggagcgaacgttcaatcattagctgttaactctgctacgtcgggcttacatttggctcttgaagctgttggcgtaaaacctggagaccaagttattgtcccatcatatacattcactgctactgccgaaattgtcaggtaccttggtgctgatcctgtaattgttgatgtagatcgtaaaacatttaatatatcagttgatgccattgagaaggctattactaataaaacaaaggcgattattccagtacacttcgctggattagcttgtgacatggattcaatcttatcaattgctaaaaaatatgacctaaaggttgtcgaggatgccgctcatgcatttcctacaacatataaaggaagtaagataggaacgcttgattcagatgctacggtttttagcttctacgccaataaaactatgacaaccggtgaaggcggaatggttgtttcaaaaaataaagatataattgagcgttgtaaggtaatgcgtttacatggaatcagtcgtgacgcttttgaccggtaccagtctaaaactccttcttggttttatgaggttgtagctccagggtttaaatacaatatgcctgatatctgtgcggcaatcggtattcatcaacttagaaagatcgatgattttcagaaaaaacgtcaacgaatggcaaaaatttacgatgatgcgttaaaagaattgccacttgaattgcctgaatggcctactaatgctagtgatattcatgcttggcatctatatcctatccgcttaaaaactgattcggctattaatcgcgatgattttattaagaagttatcagatcttggaattggttgttctgtccattttataccgttgcataagcaaccggtttggcgtgatacatataatttgaacgccagtgactttccagtttctgaggcgtgttatttaaatgaaatatctattcctctttatactaaaatgacggatcaagatcagttgttcgttatcgaatcgattagacaattatttatgtaa

SEQ ID NO: 43660 - protein, 384 aa, Plesiomonas shigelloides
MKNFIPFALPEIGEEEIAEVIDSLRSGWITTGPKAKQFEQEFSNYLGANVQSLAVNSATSGLHLALEAVGVKPGDQVIVPSYTFTATAEIVRYLGADPVIVDVDRKTFNISVDAIEKAITNKTKAIIPVHFAGLACDMDSILSIAKKYDLKVVEDAAHAFPTTYKGSKIGTLDSDATVFSFYANKTMTTGEGGMVVSKNKDIIERCKVMRLHGISRDAFDRYQSKTPSWFYEVVAPGFKYNMPDICAAIGIHQLRKIDDFQKKRQRMAKIYDDALKELPLELPEWPTNASDIHAWHLYPIRLKTDSAINRDDFIKKLSDLGIGCSVHFIPLHKQPVWRDTYNLNASDFPVSEACYLNEISIPLYTKMTDQDQLFVIESIRQLFM

SEQ ID NO: 43661 - DNA, 1167 bp, Streptomyces lavendulae
  CDS (1)..(1167)
atgacacctacgtccggtgatgacgtcctgtcctttccctcatggccgcaacacggcgcggaggagcgcgccggactcctgcgggccctggaccagaaggggtggtggcgcgacgcggggcaggaggtcgatctcttcgagcgggagttcgccgaccaccacggcgccccgcacgcgatcgccacgacgaacggcacccacgccctggaactcgccctgggggtcatggggatcggccccggtgacgaggtcatcgtccccgcgttcaccttcatctcgtcgtcgctggccgtgcagcgcatgggcgcggtgccggtgccggcggacgtacggcccgacacctactgcctcgatgccgacgcggcggcggcgctggtgacgccacgcaccaaagcgatcatgccggtccacatggcgggccagttcgccgacatggacgccctggagaagctctccgtcgcgacgggcgtgccggtcctccaggacgccgcgcacgcccacggcgcgcagtggcagggccgccgggtcggggagctcggctcgatcgccgccttcagcttccagaacggcaagctgatgaccgccggcgagggcggcgccctgctcctgccggacgacgagtccttccacgaggcgttcctccagcactgctgcggccgcccgcccggggaccgcgtctaccgccatctgacgcagggctccaactaccgcatgaacgagttctccgcgagcgtcctgcgtgctcaactgaagcgcttgaaggatcagttgcgcatcagggaggagcgctgggcccagctgcgtacggcactggccgccatcgacggcgtggtgccgcaggggcgcgacgagcgcggcgacctccactcccactacatggccatggtccggctgcccggcatctcggcccggcgccgcctcgcgctggtggacgcgctggtcgagcggggagtgcccgcgttcgtcggcttcccgccggtctaccgcaccgagggtttcgcgcgcggcccggcgccggcggacgccgaggagctggccaagagctgtcccgtggcggaggagatcggcagcgactgcctctggctgcaccatcgcgtcctgctcgccgacgtgaccacgctggaccggctggcggaggtcttctccggcctcgtcggcgcgctctga

SEQ ID NO: 43662 - protein, 388 aa, Streptomyces lavendulae
MTPTSGDDVLSFPSWPQHGAEERAGLLRALDQKGWWRDAGQEVDLFEREFADHHGAPHAIATTNGTHALELALGVMGIGPGDEVIVPAFTFISSSLAVQRMGAVPVPADVRPDTYCLDADAAAALVTPRTKAIMPVHMAGQFADMDALEKLSVATGVPVLQDAAHAHGAQWQGRRVGELGSIAAFSFQNGKLMTAGEGGALLLPDDESFHEAFLQHCCGRPPGDRVYRHLTQGSNYRMNEFSASVLRAQLKRLKDQLRIREERWAQLRTALAAIDGVVPQGRDERGDLHSHYMAMVRLPGISARRRLALVDALVERGVPAFVGFPPVYRTEGFARGPAPADAEELAKSCPVAEEIGSDCLWLHHRVLLADVTTLDRLAEVFSGLVGAL

SEQ ID NO: 43663 - DNA, 1137 bp, Streptomyces bluensis
  CDS (1)..(1137)
gtgagcgcttttcaggatttgccgaggtggccccagctggcggacaacgacatcgaggcggcggtcgccgccttgcgttcgaaccgcctggcggggtcgggcaacagcacggtccaggacttcgagtcggccctggccgcggggcagggcgtcgagcacgcggtcgccgtgtccacgggcacggcagcagtgcacctggcactgcacgcgctggacgtcggggccggcgacgaagtgatcgtgcccacccacacgttcatcggttcggcgagcccggtcacctatctgggcgcccgcccggtcttcgccgatgtcacacccgacacgcactgcctggaccccgactccgtcaaggcactcctcaccgagcgcaccaaggcgatcgtggcggtgcacatcaacggctgtgccgcggacatggaggccctgtccgcggtcggagccgccgcgggcgttccggtgatcgaggacatggcgcaggcgctgggcacccgttcgggcgggcgccctgtaggcgggttcggggacctggcgtgcgtcagcctcttcgagcagaaggtgatcacgtcggggggcgagggcggcgccgtcctcacgaacaatcccggctacgcggagcgcttgcgccgcgtgcgcagccacggcgagggccccatcaagggccgcccgggcctgatctgggcccacgaggtgggctacaactaccggctcacatctgtccaggccgcgatcggcctcgcccagcacgcccgtctccaggagctggtcgaggcccgcaggcacaacgcggcccggctgtccgagcgactcgcgggcgtcgacgggctcgaactgcctgtggagccggcggggaccacgcacgcgttctggaagtacgtggtgcgcgtggtgcccggcgagggacgcccgccggccgcggagatcgcggcgacgctgcgctcgcgcggcgtgccggtgctgctgcgctatcccttccccctgcacaagcagccggccttcgccgagcaccaaggggtgtcgctcccggtggcggagcgcctctcgcaggagctccttgcgcttccgtcgcacccgggcctggtggaggggcacctagaccacgtcgcggacgaggtccgccgggccgtcgccccgtga

SEQ ID NO: 43664 - protein, 378 aa, Streptomyces bluensis
MSAFQDLPRWPQLADNDIEAAVAALRSNRLAGSGNSTVQDFESALAAGQGVEHAVAVSTGTAAVHLALHALDVGAGDEVIVPTHTFIGSASPVTYLGARPVFADVTPDTHCLDPDSVKALLTERTKAIVAVHINGCAADMEALSAVGAAAGVPVIEDMAQALGTRSGGRPVGGFGDLACVSLFEQKVITSGGEGGAVLTNNPGYAERLRRVRSHGEGPIKGRPGLIWAHEVGYNYRLTSVQAAIGLAQHARLQELVEARRHNAARLSERLAGVDGLELPVEPAGTTHAFWKYVVRVVPGEGRPPAAEIAATLRSRGVPVLLRYPFPLHKQPAFAEHQGVSLPVAERLSQELLALPSHPGLVEGHLDHVADEVRRAVAP

SEQ ID NO: 43665 - DNA, 1167 bp, Streptomyces collinus
  CDS (1)..(1167)
atgaacgcgcgaccggcaccggaattccccacatggccccagtacgacgacgaggagcggaccggtctgatccgggccctcgaacagggccagtggtggcgcatgggcggggaggaagtctcctccttcgagcaggagttcgcggacttccacggcgccccgcacgccttcgcggtcaccaacggcacccacgccttcgaactcgccctccaggtcatgggcgccggcccgggcaccgaggtcatcgtgcccgccttcaccttcatctcctcctcgcaggccgcccagcgcatcggcgccgtcgcggtccccgtcgacgtcgaccccgacacgtacaacatcgacgtcgccgccgcggccgccgccgtcaccccgcgcacccgcgtcatcatgcccgtgcacatggccggtctgatggccgacatggacgccctcggcaagctctccgccgacaccggcgtagcgatcctgcaggacgcggcccacgcccagggcgcccgctggcagggcaagcgggtcggtgaactcggcacggtcgccgcgttctccttccagaacggcaagctgatgaccgccggcgagggcggcgccgtcctgttccccgagaacgacctgtacgaggcggcgttcctgcggcacagctgcggccggccgcgcaccgaccggcactacaagcaccaggtcgccggcaccaacatgcggctcaacgagttctccgccgccgtgctgcgcgcccagctgcgccgcctgcccgcccagacggagctgcgcgaccggcgctgggcgctgctgtcccggctgctcggtgccgtcgacggcgtcgtgccgcagggcggtgacgtccgcgccgaccagaacacccactacatggcgatgttccggatccccggcatcaccgaagcggaccgcaacaccctggtggaccggctggtcgaggccgggctgcccgcgttcgccgcgttccgcgcctctaccgcaccgacgccttctggggagaaccggcgcccccgacgaagaccgtggagcagtgtcgccgagcgctgcccgcacagccgaggccatcagcagcgaactgcgtctggctgcaccaccgggtcctcctcgccgacgagcgggacctggaactcagcggccgagatcatcgcggacgcagtggccgcgatatga

SEQ ID NO: 43666 - protein, 388 aa, Streptomyces collinus
MNARPAPEFPTWPQYDDEERTGLIRALEQGQWWRMGGEEVSSFEQEFADFHGAPHAFAVTNGTHAFELALQVMGAGPGTEVIVPAFTFISSSQAAQRIGAVAVPVDVDPDTYNIDVAAAAAAVTPRTRVIMPVHMAGLMADMDALGKLSADTGVAILQDAAHAQGARWQGKRVGELGTVAAFSFQNGKLMTAGEGGAVLFPENDLYEAAFLRHSCGRPRTDRHYKHQVAGTNMRLNEFSAAVLRAQLRRLPAQTELRDRRWALLSRLLGAVDGVVPQGGDVRADQNTHYMAMFRIPGITEADRNTLVDRLVEAGLPAFAAFRASTAPTPSGENRRPRRRPWSSVAERCPHSRGHQQRTASGCTTGSSSPTSGTWNSAAEIIADAVAAI

SEQ ID NO: 43667 - DNA, 1302 bp, Streptomyces violaceoruber
  CDS (1)..(1302)
atggatgcggagaagacgcacatcctggagagggtgcgcgagtaccaccaggccagggagcagcgggagttcgtgccgggcgtgacaccggtgcagccctcgggcgcggcgctcgacgcgaacgaccgggtggcgctcgtcgaagcggcgctcgacctgaggatcgccgccgggccgagcacacagcgcttcgagcgcgacttcgcccgctacttcgggctgcgcaaggcacacatgaccaactcgggttcctccgccaaccttctcgccctgacctcgctgacctcgcacacgctgggcgaccgcaggctgcggcccggggacgaggtgatcacggtggcggccgggttcccgacgacggtcaacccgatcatccagaacggcctggtccccgtcttcgtggacgtggagctggggacgtacaacacgaccgccgagcgggtcctcgccgcggtcggcccgcgcacgaaggcgatcatgatcgcgcacgcgcttggcaacccgttcccggtcgcggacgtcgccgccatcgccgccgaacacggcctgtacctcgtcgaggacaactgcgacgccgtcggttcgtaccaccagggcaggctgaccggcaccttcggcgacctgacgacgaccagtttctatccggcgcaccacatcaccacgggcgagggcggctgtgtcctcacccgcaatctggctctcgcgcggatcgtggagcaactgcgggactggggccgggactgctggtgcgaaccgggcaaggacaacacctgcttcaagcggttcgactaccagctggggacgctgccgcacggctacgaccacaagtacatcttcacgcatctcggctacaacctgaaggccaccgacatccaggccgcgctcggcgtcagccagctgtcgcggctcgactccttcggcaaggcccggcgcgccaactggcagcggatgtacgagggtctggcgggcgttccggggctgctgctgccccgggcgacggagcacagcgacccgagctggttcggcttcgtgctcaccgtgctgcccgacgcgtctttcacccggcgcggcctggaggacttcctcggttcccggaagatcggcaccaggcggctgttcggcggcaacctgacccggcaccccgcctaccaggaccgcgactaccgggtcgtgggcgagctgaccaactccgacgtcatcaccgagcacaccctgtgggtgggcgtccatcccagcatgaccgacgagatggtcgaccacgtggccggaagcatccgggagttcgcgatctcggcacgctga

SEQ ID NO: 43668 - protein, 433 aa, Streptomyces violaceoruber
MDAEKTHILERVREYHQAREQREFVPGVTPVQPSGAALDANDRVALVEAALDLRIAAGPSTQRFERDFARYFGLRKAHMTNSGSSANLLALTSLTSHTLGDRRLRPGDEVITVAAGFPTTVNPIIQNGLVPVFVDVELGTYNTTAERVLAAVGPRTKAIMIAHALGNPFPVADVAAIAAEHGLYLVEDNCDAVGSYHQGRLTGTFGDLTTTSFYPAHHITTGEGGCVLTRNLALARIVEQLRDWGRDCWCEPGKDNTCFKRFDYQLGTLPHGYDHKYIFTHLGYNLKATDIQAALGVSQLSRLDSFGKARRANWQRMYEGLAGVPGLLLPRATEHSDPSWFGFVLTVLPDASFTRRGLEDFLGSRKIGTRRLFGGNLTRHPAYQDRDYRVVGELTNSDVITEHTLWVGVHPSMTDEMVDHVAGSIREFAISAR

SEQ ID NO: 43669 - DNA, 1140 bp, Streptomyces venezuelae
  CDS (1)..(1140)
gtgagcagccgcgccgagaccccccgcgtccccttcctcgacctcaaggccgcctacgaggagctccgcgcggagaccgacgccgcgatcgcccgcgtcctcgactcggggcgctacctcctcggacccgaactcgaaggattcgaggcggagttcgccgcgtactgcgagacggaccacgccgtcggcgtgaacagcgggatggacgccctccagctcgccctccgcggcctcggcatcggacccggggacgaggtgatcgtcccctcgcacacgtacatcgccagctggctcgcggtgtccgccaccggcgcgacccccgtgcccgtcgagccgcacgaggaccaccccaccctggacccgctgctcgtcgagaaggcgatcaccccccgcacccgggcgctcctccccgtccacctctacgggcaccccgccgacatggacgccctccgcgagctcgcggaccggcacggcctgcacatcgtcgaggacgccgcgcaggcccacggcgcccgctaccggggccggcggatcggcgccgggtcgtcggtggccgcgttcagcttctacccgggcaagaacctcggctgcttcggcgacggcggcgccgtcgtcaccggcgaccccgagctcgccgaacggctccggatgctccgcaactacggctcgcggcagaagtacagccacgagacgaagggcaccaactcccgcctggacgagatgcaggccgccgtgctgcggatccggctcgcccacctggacagctggaacggccgcaggtcggcgctggccgcggagtacctctccgggctcgccggactgcccggcatcggcctgccggtgaccgcgcccgacaccgacccggtctggcacctcttcaccgtgcgcaccgagcgccgcgacgagctgcgcagccacctcgacgcccgcggcatcgacaccctcacgcactacccggtacccgtgcacctctcgcccgcctacgcgggcgaggcaccgccggaaggctcgctcccgcgggccgagagcttcgcgcggcaggtcctcagcctgccgatcggcccgcacctggagcgcccgcaggcgctgcgggtgatcgacgccgtgcgcgaatgggccgagcgggtcgaccaggcctag

SEQ ID NO: 43670 - protein, 379 aa, Streptomyces venezuelae
MSSRAETPRVPFLDLKAAYEELRAETDAAIARVLDSGRYLLGPELEGFEAEFAAYCETDHAVGVNSGMDALQLALRGLGIGPGDEVIVPSHTYIASWLAVSATGATPVPVEPHEDHPTLDPLLVEKAITPRTRALLPVHLYGHPADMDALRELADRHGLHIVEDAAQAHGARYRGRRIGAGSSVAAFSFYPGKNLGCFGDGGAVVTGDPELAERLRMLRNYGSRQKYSHETKGTNSRLDEMQAAVLRIRLAHLDSWNGRRSALAAEYLSGLAGLPGIGLPVTAPDTDPVWHLFTVRTERRDELRSHLDARGIDTLTHYPVPVHLSPAYAGEAPPEGSLPRAESFARQVLSLPIGPHLERPQALRVIDAVREWAERVDQA

SEQ ID NO: 43671 - DNA, 1092 bp, Leptospira borgpetersenii
  CDS (1)..(1092)
atgatcgaatatgaaaatctgcgtttagcgaatacacggttctttgaagagtataaaacgcggctttctgaaaccatccaaagcgggtggtatatattagggaaggaagtttctagttttgaaaatcaattcgcccaatacaatggaaaccagtattgtataggagtagggaatggtttggatgcacttatactcgccttgaaagcgttaaacatagaaaaagactccgaaattatagttccttcgaatacttatatagcatctattttagcgattttgcatgcaggtttgagacctatcttagttgaaccggatattagaacctataatatcgatcccgaaagaatagaggaaaaaattaattccagaacgaaaggaattctgattgtacatttgtatggtaaaccttgcgagatggactctattttgaagattaaggaaaaaaataatctgtttttagtagaggattgtgcacaatctcacggcgctttgtataaggggaagaaaacgggaacgtttggagaaattaacgggttcagtttttatcccactaaaaacttgggggctattggagatgcgggagctgtcgtgacggataacgatctatatcacgacgaagttaagaaactaagaaattacggttcttcgatcaagtacaagaatgatttactcggttataattctcgtttagatgaattgcaggctataatcttaaatatcaagttgaaatatttggatgcaatgaacgaacataaaagaaatttagccaagatttatctggaaaatctaaaagacgattttataaaaccggtaattgacgaaggaacttacgacgtatatcatatctttaatgttcgccatacaagacgtgacgggctgcgagactatcttctaaaaaacggcgtaaagactgaaattcattatccgattccgcctcataaacaagttgcaatgaaggacgtatttacatatgtagaaggcgagtttgctatctccgaggaggttcatcgtactacgctcagtcttccaatctcaacttttcacactaaaaacgatatttataaagtcgtcgagatcatgaatagattttga

SEQ ID NO: 43672 - protein, 363 aa, Leptospira borgpetersenii
MIEYENLRLANTRFFEEYKTRLSETIQSGWYILGKEVSSFENQFAQYNGNQYCIGVGNGLDALILALKALNIEKDSEIIVPSNTYIASILAILHAGLRPILVEPDIRTYNIDPERIEEKINSRTKGILIVHLYGKPCEMDSILKIKEKNNLFLVEDCAQSHGALYKGKKTGTFGEINGFSFYPTKNLGAIGDAGAVVTDNDLYHDEVKKLRNYGSSIKYKNDLLGYNSRLDELQAIILNIKLKYLDAMNEHKRNLAKIYLENLKDDFIKPVIDEGTYDVYHIFNVRHTRRDGLRDYLLKNGVKTEIHYPIPPHKQVAMKDVFTYVEGEFAISEEVHRTTLSLPISTFHTKNDIYKVVEIMNRF

SEQ ID NO: 43673 - DNA, 1762 bp, Bacillus stearothermophilus
  CDS (394)..(1512)
gcttatggcagtccatctcagtctctttgccttgatcgtcttcgtggaactgctggctgaactgatcggcttggtcaatgatcagtacaaaccgtttatgacttttattcgtaagctgcttcggggaagccgaaaagtatacggaaatgaccgataaatagcaaatgagccgtttgtgccatgaaagggacaaacggcttttttcaggaatgccccgtctttggaaaattatgcccttctttttcgttgtttatgcaggttctgccgttccttcgctgatttttttgcggcaaggccaagattgccacaaaactgtcattatatattgacgcaaaaatatgataaactaaacatggttattctacatattttttggattcggaggaacttgcgatgaacgtgccaatgttggatttaagcgaacagtatgaacaattgaagccggagatcatgcgcgtattggatgaagtgatgcgctcctctcgctttattttgggagattatgtcaaaaagctagaagcagatattgctgcctacagccgggcgaaacacggaatcggctgcggcaacggaagcgatgcgatacatattgctttgcaagcagccggcgtcgggccgggcgatgaagtcatcacaacggcgttcacctttttcgcgacggcaggatcgattgcgcgggccggggccaaaccggtgtttgtcgatatcgatccggtgacgttcaacatcgatccagcgcaagttgaagcggcggtgacggagaagacgaaagccatcatcccggtgcatttgtacgggcaaatggcggatatggaggcgattgccgcgattgccaagcggcatggattggttgtcattgaggacgccgcccaggcgatcggcgcgaaatacaacgggaaatgcgttggcgagcttgggacggcggcgacgtacagtttcttcccgacgaaaaacttgggcgcctatggggatggcggcatgatcattacgaatgatgacgaactggccgaaaaatgccgggtcatccgcgttcatggcagcaagccgaaatattaccatcatgtacttggctacaacagccgcctcgatgagatgcaagcggcgattttaagcgtcaaattcccgcatctggatcggtggacggaacagcggcgcaagcatgcggcgacgtatacgcgcctgctcgaggaggcggtcggcgaccttgttgtgacgccgaaagaagtcgacggtcgctatcatgtgttccatcaatacacgattcgagcgccgaagcgcgacgagttgcaagcgtttttgaaagaacaggggatcgcgacgatggtgtactatccgctgccgctgcatttgcagccggtgtttgcttcgctcgggtataaggaagggcagttgccggaggcggaaaaagcggcgaaagaagcgctgtcgctgccgatgttcccagagctgaaagaggagcagcaacagtacgtcgtcgagaaaatcgcggaattttaccgtcatttcgcttgatcgtccaaccggccaaaggaaacgtcacttgcgcacagcaatggcgtttcctttggcgttggatcatttgttttgttcacaacactttgttattttatgataaggggtggtggccggattgacggcggaaaaacgaccgtttgtgctgtacgaatatttgcgctttttttggcagcgaaaatggtggtttcttgttgttccgcttgcgacgatcgtgttgaccgtcacgtcagggcggcttttgctgcag

SEQ ID NO: 43674 - protein, 372 aa, Bacillus stearothermophilus
MNVPMLDLSEQYEQLKPEIMRVLDEVMRSSRFILGDYVKKLEADIAAYSRAKHGIGCGNGSDAIHIALQAAGVGPGDEVITTAFTFFATAGSIARAGAKPVFVDIDPVTFNIDPAQVEAAVTEKTKAIIPVHLYGQMADMEAIAAIAKRHGLVVIEDAAQAIGAKYNGKCVGELGTAATYSFFPTKNLGAYGDGGMIITNDDELAEKCRVIRVHGSKPKYYHHVLGYNSRLDEMQAAILSVKFPHLDRWTEQRRKHAATYTRLLEEAVGDLVVTPKEVDGRYHVFHQYTIRAPKRDELQAFLKEQGIATMVYYPLPLHLQPVFASLGYKEGQLPEAEKAAKEALSLPMFPELKEEQQQYVVEKIAEFYRHFA

SEQ ID NO: 43675 - DNA, 1113 bp, Streptomyces peucetius
  CDS (1)..(1113)
gtgtccacctacgtctggcaatacctcaatgaataccgggaagaacgcgccgacattctcgatgcggtggaaaccgtattcgagtccggccagcttattctcgggaccagcgtccgctctttcgaggaggagttcgccgcttatcacggactgccgtactgcacgggcgtcgacaacggcaccaacgcgctggtcctcggcctgcgggcgctcggcatcggcccgggggacgaggtcgtgacggtctccaacaccgcggcccccaccgtggtggccatcgacgccgtgggcgccacccccgtcttcgtcgacgtgcacgaggagaactacctcatggacaccggccggctccggtcggtgatcggcccgcgcacccggtgcctgctgcccgtccacctctacggacagagcgtggacatgacccccgtgctcgaactcgccgccgagcacgacctgaaggtgctggaggactgcgcccaggcccacggtgcccgccgtcacggacggctggtcggcacccaggggcatgcggcggccttctccttctacccgaccaaggtcctcggtgcctacggtgacggcggcgccgtcgtcacgccggacgcggaagtcgaccggcggctgcggcggttgcgctactacggcatgggggagcgctactacgtcgtggacacccccgggcacaacagcaggctcgacgaggtgcaggccgagatcctgcgccggaaactgcgccgcctcgacgcctatgtcgagggccgccgggccgtcgcccgccgctacgaggagggactcggtgacctcgacggcctggtgctgcccacgatcgccgagggcaacgaccacgtctactacgtgtacgtggtgcgtcaccccgaacgcgaccgcatcctggaggcgctcaccgcctacgacatccatctcaacatcagctacccctggcccgtccacaccatgagcggattcgcccacctcggctacggccccggcgacctgccggtgaccgaacggctggccggcgagatcttctccctgccgatgtacccctcgctgcgtcccgacgcgcaggagaaggtgatcgacgcggtgcgggaggtcgtcggaagcctgtga

SEQ ID NO: 43676 - protein, 370 aa, Streptomyces peucetius
MSTYVWQYLNEYREERADILDAVETVFESGQLILGTSVRSFEEEFAAYHGLPYCTGVDNGTNALVLGLRALGIGPGDEVVTVSNTAAPTVVAIDAVGATPVFVDVHEENYLMDTGRLRSVIGPRTRCLLPVHLYGQSVDMTPVLELAAEHDLKVLEDCAQAHGARRHGRLVGTQGHAAAFSFYPTKVLGAYGDGGAVVTPDAEVDRRLRRLRYYGMGERYYVVDTPGHNSRLDEVQAEILRRKLRRLDAYVEGRRAVARRYEEGLGDLDGLVLPTIAEGNDHVYYVYVVRHPERDRILEALTAYDIHLNISYPWPVHTMSGFAHLGYGPGDLPVTERLAGEIFSLPMYPSLRPDAQEKVIDAVREVVGSL

SEQ ID NO: 43677 - DNA, 1098 bp, Saccharopolyspora erythraea
  CDS (1)..(1098)
atggacgtccccttcctggacctgcaagccgcgtacctcgaactccggtccgacatcgaccaggcgtgccggcgcgtgctcgggtcgggctggtacctgcacgggccggagaacgaggcgttcgaggcggagttcgccgcctactgcgagaacgcgcactgcgtgacggtcggcagcggatgcgacgcgctggagctgagcctcgtggcgctgggcgtcggtcagggcgacgaggtgatcgtgccgtcccacaccttcatcgcgacgtggctcggtgtcccggtgggcgcggtgccggtgccagtcgaaccggaaggcgtgagccacacgctcgatccggccctggtggaacaggccatcacgccgcggacggccgccatcctgccggtgcacctctacggccaccctgcggacctcgacgcgctgcgagcgatcgccgaccgccacggcctggcactggtggaggacgtcgcacaggcggtcggcgcccgccaccgcggccaccgcgtcggcgccggctcgaacgccgcggccttcagcttctacccgggcaagaacctcggagcgctgggcgacggcggcgcggtcgtcaccaccgacccggccctggccgagcgcatccgcctgctgcgcaactacggctcgaagcagaagtacgtgcacgaggtccgcggcaccaacgcccgcctcgacgaactccaggcggcggtcctgcgcgtcaagctccgccacctcgacgactggaacgcccgccgcacaacgctggcgcagcactaccagacggaactgaaggacgtccccggcatcacgctcccggaaacccacccctgggccgactcagcctggcacctcttcgtcctccgctgcgagaaccgcgaccacctccaacgccacctgaccgacgcgggcgtccagaccctcatccactacccgaccccggtccacctctcacccgcctacgccgacctcggcctgcccccaggctccttccccgttgcggagtctctggcgggggaggtcctcagcctccccatcggcccccacctctccagggaggcggcagaccacgtcatcgcgaccctcaaggctggggcttga

SEQ ID NO: 43678 - protein, 365 aa, Saccharopolyspora erythraea
MDVPFLDLQAAYLELRSDIDQACRRVLGSGWYLHGPENEAFEAEFAAYCENAHCVTVGSGCDALELSLVALGVGQGDEVIVPSHTFIATWLGVPVGAVPVPVEPEGVSHTLDPALVEQAITPRTAAILPVHLYGHPADLDALRAIADRHGLALVEDVAQAVGARHRGHRVGAGSNAAAFSFYPGKNLGALGDGGAVVTTDPALAERIRLLRNYGSKQKYVHEVRGTNARLDELQAAVLRVKLRHLDDWNARRTTLAQHYQTELKDVPGITLPETHPWADSAWHLFVLRCENRDHLQRHLTDAGVQTLIHYPTPVHLSPAYADLGLPPGSFPVAESLAGEVLSLPIGPHLSREAADHVIATLKAGA

SEQ ID NO: 43679 - DNA, 1524 bp, Rhizobium meliloti
  CDS (1)..(1524)
atgaaagtcacaattcgcataaacggcgacgtcttgtcagcgtatatccctaagaaggacctggaggagccgatcatttcggtggcgaatgaagacctatggggcggctcgatactgctgaggaacggctggcggctggccctgccccaccttccgcaggaagctcgcctgccggttaccgtcgaggcaagaagaatgttcggccggcttgatcgaggtgcgcatgaaaaaccagatcggatgacgaggatcggtgagatctcaagctcccaagatgccgctgcaatgctagccgagaaccaaaagatgcatccatggccggctctaacgagaaccgcttacgaggatgtcgccgcatgtatctcttccggagaattatccggatcgggactgggcattatcaatgcgttcgagcggcgcatggaggagtggatcggcggcggttatgtggtctcggcaagtagcggcacagccgccctgacagtggcgctcatagctctcggcatccagccgggggacgttgtgcttctgccttcctatacctgggctgccacagcattggcaccgctacttattggagcgatcccccgtttcgtcgacattgatccgaattcctacaacatctctccgactgcgttggcggctgcgatcacaccggacgtcaaggcaatcatcgtggtccacatgcacggcattagctgcgacatggatgagattatttgccatgcgagagagcagggcattgcggtcatcgaggactgcgctcaggctcatggcgcactctacaaggggcaacatgttgggcttctgtccgacatcggatgcttcagcatgcaaaagagcaagcacctgtccgcgggcgatggcggattcatggtgacaagggatcccacgctcgcccaaaaaatgcgcgacatctgcaatttcggtctccccaccccaaaggcaaactaccgattcgatgaggtggtgcgggacggttatgccgttttccgcgagtgtgagcagatcggtggcatgttcaggttacagccgatgtccgcggctctggtgatgcaccagctagagcatctgcgccagcggatcgcctggcttcaaactgcaatggaacctctggtcgaggagtctgccaaaatccctttcttcaagattacgcgatcgcacgtcgaccggacgcatgtatggcataaaatccgcgttggaattgactatgcggcagtcgattacttcgggagatcaatggcggaaatcagacgggggctgcgcaacagccttgccgagcgcggcatctcgagcacgctgtggacggcgcctatactcccactccagacggcctttagaccctatgccggcgtcgtcgagtggaccaaatccgctggccatcttgcgatcgaaaactcgttcatcgtcttcgatgagaactacccgttgatcgcgcaggaaccggctaagatggcggagcttgttgtcaagctacagcaagcttgggacgagcactttacttcactcgctagaggcaagtga

SEQ ID NO: 43680 - protein, 507 aa, Rhizobium meliloti
MKVTIRINGDVLSAYIPKKDLEEPIISVANEDLWGGSILLRNGWRLALPHLPQEARLPVTVEARRMFGRLDRGAHEKPDRMTRIGEISSSQDAAAMLAENQKMHPWPALTRTAYEDVAACISSGELSGSGLGIINAFERRMEEWIGGGYVVSASSGTAALTVALIALGIQPGDVVLLPSYTWAATALAPLLIGAIPRFVDIDPNSYNISPTALAAAITPDVKAIIVVHMHGISCDMDEIICHAREQGIAVIEDCAQAHGALYKGQHVGLLSDIGCFSMQKSKHLSAGDGGFMVTRDPTLAQKMRDICNFGLPTPKANYRFDEVVRDGYAVFRECEQIGGMFRLQPMSAALVMHQLEHLRQRIAWLQTAMEPLVEESAKIPFFKITRSHVDRTHVWHKIRVGIDYAAVDYFGRSMAEIRRGLRNSLAERGISSTLWTAPILPLQTAFRPYAGVVEWTKSAGHLAIENSFIVFDENYPLIAQEPAKMAELVVKLQQAWDEHFTSLARGK

SEQ ID NO: 43681 - DNA, 1314 bp, Salmonella typhimurium
  CDS (1)..(1314)
atgacagcaaataacctgcgtgagcaaatctctcagcttgtcgctcagtatgcgaatgaggcattgagcccgaaaccttttgttgcaggtacaagcgttgtgcctccttccgggaaggttattggtgccaaagagttacaattgatggttgaggcgtctcttgatggatggctaactactggtcgtttcaatgatgcctttgaaaaaaaacttggggaatttattggggttcctcatgttttaacgacaacatctggctcttcggcaaacttgctggcactgactgcgctgacttccccaaaattaggcgagcgagctctcaaacctggtgatgaggttattactgtcgctgctggcttcccgactacagttaacccggcgatccagaatggtttaataccggtattcgtggatgttgatatcccgacatataatatcgatgcctctctcattgaagctgcagttactgagaaatcaaaagcgataatgatcgctcatacactcggtaatgcatttaacctgagtgaagttcgtcggattgccgataaatataacttatggttgattgaagactgctgtgatgcccttgggacgacttatgaaggccagatggtaggtacctttggtgacatcggaaccgttagtttttatccggctcaccatatcacaatgggtgaaggcggtgctgtattcaccaagtcaggtgaactgaagaaaattattgagtcgttccgtgactggggccgggattgttattgtgcgccaggatgcgataacacctgcggtaaacgttttggtcagcaattgggatcacttcctcaaggctatgatcacaaatatacttattcccacctcggatataatctcaaaatcacggacatgcaggcagcatgtggtctggctcagttggagcgcgtagaagagtttgtagagcagcgtaaagctaacttttcctatctgaaacagggcttgcaatcttgcactgaattcctcgaattaccagaagcaacagagaaatcagatccatcctggtttggcttccctatcaccctgaaagaaactagcggtgttaaccgtgtcgaactggtgaaattccttgatgaagcaaaaatcggtacacgtttactgtttgctggaaatctgattcgccaaccgtattttgctaatgtgaaatatcgtgtagtgggtgagttgacaaataccgaccgtataatgaatcaaacgttctggattggtatttatccaggcttgactacagagcatttagattatgtagttagcaagtttgaagagttctttggtttgaatttctaa

SEQ ID NO: 43682 - protein, 437 aa, Salmonella typhimurium
MTANNLREQISQLVAQYANEALSPKPFVAGTSVVPPSGKVIGAKELQLMVEASLDGWLTTGRFNDAFEKKLGEFIGVPHVLTTTSGSSANLLALTALTSPKLGERALKPGDEVITVAAGFPTTVNPAIQNGLIPVFVDVDIPTYNIDASLIEAAVTEKSKAIMIAHTLGNAFNLSEVRRIADKYNLWLIEDCCDALGTTYEGQMVGTFGDIGTVSFYPAHHITMGEGGAVFTKSGELKKIIESFRDWGRDCYCAPGCDNTCGKRFGQQLGSLPQGYDHKYTYSHLGYNLKITDMQAACGLAQLERVEEFVEQRKANFSYLKQGLQSCTEFLELPEATEKSDPSWFGFPITLKETSGVNRVELVKFLDEAKIGTRLLFAGNLIRQPYFANVKYRVVGELTNTDRIMNQTFWIGIYPGLTTEHLDYVVSKFEEFFGLNF

SEQ ID NO: 43683 - DNA, 1170 bp, Bacillus subtilis
  CDS (1)..(1170)
atggtgcaaaagagaaatcattttctcccttactcattgccgttaatcggtaaggaagaaattcaggaggttacagaaacgcttgaatcgggatggctctctaaaggcccgaaggttcagcagtttgaaaaagagtttgccgcgtttgtcggggcgaagcacgccgtggcggtgaattcatgtaccgcagctttatttttggctttgaaagcaaaagggattgggcccggggacgaggtcattacctctccgcttacgttcagctcgaccgccaatacgattattcatacgggagcgacgcctgtgtttgcggatattgacgaaaacacgctcaatattgacccggtaaagcttgaggcggccgtcacaccgcgaacgaaagcagttgtgcccgtccactttggcgggcagtcctgcgatatggatgcaatattggctgttgcccaaaatcatggtttattcgtgctggaggatgcggcacatgcggtatatacgacttataagcaaagaatgatcggttctatcggggatgcaacggcattcagcttttacgccaccaaaaacctcgcgacaggggaaggcggcatgctgacgactgatgatgaggagcttgccgataagatacgggtgctaagccttcacggcatgagtaaagccgcatggaaccgttattcttcaaatggcagctggtactatgaagtcgaatcgcccggctataagatgaatatgtttgatttgcaggcggccctcggacttcatcagctgaaacggctggatgatatgcagaaacggagagaagagattgccggccgctatcaaaccgcttttcagcagattcctgggctgatcacgccgtttgtccatgatgacggcaggcacgcctggcatctatatgttctgcaagttgatgaaaaaaaggccggggttacgcgcagcgaaatgattacggctttaaaggatgaatacaatatcggcactagcgttcattttattccagtacacattcatccgtattatcaaaagcaatttggatataaggaagcggactttccgaatgccatgaattactataaacgaaccctttctctcccgctctatccatcaatgtctgacgatgatgtagatgatgtcattgaagctgtgcgggatatcgtaaaaggggctgattaa

SEQ ID NO: 43684 - protein, 389 aa, Bacillus subtilis
MVQKRNHFLPYSLPLIGKEEIQEVTETLESGWLSKGPKVQQFEKEFAAFVGAKHAVAVNSCTAALFLALKAKGIGPGDEVITSPLTFSSTANTIIHTGATPVFADIDENTLNIDPVKLEAAVTPRTKAVVPVHFGGQSCDMDAILAVAQNHGLFVLEDAAHAVYTTYKQRMIGSIGDATAFSFYATKNLATGEGGMLTTDDEELADKIRVLSLHGMSKAAWNRYSSNGSWYYEVESPGYKMNMFDLQAALGLHQLKRLDDMQKRREEIAGRYQTAFQQIPGLITPFVHDDGRHAWHLYVLQVDEKKAGVTRSEMITALKDEYNIGTSVHFIPVHIHPYYQKQFGYKEADFPNAMNYYKRTLSLPLYPSMSDDDVDDVIEAVRDIVKGAD

SEQ ID NO: 43685 - DNA, 1161 bp, Methanococcus jannaschii
  CDS (1)..(1161)
atgataagagaaagttttttgccaccatttaggccatgtattggtgaagaagagataaatgaagttatagatacattaaagtcagattggataactatgggtccaaaaacattaaaatttgaagaattgtttagaaattatattggaagtaaatttgcaatatccttaaattcatgcacagccgggttacatctgtcattggttgcattaaatataaaggataaagatgaagtcataactacaccatatacctttgcagcaactgggaacgttatagttcatcaaagggcaaagcccgtatttgttgatattgataaagaaacctataatattaacgttgaggagatagaaaatgccataactgagagaacaaaggcaataattcctgtccattatgcaggacatccatgtgaaatggatgaaatattaaaaatagcaagagactatgatttatatgtaattgaagatgctgcacatgcattgggggcagagtataaaggaaaaaaaataggtactattggagatacaacatcattcagcttttatgcaacaaaaaatataaccactggggaggggggaatggttactactgacaatgaagagattgcagaaaaaataaaaatactgcgactacatgggataagtagagacgcttggaaaagatactcatccgagggctcatggtactatgagattatcgagtgtggttataaatataacatgaccgacattcaagcatcaatcggaatacatcaactaaaaaaagcagagataatgagaaaaagaagagaagaaatcgctaaaatttataatgaagagtttgaaaatcttgaggggttaataactccaaccataaaaaaacatgttaaacatgcatggcacttatatccgttgttaataaatatcgatagattgaagataaacagaaccaaatttattgaagagttaaaaaaacagaatattggaacaagtgttcattttatcccattacacttgcatccattttataggaaaacttttggatataaaaaaggtgattttccaaatgcagagtgggtttatgagagagagatttccttgccaatatatccaaaaatgactgatgatgatgtaattgatgtagttaatgcggttaaaaaaattgtttctgagaacagatga

SEQ ID NO: 43686 - protein, 386 aa, Methanococcus jannaschii
MIRESFLPPFRPCIGEEEINEVIDTLKSDWITMGPKTLKFEELFRNYIGSKFAISLNSCTAGLHLSLVALNIKDKDEVITTPYTFAATGNVIVHQRAKPVFVDIDKETYNINVEEIENAITERTKAIIPVHYAGHPCEMDEILKIARDYDLYVIEDAAHALGAEYKGKKIGTIGDTTSFSFYATKNITTGEGGMVTTDNEEIAEKIKILRLHGISRDAWKRYSSEGSWYYEIIECGYKYNMTDIQASIGIHQLKKAEIMRKRREEIAKIYNEEFENLEGLITPTIKKHVKHAWHLYPLLINIDRLKINRTKFIEELKKQNIGTSVHFIPLHLHPFYRKTFGYKKGDFPNAEWVYEREISLPIYPKMTDDDVIDVVNAVKKIVSENR

SEQ ID NO: 43687 - DNA, 1158 bp, Escherichia coli
  CDS (19)..(1158)
atggcggaaggaaaagcaatgtcagaatttttgcctttttcgcgaccagcaatgggcgtggaggaactcgctgcagttaaagaggttctcgaatccggttggatcacaaccggtccgaagaatcaggcgcttgagcaagctttttgccagttgacgggaaatcagcatgccatcgcggtcagttcagccaccgccggaatgcatatcacgctaatggcgttgaaaattggcaagggcgatgaagtgattacgccttccctgacctgggtttcaaccctcaatatgatttccttgttgggtgcaacgccggtaatggtggatgtcgaccgcgatacgctgatggtcacgcctgaagctatcgagtcagccattacgccacgcactaaagccatcattccggtgcattatgccggtgcgccagcagatattgacgccattcgcgccattggcgaacgttacggcatcgcagttatcgaagatgctgcccatgccgtcggtacgtattacaaagggcgacatattggcgcaaaaggtaccgctattttttcatttcatgccattaaaaatattacctgtgctgaaggtggcctgattgtaactgataatgaaaaccttgcccgccagctacggatgctgaaatttcacggtctgggtgtcgatgcctatgacagacaaacctggggccgtgcaccgcaggctgaagtcttaacaccgggctataagtacaatctgaccgatattaacgccgcgattgccctgacacagttagtcaaattagagcacctcaacacccgtcggcgcgaaattgcccagcaatatcagcaagcactggcagctctcccctttcagccattaagccttcccgcctggccgcacgttcacgcctggcatctgtttattattcgtgtcgatgaacaacgttgtggtatcagtcgcgatgcgttgatggaagcgttaaaagaaagaggcattggtaccgggttacatttccgcgccgctcacacacaaaaatattatcgcgagcgttttcccacgctgtcgttaccgaataccgaatggaatagcgaacgcatctgttctttgccgctgttcccggatatgactaccgccgatgccgaccatgtcatcacagcccttcagcaactcgcaggacaataa

SEQ ID NO: 43688 - protein, 379 aa, Escherichia coli
MSEFLPFSRPAMGVEELAAVKEVLESGWITTGPKNQALEQAFCQLTGNQHAIAVSSATAGMHITLMALKIGKGDEVITPSLTWVSTLNMISLLGATPVMVDVDRDTLMVTPEAIESAITPRTKAIIPVHYAGAPADIDAIRAIGERYGIAVIEDAAHAVGTYYKGRHIGAKGTAIFSFHAIKNITCAEGGLIVTDNENLARQLRMLKFHGLGVDAYDRQTWGRAPQAEVLTPGYKYNLTDINAAIALTQLVKLEHLNTRRREIAQQYQQALAALPFQPLSLPAWPHVHAWHLFIIRVDEQRCGISRDALMEALKERGIGTGLHFRAAHTQKYYRERFPTLSLPNTEWNSERICSLPLFPDMTTADADHVITALQQLAGQ

SEQ ID NO: 43689 - DNA, 22 bp, Primer
atgattccatttaacgcaccgc

SEQ ID NO: 43690 - DNA, 27 bp, Primer
ttaggaaaagtagttcaacaaagtcgc

SEQ ID NO: 43691 - protein, 357 aa, consensus
  MISC_FEATURE (1)..(357): consensus for the disclosure of xaa see table XV
EXXXXXXXXXXXXXXXXXXXXXXTXAXXXXXXXXXXXXXXXXXXXXXXXXXXGDXVXXXXXXXXXXXXXXXXXGXXPVXXDXXXXXXXXXXXXXXXXXXXXXXXXXXXXXXXXXXXXXXXXXXXXXXXXAXXXVHXXGXXXXXXXXXXXXXXXXXXXXXXXXXXXXXXXXXXXXXXXXEDXAXXXGXXXXXXXXXXXXXXXXXXXXXXXXXXXXXXXXXXXXXXSFXXXKXXXXXXXGGXXXXXXXXXXXXXXXXXXXXXXXXXXXXXXXXXXXXXXXXXXGXXXXXXXXXXXXXXXXXXXXXXXXXXXXXXXXXXXXXXXGXXXXXXXXXAAXXXXXLXXXXXXXXXXRXXXXXXY

SEQ ID NO: 43692 - protein, 26 aa, consensus
  MISC_FEATURE (1)..(26): consensus for the disclosure of xaa see table XV
XXXXXXXXXXXXXXXXXXXXXXXXXX

SEQ ID NO: 43693 - protein, 54 aa, consensus
  MISC_FEATURE (1)..(54): consensus for the disclosure of xaa see table XV
XXXXXXXXXXXXXXXXXXXXXXXXXXXXXXXXXXXXXXXXXXXXXXXXXDXXXX

SEQ ID NO: 43694 - protein, 28 aa, consensus
  MISC_FEATURE (1)..(28): consensus for the disclosure of xaa see table XV
XXXXXXXXXXXXXXXXXXXXXXXXXXXX

SEQ ID NO: 43695 - protein, 29 aa, consensus
  MISC_FEATURE (1)..(29): consensus for the disclosure of xaa see table XV
XXXXXXXXXXXXXXXXXXXXXXXXXXXXX

SEQ ID NO: 43696 - DNA, 1845 bp, Escherichia coli K12; identical to SEQ ID NO: 1739
  CDS (1)..(1845)

SEQ ID NO: 43697 - protein, 614 aa, Escherichia coli K12; identical to SEQ ID NO: 1740

SEQ ID NO: 43698 - DNA, 1836 bp, Vibrio cholerae; identical to SEQ ID NO: 1741
  CDS (1)..(1836)

SEQ ID NO: 43699 - protein, 611 aa, Vibrio cholerae; identical to SEQ ID NO: 1742

SEQ ID NO: 43700 - DNA, 1878 bp, Yersinia pestis; identical to SEQ ID NO: 1743
  CDS (1)..(1878)

SEQ ID NO: 43701 - protein, 625 aa, Yersinia pestis; identical to SEQ ID NO: 1744

SEQ ID NO: 43702 - DNA, 2109 bp, Agrobacterium tumefaciens; identical to SEQ ID NO: 1745
  CDS (1)..(2109)

SEQ ID NO: 43703 - protein, 702 aa, Agrobacterium tumefaciens; identical to SEQ ID NO: 1746

SEQ ID NO: 43704 - DNA, 2097 bp, Nostoc sp. PCC 7120; identical to SEQ ID NO: 1747
  CDS (1)..(2097)

SEQ ID NO: 43705 - protein, 698 aa, Nostoc sp. PCC 7120; identical to SEQ ID NO: 1748

SEQ ID NO: 43706 - DNA, 1953 bp, Caulobacter crescentus; identical to SEQ ID NO: 1749
  CDS (1)..(1953)

SEQ ID NO: 43707 - protein, 650 aa, Caulobacter crescentus; identical to SEQ ID NO: 1750

SEQ ID NO: 43708 - DNA, 1851 bp, Pseudomonas aeruginosa; identical to SEQ ID NO: 1751
  CDS (1)..(1851)

SEQ ID NO: 43709 - protein, 616 aa, Pseudomonas aeruginosa; identical to SEQ ID NO: 1752

SEQ ID NO: 43710 - DNA, 1962 bp, Pseudomonas aeruginosa; identical to SEQ ID NO: 1753
  CDS (1)..(1962)

SEQ ID NO: 43711 - protein, 653 aa, Pseudomonas aeruginosa; identical to SEQ ID NO: 1754

SEQ ID NO: 43712 - DNA, 2241 bp, Escherichia coli; identical to SEQ ID NO: 1755
  CDS (1)..(2241)

SEQ ID NO: 43713 - protein, 746 aa, Escherichia coli; identical to SEQ ID NO: 1756

SEQ ID NO: 43714 - DNA, 1992 bp, Escherichia coli; identical to SEQ ID NO: 1757
  CDS (1)..(1992)

SEQ ID NO: 43715 - protein, 663 aa, Escherichia coli; identical to SEQ ID NO: 1758

SEQ ID NO: 43716 - DNA, 1959 bp, Vibrio cholerae; identical to SEQ ID NO: 1759
  CDS (1)..(1959)

SEQ ID NO: 43717 - protein, 652 aa, Vibrio cholerae; identical to SEQ ID NO: 1760

SEQ ID NO: 43718 - DNA, 1839 bp, Citrobacter freundii; identical to SEQ ID NO: 1761
  CDS (1)..(1839)

SEQ ID NO: 43719 - protein, 612 aa, Citrobacter freundii; identical to SEQ ID NO: 1762

SEQ ID NO: 43720 - DNA, 2229 bp, Pseudomonas aeruginosa; identical to SEQ ID NO: 1763
  CDS (1)..(2229)

SEQ ID NO: 43721 - protein, 742 aa, Pseudomonas aeruginosa; identical to SEQ ID NO: 1764

SEQ ID NO: 43722 - DNA, 2010 bp, Escherichia coli; identical to SEQ ID NO: 1765
  CDS (1)..(2010)

SEQ ID NO: 43723 - protein, 669 aa, Escherichia coli; identical to SEQ ID NO: 1766

SEQ ID NO: 43724 - DNA, 1941 bp, Porphyromonas gingivalis (Bacteroides gingivalis); identical to SEQ ID NO: 1767
  CDS (1)..(1941)

SEQ ID NO: 43725 - protein, 646 aa, Porphyromonas gingivalis (Bacteroides gingivalis); identical to SEQ ID NO: 1768

SEQ ID NO: 43726 - DNA, 1842 bp, Vibrio vulnificus (strain YJ016); identical to SEQ ID NO: 1769
  CDS (1)..(1842)

SEQ ID NO: 43727 - protein, 613 aa, Vibrio vulnificus (strain YJ016); identical to SEQ ID NO: 1770

SEQ ID NO: 43728 - DNA, 1860 bp, Photorhabdus luminescens (subsp. laumondii); identical to SEQ ID NO: 1771
  CDS (1)..(1860)

SEQ ID NO: 43729 - protein, 619 aa, Photorhabdus luminescens (subsp. laumondii); identical to SEQ ID NO: 1772

SEQ ID NO: 43730 - DNA, 2100 bp, Chromobacterium violaceum; identical to SEQ ID NO: 1773
  CDS (1)..(2100)

SEQ ID NO: 43731 - protein, 699 aa, Chromobacterium violaceum; identical to SEQ ID NO: 1774

SEQ ID NO: 43732 - DNA, 2214 bp, Bordetella pertussis; identical to SEQ ID NO: 1775
  CDS (1)..(2214)

SEQ ID NO: 43733 - protein, 737 aa, Bordetella pertussis; identical to SEQ ID NO: 1776

SEQ ID NO: 43734 - DNA, 1890 bp, Bordetella parapertussis; identical to SEQ ID NO: 1777
  CDS (1)..(1890)

SEQ ID NO: 43735 - protein, 629 aa, Bordetella parapertussis; identical to SEQ ID NO: 1778

SEQ ID NO: 43736 - DNA, 1839 bp, Nitrosomonas europaea; identical to SEQ ID NO: 1779
  CDS (1)..(1839)

SEQ ID NO: 43737 - protein, 612 aa, Nitrosomonas europaea; identical to SEQ ID NO: 1780

SEQ ID NO: 43738 - DNA, 1995 bp, Acinetobacter baumannii; identical to SEQ ID NO: 1781
  CDS (1)..(1995)

SEQ ID NO: 43739 - protein, 664 aa, Acinetobacter baumannii; identical to SEQ ID NO: 1782

SEQ ID NO: 43740 - DNA, 1875 bp, Vibrio parahaemolyticus; identical to SEQ ID NO: 1783
  CDS (1)..(1875)

SEQ ID NO: 43741 - protein, 624 aa, Vibrio parahaemolyticus; identical to SEQ ID NO: 1784

SEQ ID NO: 43742 - DNA, 1959 bp, Vibrio parahaemolyticus; identical to SEQ ID NO: 1785
  CDS (1)..(1959)

SEQ ID NO: 43743 - protein, 652 aa, Vibrio parahaemolyticus; identical to SEQ ID NO: 1786

SEQ ID NO: 43744 - DNA, 2235 bp, Pseudomonas putida (strain KT2440); identical to SEQ ID NO: 1787
  CDS (1)..(2235)

SEQ ID NO: 43745 - protein, 744 aa, Pseudomonas putida (strain KT2440); identical to SEQ ID NO: 1788

SEQ ID NO: 43746 - DNA, 1890 bp, Escherichia coli O6; identical to SEQ ID NO: 1789
  CDS (1)..(1890): n means a or g or c or t/u

SEQ ID NO: 43747 - protein, 629 aa, Escherichia coli O6; identical to SEQ ID NO: 1790
  misc_feature (624)..(624): Xaa can be Thr or Ala or Pro or Ser

SEQ ID NO: 43748 - DNA, 1863 bp, Brucella suis; identical to SEQ ID NO: 1791
  CDS (1)..(1863)

SEQ ID NO: 43749 - protein, 620 aa, Brucella suis; identical to SEQ ID NO: 1792

SEQ ID NO: 43750 - DNA, 1881 bp, Xanthomonas campestris (pv. campestris); identical to SEQ ID NO: 1793
  CDS (1)..(1881)

SEQ ID NO: 43751 - protein, 626 aa, Xanthomonas campestris (pv. campestris); identical to SEQ ID NO: 1794

SEQ ID NO: 43752 - DNA, 1881 bp, Xanthomonas axonopodis (pv. citri); identical to SEQ ID NO: 1795
  CDS (1)..(1881)

SEQ ID NO: 43753 - protein, 626 aa, Xanthomonas axonopodis (pv. citri); identical to SEQ ID NO: 1796

SEQ ID NO: 43754 - DNA, 1992 bp, Salmonella typhimurium; identical to SEQ ID NO: 1797
  CDS (1)..(1992)

SEQ ID NO: 43755 - protein, 663 aa, Salmonella typhimurium; identical to SEQ ID NO: 1798

SEQ ID NO: 43756 - DNA, 2256 bp, Salmonella typhimurium; identical to SEQ ID NO: 1799
  CDS (1)..(2256)

SEQ ID NO: 43757 - protein, 751 aa, Salmonella typhimurium; identical to SEQ ID NO: 1800

SEQ ID NO: 43758 - DNA, 2049 bp, Escherichia coli; identical to SEQ ID NO: 1801
  CDS (1)..(2049)

SEQ ID NO: 43759 - protein, 682 aa, Escherichia coli; identical to SEQ ID NO: 1802

SEQ ID NO: 43760 - DNA, 2178 bp, Escherichia coli; identical to SEQ ID NO: 1803
  CDS (1)..(2178)

SEQ ID NO: 43761 - protein, 725 aa, Escherichia coli; identical to SEQ ID NO: 1804

SEQ ID NO: 43762 - DNA, 2001 bp, Escherichia coli; identical to SEQ ID NO: 1805
  CDS (1)..(2001)

SEQ ID NO: 43763 - protein, 666 aa, Escherichia coli; identical to SEQ ID NO: 1806

SEQ ID NO: 43764 - DNA, 2133 bp, Vibrio mimicus; identical to SEQ ID NO: 1807
  CDS (1)..(2133)

SEQ ID NO: 43765 - protein, 710 aa, Vibrio mimicus; identical to SEQ ID NO: 1808

SEQ ID NO: 43766 - DNA, 1845 bp, Salmonella typhimurium; identical to SEQ ID NO: 1809
  CDS (1)..(1845)

SEQ ID NO: 43767 - protein, 614 aa, Salmonella typhimurium; identical to SEQ ID NO: 1810

SEQ ID NO: 43768 - DNA, 2181 bp, Klebsiella pneumoniae; identical to SEQ ID NO: 1811
  CDS (1)..(2181)

SEQ ID NO: 43769 - protein, 726 aa, Klebsiella pneumoniae; identical to SEQ ID NO: 1812

SEQ ID NO: 43770 - DNA, 1782 bp, Geobacter sulfurreducens; identical to SEQ ID NO: 1813
  CDS (1)..(1782)

SEQ ID NO: 43771 - protein, 593 aa, Geobacter sulfurreducens; identical to SEQ ID NO: 1814

SEQ ID NO: 43772 - DNA, 1974 bp, Aeromonas salmonicida subsp. salmonicida; identical to SEQ ID NO: 1815
  CDS (1)..(1974)

SEQ ID NO: 43773 - protein, 657 aa, Aeromonas salmonicida subsp. salmonicida; identical to SEQ ID NO: 1816

SEQ ID NO: 43774 - DNA, 25 bp, Primer
atgattaaaaaagcttcgctgctga

SEQ ID NO: 43775 - DNA, 25 bp, Primer
ttagaaggtgtagctgccagacaag

SEQ ID NO: 43776 - protein, 779 aa, consensus
  MISC_FEATURE (1)..(779): consensus for the disclosure of xaa see table XV
VXXXXXXXXXXXXXXXXXXXXXXXXXXXXXXXXXXXXXXXXXGXXXXXXXXXXXXXXXXXXXXRGXXXXXXLXLXDGXXXXXXXXXXXXXXXXXXXXXXXXXXPXXXXXRIEXXRGPXXXXYGSXAXGGVXNIXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXDXXXXXXXXXXXXXXXXXXXXGXXXXXXXXXXXXXXXXXXXXXXXXXXXXXAPXXXXXXXXXXXXXXXXXXXXXXXXXXXXXXXXXNXXLXPEXSXXXEXXXXXXXXXXXXXXXXXXXXXXXXXXXXXIXXXXXXXXXXXXXXXXXXXXXXXXXXXXXXXXXXXXXXXXXXXGXEXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXGRXXXXXXXXXF

SEQ ID NO: 43777 - protein, 117 aa, consensus; identical to SEQ ID NO: 1974
  MISC_FEATURE (1)..(117): consensus for the disclosure of xaa see table XV

SEQ ID NO: 43778 - protein, 177 aa, consensus; identical to SEQ ID NO: 1975
  MISC_FEATURE (1)..(177): consensus for the disclosure of xaa see table XV

SEQ ID NO: 43779 - DNA, 1326 bp, Escherichia coli
  CDS (1)..(1326)
atgacgcacgataatatcgatattctggtggtggatgatgacattagccactgcactattttgcaggctttactgcgcggctggggctataacgtcgcgctggcgaacagcgggcgacaggcgttggagcaggtgcgggaacaggtttttgatcttgtgctttgcgatgtgcgaatggcggagatggacggcatcgccacgctgaaagagatcaaagcgttaaacccggcaattccggtgctgattatgactgcgtactccagcgtcgagacggcggtagaggcactgaaaactggggcgctggattatctcatcaagccgctggatttcgataacctacaggcgacgctggaaaaagcgctcgcgcatacgcacagtattgatgctgaaacacctgcggtgactgccagccagttcggtatggtcggtaaaagcccggcgatgcaacacctgctcagtgaaatcgccctcgtcgcgccatcggaagccacggtactgatccacggcgattccggcaccggtaaagagctggtcgccagggcgattcacgccagtagcgcacgtagcgaaaaaccgctggtaacgctcaactgtgcggcactcaacgaatccttgctggaatctgaattgttcggtcacgaaaaaggggcgtttactggagccgataaacgccgggaagggcgctttgttgaggcggacggcggcacgctgtttctcgatgaaattggcgatatctcgccgatgatgcaggtgcgtctgctgcgtgcgattcaggagcgcgaagttcagcgtgtcggtagcaaccagattatctcggttgatgtccggctgattgcggcgacccatcgcgatcttgccgcagaggtgaatgccgggcgttttcgccaggatctctactatcgcctgaatgtggtggcgattgaagtaccatcgctgcggcaacggcgggaagatatccctctgctggctggccattttctgcagcgctttgccgagcgtaatcgcaaggcggtaaaaggttttacgccccaggcgatggatctgttgattcattacgactggccgggaaatattcgtgagctggaaaacgcggtggaacgggcagtggtgctgctgaccggggaatatatttccgaacgcgagctgccgctggcgattgccagtacgccgatcccgctgggacaaagtcaggatattcagccgttggtggaagtggaaaaagaggtgattctggcggcgctggagaaaacgggcggcaacaaaaccgaagccgcccgtcagttagggatcacgcgcaaaacgctattggcaaaactgtcgcgttag

SEQ ID NO: 43780 - protein, 441 aa, Escherichia coli
MTHDNIDILVVDDDISHCTILQALLRGWGYNVALANSGRQALEQVREQVFDLVLCDVRMAEMDGIATLKEIKALNPAIPVLIMTAYSSVETAVEALKTGALDYLIKPLDFDNLQATLEKALAHTHSIDAETPAVTASQFGMVGKSPAMQHLLSEIALVAPSEATVLIHGDSGTGKELVARAIHASSARSEKPLVTLNCAALNESLLESELFGHEKGAFTGADKRREGRFVEADGGTLFLDEIGDISPMMQVRLLRAIQEREVQRVGSNQIISVDVRLIAATHRDLAAEVNAGRFRQDLYYRLNVVAIEVPSLRQRREDIPLLAGHFLQRFAERNRKAVKGFTPQAMDLLIHYDWPGNIRELENAVERAVVLLTGEYISERELPLAIASTPIPLGQSQDIQPLVEVEKEVILAALEKTGGNKTEAARQLGITRKTLLAKLSR

SEQ ID NO: 43781 - DNA, 1347 bp, Xanthomonas oryzae pv. oryzae KACC10331
  CDS (1)..(1347)
atggcgtgcatcctgatcatcgacgacgatgcggcgtttcgcaccaccttacaggccacattgcgctcgttcgggcacacggtggtcgcggccgacaacgggcccgacggtctggcgcggctgagcgaaggcgggatcgacatggcgttcgtggatttccgcatgccgggcatggatggcatcgcggtgctgcgcgcgcgcctggacgatgcgcaggcgcggcaggtaccgctggtgatgctcaccgcgcatgtgtccagcggcaacaccatcgaagcaatgacgctgggtgccttcgatcatctggtcaagccggtgggccgcgccgacatcgtcgaagtggtggagcgtgcgctgctgagccgcgccgacgcacaggccgcagcgaccgaaacgccacaagcgccacacgaggacgacgatgcgttggttggccacagcccggcgatgcgcacggtgcacaagcacatcgggctggcggcggcctctgatctgccggtgctgatcaccggtgaaaccggcaccggcaaggagttggccgcacgcgccctgcatcgcgccagtccgcgcgccgaggcgccgttcgttgcggtcaactgcgcggccattccgctggagttgatggaaagcgaattgttcggccatcgcaagggcgcgttttccggcgccagcagcgaccgtctgggtctgattcgcgaggccgatggcggcaccttgtttctcgacgagatcggcgacatgccgctgccgatgcaagccaagctgctgcgcttcctgcaggaaggcgaggtgacgccgttgggcggcagcggctcgcagaaggtggatgtgcgggtgctcgcggccacccatcgcgacctggcggcctgcgtggccgacggtcgctttcgcagcgatctgcgctaccgcctcaatgtggtgccgatcgaattgccacctttgcgcgagcgcggccaagacatcctgctgctggcgcagcactttctgagcacgaatgcagcgcgcgcgcagagcctgtcgccggctgcgcaggagcgtctgcttgcgcaccgctggcctggcaacgtgcgcgagctgcgcaatgtcatgcagcgcagccaggtcatggtgcgcggcgccagcatcgatgcggcggatctggacgaagcgctggccgaggcgggtgaggcgacgccagatgttgcgtcggcgatgacagggacactgcccgaagcagtggcgcggctggaaaaacagatgatccagtcggctctggaacagagccatggcaaccgcgcagaggccgcgcgccggttgggcatccaccggcaactgctctatcgcaagctggaggaatacggcctgtga

SEQ ID NO: 43782 - protein, 448 aa, Xanthomonas oryzae pv. oryzae KACC10331
MACILIIDDDAAFRTTLQATLRSFGHTVVAADNGPDGLARLSEGGIDMAFVDFRMPGMDGIAVLRARLDDAQARQVPLVMLTAHVSSGNTIEAMTLGAFDHLVKPVGRADIVEVVERALLSRADAQAAATETPQAPHEDDDALVGHSPAMRTVHKHIGLAAASDLPVLITGETGTGKELAARALHRASPRAEAPFVAVNCAAIPLELMESELFGHRKGAFSGASSDRLGLIREADGGTLFLDEIGDMPLPMQAKLLRFLQEGEVTPLGGSGSQKVDVRVLAATHRDLAACVADGRFRSDLRYRLNVVPIELPPLRERGQDILLLAQHFLSTNAARAQSLSPAAQERLLAHRWPGNVRELRNVMQRSQVMVRGASIDAADLDEALAEAGEATPDVASAMTGTLPEAVARLEKQMIQSALEQSHGNRAEAARRLGIHRQLLYRKLEEYGL

SEQ ID NO: 43783 - DNA, 1431 bp, Vibrio fischeri ES114
  CDS (1)..(1431)
atgatacaaaaaaaatatttattaatggtagaagatactgcttccgttgctgcgttatatcgctcttatttaaacccgttaggttttgatattgatgtcgtagctaaaggtgttgaagccattgagaaaatcaaattaagaacccctgatcttgtgttactagatttgcgcctgcctgacatgacaggttttgatgtgttggctgaaattcgtaaagataaccaaagtattcctgttgtattaatgacggctcatggctcaattgatgctgcagtagaagccatgcagttaggggctcaagatttcttaatcaaaccatgtgaagctgaccgtttgagggttacggtaaataacgcattacgacgtgcacaaaaagatcagaaagaattccaagagaatccaaaagataccaataaacagtatcaaggatttattggtagtagctctcaaatgcatcaggtttatcgcaccatagattccgccgcaccaagtaaagccacggtatttattactggtgaatcggggacgggtaaagaggtgtgtgctgaagccattcatgcggctagtaagcgtggagacgggcctttcatcgctattaactgtgcggcaattccaaaagatttaattgaaagtgagctttttggtcacgttaaaggcgcatttacaggtgcctctgttgatcgaaaaggtgctgccgaacaagcagatggaggtacgcttttcctcgatgaattatgtgaaatggatttggatttacagaccaaattattgcgatttattcaaactggtacttttcaaaaagttggttcttctaaaatgagccgagttgatgttcgatttgtttgtgctacaaaccgagacccttggctagaagtacaagcaggccgatttagagaggatttatattatcgtttacatgttattcctctaacattacctcctctaagagacagaggaaatgatattattgaaattggtcactcaatccttgggcatttttctcacgaggaaggtcgtgagtttattacatttagtcctgaggttgtggataggtttttgaattacgattggcctggaaacgtacgacaattacaaaatgtgattaggaatgtagtcgtattaaataaaggaaaagaagtcgaattatccatgctgccccctccattatcattagatagtaagagtggtgtaaatattgcatctaatgtatccataagcgattcaactaagcctacagaatctattctgcctagtaataggatcttagatagtaaagatcaagaaactattattccgttatggcaatctgaaaaacagatcattgaaaacgcaattgaactatgtggtgggaacattccacaagccgctaagcaattagaggttagtccttctacaatatatagaaaactacagtcttggaatgaaagataa

SEQ ID NO: 43784 - protein, 476 aa, Vibrio fischeri ES114
MIQKKYLLMVEDTASVAALYRSYLNPLGFDIDVVAKGVEAIEKIKLRTPDLVLLDLRLPDMTGFDVLAEIRKDNQSIPVVLMTAHGSIDAAVEAMQLGAQDFLIKPCEADRLRVTVNNALRRAQKDQKEFQENPKDTNKQYQGFIGSSSQMHQVYRTIDSAAPSKATVFITGESGTGKEVCAEAIHAASKRGDGPFIAINCAAIPKDLIESELFGHVKGAFTGASVDRKGAAEQADGGTLFLDELCEMDLDLQTKLLRFIQTGTFQKVGSSKMSRVDVRFVCATNRDPWLEVQAGRFREDLYYRLHVIPLTLPPLRDRGNDIIEIGHSILGHFSHEEGREFITFSPEVVDRFLNYDWPGNVRQLQNVIRNVVVLNKGKEVELSMLPPPLSLDSKSGVNIASNVSISDSTKPTESILPSNRILDSKDQETIIPLWQSEKQIIENAIELCGGNIPQAAKQLEVSPSTIYRKLQSWNER

SEQ ID NO: 43785 - DNA, 1461 bp, Mesorhizobium loti MAFF303099
  CDS (1)..(1461)
atgaccgctcgcggcaatattctcgtcgccgatgacgatgcggcgatccgcaccgtgctcaaccaggctctctcgcgcgtcgggcacgaggtgcgcgtcacctccaacgcctcgaccttgtggcgctgggtggccgcgggcgagggcgaccttgtcatcaccgacgtcgtcatgccggatgaaaacgccttcgacatgctaccgcgcatcaagaaggcgcggccggaactgccggtcattgtcatgagcgcccagaacacgttcatgacggcgatccgcgcatccgagacaggcgcctatgaatatctcccgaaaccgttcgacctgaccgaactgctcaacatcgtcaaccgggcgctgtctgagccccgccggccgaagatcgatgcgcggcccgatgagcagccggaaacgatgccgctggtcggccgctcggcggccatgcaggacatctatcgcatgctggcgcgcatgatgcagaccgacctcacggtgatgatctcgggcgaatccggcaccggcaaggaactggtggcgcgtgcgctgcacgaatatggccgtcgtcgcggcgggccgtttgtcgccatcaatatggcggcgatcccgcgtgacctgatcgaatcggaactgttcggccatgagaagggtgccttcaccggcgcgcagaaccgctccaccggccgtttcgagcaggccgagggcggcacgctgttcctcgacgagatcggcgacatgccgatggaggcacagacgcgcctgctgcgcgtcctgcagcagggcgagtacacgaccgtcggcggacgcacgccgatcaagaccgatgtgcgcatcgtcgccgccaccaacaaggatctgcgcacgctgatcaaccagggactgttccgcgaggatctgttctatcgtctcaatgtcgttccgctgaggctgccggcattgcgcgagcgctccgaggacgtgcccgatctcgtgcgccacttcttcaagctcggcgagatggaagggctgcagaccaagcgcatctcgtccggcggcatcgaactgatgaagcgctacccgtggccgggcaatgtgcgcgaactggaaaacctggttcgccggctggccgctctttattcgcaggacgagatttccgccgagatcatcgaggcggagctgaagaccggcgagcgccccgtggtgcccggcggcggcaacctcattcccgacgatctctccatcggccaggcagtggagcacttcctgcagcgctatttcgcctcgtttgccggcgaattgccgcccgccggactctaccagcgcatactgtccgaggtcgaatatccgctggtcctggcctcaatgacggcaacccgcggcaaccagatcaaggctgcggaactgctggggctgaaccgcaacacgctgcgcaagaagattcgcgaactgggcgtcaacgtctataaatcgtcgcggccgggctga

SEQ ID NO: 43786 - protein, 486 aa, Mesorhizobium loti MAFF303099
MTARGNILVADDDAAIRTVLNQALSRVGHEVRVTSNASTLWRWVAAGEGDLVITDVVMPDENAFDMLPRIKKARPELPVIVMSAQNTFMTAIRASETGAYEYLPKPFDLTELLNIVNRALSEPRRPKIDARPDEQPETMPLVGRSAAMQDIYRMLARMMQTDLTVMISGESGTGKELVARALHEYGRRRGGPFVAINMAAIPRDLIESELFGHEKGAFTGAQNRSTGRFEQAEGGTLFLDEIGDMPMEAQTRLLRVLQQGEYTTVGGRTPIKTDVRIVAATNKDLRTLINQGLFREDLFYRLNVVPLRLPALRERSEDVPDLVRHFFKLGEMEGLQTKRISSGGIELMKRYPWPGNVRELENLVRRLAALYSQDEISAEIIEAELKTGERPVVPGGGNLIPDDLSIGQAVEHFLQRYFASFAGELPPAGLYQRILSEVEYPLVLASMTATRGNQIKAAELLGLNRNTLRKKIRELGVNVYKSSRPG

SEQ ID NO: 43787 - DNA, 1536 bp, Mesorhizobium loti MAFF303099
  CDS (1)..(1536)
atgacaggttccatactcatagtcgatgacgatcccgtgcagcgccggctgctcgaggcggcggtgacgcggttcggccacacggcaatcgttgtcgacggcggcgaggctggcctcgacgcgctcgacgggcctggtgcccgcgacatctgcgtggtcattctcgacctggtcatgcccggtctcgacggcatcggcgtgctgaaagccatgcgcgaacgcgacatcaccgtcccggtcatcgtgcagaccgcccagggcggcatcgaaaccgtggtgttggcgatgcgccacggcgccttcgatttcgtcgtcaagccggcgtcacccgacaggctgcaggcctcgatcgccaatgcgctcaaggtcgaggcagtcgagggcgaggtcaagcgcacgtcgcgcaagcgcggcgggttgctgacattcagggacatgatcacccacagtccggccatggacagggtgatacgcctcggccagaaagcggccggatccagcatcccgatcctgatcgaaggcgaatccggcgtcggcaaggaactggtggcgcgtgccatccagggcagcggcgaccgccgctcgaaacccttcgtcaccgtcaattgcggcgccattcccgacaatctggtcgaatcgatcctgttcggccacgagaagggctcgttcaccggcgccaccgacaagcacaccggcaaattcgtcgaagcgcattcgggcacgctgttcctcgacgagatcggcgacctgccgctcgacgtgcaggtcaagctgttgcgcgccgtgcaggagggcgaggtcgatccggtcggcggccgttcgaccgtcaaggtcgacatcaggctgatctcggcgacgcatcgcaacctcctgcagcaggtcaaggacggcaagttccgcgaagacctgttctaccggctcaatgtctacccgatcttcgtgccgccgctgcgcgaccgccgtgacgacattccgcatctggtaacgcatttcatggagaaggtcgcgcccgccgacccgcgtcgtcgcctgcaaggcatttcgccggcagcgcttgccgtgctggaggcctatgactggcccggcaacataaggcagctcgaaaacgccgtcttccgcgcctcggtgctgtgtgaaggcgacgtgctcgatgtcgatgattttccgcagatccgcgcgcaggtggaaggcaccgtcaatctcgaaacggacgacgcagcacctcgcctctcatcgcctccggagcttcgcgatgagggggggccggccggcgatgacgctccagccgccgagccagaccggccggccgtgcttcagcccagattcggcacactgcgggcgctcgacgaacgcggcaatgtgcgggcgctggccgatgtcgaactcgagatgatcaagcttgccatcgaccactacaacggccagatgagcgaagtcgcgcgccgcctcggcatcggccgctcgacgctctaccgcaaacttaaggaatacggcatcgacccggagacgggtcgtgtcgaccgcctcgcttcctaa

SEQ ID NO: 43788 - protein, 511 aa, Mesorhizobium loti MAFF303099
MTGSILIVDDDPVQRRLLEAAVTRFGHTAIVVDGGEAGLDALDGPGARDICVVILDLVMPGLDGIGVLKAMRERDITVPVIVQTAQGGIETVVLAMRHGAFDFVVKPASPDRLQASIANALKVEAVEGEVKRTSRKRGGLLTFRDMITHSPAMDRVIRLGQKAAGSSIPILIEGESGVGKELVARAIQGSGDRRSKPFVTVNCGAIPDNLVESILFGHEKGSFTGATDKHTGKFVEAHSGTLFLDEIGDLPLDVQVKLLRAVQEGEVDPVGGRSTVKVDIRLISATHRNLLQQVKDGKFREDLFYRLNVYPIFVPPLRDRRDDIPHLVTHFMEKVAPADPRRRLQGISPAALAVLEAYDWPGNIRQLENAVFRASVLCEGDVLDVDDFPQIRAQVEGTVNLETDDAAPRLSSPPELRDEGGPAGDDAPAAEPDRPAVLQPRFGTLRALDERGNVRALADVELEMIKLAIDHYNGQMSEVARRLGIGRSTLYRKLKEYGIDPETGRVDRLAS

SEQ ID NO: 43789 - DNA, 1368 bp, Mesorhizobium loti MAFF303099
  CDS (1)..(1368)
atgagtgctgaatcaggaccggtcatttttatcgacgatgacgaggatgtgcttcgcgcagccacgcagatgctgaagcttgcctcgttctcaccgagcgtgttcggttcggccgaggccgcactcgccagaatcgacgggaacttcgatggccctgtcgtgagtgacatccgtatgcccgggctgaacggacttcagctcttcgagcgagtgaaggcgatcgacccggaaattccggttgtcctgatcaccgggcatgccgacgtcgagctggccgttgccgccatccaggatggcgcctacgatttcatctcgaagccatatgcgaacgaccggcttctcgtgacgctgcatcgcgcttcggaaaaacggcgcctggtcctggaaaacagacgtcttagggatgcggttgtccgatctgcgggcgatatcccgctgatcggggaggcaccgaccatgattcgattgcgcgaaactctccgccagatcgccgataccgatgtggatgtccttgtggaaggcgagacgggcacgggcaaggaggtggtcgcggatctgcttcaccgctggagcagacgacgcacgaagcccttcgttgccctgaattgtggagcgctgcccgaaagcgtcatcgatagcgaacttttcgggcacgaggcaggcgcctttactggcgcgcagaggcgcaggaccggtcgcatcgagcattcgaacggagggacgctcttcctcgacgaaatcgagtcgatgccgccagcactccaggtgaagcttctgagggtgcttgagacccggcagatcacgccgcttggcacgaacgaaacccgcagcatcgaccttcgtgtcgtgtcggctaccaaggccgatctcggcgatccggccgcccgcggagatttccgggaagacctttatttccggctgaatgtggtgacgctccgcatcccgccgcttcgcgaaaggcgcgaagacatcccgatgctctttgggcatttcctggaacgcgcctccaaacgcttcagcaggccagttccggacatcagcgctggcgtgcgcgatcgcctcgtgagccacaattggcccggcaatgtccgtgaactcgtgcatttcgccgatcgcgttgcattgggacttgaaaggctgggcacgcccattgcatcaggtcgaaaggaacaagcggtatcaagcctccacttgtccgagaaggtcagcctttatgaggcgactatcatccgcgatgccttgcaggaatgcggcggcgacgtgaggcgcacgatcgaagtcctgggagttccccgcaagaccttctacgacaagctgaaacgacatgggatagacacggccgattatcgaaaaaccgccattggctga

SEQ ID NO: 43790 - protein, 455 aa, Mesorhizobium loti MAFF303099
MSAESGPVIFIDDDEDVLRAATQMLKLASFSPSVFGSAEAALARIDGNFDGPVVSDIRMPGLNGLQLFERVKAIDPEIPVVLITGHADVELAVAAIQDGAYDFISKPYANDRLLVTLHRASEKRRLVLENRRLRDAVVRSAGDIPLIGEAPTMIRLRETLRQIADTDVDVLVEGETGTGKEVVADLLHRWSRRRTKPFVALNCGALPESVIDSELFGHEAGAFTGAQRRRTGRIEHSNGGTLFLDEIESMPPALQVKLLRVLETRQITPLGTNETRSIDLRVVSATKADLGDPAARGDFREDLYFRLNVVTLRIPPLRERREDIPMLFGHFLERASKRFSRPVPDISAGVRDRLVSHNWPGNVRELVHFADRVALGLERLGTPIASGRKEQAVSSLHLSEKVSLYEATIIRDALQECGGDVRRTIEVLGVPRKTFYDKLKRHGIDTADYRKTAIG

SEQ ID NO: 43791 - DNA, 1362 bp, Borrelia burgdorferi B31
  CDS (1)..(1362): n means a or g or c or t/u
ttgaaaatgagcaaaatacttgtagctgatgatgaaaagaatattagagaaggaattgctacttatcttgaggatgaaggatattttgttttcactgctagtgacggagaagaagctcttgaaacaattgaaaatgaaaatcttgatgtaataatatctgacctgagaatgccccagatatctggagaaaaattgctcaaaatagttaaagaaaaaaacttgggaataccttttattattctaacagcccacggaacagttgattctgctgtagatgccatgagagagggtgcttatgattttttaacaaagcccttagaccttgaaagacttttgctaataataaaaagatcactaaataaaaaagaaaataacgataatgaaaatgctaatttagaaaatatactaataagaaaagatctaaaatactatgaaaaaatcatgggaaaatccctattaatgcaaaaaatttttgaacttgtaataaaaatagcaaaatcaaatgcatctattcttataacgggcgaaagcggtgttggtaaagaaataatagcagatgctatttttgatctttcaaatagaaatgacaaaccatttataaaagtaaattgcgcagcactttctgaaagcattcttgaaagtgaactttttggccatgaaaaaggagcattcactggagcaatttccaaaaaaaaaggcagatttgaacttgcaaacaaaggcacaatttttcttgatgagatagcagaaatttcacctgaaattcaagtcaagcttttaagagtactgcaaaacaaaacttttgaacgtgttgggggagaagctacaattaaagttgatatcaggcttctggctgcaacaaacaaaaacattgaagaggaaattaaaaaggaaaaatttagagaagatttattttatagattaaatatcattaatataaacataccgcctttaagagaaagaaaagatgatatatcttatttaacaaacatactaataaaagacgtcgcaaaggaaaacaatagagaagaaaaaactctttctaatgatgcaatgaaagctctctattattacgattggccaggaaatattagagaattaaaaaatgtgcttgaaagtgcattaatattatcaaaaggcaaacaaatcactaaagaagatttgccagcaaaaatcaaaaataatgaaaatcttatatttaaaataacactaccaatnggaattagcctaaaagaagctgaaaaagaaataataaaacaaacactttttcattccaaaaacaacaaaagcaaatgcgccgaaatactaaaaataggaagaaaaactttacacaataaaataatcgaatataatattgattaa

SEQ ID NO: 43792 - protein, 453 aa, Borrelia burgdorferi B31
  misc_feature (406)..(406): Xaa can be Ile or Met
MKMSKILVADDEKNIREGIATYLEDEGYFVFTASDGEEALETIENENLDVIISDLRMPQISGEKLLKIVKEKNLGIPFIILTAHGTVDSAVDAMREGAYDFLTKPLDLERLLLIIKRSLNKKENNDNENANLENILIRKDLKYYEKIMGKSLLMQKIFELVIKIAKSNASILITGESGVGKEIIADAIFDLSNRNDKPFIKVNCAALSESILESELFGHEKGAFTGAISKKKGRFELANKGTIFLDEIAEISPEIQVKLLRVLQNKTFERVGGEATIKVDIRLLAATNKNIEEEIKKEKFREDLFYRLNIININIPPLRERKDDISYLTNILIKDVAKENNREEKTLSNDAMKALYYYDWPGNIRELKNVLESALILSKGKQITKEDLPAKIKNNENLIFKITLPXGISLKEAEKEIIKQTLFHSKNNKSKCAEILKIGRKTLHNKIIEYNID

SEQ ID NO: 43793 - DNA, 1320 bp, Aquifex aeolicus VF5
  CDS (1)..(1320)
gtgaacgttttggtaattgaagatgacaaggttttcagaggtttactcgaggaatacctttccatgaaaggtataaaagttgagagtgctgagaggggaaaggaagcgtacaaactcctttcggaaaaacacttcaacgtggtactccttgatctcctgcttccagacgtgaacggactggaaatactcaagtggattaaagaaagaagcccggaaacggaagtaatcgtaattacgggacacggaactataaaaactgcggtagaagctatgaaaatgggagcgtacgactttttaacaaaaccctgcatgctcgaagaaatagaactcactataaataaggcgatagaacacaggaaattgaggaaagaaaacgaattactgagaagggaaaaggacttaaaggaagaggagtacgtattcgaaagccccaaaatgaaggagattctggaaaaaattaagaagatttcctgtgcggaatgtcccgtccttatcacgggagaaagcggagttggaaaggaggttgtggcacggcttatacacaaattgagcgacagatctaaagagccctttgttgcattaaatgttgcttcaattccccgggatatattcgaagcggaactcttcgggtacgaaaagggagccttcacgggagcagtatcttccaaggaaggtttttttgagcttgcggacggaggaacactctttttggacgagataggtgagctgagtttagaggctcaggcaaaactgctcagggtaattgagagcggaaagttttacagactcggcggaaggaaggaaattgaagtaaacgtaaggattctggccgcaactaatagaaacattaaagaacttgtaaaggaaggaaagttcagggaagacctttactacagactcggagttatcgagatagaaataccacctttgagggaaaggaaggaagacataatccctctcgccaatcactttctgaaaaagtttagcaggaagtacgcaaaagaagtggagggattcacaaaaagtgcccaagaacttctactaagttatccctggtacggaaacgtgagggaactcaaaaacgtaattgaaagggctgtactcttttccgagggaaagtttatagacagaggggaattgtcctgcttggtaaattcaaaagggataaaaaacaaacacaaaagtataaaggaaattgaaaaggaagaaataataaaagtcttgaaagaggtaaatttcaataaaaaacttgcttccgagatccttgggattcccttaagaactctctacaggagactgaaggagtacggaatagagtaa

SEQ ID NO: 43794 - protein, 439 aa, Aquifex aeolicus VF5
MNVLVIEDDKVFRGLLEEYLSMKGIKVESAERGKEAYKLLSEKHFNVVLLDLLLPDVNGLEILKWIKERSPETEVIVITGHGTIKTAVEAMKMGAYDFLTKPCMLEEIELTINKAIEHRKLRKENELLRREKDLKEEEYVFESPKMKEILEKIKKISCAECPVLITGESGVGKEVVARLIHKLSDRSKEPFVALNVASIPRDIFEAELFGYEKGAFTGAVSSKEGFFELADGGTLFLDEIGELSLEAQAKLLRVIESGKFYRLGGRKEIEVNVRILAATNRNIKELVKEGKFREDLYYRLGVIEIEIPPLRERKEDIIPLANHFLKKFSRKYAKEVEGFTKSAQELLLSYPWYGNVRELKNVIERAVLFSEGKFIDRGELSCLVNSKGIKNKHKSIKEIEKEEIIKVLKEVNFNKKLASEILGIPLRTLYRRLKEYGIE

SEQ ID NO: 43795 - DNA, 1377 bp, Treponema pallidum subsp. pallidum str. Nichols
  CDS (1)..(1377)
atgaaattcagtattctcgtactagatgatgaaaaaaatatccgtgaaggtttgcaaatggccctcgaagatgaaggatatgaggtgtttaccgcagaggatggaaatacaggggtagagattgccctcaaaggggatatcgatcttattatcactgatttaaaaatgcctcgtatgagcggggaattggtgctgcaacatgtgcacgcggtgttgcccgatattcctatcattattctcaccgggcatggcacagtagaaaatgcagttgaagcaatgcacaagggagcttacgattttttaactaaaccattggatcttaaccgattgtctttgcttgtgcgccgggcgctacaaaaccgagagttgatcgttcaacatcgagagttaatcaaacaaataggaaatcgcacctcattcgagaacattgtaggagaaagtcctgcaatgaacaaagtgtttgacatggtaaaaaaggcagccgcctcaaaagcgtccgtgctcattactggagaaagcggggtcggtaaagaacttatcgcgaatgcaatccataatctttcgccgaggaaggcaaaacctttaattaaagtacactgcgcttcttttgcagaaggagtgttggaaagtgagttattcggtcatgaaaggggtgcctttaccggtgcggtcaatcgcatgaaaggtcgttttgaacttgcgcacgaaggatcaatgtttcttgatgaaatcggagaagtaagtatggctgtgcaaataaaactactccgtgtgttacaagaacgttcatttgaacgtgtaggtggaagagaaacaataaaagttgatgtacgcgtaatttctgcaacaaatcgtaatcttttagaagaaattaaacgcaatttgtttcgagaggatctttattaccgattaaatgttgtgcacattcacgttcctgcgctgcgcgagcgcaaggaggatttgccattactgattgcaacatttcttaaagagattgcagaagaaaacggtaaaaaaattacctctatagatcctcaggcccagtctgcactgcacgcgtatgattggcctggtaatattcgtcagctgagaaactgcattgaaagcgctgtcattatgagctcaggtcctgttatccacatagaggatctctcagagccaattcgatctctcggtgaaacctcttccatacgcattcctataggagtgagcatggaggatgcagaaaaggaaatcatcctccagacactggaagcacaaaaaggtaataagagcaaaaccgcagacgtgcttggcattgggagaaagacgctctatctaaaattagatcaatacacgaatacaagctttgaacctgatgccgcagcaaaatcatga

SEQ ID NO: 43796 - protein, 458 aa, Treponema pallidum subsp. pallidum str. Nichols
MKFSILVLDDEKNIREGLQMALEDEGYEVFTAEDGNTGVEIALKGDIDLIITDLKMPRMSGELVLQHVHAVLPDIPIIILTGHGTVENAVEAMHKGAYDFLTKPLDLNRLSLLVRRALQNRELIVQHRELIKQIGNRTSFENIVGESPAMNKVFDMVKKAAASKASVLITGESGVGKELIANAIHNLSPRKAKPLIKVHCASFAEGVLESELFGHERGAFTGAVNRMKGRFELAHEGSMFLDEIGEVSMAVQIKLLRVLQERSFERVGGRETIKVDVRVISATNRNLLEEIKRNLFREDLYYRLNVVHIHVPALRERKEDLPLLIATFLKEIAEENGKKITSIDPQAQSALHAYDWPGNIRQLRNCIESAVIMSSGPVIHIEDLSEPIRSLGETSSIRIPIGVSMEDAEKEIILQTLEAQKGNKSKTADVLGIGRKTLYLKLDQYTNTSFEPDAAAKS

SEQ ID NO: 43797 - DNA, 1161 bp, Chlamydophila pneumoniae CWL029
  CDS (1)..(1161)
atggcgattaaaaatatacttgttgttgatgacgagcccctactcagagatttcctctcggaacttcttacctcacagggattcatcccagacactgctgaaaacttaagaaatgctctccaaatgatccgaagtcgagactatgaccttgtcatctcagacatgagtatgcctgacggctctggtcttgatttaatcaaaattataaagcaaagctccccccacacgcccgtccttgtagtcactgcttacggaagcatagagaacgccgtagaggctatgcaccaaggggcattcaactacttaacaaaacctttttcttctgaagcactttttgcctttatctctaaagctgaagaacttaagaacctagtccatgagaatctctttctacattctcagacaacaccagattcacaccctctgattgcagaaagcaaggctatgaaagatcttcttgccatagcaaaaaaagcagcttcaagctcagcaaatatattcattcacggagaatcgggatgcggaaaggaagtcctctccttttttatccaccacaactctcctcgagccaaccacccctatattaaagttaactgcgcagcaattcctgaaactctcttagaatcagaactttttggccatgaaaagggagcatttacaggagcaactacaaagaaggcaggacgttttgaacttgcccataaaggaaccctcttattagatgaaatcaccgaagtcccagtaaaccttcaagcaaaactcctgagagctatccaagaaaaagaaatcgaacaccttggaggaaccaagaccctctccgtagatgttcgcatcttagcgacctcaaaccgaaagcttaaagaagctatcgatgataaaagcttccgacaagatctgtattaccggttgaatgtcatccctctacacctcccccctctaagagaccgacaggacgacatcctccctctggcgaactacttcctaaataagttctgccgcatgaacaatactcctctgaaaaccctctctcctaaagctcaagagctcctccttaactacccctggccaggcaatattcgagagctctccaatgttctggaacgtgtggttatcctagagaacacctccctactcaccgaagacatgctcgctttagcttga

SEQ ID NO: 43798 - protein, 386 aa, Chlamydophila pneumoniae CWL029
MAIKNILVVDDEPLLRDFLSELLTSQGFIPDTAENLRNALQMIRSRDYDLVISDMSMPDGSGLDLIKIIKQSSPHTPVLVVTAYGSIENAVEAMHQGAFNYLTKPFSSEALFAFISKAEELKNLVHENLFLHSQTTPDSHPLIAESKAMKDLLAIAKKAASSSANIFIHGESGCGKEVLSFFIHHNSPRANHPYIKVNCAAIPETLLESELFGHEKGAFTGATTKKAGRFELAHKGTLLLDEITEVPVNLQAKLLRAIQEKEIEHLGGTKTLSVDVRILATSNRKLKEAIDDKSFRQDLYYRLNVIPLHLPPLRDRQDDILPLANYFLNKFCRMNNTPLKTLSPKAQELLLNYPWPGNIRELSNVLERVVILENTSLLTEDMLALA

SEQ ID NO: 43799 - DNA, 1407 bp, Vibrio cholerae O1 biovar eltor str. N16961
  CDS (1)..(1407)
ttgtctatgagtagaggatacgtctgggttgtcgatgatgatagttccattcgctgggtaatggagaaaacgctctcttcagcccatataaaatgcgaaaccttcgcagatgcggaaagcgtactgctggcactggagcgtgaaacccccgacgttcttgtctcagatattcgcatgccagggatggatggcattgctctgctcaatcaagtacaccaacgcacccctgaacttccggtgatcattatgaccgcgcattcggatctggatgccgccgtcaatgcctaccaacaaggtgcctttgagtatcttcccaagccttttgatgtcgatgaaaccctcaccttagtcgaacgtgccatcgctcatggtcaagagcagcgcaagacatctcatcgtcccagtgaaaactattccgcccctgaaatcattggcgaagcgccggctatgcaagaagtgtttcgcgcaattggtcgcttatcacgctcttcgatttcggtattgatcaacggtgaatcgggaaccggtaaagaattggtcgctcatgctctgcatagacatagtcctcgtgcccaaaagccgtttattgccctcaatatggcggcgattcccaaagatctcatcgaatctgaactgtttggccatgaaaaaggcgcgtttactggtgcaaataccgtgcgccaaggtcgcttcgaacaagccaatggcggcactttatttcttgatgaaattggcgatatgccgctcgatattcaaactcggttattgcgcgtgttggcggatggtcagttttatcgcgttggcggtcatgtcgcgataaaagtcgatgtgcgaatcgtcgcagccactcaccaaaatcttgaaaaactggttcatcaaggcaaatttcgtgaagacttattccatcgtctgaacgttattcgcatccatatcccgtcactgcgtgaacgtcgacaagatattgaaaagctcactaagcactttttagcgctggcagccaaagagctcggagtggagatgaaaacgctcaacccgcgcaccgtggatattctgaccaagctcgattggccgggtaacgtgcgccaactcgaaaacatgtgtcgctggctcacggtgatggcaagtggaagtgaagtgctgccaagtgatcttccttccgaattattatcagaaaggaaagccagccattttgataatgatataagttggcagaaacagttagaaacatgggcaaaatctgcactggcctccggtgaaaccgagttgcttgcctacgcactcccagaatttgaacgtatacttttagaagcggcacttcaccacaccaatggacataaacaagaagccgccaaagtattgggctggggacggaatacgctaacacgtaaactcaaagagttatattaa

SEQ ID NO: 43800 - protein, 468 aa, Vibrio cholerae O1 biovar eltor str. N16961
MSMSRGYVWVVDDDSSIRWVMEKTLSSAHIKCETFADAESVLLALERETPDVLVSDIRMPGMDGIALLNQVHQRTPELPVIIMTAHSDLDAAVNAYQQGAFEYLPKPFDVDETLTLVERAIAHGQEQRKTSHRPSENYSAPEIIGEAPAMQEVFRAIGRLSRSSISVLINGESGTGKELVAHALHRHSPRAQKPFIALNMAAIPKDLIESELFGHEKGAFTGANTVRQGRFEQANGGTLFLDEIGDMPLDIQTRLLRVLADGQFYRVGGHVAIKVDVRIVAATHQNLEKLVHQGKFREDLFHRLNVIRIHIPSLRERRQDIEKLTKHFLALAAKELGVEMKTLNPRTVDILTKLDWPGNVRQLENMCRWLTVMASGSEVLPSDLPSELLSERKASHFDNDISWQKQLETWAKSALASGETELLAYALPEFERILLEAALHHTNGHKQEAAKVLGWGRNTLTRKLKELY

SEQ ID NO: 43801 - DNA, 1452 bp, Bacillus halodurans C-125
  CDS (1)..(1452)
atgacaagcatattaatcattgacgatgaagtagaagtaggtaactttctttcccatctcttcatgtcaaagggatacaatgtgactgttgtaaatagtggaaaggaattcaatgaaattgactttagccaccagccatttcatgctgcgatgatcgacctaaaattacctgatgctaatggacttgtgttactcaagcatttaaaaaggagacaaccccattgtaaagtgattatcatgacaggttacagcacaataaaaacagccgtcgaggcgatgaagttaggggcaagtgattacatagagaagccatttgatgatattgatttgttagaggcccaagtggacgacttgctcatttccaatgtaacctccaacgagcaacgcattctcgatttggctataaatgtagggctcattgtgggacaaaatgagacaatgagacagttaattcaaacggcttataaagtagcaggcaaaaatgtaaatgtgttaattgagggggaaacagggacgggaaaggaagtgttggcacggtttatccatcaggcaagtcaaaggagttacgaatcgtttattggggtaaactgtggagcactatccgaatctttattggagagtgagctttttggtcacgaaaaaggagcctttacaggggcaacacaaatgcggaaaggcctttttgaaattgccagcaagggaacgctgtttcttgatgaaatagcggaagcctcaacttcaattcaagtgaaactcttacgtgtacttgaaacacgagagtttatgcgtctaggaggagaacgaatatttcgaacaaatacccgtctgcttgcggcaacgaacgaagatcttcaagaagcggtgcagcagaaaaaatttagagaagatctattttaccggttaaacgtcgtccatttacaaattccgccgcttcgagagagaaaagaggacatcccactcttaatggaacactttttgaaacgatatccaggtatcgaaatcacgttttcggatgatgcagtaaaaacgatgcaaagctatgaatggccagggaatatccgagaattatcaaactgcattactaggatcgtcacgttagccgattccggtcatgtgaaaatcactgctgatcatcttccgtttacaggtcaacgttcggtcacctctaaaaagctaacagctagcagtcgttccgaaacactgggagagggcatggacgagcatattgaaaaatggatggatgaagctttatgtttttattcacaaaaagaagatattgatttagaagaggttcttgcccaagttaaacagttagagtcacaactcggcaaagctctcattttacaaacgttagaagctacccatggcaaccgaaaagaagccgcaaaacggttgcaaatttcgacgagaaagctccgatatcttttaaatgaaaaagtgaatacagaatag

SEQ ID NO: 43802 - protein, 483 aa, Bacillus halodurans C-125
MTSILIIDDEVEVGNFLSHLFMSKGYNVTVVNSGKEFNEIDFSHQPFHAAMIDLKLPDANGLVLLKHLKRRQPHCKVIIMTGYSTIKTAVEAMKLGASDYIEKPFDDIDLLEAQVDDLLISNVTSNEQRILDLAINVGLIVGQNETMRQLIQTAYKVAGKNVNVLIEGETGTGKEVLARFIHQASQRSYESFIGVNCGALSESLLESELFGHEKGAFTGATQMRKGLFEIASKGTLFLDEIAEASTSIQVKLLRVLETREFMRLGGERIFRTNTRLLAATNEDLQEAVQQKKFREDLFYRLNVVHLQIPPLRERKEDIPLLMEHFLKRYPGIEITFSDDAVKTMQSYEWPGNIRELSNCITRIVTLADSGHVKITADHLPFTGQRSVTSKKLTASSRSETLGEGMDEHIEKWMDEALCFYSQKEDIDLEEVLAQVKQLESQLGKALILQTLEATHGNRKEAAKRLQISTRKLRYLLNEKVNTE

SEQ ID NO: 43803 - DNA, 1362 bp, Bacillus halodurans C-125
  CDS (1)..(1362)
atgaaacgaattctcataattgatgatgaaccttccatctgttcttctttgcagtttgcgttagaggatgactatgagacagaggcgacaaccgaggtagacaaaggattgcatatcatcgagcaagaacctatcgatgttgttcttcttgatttaaagattggtaaagtcgatggccttgaagtacttcaggaaattaaaaggaaaaagccggagacgattgtcattatgattacggcttatggaacgattgccaattcggtcaaggcgattcgattaggggcctattcgtatttaacaaagccaatccacatggaagaattgttctcggttttagagcaagcattacattacaaaaagctgaacgaacaagttgcttatttaagccaagagcttgaaaagaagtacggctatgaaggtatgatcggaaaaagtgaagcgatgacccaagtgtttcatcttattgaaaaagtaaaaaatgttgactcaagcgtcttaattacaggtgaaagtggcacaggaaaggaactcgtcgctcgggcgattcacttttcaggcaaacgaaaacaggaacactttgaagttgtgaattgtgcagcgattccggaacacttgttagagagcgagcttttcggctatgagaaaggggccttcactggggctgcgacaagaaaggaagggaaatttcaactcgcaaatcgaggaacgatttttcttgatgaaatcggtgacatgccgttagcactccaggcgaagctacttcgagtgttgcagaaaaaagaagtaaccaagctcggttcaaacaaaacggaaaagcttgacgtacgtgtgattgcggcaaccaacaagtcgttacaggaacaagtaaaggaagggacgtttcgcgaggatttatactttcgtttacacgtcatccatatccatttgccgccattgcgtgaaaggcaagaggaccttccgtatttgctgcaacactttcttcatacatttaatcaggagttaggaaaaagcatgaaagggtttcggtctgatgctcaacgggagttactagcctatcaataccctggcaatattcgcgagctatctaacattgtggaaagctcaatggtaattgcagatggcgagtatattgagcttgaggacttgcctatgttcatacgtgaaaaaggggaaggattcgccaaacaaaaaggctcactcgatgattatatcggtcgcccgctaaaagaattagagaaagacttcattttggcaaccttgaagcacaacgacaatcaccgtaagaaaacagcggaaatgctcggcattagtgagcggggattaagggataaattaaaacagtatcttgtcggtaaaaactaa

SEQ ID NO: 43804 - protein, 453 aa, Bacillus halodurans C-125
MKRILIIDDEPSICSSLQFALEDDYETEATTEVDKGLHIIEQEPIDVVLLDLKIGKVDGLEVLQEIKRKKPETIVIMITAYGTIANSVKAIRLGAYSYLTKPIHMEELFSVLEQALHYKKLNEQVAYLSQELEKKYGYEGMIGKSEAMTQVFHLIEKVKNVDSSVLITGESGTGKELVARAIHFSGKRKQEHFEVVNCAAIPEHLLESELFGYEKGAFTGAATRKEGKFQLANRGTIFLDEIGDMPLALQAKLLRVLQKKEVTKLGSNKTEKLDVRVIAATNKSLQEQVKEGTFREDLYFRLHVIHIHLPPLRERQEDLPYLLQHFLHTFNQELGKSMKGFRSDAQRELLAYQYPGNIRELSNIVESSMVIADGEYIELEDLPMFIREKGEGFAKQKGSLDDYIGRPLKELEKDFILATLKHNDNHRKKTAEMLGISERGLRDKLKQYLVGKN

SEQ ID NO: 43805 - DNA, 1422 bp, Pseudomonas aeruginosa PAO1
  CDS (1)..(1422)
atggcagccaaagtcctgctggtcgaagacgaccgcgcactacgcgaagccctcagcgacaccctgctgctgggcggtcacgagttcgtcgccgtggactcggcggaggcggcgctgccggtcctggcccgcgaagccttcagcctggtgatcagcgacgtgaacatgccgggcatggacggacaccagttgctcggcctgatccgtacacgctacccgcacctgccggtgttgctgatgaccgcctacggcgcggtcgatcgcgccgtcgaggcgatgcgccagggcgccgccgactacctggtcaagccgttcgaggcgcgggcgctgctcgacctggtggcgcgccatgcgctgggccagttgccgggcagcgaggaggatggtccggtggccctggagccggccagccggcagttgctggaactggccgcgcgggtcgcgcgcagcgattccaccgtgctgatctccggcgagtccgggaccggcaaggaagtcctggccaactatatccaccagcaatcgccgcgtgccggcaagccgttcatcgcgatcaactgcgcggcgatcccggacaacatgctcgaggccaccctgttcggccacgagaaaggttccttcaccggcgccattgccgcccagcccggcaagttcgagctggccgacggcggcaccattcttctcgacgagatatcggaaatgcccctcggcctgcaggccaagctgttgcgcgtattgcaggagcgcgaggtggagcgggtcggtgcgcgcaaaccgatcaacctggatatccgcgtgcttgccacgaccaaccgcgacctcgcggcggaagtcgcggcggggcgtttccgcgaggacctctactatcgcctgtcggtcttcccgctggcctggcggccgctgcgcgaacgccctgcggacatcctgccgctggccgagcgtctgctgcgcaagcacagccgcaagatgaacctcggcgcggtggcgctcggccccgaggccgcccagtgcctggtccggcatgcctggccgggcaacgtacgggaactcgacaacgccatccagcgtgcgttgatcctgcaacagggcggcctgatccagcccgccgacctgtgcctcaccgcgccgatcggcatgccgctcgcggccccggtgccggtgcccatgccggcaatgccaccggccaccccgccgagcgtcgagattccgtcgccggccgcaggccaggacgctagcggcgcgctgggcgacgacctgcgtcgccgcgaattccaggtgatcatcgataccctgcgcaccgagcgcggccgccgcaaggaggctgccgagcgccttggcatcagcccacggaccctgcgctacaagctcgcccagatgcgcgacgcggggatggacgtggaggcctatctctacgccatctga

SEQ ID NO: 43806 - protein, 473 aa, Pseudomonas aeruginosa PAO1
MAAKVLLVEDDRALREALSDTLLLGGHEFVAVDSAEAALPVLAREAFSLVISDVNMPGMDGHQLLGLIRTRYPHLPVLLMTAYGAVDRAVEAMRQGAADYLVKPFEARALLDLVARHALGQLPGSEEDGPVALEPASRQLLELAARVARSDSTVLISGESGTGKEVLANYIHQQSPRAGKPFIAINCAAIPDNMLEATLFGHEKGSFTGAIAAQPGKFELADGGTILLDEISEMPLGLQAKLLRVLQEREVERVGARKPINLDIRVLATTNRDLAAEVAAGRFREDLYYRLSVFPLAWRPLRERPADILPLAERLLRKHSRKMNLGAVALGPEAAQCLVRHAWPGNVRELDNAIQRALILQQGGLIQPADLCLTAPIGMPLAAPVPVPMPAMPPATPPSVEIPSPAAGQDASGALGDDLRRREFQVIIDTLRTERGRRKEAAERLGISPRTLRYKLAQMRDAGMDVEAYLYAI

SEQ ID NO: 43807 - DNA, 1437 bp, Pseudomonas aeruginosa PAO1
  CDS (1)..(1437)
atggcacatattctgatcgtcgaagacgaaaccattatccgatctgcattgcgacgcctgctggagcgcaaccagtaccaggtcagcgaagccggctcggtgcaggaagcccaggagcgctacaccatcccctccttcgacatggtggtcagcgacctgcgcctgccgggcgcccccggcaccgaactgatcaagctcgccgaaggcattccggtgctgatcatgaccagctacgccagcctgcgttcggcggtggattcgatgaagatgggcgcggtggactacatcgccaagcctttcgaccacgacgaaatgctccaggccgtggcgcgcatcctcaaggaccgccaggagaaccgcagcgcggccccggtctccgccaacggcggcaaggccggcggcgagcgcggcgccagcccggcggtagccgacggcgagataggcatcatcggctcctgtgcgccgatgcaagagctgtacagcaagattcgcaaggtcgcgccgaccgactccacggtactgatccagggcgagtccggcaccggcaaggaactggtcgcccgcgccctgcacaacctgtcgaagcgcgccaaggcgccgctgatctcggtgaactgtgcggcgattccggaaaccctgatcgaatccgagctgttcggccatgaaaaaggcgccttcaccggtgccagcgccgggcgcgccgggctggtcgaagcggccgacggcggcaccctgttcctcgacgagatcggcgaactgccgctggaggcccaggcccgcctgctgcgcgtattgcaggaaggcgagatccgccgggtcggctcggtgcaatcgcagaaggtcgacgtgcgcctgatcgccgccacccaccgcgacctgaaaaccctggccaagaccgggcaattccgcgaagacctctattaccgcctgcatgtgatctcgctgaagctgcccgccctgcgcgagcgtggcaacgacgtgatggagatcgcccgcgcctttctggctcgccagtgcacccggatggggcgcgcgccgctcagcttcgcccacgacgccgaacaggcgatccgccattacccatggccgggcaacgtgcgcgaactggaaaacgccatcgagcgggcggtgatcctcagcgagagccaggaaatccacgccgacctgctgggtatcgacatcgagctggacgacctcgaggacgacttcgccgccgacctcggcctcggcccggcgggcgccgcggccagcaaccacgagcccaccgaggacctttcgctggaagactacttccagcacttcgtcctcgagcaccaggaccacatgaccgagaccgaactggcccgcaagctgggcatcagccgcaaatgcctgtgggaacgccgccagcgcctgggcattccgcggcgtaaatcaggggcctcggccgactcgtaa

SEQ ID NO: 43808 - protein, 478 aa, Pseudomonas aeruginosa PAO1
MAHILIVEDETIIRSALRRLLERNQYQVSEAGSVQEAQERYTIPSFDMVVSDLRLPGAPGTELIKLAEGIPVLIMTSYASLRSAVDSMKMGAVDYIAKPFDHDEMLQAVARILKDRQENRSAAPVSANGGKAGGERGASPAVADGEIGIIGSCAPMQELYSKIRKVAPTDSTVLIQGESGTGKELVARALHNLSKRAKAPLISVNCAAIPETLIESELFGHEKGAFTGASAGRAGLVEAADGGTLFLDEIGELPLEAQARLLRVLQEGEIRRVGSVQSQKVDVRLIAATHRDLKTLAKTGQFREDLYYRLHVISLKLPALRERGNDVMEIARAFLARQCTRMGRAPLSFAHDAEQAIRHYPWPGNVRELENAIERAVILSESQEIHADLLGIDIELDDLEDDFAADLGLGPAGAAASNHEPTEDLSLEDYFQHFVLEHQDHMTETELARKLGISRKCLWERRQRLGIPRRKSGASADS

SEQ ID NO: 43809 - DNA, 1431 bp, Pseudomonas aeruginosa PAO1
  CDS (1)..(1431)
atgagccgatcagagaccgtctggatcgtcgacgacgaccgctccatccgctgggtactggaaaaagccctgcaacaggaaggcatgaccacggtgagcttcgacagcgccgacagcgtgatcggccgcctcggccggcagcagccggacgtgatcatctccgatatccgcatgcccggcgccagcggcctcgacctgctggcgcagatccgcgaactgcatccgcgcctgccggtgatcatcatgaccgcgcattccgacctcgacagcgcggtggcctcctaccagggcggcgccttcgaatacctgcccaagccgttcgacgtcgacgaggcggtctccctggtcaagcgcgccaaccagcacgcccaggagcagcagggcctggagctgccggcgaaccaggcgcgcacgccggagatcatcggcgaggcgccggcgatgcaggaggtattccgcgccatcggccgcctcagccattccaacatcaccgtgctgatcaacggcgaatcgggtaccggcaaggagctggtcgcccatgccctgcatcgccacagcccgcgcgcagcctcgccattcatcgcgctgaacatggcggcgatccccaaggacctgatggaatccgagctgttcggccatgagaagggcgccttcaccggggccgccgcccagcgccgcggacgcttcgagcaagccgatggcggcaccctgttcctcgacgagatcggcgacatgccggccgacacccagacccgcctgctgcgcgtcctggccgacggcgagttctaccgggtcggcgggcacacgccggtgaaggtcgacgtgcggatcatcgccgccacccaccagaacctggaaagcctggtgcgcgacggcaagttccgcgaggacctgttccatcgcctgaacgtgatccgcatccacatcccgcggctggccgaccgccgcgaggacatcccggcgctggcccggcacttcctcagccgcgccgcccaggagctggcggtggaacccaagctgctgaaggcggaaaccgaggagtacctgaagaacctcggctggccgggcaacgtccgccaactggagaacacctgtcgctggatcaccgtgatggcctccggccgcgaggtgcacatcgacgacctgccgccggagctgctgacccagccgcaggacagcgcgccggcggcgaactgggaacaggcccttcgccagtgggccgaccaggcgctgggccgcggccagtcgaacctgctggacagcgccgtgccggccttcgaacggatcatgatagaaaccgccctcaagcacaccgccggccgccgccgcgatgccgccgtgctgctcggctggggccgcaataccctgacccgcaagatcaaggagctggggatgaacgtcgatggagccgacgacgaaggcgacgactga

SEQ ID NO: 43810 - protein, 476 aa, Pseudomonas aeruginosa PAO1
MSRSETVWIVDDDRSIRWVLEKALQQEGMTTVSFDSADSVIGRLGRQQPDVIISDIRMPGASGLDLLAQIRELHPRLPVIIMTAHSDLDSAVASYQGGAFEYLPKPFDVDEAVSLVKRANQHAQEQQGLELPANQARTPEIIGEAPAMQEVFRAIGRLSHSNITVLINGESGTGKELVAHALHRHSPRAASPFIALNMAAIPKDLMESELFGHEKGAFTGAAAQRRGRFEQADGGTLFLDEIGDMPADTQTRLLRVLADGEFYRVGGHTPVKVDVRIIAATHQNLESLVRDGKFREDLFHRLNVIRIHIPRLADRREDIPALARHFLSRAAQELAVEPKLLKAETEEYLKNLGWPGNVRQLENTCRWITVMASGREVHIDDLPPELLTQPQDSAPAANWEQALRQWADQALGRGQSNLLDSAVPAFERIMIETALKHTAGRRRDAAVLLGWGRNTLTRKIKELGMNVDGADDEGDD

SEQ ID NO: 43811 - DNA, 1389 bp, Pseudomonas aeruginosa PAO1
  CDS (1)..(1389)
atgagtcccttcgcgccattcgatgcccagacccaggtcctgctgatcgacgacgatccgcacctgcgccaggccctgcgccagacgctcgacctcgccgggctcaaggtcgcgaccctggacgacgcgcgccagttggataccgcgcagtgcaaggactggcccggggtggtggtcagcgacatccgcatgcccggcatcgatggcatggaactgctccgccaattgcacgaacaggacgccgacctgccggtgatcctgatcaccggccacggcgacgtgccgctggcggtccaggccatgcgcggcggcgcctatgacttcctggaaaagcccttccccagcgacgccctgctcgacagcgtgcgccgcgccctggaggtgcgccggctggtcctggagaaccgcaccctgcgcctggccctggccgaacgccacgagctgcatgggcgcctgatcggacgctcggccggcatgcagcgcctgcgcgagcaggtcggctcgctggcggcgatccaggccgacgtgctggtccttggcgaaaccggcgccggcaaggaggtggtcgcgcgggccctgcatgacctgtcgagcagacgcgacggaccgttcgtcgcgatcaacgccggcgccctcgccgaatcggtggtggaaagcgaactgttcggtcacgaggccggcgccttcaccggcgcgcagaagcgccgcatcggcaagttcgagtacgccaatggcggcaccctgttcctcgacgagatcgagagcatgagcctggacgtgcaggtcaagctgttgcgcctgctgcaggaacgggtagtcgagcggctcggctccaaccagttgatcccgctggatatccgcatcatcgcggcaaccaaggaagacctgcgccaggccgccgaccagggccgcttccgcgccgacctctattaccgcctcaacgtcgccagcctgcgcattccaccgctgcgcgagcgcggcgaagacatcccgctgctgttccgccatttcgccgaagccggcgccatgcgtcatggcctgacgccacgcgaactggacgccggccagtcggcgcggctgctggcctacgactggccgggcaacgtgcgcgaattgcagaacgccgccgagcgcttcgccctgggtctcggcctgagcctggacgacggagtcctgcccgacgccgccgacgagccgcacaacctcagcgccaaggtcgaggccttcgagcgctcgctgatcgctgccgaactggaacgcccgcacaattcgctgcgcagcgtcgccgaggccctcggtatcccgcgcaagaccctgcacgacaagctgcgcaagcacggcctgccgttcaacacacctggcgaaaatccgccagatgatggcgaatga

SEQ ID NO: 43812 - protein, 462 aa, Pseudomonas aeruginosa PAO1
MSPFAPFDAQTQVLLIDDDPHLRQALRQTLDLAGLKVATLDDARQLDTAQCKDWPGVVVSDIRMPGIDGMELLRQLHEQDADLPVILITGHGDVPLAVQAMRGGAYDFLEKPFPSDALLDSVRRALEVRRLVLENRTLRLALAERHELHGRLIGRSAGMQRLREQVGSLAAIQADVLVLGETGAGKEVVARALHDLSSRRDGPFVAINAGALAESVVESELFGHEAGAFTGAQKRRIGKFEYANGGTLFLDEIESMSLDVQVKLLRLLQERVVERLGSNQLIPLDIRIIAATKEDLRQAADQGRFRADLYYRLNVASLRIPPLRERGEDIPLLFRHFAEAGAMRHGLTPRELDAGQSARLLAYDWPGNVRELQNAAERFALGLGLSLDDGVLPDAADEPHNLSAKVEAFERSLIAAELERPHNSLRSVAEALGIPRKTLHDKLRKHGLPFNTPGENPPDDGE

SEQ ID NO: 43813 - DNA, 1428 bp, Xylella fastidiosa 9a5c
  CDS (1)..(1428)
atggttgagattgatgcgacttccccacgcatctgggtggttgacgacgatcgctcggtacgcttcgtgttgtctactgcactgcgtgatgcaggctatatcgtggaaggttttgagagtacttgcgcagcgttgcaagccctggcagcctccccaatcccagacttattgttcaccgacgtacgcatgcctggtgatgatggtttgattttgctggacaagctcaaagcacgccatccgcaccttccagtaattgttatgtctgcctacaccgatgtggctagcactgccggtgcatttcgcagtggtgcacatgaattcttgtccaagccctttgatctagacgatgcggttgcgttggcagctcgtgtgttaccacatacagaaggatctcatgggggaccacccatattgcctgctgccaacagtaatcccgtcttgatcggcagcactccggtgatgcgcgctttgttccgtgcaatcggacggttggcgcaggcaccactctcggtactgattaacggtgaaacaggcaccggcaaggagctcgttgcacgtgcgttacacaacgaatctccgcgtgcgcaggcgccgttcgttgcgctgaatgctgcggcgattccaaccgagcttttggagagcgagttgttcggtcacgaggccggcgcgtttacaggagcgaccaaacgtcatattggccgctttgagcaagccgatggcggcactttatttttggatgaaatcggcgatatgccattgtctttgcagacgagactgttacgtgtactggctgaaaatgaattcttccgggtcgggggccgcgaactgatccgtgtcaatgtccgtgtgattactgcgacccatcaggatcttgatatgttggtcgagcagggtcgttttcgttccgatctcttgcaccgtttggatgtggtgcgcttgcaactgccatcattacgtgagcggcgtgatgacgtggcacagttggccgagaattttttggcgatggctggacacaagctggatatctcagttaaacgtttgtctgccgatgcgctagagatactgcgtcgctacgattggccaggtaatgtccgtgagctggaaaatatttgttggcgattagctgctttggtgaacactgagacaattgatgccaatgatgttgaagctgtgttaacgcatggcaagcgcaagcgttgtaacactgaaagcgattgggatatccatttggccaaatgggcggaaggccgcttagcggcaggcgcaactgctgtgcatgccgaggctcgcaaatgtttggaccgaacgctactggatgtggcattgcgtttgacgcagggccgtcgtgccgaagcagctgcacgtcttggtctgggtcgtaacacgttgacccgcaagcttggctcaagtcaacgtcgtagggggtaa

SEQ ID NO: 43814 - protein, 475 aa, Xylella fastidiosa 9a5c
MVEIDATSPRIWVVDDDRSVRFVLSTALRDAGYIVEGFESTCAALQALAASPIPDLLFTDVRMPGDDGLILLDKLKARHPHLPVIVMSAYTDVASTAGAFRSGAHEFLSKPFDLDDAVALAARVLPHTEGSHGGPPILPAANSNPVLIGSTPVMRALFRAIGRLAQAPLSVLINGETGTGKELVARALHNESPRAQAPFVALNAAAIPTELLESELFGHEAGAFTGATKRHIGRFEQADGGTLFLDEIGDMPLSLQTRLLRVLAENEFFRVGGRELIRVNVRVITATHQDLDMLVEQGRFRSDLLHRLDVVRLQLPSLRERRDDVAQLAENFLAMAGHKLDISVKRLSADALEILRRYDWPGNVRELENICWRLAALVNTETIDANDVEAVLTHGKRKRCNTESDWDIHLAKWAEGRLAAGATAVHAEARKCLDRTLLDVALRLTQGRRAEAAARLGLGRNTLTRKLGSSQRRRG

SEQ ID NO: 43815 - DNA, 1494 bp, Xylella fastidiosa 9a5c
  CDS (1)..(1494)
ttggcatcttcgatgcgttgccgtgcgattgaagacgatgggaattgtccatcttcagtctgctgcgttatcttggcattcatgaatcaatcccgcagtgctctgattgtcgatgacgagcgcgacatccgtgaacttttggtccttacgctaggacgtatggggctgcgtatcagaacggcagctaatctggcacaagcatacgcgttacttgagtctgactcgttcaatctttgtatcaccgacatgcgtttacctgacggcagtggcattgagctggtgaacaagattgtgcgtcattatccacgtaccccggtggccatgatcactgcttttggcagtatcgaactggcggtagaggcgctcaaggaaggtgcttttgactttgtcagcaaacctgttgatctgaatgtcctgcgaggcatggtccgtcatgctttggaattgaacaatcgtgaacgctctgttgtgtcaagtcagccacaaagccccagccaacgtctccttggcgagtcgttaccgatggctcagcttcgggccaccatcgctaaagtggcgcgtagtcaagctccggtttatatccttggtgaatccggagttggtaaggaattggttgcacgtacgatccacgaacagagtgtccgtgctgctggggcgttcgtgccggttaactgtggtgcgatccctgtggatcttatggaaagcgaatttttcggtcacaagaaagggagtttcaccggtgcgcatactgataaaccaggcttattccaaagtgctggcggcggtactttattcctggatgaagttgccgaattacccttgcacatgcaagttaaattgctgcgtgcgattcaggagaaatcgatacggccaatcggtgcaaccgttgaggtaccagtagatgtgcgtattttatcggcgactcaccaagatctgagtgacctgattgccaatggccgcttccgtcacgatttgtactaccgcatcaatgtgatcgagatacgtgttccaccgctacgtgagcgtgctggcgatttgccgcatcttgctgcagccattgtagctcgcttggcgcacacgcatgggcgggcggtcccgttgctttcaccctccgccttggaggcgttagatcattattcgttcccgggtaatgtgcgtgaactggagaacattctggagcgtgctctagcactgactgaagatgatcatatcggtgtcgcggatctgcatctgccccagggcagtttgcatggacagggattgccgctcccgttagtgcccacagttctcccgattgtgcctgtggacgcatcggcatcggtggagggtgagaatacgccggctgccttgccgtcgtatatggagcagctggaacgtgctgccattcaaaaggcgttggaagagaatcgctggaataaaacaaagacagccgcaaaacttggcatcactttccgtgccttgcgttacaaactaaagaagctgggcatggagtaa

SEQ ID NO: 43816 - protein, 497 aa, Xylella fastidiosa 9a5c
MASSMRCRAIEDDGNCPSSVCCVILAFMNQSRSALIVDDERDIRELLVLTLGRMGLRIRTAANLAQAYALLESDSFNLCITDMRLPDGSGIELVNKIVRHYPRTPVAMITAFGSIELAVEALKEGAFDFVSKPVDLNVLRGMVRHALELNNRERSVVSSQPQSPSQRLLGESLPMAQLRATIAKVARSQAPVYILGESGVGKELVARTIHEQSVRAAGAFVPVNCGAIPVDLMESEFFGHKKGSFTGAHTDKPGLFQSAGGGTLFLDEVAELPLHMQVKLLRAIQEKSIRPIGATVEVPVDVRILSATHQDLSDLIANGRFRHDLYYRINVIEIRVPPLRERAGDLPHLAAAIVARLAHTHGRAVPLLSPSALEALDHYSFPGNVRELENILERALALTEDDHIGVADLHLPQGSLHGQGLPLPLVPTVLPIVPVDASASVEGENTPAALPSYMEQLERAAIQKALEENRWNKTKTAAKLGITFRALRYKLKKLGME

SEQ ID NO: 43817 - DNA, 1542 bp, Sinorhizobium meliloti 1021
  CDS (1)..(1542)
gtgacatcccatattcttgtcatcgacgacgatccggtgcagcggcggctgctgacgaacatgatcgagcggctgggccatgtcgcgcatctcgccgacaacgggcgcagcgggctcgaactcctgcagcgcaaaggcggcatcatcaacgtcatcctgctcgatcttctgatgccggaaatgaacgggcacggccttctcgaggcgctcgccgagcgtggcatcgacatcccggtcatcgtccagacagggcagggcggcatcgagacggtggtccaggcgatgcaggccggcgccttcgatttcctcgtcaagccggtttcgccggagcggctgtcgatcgccttgggcaacgcgctgaagatggcgagtcgtgacggcaaggtcaaaaccgcgcggcgtccgcgtggcggggccgtcggtttcgacgatatagtctcggcgagcccggcgatgatccgcgtcatcgatctcgcgcgccgcgctgctcagtcgaacatcccgatcgtgctcgagggcgagtcgggcgtcggcaaggaaatggtggcccgcgccatccaggcggcgagcgaccgggcggcgaagcctttcgtcaccgtcaattgcggcgcgatcccccacaatctcgtcgagagcattctcttcggccatgagaagggagcgtttacgggcgcgagcgaaaagcacagcggcaagttcgtcgatgccgacggcggcaccctctttctcgacgaaatcggcgatcttccgctcgacgtacaggtcaagctgctgcgcgccgtccagcagggcgagatcgagacgatcggggcgcgtcagccgcagaaggtgaatgtgcgcctcatctcggccaccaataaggaccttatcaccgaggttcgcgagggccggttccgcgaagatctctactatcggctgaacgtcttcccgatcaccattccggcgctgcgccggcgcaaggaggatatccccgttctggtacgcgccttcgtcgagcgcttctccgccgagcagagactcgatcagcggctgacggtatcgagcggtgccatggcgctgctgacgtcctatgactggccgggcaatatccgccagctcgaaaacgcgatcttccgcgccgtcgtgcttgctgacggccacgaactcacggtcagggattttccgcaggtcgccacccagataccgggctacatcgttgccgaccgctccggtctctcctggggggaagccggcccggaacgtcgtcccgcctccggtcagctcgccgccgcccaggccgatgccggcgcgcgggaacaaccggcgcattccgagcagaccccggaaggccgtctggagaacgccatcgccagcctcagcgaaggcggcgaggtcaggaagctcgccgaggtcgaggaggaactgattcggtttgccctgaaattctaccgcggccagatgagccaagtggcgcgcaaattgggaatcgggcgctcgactctctatcgcaaactcaaggattacggcatcgatcccgacaatcccctgcgtgaagcggcataa

SEQ ID NO: 43818 - protein, 513 aa, Sinorhizobium meliloti 1021
MTSHILVIDDDPVQRRLLTNMIERLGHVAHLADNGRSGLELLQRKGGIINVILLDLLMPEMNGHGLLEALAERGIDIPVIVQTGQGGIETVVQAMQAGAFDFLVKPVSPERLSIALGNALKMASRDGKVKTARRPRGGAVGFDDIVSASPAMIRVIDLARRAAQSNIPIVLEGESGVGKEMVARAIQAASDRAAKPFVTVNCGAIPHNLVESILFGHEKGAFTGASEKHSGKFVDADGGTLFLDEIGDLPLDVQVKLLRAVQQGEIETIGARQPQKVNVRLISATNKDLITEVREGRFREDLYYRLNVFPITIPALRRRKEDIPVLVRAFVERFSAEQRLDQRLTVSSGAMALLTSYDWPGNIRQLENAIFRAVVLADGHELTVRDFPQVATQIPGYIVADRSGLSWGEAGPERRPASGQLAAAQADAGAREQPAHSEQTPEGRLENAIASLSEGGEVRKLAEVEEELIRFALKFYRGQMSQVARKLGIGRSTLYRKLKDYGIDPDNPLREAA

SEQ ID NO: 43819 - DNA, 1413 bp, Yersinia pestis CO92
  CDS (1)..(1413)
atgcaacgagggatagtctggatcgtcgatgacgatagttccatccgctgggtgcttgagcgcgcactgactggagcgggtctaaactgtgtcgcattcgatagcggcaatcaggtattggatgcactggctacgcgaactccagatgtgttgttatcagatatccgtatgccaggaatggatggcttggcattactcaaacaaattaagcaacgccatccgatgctcccggtcatcataatgacggcccattcagatttagatgccgccgtcagtgcgtatcagcaaggggcctttgactatttgcccaaaccgtttgatatcgacgaggccgtggctctggttgaacgggctattagccattatcaggagcaacaacaacccgcccgtagccaaccagtcagtgggccgacagccgatattatcggcgaagcaccggcgatgcaggatgtttttcgtatcattggccgcttgtcacgctcctcaattagcgtactgattaatggtgaatccggtaccggtaaagagctggtcgcacacgcattacatcgccacagcccacgggctaaagccctctttatcgcactgaacatggcggctatcccgaaagatttaattgagtcggaactgttcggtcacgaaaaaggggcatttaccggggccaatcaggtacggcaggggcgctttgaacaagctgacaccggcacactttttttagatgaaattggtgatatgccactggatgtgcaaacccgcctgttacgggtattggctgatggccagttctatcgggtcgggggctatgcacccgttaaagtcgatgtgcggatcattgcggcaactcaccagaatctggagttgcgtgttcaagaaggaaaattccgtgaggatctattccatcgtctgaatgtgatccgagtacatttacctccactacgtgaacgcagtgaggatattccgcgtttggctcgctactttttacacgtagcggctaaagagttgggcgtggaaagcaaaaatctgcatccagagaccgaagcggcgctaacccgcttaccttggcctgggaacgtgcgccaactggagaatacctgtcgttggctgaccgtcatggccgctgggcaggaagtcctcgttcaggatctgccgtctgaattatttgaaactcatatgcccgatgcatccggccaacgagcccccgacagttggtcaacgctgttagcgcaatgggcggatcgtgcgttgcgttctggtcatcaggatttactgtctgaagcacaaccagaaatggagcgcacgctgttaaccaccgcattacgccatacccaaggccataagcaggaagcagcacgcctgctgggctggggccgtaatacattaacgcggaagttgaaagagttggggatggagtag

SEQ ID NO: 43820 - protein, 470 aa, Yersinia pestis CO92
MQRGIVWIVDDDSSIRWVLERALTGAGLNCVAFDSGNQVLDALATRTPDVLLSDIRMPGMDGLALLKQIKQRHPMLPVIIMTAHSDLDAAVSAYQQGAFDYLPKPFDIDEAVALVERAISHYQEQQQPARSQPVSGPTADIIGEAPAMQDVFRIIGRLSRSSISVLINGESGTGKELVAHALHRHSPRAKALFIALNMAAIPKDLIESELFGHEKGAFTGANQVRQGRFEQADTGTLFLDEIGDMPLDVQTRLLRVLADGQFYRVGGYAPVKVDVRIIAATHQNLELRVQEGKFREDLFHRLNVIRVHLPPLRERSEDIPRLARYFLHVAAKELGVESKNLHPETEAALTRLPWPGNVRQLENTCRWLTVMAAGQEVLVQDLPSELFETHMPDASGQRAPDSWSTLLAQWADRALRSGHQDLLSEAQPEMERTLLTTALRHTQGHKQEAARLLGWGRNTLTRKLKELGME

SEQ ID NO: 43821 - DNA, 1338 bp, Yersinia pestis CO92
  CDS (1)..(1338)
atgacaccacgcaaaccggccaatctactgctggttgacgacgatcccagcttattgaaattgctggggatgcgtttaaccagtgaagggtttaatgtcacgacagctgaaagcggtcacgaagcattgcgtttgttaatgcgtgagaaaattgacattgttatcagtgatctgcgaatggatgagatggacggcatggcgctgttcgctgaaattcaaaaatatcaaccggggatgcctgtgattatcctcacagcgcacggttcgatccctgatgccgttgccgcgacccagcaaggggtattcagttttctgaccaagcctgttgatcgcgatgcgctatataaggctattgatgcggcattagaactttcgattccagcgggtgatgatacttggcgtgaagagatagtgactcgcagcccggtcatgctacgtctgttagaacaagcgaaaatggtcgcacaatctgacgtcagtgtgctgattaacgggcaaagcggcaccggtaaagaggtattggcacaggctatccatgccgccagcccacgggccaaaaaagcctttattgccatcaactgtggtgccttaccagagcagttgctggagtctgaattattcggccatgctaagggtgcgtttaccggtgcagtcagcagccgtgaagggttgtttcaggccgctgaagggggcacattgttcctggatgagatcggcgatatgccgctctcattacaagtaaaattactgcgggtattgcaagagcgcaaagttcgtccattgggcagcaatcgtgatttaagtattaatgtccgggtgatttcagcgactcaccgtgacttgcccaaagcgatggcaaagaatgaattccgtgaagatctctactaccgtttaaatgtggttaacctaaaaatcccggcgctacacgagcgggcggaagatattccattgctggcaaaccatctattacgggagtcggctaagcggcataagccgtttgttcgcagtttctcaaacgatgcgatgaagcggttgatgacagccagttggcccggtaacgtgcgccaactggtcaacgtgattgagcaatgcgtggcgttgacctcggcaccggttatcagcgaagcgctggttgagcaggcgctggagggtgaaaataccgtattaccgacgtttgtggaggcccgtaatcaattcgaactaaactatttgcgtaagctattacaaattgccaaaggtaacgttacccaagccgctcgtatggcggggcgtaaccgtactgagttctataaattgttgtctcgccacgagttggatgccaacgattttaaagagtaa

SEQ ID NO: 43822 - protein, 445 aa, Yersinia pestis CO92
MTPRKPANLLLVDDDPSLLKLLGMRLTSEGFNVTTAESGHEALRLLMREKIDIVISDLRMDEMDGMALFAEIQKYQPGMPVIILTAHGSIPDAVAATQQGVFSFLTKPVDRDALYKAIDAALELSIPAGDDTWREEIVTRSPVMLRLLEQAKMVAQSDVSVLINGQSGTGKEVLAQAIHAASPRAKKAFIAINCGALPEQLLESELFGHAKGAFTGAVSSREGLFQAAEGGTLFLDEIGDMPLSLQVKLLRVLQERKVRPLGSNRDLSINVRVISATHRDLPKAMAKNEFREDLYYRLNVVNLKIPALHERAEDIPLLANHLLRESAKRHKPFVRSFSNDAMKRLMTASWPGNVRQLVNVIEQCVALTSAPVISEALVEQALEGENTVLPTFVEARNQFELNYLRKLLQIAKGNVTQAARMAGRNRTEFYKLLSRHELDANDFKE

SEQ ID NO: 43823 - DNA, 1467 bp, Caulobacter crescentus CB15
  CDS (1)..(1467)
atgaccaaaacggtccttgtcgtcgatgacgacccgacacaacgtcggttgattcaagcggtgctcgagcgcgacgggttcgcggtctcgcacgcggaaggcggcgacgcggcgatcgcgcacctgacgtccggcgcgcccgccgatgtcatcctgctggatctcgtcatgcctggcctcaacggtcaggacgccctgaaggaaatgcgcgcccgcggcttcaaccagcccgtgatcgtgctgacggccagcggtggcgtcgacaccgtggtcaaggccatgcaggccggcgcctgcgacttcttcatcaagcccgcctcgcccgagcggatcaccgtgtcgatccgcaacgccctgtcgatgggcgacctcaagggcgaggtcgagcggctgaccaagcgcgcgggcggcaagaccaccttcgcggacctgatcggcgcctcgccggtcatgaccatggtcaagcgcatgggcgagcgggccgccaagagcggtatcccggtgctgatcaccggcgaaagcggcgtcggcaaggagctgatcgcccgcgccgtccacggctcttccgaccgcgccggcaagccgtttgtcgcggtcaactgcggcgcgatccccgagaacctcgtcgagtcgatcctgttcggccacgagaagggctcgttcaccggcgccaccgacaagcatctgggcaagttcaaggaggccgacggcggcaccctgttcctcgatgaggtcggcgagctgccgctcgacatgcaggtcaagctgctgcgcgccctgcaggagggcgagatcgacccgatcggctccaagcgctcgatcaaggtcgatgtccggatcgtgtcggcgaccaatcgcgatctgcagcaggccgtttcgggcggccggttccgcgaagacctgttttatcgcctgaacgtgttcccgatcgaggcgccgtccctgcgcgagcgtcgcgaggacatcccggccctcgtcgaggcgttcatccgccggttcaacgtcgaagaaggcaagcgcgtgatcggcgcctcgcccgagacgatgcaactgctgaccagcttcgactggcccggcaatgtgcgccaactggaaaacaccgtctatcgcgccatcgtgctggccgatgcgccctatctgcagccgttcgacttcccggcgatctcgggcctggccgcgccgatcgaggccgtatcgatctcgccctcgccgccgcctgcagccctgttgcaagccacgcatgcggcgatggccgccgccgtcgcagaggcgcctgtgcgcatcctcgacgatcgcggtcacctgcggaccctggaggagatcgagcgcgacctcatccagcatgcgatcgacgtctatgccggccacatgagcgaggtcgcgcggcgtttgggcatcggtcgctcgaccctctatcgcaaggttcgcgagcagggcatcgaagtcgacatgaaggaagcgggctga

SEQ ID NO: 43824 - protein, 488 aa, Caulobacter crescentus CB15
MTKTVLVVDDDPTQRRLIQAVLERDGFAVSHAEGGDAAIAHLTSGAPADVILLDLVMPGLNGQDALKEMRARGFNQPVIVLTASGGVDTVVKAMQAGACDFFIKPASPERITVSIRNALSMGDLKGEVERLTKRAGGKTTFADLIGASPVMTMVKRMGERAAKSGIPVLITGESGVGKELIARAVHGSSDRAGKPFVAVNCGAIPENLVESILFGHEKGSFTGATDKHLGKFKEADGGTLFLDEVGELPLDMQVKLLRALQEGEIDPIGSKRSIKVDVRIVSATNRDLQQAVSGGRFREDLFYRLNVFPIEAPSLRERREDIPALVEAFIRRFNVEEGKRVIGASPETMQLLTSFDWPGNVRQLENTVYRAIVLADAPYLQPFDFPAISGLAAPIEAVSISPSPPPAALLQATHAAMAAAVAEAPVRILDDRGHLRTLEEIERDLIQHAIDVYAGHMSEVARRLGIGRSTLYRKVREQGIEVDMKEAG

SEQ ID NO: 43825 - DNA, 1713 bp, Ralstonia solanacearum GMI1000
  CDS (1)..(1713)
atgagccgccagccgtttttccgtccccccatgtccaaagctgccgtcgttcgcgaacccatcctcgtcgtcgatgacgaggccgatctgcgtgagctgctggagatctccctgcggcgcatggggcacgatgtggtgctggccggcggcctggccgaggcgcgcgaggcgctgacgcggcaacgctttgcgctggtgctgaccgacatgcgcctgggcgacggcctgggcatcgacctggtgcgccagctctcggccaccgccgatcgcacgccggtggccgtcatcaccgcctacggcagcgccgagaacgcggtggaggcgctcaaggcgggcgcgttcgactacatcgccaagccgctgtcgctcgaccagctgcgcagcctggtgctcaacgcgctgggccgccagcagcgcgatcccgatcccggcagcgccgatctcgccgaacgcaccagtgcgctgctgcccggccattcggccgccatgcaggaggtgcgccgctcgctgctgcggctggcgcgcagcatggcgccggtggtgatcagcggcgaatcgggcagcggcaaggagcgcgcggcgcgcgccatccacgcgctgtcgtcgcgctcggcgcggccgttcgtggccgtcaactgcggcgcgattcccgagaacctgatggaagccgagttcttcggctacgtgaagggtgccttcacgggtgccgacagcgaccgccagggcttcttccaggcggcccacggcggcacgctcatgctcgacgaggtggccgacctgccgctgaccatgcaggtcaagctgctgcgcgcgctgcaggagcgccgcgtgcgcaagatcggcgagagccgcgaagacccggtcgacgtgcgcgtggtatgcgcgagccaccagaacctcgcgcgcctggtcgccgccgggcgtttccgcgaagatttgttctaccggctcaacgtgctggagctgcgcatgccgacgctgcgcgagcgcgccgaggacgtgccggtcctggcgggcgtgctgctggagcagctggccgcgcgctatggcgatctgcggccgaagcggcttacgcgccaggcgctacagcagctgtgcgcctatccgttccccggcaacgtgcgcgagctggataacctgctggagcgcgcctacgcctttgccgagggcgagtcgatcgacgtggaccatctcggcgcgctgggcaccgacatcgagcgctcgccgctgttccatcgcgcgcgcgaggcgcatggcggccatcccgtgcacccggcgcacctgccgccggtgccggcgcccggccatcccgcccatccggggcatcccggccatgtcgcgcatccgctcggcgtgccgcagccggtgggcggctggcccgatgcggcctacattcccgtgccggtgccgatgggcctgatgccgcatcccgtcgtcgtgcccgtgccggtcgagcccgcgccggtgatcgagccggccgcgccggccatgcccgcggtgtccttgccggtggacttgccggcctacctcgaatcggtggagcgcggcgtgatcctggccgcgctggcgcagaccggcttcaaccggacggcggcctccaagctgctcggcctgagcttccggcagctgcgctaccggatgcagcagctggacatccgcgatccgcgcgacatcgaagccgcggcgggcaacggcggggtgggtgatgcctga

SEQ ID NO: 43826 - protein, 570 aa, Ralstonia solanacearum GMI1000
MSRQPFFRPPMSKAAVVREPILVVDDEADLRELLEISLRRMGHDVVLAGGLAEAREALTRQRFALVLTDMRLGDGLGIDLVRQLSATADRTPVAVITAYGSAENAVEALKAGAFDYIAKPLSLDQLRSLVLNALGRQQRDPDPGSADLAERTSALLPGHSAAMQEVRRSLLRLARSMAPVVISGESGSGKERAARAIHALSSRSARPFVAVNCGAIPENLMEAEFFGYVKGAFTGADSDRQGFFQAAHGGTLMLDEVADLPLTMQVKLLRALQERRVRKIGESREDPVDVRVVCASHQNLARLVAAGRFREDLFYRLNVLELRMPTLRERAEDVPVLAGVLLEQLAARYGDLRPKRLTRQALQQLCAYPFPGNVRELDNLLERAYAFAEGESIDVDHLGALGTDIERSPLFHRAREAHGGHPVHPAHLPPVPAPGHPAHPGHPGHVAHPLGVPQPVGGWPDAAYIPVPVPMGLMPHPVVVPVPVEPAPVIEPAAPAMPAVSLPVDLPAYLESVERGVILAALAQTGFNRTAASKLLGLSFRQLRYRMQQLDIRDPRDIEAAAGNGGVGDA

SEQ ID NO: 43827 - DNA, 1365 bp, Ralstonia solanacearum GMI1000
  CDS (1)..(1365)
atgcctgacacccctttctcttccgagctgtcgtccgccgccgaccttgcgccggtcttcctgatcgaagacgacgacgtggtgcgcctgggctgcgagcaagcgctcaccctggcggacctgccggtgcggcccttcgccgatgccgagagcgcgctggccgcgctggccgcgcagacgccgtccgtggtggtgagcgacgtccggctgcccggccgcgacggcctggccgtgctgcgcgagatgctgcggcacgatcgccagttgccggtcatcctggtcaccggtcacggcgatgtgtcgatggccgtgacggccatgcgtgccggcgcgtacgacttcatcgaaaagccgttccactccgagcgcctggtcgatgtggtgcggcgcgcgctggagaagcgcaggctcaccgccgagaacctgcgcctgcgcgcggcgctgcagggccgccaggcgtttgcgctggtcggccagagccagaccatgcaggacgtgcgccgcctggtggcggcgctggcgccgaccgatgccgacatcctggtcaccggcgagaccggcgcgggcaaggacgtgctcgcgcgcgccatccacgaaggcagccggcggcgcgggccgttcgtcgcgctcaattgcgcggcgctgccggagtccgtcttcgagagcgagatgttcggccacgaggcgggcgccttcaccggcgccaaccgccggcgcatcggcaagatggaatatgccgacggcggcacgctgttcctcgacgagatcgaatcgatgccgctggcgctgcaggccaagctgctgcgcgcgctgcaggagcgcagcatcgagcggctgggcagcaatgccagcgtgccggtcgactgccgcgtggtggcggcggccaaggtggacctgaaggcggcggccgatcatggcgcgttccgcgccgacctgtactaccggctgaacgtggtgtcgatcgcgctgccgccgctgcgccagcgcgccgaggacatcccgctgctgatggcgcatttcctgcagcaggcggcgttgcgctacgaccgcgcggcgcccgactggagcgcgcaggacatgatgcgctggcagcaccacgactggcccggcaatgtgcgcgaattgaagaacgtggccgaacgcttctgcctgggcctggacgatggcctgatcgcctccgaagcgagccagcactcactggccggccgcatgatggcggtcgagcgcgccaccatcgaagaggccttgcgcgccaccgaaggcagcgtcgcccgcgcggccgacctgctggcggtgccgcgcaagacgctgtacgacaagctgaaccggcacggcatcgagccggagcgctttcgcgccggctga

SEQ ID NO: 43828 - protein, 454 aa, Ralstonia solanacearum GMI1000
MPDTPFSSELSSAADLAPVFLIEDDDVVRLGCEQALTLADLPVRPFADAESALAALAAQTPSVVVSDVRLPGRDGLAVLREMLRHDRQLPVILVTGHGDVSMAVTAMRAGAYDFIEKPFHSERLVDVVRRALEKRRLTAENLRLRAALQGRQAFALVGQSQTMQDVRRLVAALAPTDADILVTGETGAGKDVLARAIHEGSRRRGPFVALNCAALPESVFESEMFGHEAGAFTGANRRRIGKMEYADGGTLFLDEIESMPLALQAKLLRALQERSIERLGSNASVPVDCRVVAAAKVDLKAAADHGAFRADLYYRLNVVSIALPPLRQRAEDIPLLMAHFLQQAALRYDRAAPDWSAQDMMRWQHHDWPGNVRELKNVAERFCLGLDDGLIASEASQHSLAGRMMAVERATIEEALRATEGSVARAADLLAVPRKTLYDKLNRHGIEPERFRAG

SEQ ID NO: 43829 - DNA, 1476 bp, Ralstonia solanacearum GMI1000
  CDS (1)..(1476)
gtggagcgcttcgcgcatacgcggcgccggacatcgcccctgcagagggaccgccggcccctcgcggccggcccatccaacagaaacgagatgccacatatcctgattgtcgaagacgatgccagcgcacgcgccgccctgggcgagctggtcagcgccgagggcttcaccacggcccaggcgggctcgctgcgcgacgcgcgcatccagatctcgcgccacagccccgacgccgtgctgatcgacctggtcctgccggacggcaacggcatggacttgctggaagacattccctcgcattccggcaccgagatcatcgtcatgaccgggcacgccagcgtggagacggcggtggaggcgctgcgcatgggcgcggcggactatctcgtcaagccggtcaacttccagcgcctgaaatccatcctggcgcgcattccgcgtccgggtgacctcaaggccgagatcggcagcctgcgtggcgagctgcggcggctgggcctgtttggccagatgctcggcaattcgccggcgatgcagacgttgtacgaccaggtcagccgcgtggcgcccaccgaggccaccgtcctgctgatcggcgaatcgggcaccggcaaggagctggccgcgcagaccatccacgacctgagcctgcggcgcaagcagcccttcctgccggtcaactgcggggcgatctcgcccaacctgatcgagtcggagatgttcggccacgagcgcggcagcttcaccggcgccgaccgccagcacaagggctacttcgaacgcgccaatggcggcacgctgttcctggacgagatcaccgagatgccggtcgagctgcaggtcaagctgctgcgcgtgctggagacgggcgtgttcatgcgcgtgggcaccaaccgcgagatcgacaccgatgtgcgcgtgatcgccgccaccaaccgcgatcccgaggaagccgtggccgacggcaagctgcgcgctgacctgtaccaccggctcaatgtgttcccgatgcagctgccgccgctgcgcgagcgcggcaaggacgtggaactgctggcgcagcatttcctggaccagctcaacgcgcagaacagcagcaagaagaccttcctgccgccggcgatggatacgctgcgtgcctacaactggcccggcaatgtgcgcgagctgcgcaactacgtgcagcgcgcctacatcatgtccgacgacgccggcatcagcaccgaggccgtgccgctgcaggtatccaccacgcaggcgtcgtccggctccacgctgacgatcccggtcggcacgtcgctggcgagcgccgacaagaagatcatcctggcgacgctggagcaatgtggcggcgtgaagaagcgcgccgccgaactgctcggcatcagcctgaagacgctgtacaaccgcctggaggaatacggcagcagcaacagcgaaggcgagaacggcaaggcgcagaccacggaagcctga

SEQ ID NO: 43830 - protein, 491 aa, Ralstonia solanacearum GMI1000
MERFAHTRRRTSPLQRDRRPLAAGPSNRNEMPHILIVEDDASARAALGELVSAEGFTTAQAGSLRDARIQISRHSPDAVLIDLVLPDGNGMDLLEDIPSHSGTEIIVMTGHASVETAVEALRMGAADYLVKPVNFQRLKSILARIPRPGDLKAEIGSLRGELRRLGLFGQMLGNSPAMQTLYDQVSRVAPTEATVLLIGESGTGKELAAQTIHDLSLRRKQPFLPVNCGAISPNLIESEMFGHERGSFTGADRQHKGYFERANGGTLFLDEITEMPVELQVKLLRVLETGVFMRVGTNREIDTDVRVIAATNRDPEEAVADGKLRADLYHRLNVFPMQLPPLRERGKDVELLAQHFLDQLNAQNSSKKTFLPPAMDTLRAYNWPGNVRELRNYVQRAYIMSDDAGISTEAVPLQVSTTQASSGSTLTIPVGTSLASADKKIILATLEQCGGVKKRAAELLGISLKTLYNRLEEYGSSNSEGENGKAQTTEA

SEQ ID NO: 43831 - DNA, 1452 bp, Agrobacterium tumefaciens str. C58
  CDS (1)..(1452)
atgacagctacgatcctcgtcgccgatgatgatgccgcaatccgcacggtgctgaaccaggcgctcagccgtgccggttatgacgtgcgcatcacctccaatgccgcaacgctttggcgctgggtgtcggcgggtgagggcgatctcgtcgtgaccgatgttgtgatgccggatgaaaacgccttcgaccttctgccgcgcatcaagaaggcccgcccggacctgccggttctcgtcatgagcgcgcagaacaccttcatgacggccatcaaggcttcggaaaagggcgcttatgattatctgcccaagcccttcgacctgacggaactgatcgccatcatcggccgcgcgctctccgagccgaagcgcaagcccgccaagctcgatgacgacatgcaggacggcatgccgctcgtcggccgctccgcagcgatgcaggaaatctaccgcgttctcgcgcgcctgatgcagaccgatctgacgctgatgatcacgggtgaatccggtaccggcaaggagctggtggcgcgggcgctgcatgattacggcaagcgccgcaacggtccctttgtcgccatcaatatggccgccatcccgcgcgacctgatcgaatcggaactgttcggccatgagaagggcgccttcaccggcgcacagaaccgttccaccggccgtttcgagcaggccgagggtggcacactgttcctagatgaaatcggcgacatgccgatggatgcccagacgcgtctgctgcgtgtgttgcagcagggcgaatatacgaccgtgggcgggcgcacgccgatccgcaccgatgtccgcatcgttgccgccaccaacaaggacctgaaacagtcgatcaatcagggcctcttccgcgaggacctttattatcgcctcaacgtcgtgccgttgcgcctgccgccgctgcgcgatcgtgccgaggatattcctgatctcgtccgccatttcatccagacgggtgagaaagaagggctggagggcaagcgtttcgagacggaggcgctggaagtcatgaaggcctatgcctggccgggcaacgtccgcgagttggaaaacctgatccgccgcctgatggcgctttatccgcaggaagtcatcacccgcgaaatcatcgagcaggaattacagtcggatgttcccgatagcccgttggacaagatggcggttcgcaccggttcgctcaccatttcgcaggctgtcgaggagaacatgcgggattatttcgccagcttcggcgatggcctgccgccgcccggcctttacgaccgcgtgctgcgcgaactcgaatatccgctgattctcgcggctctgacggcaacccgcggcaaccagatcaaggccgccgatcttcttggcctcaaccgcaatacgttgcgcaagaaaatccgcgagctcggcgtttccgtctatcgtagttcccgccccagctga

SEQ ID NO: 43832 - protein, 483 aa, Agrobacterium tumefaciens str. C58
MTATILVADDDAAIRTVLNQALSRAGYDVRITSNAATLWRWVSAGEGDLVVTDVVMPDENAFDLLPRIKKARPDLPVLVMSAQNTFMTAIKASEKGAYDYLPKPFDLTELIAIIGRALSEPKRKPAKLDDDMQDGMPLVGRSAAMQEIYRVLARLMQTDLTLMITGESGTGKELVARALHDYGKRRNGPFVAINMAAIPRDLIESELFGHEKGAFTGAQNRSTGRFEQAEGGTLFLDEIGDMPMDAQTRLLRVLQQGEYTTVGGRTPIRTDVRIVAATNKDLKQSINQGLFREDLYYRLNVVPLRLPPLRDRAEDIPDLVRHFIQTGEKEGLEGKRFETEALEVMKAYAWPGNVRELENLIRRLMALYPQEVITREIIEQELQSDVPDSPLDKMAVRTGSLTISQAVEENMRDYFASFGDGLPPPGLYDRVLRELEYPLILAALTATRGNQIKAADLLGLNRNTLRKKIRELGVSVYRSSRPS

SEQ ID NO: 43833 - DNA, 1542 bp, Agrobacterium tumefaciens str. C58
  CDS (1)..(1542)
atgaccgcgcatgttctcgtgatagacgatgatcccgtccagcgccgcctgctcaaaaatgcggtggaacgttatgggcatctggccttgcttgccgaaaacggcagggcggggctggaattgctcaagcaatatagtggcgagatcaacgtcattgtcctcgatctgatgatgccggaaatggacgggcttgcctttctgaaagctgtaggcgaactcggcacggatgttccggtcatcgtacaaaccggacagggcggcatcgacaccgttgtgcaggccatgcgcgccggcgcttttgatttcgtcgtgaagccggtttcgccggaaaggatcggcgccgccatctccaatgcgctcaagctcgacaggaaagaggcaaaggcccgcacgggcaggcgcggacggagcaatgcagtgaattttaccgatatcgtttccgcaagccccgcaatgctgagggtcatcgaactggcgcagcgcgccgcccagtccagcattcccgtggtgctggaaggcgaatccggtgtcggcaaggaaatggtcgcccgcgccatccagtcaggcggcgaccgggcgaacaagccgttcataacagtcaattgcggtgccattccccataatctcgtggaaagcatcctctttggccacgagaagggcgccttcacgggtgcgacggaaaaacatgtcggcaaattcatggaggcggatggcggcacgctgttcctcgatgaaatcggtgatctgccgctcgacgtacaggtgaagctgctgcgcgccgtgcagcagggcgaaatcgaaaccgtcggctccgcgcgggtgcagaaggtcaatgtgcggctgatttcggccaccaacaagaaccttatcgaagaggtgaaggaaggccgcttccgcgaggacctctattatcgcctcaacgtcttcccgatcaccattccggcgctgcgccggcgcaaggaagatattccccatctggcgcgggttttcgccgaacgcttttcggcggagcagaaactgcccaatcccgtcggcctcgatgccagtgcgctggcgctgctgacggcctatgactggcccggcaatatccgccagttggaaaacgccgttttccgtgccgtggttctgtcgcagggttcggaactgtcggattccgattttccgcagatcgcgctgcagctgccggaattttcgaacggtgatgatggggacgatattatccgctcaccatccggatcgtcgttgaagcttgcggcctattcaccgccgccggctgccgaaagccatgctgttatcgaggagccgtcggatatctccaccacgatctatcgtggcggaaacctgatctccagcacggacgattcgggcaatatccggaaactggcagagatcgaggaggagctcatccgtttcgccctgcgtttttatcgcggccagatgagccaggtcgcgagaaagctcggcatcggccgctctacgctttatcgcaagctgaaagattatggcatcgatccggatgatccgcttcgagacgtcgcatga

SEQ ID NO: 43834 - protein, 513 aa, Agrobacterium tumefaciens str. C58
MTAHVLVIDDDPVQRRLLKNAVERYGHLALLAENGRAGLELLKQYSGEINVIVLDLMMPEMDGLAFLKAVGELGTDVPVIVQTGQGGIDTVVQAMRAGAFDFVVKPVSPERIGAAISNALKLDRKEAKARTGRRGRSNAVNFTDIVSASPAMLRVIELAQRAAQSSIPVVLEGESGVGKEMVARAIQSGGDRANKPFITVNCGAIPHNLVESILFGHEKGAFTGATEKHVGKFMEADGGTLFLDEIGDLPLDVQVKLLRAVQQGEIETVGSARVQKVNVRLISATNKNLIEEVKEGRFREDLYYRLNVFPITIPALRRRKEDIPHLARVFAERFSAEQKLPNPVGLDASALALLTAYDWPGNIRQLENAVFRAVVLSQGSELSDSDFPQIALQLPEFSNGDDGDDIIRSPSGSSLKLAAYSPPPAAESHAVIEEPSDISTTIYRGGNLISSTDDSGNIRKLAEIEEELIRFALRFYRGQMSQVARKLGIGRSTLYRKLKDYGIDPDDPLRDVA

SEQ ID NO: 43835 - DNA, 1431 bp, Xanthomonas campestris pv. campestris str. ATCC 33913
  CDS (1)..(1431)
atggctgaggccgccgccgtatcccaccgcatctgggtggtcgacgacgaccgttcggtccgcttcgtgttgtccaccgccttgcgcgatgccggctacgcggtggacggtttcgacagcgccgccgccgcgctgcaggccctggcaatgcggcccacaccggacctgctgttcaccgacgtgcgcatgcccggcgaagacggcctgaccctgctcgacaagctcaagtccaagcacccgcagctgccggtcatcgtgatgtcggcctacaccgacgtcgccagcaccgccggtgccttccgtggcggcgcgcacgaattcctgtccaagccgttcgacctggacgatgcggtagcgctggccgcgcgtgcactgcccgacgccgatgcggcggttgaagacacgctcggcacgcccgtggccgaaggctcggccgcactgatcggcgacaccccggcgatgcaggccttgttccgtgcaatcggccggctggcgcaggcgccgttgtcggtgctgatcaatggcgagaccggcaccggcaaggagctggtggcgcgcgcgctgcacaacgaatcgccgcgttcacgcaaaccgttcgttgcgctcaacaccgccgccattccggccgagctgctggaaagcgagttgttcggccacgaaaccggcgccttcaccggcgccaccaagcggcacataggccgcttcgaacaggccgacggcggcacgctgtttctggatgaaatcggcgatatgccgctgccgctgcagacccgattgctgcgcgtgctggccgagaacgaattcttccgtgtcggcgggcgcgagctgatccgcgtggatgtgcgcgtgatcgccgccacccaccaggacttggaagccctggtcgaacagggccgcttccgcgccgacctgctgcaccgcctggacgtggtgcggctgcagctgccaccgctgcgcgaacgccgcggcgacatcgcgcagctggcggaaaacttcctggccatggccgggcgcaagctcgacatgctacccaagcgcttgtcgtctgccgcgttggaggcgctacgtcagtacgactggcccggcaacgtgcgcgaactggaaaacgtgtgctggcgcttggccgcgctggccaccgcagacaccatcgatgtggtggatgtcgatgccgcactcgcgcgcggtgggcgccgcgtgcgcgccggacgcagcgatgggcagtgggacgagatgctttccagctgggcggcgcagcgcctgagcgaaggtgcgcagggcctgcacgccgaagcccgcgaacgcctggacaaaaccctgctcgaagccgcactgcaactcacccagggccgccgcgccgaagccgccgctcgcctgggcctgggccgcaacaccgtgacccgcaagctggggccggggcgcaagcggcgctga

SEQ ID NO: 43836 - protein, 476 aa, Xanthomonas campestris pv. campestris str. ATCC 33913
MAEAAAVSHRIWVVDDDRSVRFVLSTALRDAGYAVDGFDSAAAALQALAMRPTPDLLFTDVRMPGEDGLTLLDKLKSKHPQLPVIVMSAYTDVASTAGAFRGGAHEFLSKPFDLDDAVALAARALPDADAAVEDTLGTPVAEGSAALIGDTPAMQALFRAIGRLAQAPLSVLINGETGTGKELVARALHNESPRSRKPFVALNTAAIPAELLESELFGHETGAFTGATKRHIGRFEQADGGTLFLDEIGDMPLPLQTRLLRVLAENEFFRVGGRELIRVDVRVIAATHQDLEALVEQGRFRADLLHRLDVVRLQLPPLRERRGDIAQLAENFLAMAGRKLDMLPKRLSSAALEALRQYDWPGNVRELENVCWRLAALATADTIDVVDVDAALARGGRRVRAGRSDGQWDEMLSSWAAQRLSEGAQGLHAEARERLDKTLLEAALQLTQGRRAEAAARLGLGRNTVTRKLGPGRKRR

SEQ ID NO: 43837 - DNA, 1428 bp, Xanthomonas axonopodis pv. citri str. 306
  CDS (1)..(1428)
atggctgagaccgccgccgtatcccacatctgggtggtcgacgacgaccggtcggtccgtttcgtgctgtccaccgccttgcgcgatgccggctacgccgtggacggcttcgacagcgccgctgccgcgctgcaggcgctcggcatgcggcccacgccggatttgctgttcaccgacgtgcgcatgcccggcgaagacggcctgaccctgctcgacaaactcaaatccaaacacccgcacttgccggtgatcgtgatgtcggcctataccgacgttgccagcaccgccggtgccttccgcggcggcgcgcacgagttcctgtccaagccgttcgacctggacgacgcggtggcactggctgcgcgcgcgctgccggacgccgatgccggcgtcgaagaaatcgtcgccacgcggctggccgagggctcggcctcgttgatcggcgacacgcccgcgatgcaggccttgttccgcgcgatcggacgcctggcgcaggcgccgctgtcggtgctgatcaatggcgaaaccggtaccggcaaggagttggtcgcgcgcgcgttgcacaacgaatccccgcgcgcgcgcaaacccttcgtcgcgctcaacaccgccgccatcccggccgaattgctggaaagcgagttgttcggccacgaaaccggcgcgttcaccggggcgaccaaacggcatatcggccgcttcgaacaggccgatggcggcacgctgtttctggacgaaatcggcgacatgccgttgccgctgcagacccgcctgctgcgcgtgttggcagagaacgaattcttccgcgttggtgggcgcgaattgatccgcgtcgatgtgcgcgtgatcgccgccacccaccaggacctggaggcgctggtcgaacaaggccgcttccgcgccgatctgctgcaccgcctggatgtggtgcgcctgcaattgccgccgctgcgcgaacggcgcggcgacatcgcgcaactggccgaaaatttcctggccatggccgggcgcaaactcgacatgctgcccaagcggctgtcgtcggccgcgctggaagacctgcgccagtacgactggcccggcaacgtgcgcgaactggaaaacgtgtgctggcgcctggcggcgctggcgacctcggacatcatcgacgtggtcgacgtggacgccgcactggcgcgcggcggccgtcgtcaccgcagcggtcgcagcgatgggcagtgggacgacatgctttccagctgggccgcgcaacgcctgagcgaaggtgcccagggcctgcacgccgaagcgcgcgagcgcctggacaggaccttgctcgaagcggccttgcaactcacccagggccgccgcgccgaagctgccgcccgcctgggcctgggccgcaacacggtcacccgcaaactcggcccggggcgcaaacgtcgctga

SEQ ID NO: 43838 - protein, 475 aa, Xanthomonas axonopodis pv. citri str. 306
MAETAAVSHIWVVDDDRSVRFVLSTALRDAGYAVDGFDSAAAALQALGMRPTPDLLFTDVRMPGEDGLTLLDKLKSKHPHLPVIVMSAYTDVASTAGAFRGGAHEFLSKPFDLDDAVALAARALPDADAGVEEIVATRLAEGSASLIGDTPAMQALFRAIGRLAQAPLSVLINGETGTGKELVARALHNESPRARKPFVALNTAAIPAELLESELFGHETGAFTGATKRHIGRFEQADGGTLFLDEIGDMPLPLQTRLLRVLAENEFFRVGGRELIRVDVRVIAATHQDLEALVEQGRFRADLLHRLDVVRLQLPPLRERRGDIAQLAENFLAMAGRKLDMLPKRLSSAALEDLRQYDWPGNVRELENVCWRLAALATSDIIDVVDVDAALARGGRRHRSGRSDGQWDDMLSSWAAQRLSEGAQGLHAEARERLDRTLLEAALQLTQGRRAEAAARLGLGRNTVTRKLGPGRKRR

SEQ ID NO: 43839 - DNA, 1347 bp, Xanthomonas axonopodis pv. citri str. 306
  CDS (1)..(1347)
atggcgcgcatcctgatcatcgatgacgatgccgcgtttcgcaccaccttgcaggccaccttgcgctcgctcgggcatacggcggtcgccgccgagaatgggccggacgggctggcccggttgagcgaaggcggcatcgacatggcgtttgtggatttccgcatgccgggcatggatggcatcgcggtgctgcgcgcgcgcctggacgatgcgcaggcgcgtcaggtgccgctggtgatgctgaccgcccatgtgtccagcggcaacacgatcgaggcgatgacgctgggcgccttcgatcatctggtcaagccggttggtcgtgccgacatcgtggaggtggtggagcgcgcactgctcagtcgcgccgaggcgcaggctgcagcgacagacgcgttgtctgcgccggtcgaggacgacgatgcactggttggccacagcccggcgatgcgcaccgtgcacaagcgcatcggcttggcggccgcctctgatctgccggtgctgatcaccggggaaaccggcaccggcaaggaattggcggcacgcgcgttgcatcgcgccagcccgcgcgccagtgcgccattcgctgcagtcaactgcgcggccattccgctggaattgatggagagcgagctgttcggccatcgcaagggtgcgttttccggcgccagcagcgaccgacgcgggttgattcgcgaagccgatggcggcacgttgtttctggacgaaatcggcgacatgccattgccgatgcaggccaagctgctgcgtttcctgcaggaaggcgaggtgacgccattgggtggcagcggcccgcagaaggtggatgtgcgggtgctggccgccacccatcgcgacctggcggcctgcgtggccgacgggcgctttcgtagcgatctgcgttaccgcctcaatgtggtgccgatcgaactgccgccattgcgcgagcgtggccaggacatcctgttgctggcgcagcacttcctgagcgccaatgcagcgcgtgcgcagagcctgtcgccggccgcgcaggagcgcctgctcgcgcacctctggcctggcaatgtgcgcgaattgcgcaacgtcatgcagcgcagccaggtgttggtgcgtggcgccagcatcgatgcggcggatctggaggaagcgctgggcgaggctggcgaggcgccgccaaatggtgcatcggcgttgaccggcaccctgcccgaagcggtggcgcagctggaaaaacggatgatccagtcggcgctggaacagagccagggcaatcgggcagaggccgcgcgccggttggggatccaccggcaattgctctatcgcaagctggaggaatacggcttgtga

SEQ ID NO: 43840 - protein, 448 aa, Xanthomonas axonopodis pv. citri str. 306
MARILIIDDDAAFRTTLQATLRSLGHTAVAAENGPDGLARLSEGGIDMAFVDFRMPGMDGIAVLRARLDDAQARQVPLVMLTAHVSSGNTIEAMTLGAFDHLVKPVGRADIVEVVERALLSRAEAQAAATDALSAPVEDDDALVGHSPAMRTVHKRIGLAAASDLPVLITGETGTGKELAARALHRASPRASAPFAAVNCAAIPLELMESELFGHRKGAFSGASSDRRGLIREADGGTLFLDEIGDMPLPMQAKLLRFLQEGEVTPLGGSGPQKVDVRVLAATHRDLAACVADGRFRSDLRYRLNVVPIELPPLRERGQDILLLAQHFLSANAARAQSLSPAAQERLLAHLWPGNVRELRNVMQRSQVLVRGASIDAADLEEALGEAGEAPPNGASALTGTLPEAVAQLEKRMIQSALEQSQGNRAEAARRLGIHRQLLYRKLEEYGL

SEQ ID NO: 43841 - DNA, 1476 bp, Brucella suis 1330
  CDS (1)..(1476)
atgattgcagggcgtccgactggaactgtactggtggcagacgacgatgcagccattcgcacggtgctcaatcaggcattgtcccgtgctggttatgatgtgcgggtgacgtccaatgccgcatcgctctggcgctgggttgcggcgggcgatggcgatctggtgatcagcgatgtcatgatgcccgatgaaaatgcattcgatctcttgccgcgcatcaagaagatacgccccgatctgcccgttgtggtcatgagcgcgcagaacacattcatgaccgcaatccgcgcttccgaggcgggggcttatgagtatctgccaaagccgttcgatctgaccgagcttatcaatatcgtagggcgcgcgctctcggaacccaggcagaagcctgccgtggcgcttcccgacgagcagggtgagaacatgccccttgtgggccgttcgcccgccatgcaggaaatctaccgtcttctggcgcgcatgatgcagacagacctcaccgtcatggtgacgggtgaatccggcaccggcaaggaactcgtcgcgcgtgccctgcatgaatatggccgccgccgcaagggaccgttcgtggcgatcaatatggctgcaatcccgcgtgaccttatcgaatcggaactgttcgggcacgaaaagggagcattcaccggcgcacagaaccggtcgagcgggcgctttgagcaggccaatggcggtacgctgtttctggacgaaattggcgatatgccgatggaggcgcaaacgcgccttctgcgcgtgctgcaacagggcgaatatatgaccgttggcgggcgcacgccgatcaagaccgatgtgcgcatcgttgccgccaccaacagggatttacgacagatcatcgcgcaggggcttttccgcgaagacctctactaccgcttgaatgtagtgccgctgcgcctgccgccgcttcgcgaacgaagcgaggatgtccccgatctcgtgcgccatttcttcaaacgcgctgcggaagaggggttgcccgaaaagcgcattaccaatgcgggtctggagatgatgcggcgctatccgtggccgggcaatgtgcgcgagcttgaaaatctcgtgcgcaggcttgccgcgctctatccgcaggaagaaatcgcgccggaaatcatcgaaaccgagctcaaggccgaattggccaagccggacgttgttgccgctgctggcggcgagatggaaaatatctccatttcacaagccgtggagcagaacatgcagcgctatttcgcttcgttcggttcggatctgccgccgccggggctttatcagcgtgttctggctgaagtggaatatccgctgatccttgcctgcctgacggccacccgcggcaaccagatcaaggccgccgatcttttaggacttaaccggaatacgttgcgcaagaaaatccgcgaactcggcgtcaatatctatcgtggcgcaaagaccggcggttag

SEQ ID NO: 43842 - protein, 491 aa, Brucella suis 1330
MIAGRPTGTVLVADDDAAIRTVLNQALSRAGYDVRVTSNAASLWRWVAAGDGDLVISDVMMPDENAFDLLPRIKKIRPDLPVVVMSAQNTFMTAIRASEAGAYEYLPKPFDLTELINIVGRALSEPRQKPAVALPDEQGENMPLVGRSPAMQEIYRLLARMMQTDLTVMVTGESGTGKELVARALHEYGRRRKGPFVAINMAAIPRDLIESELFGHEKGAFTGAQNRSSGRFEQANGGTLFLDEIGDMPMEAQTRLLRVLQQGEYMTVGGRTPIKTDVRIVAATNRDLRQIIAQGLFREDLYYRLNVVPLRLPPLRERSEDVPDLVRHFFKRAAEEGLPEKRITNAGLEMMRRYPWPGNVRELENLVRRLAALYPQEEIAPEIIETELKAELAKPDVVAAAGGEMENISISQAVEQNMQRYFASFGSDLPPPGLYQRVLAEVEYPLILACLTATRGNQIKAADLLGLNRNTLRKKIRELGVNIYRGAKTGG

SEQ ID NO: 43843 - DNA, 1410 bp, Shigella flexneri 2a str. 301
  CDS (1)..(1410)
atgcaacgagggatagtctgggtagtcgatgacgatagttccatccgttgggtgcttgaacgtgcgctcgctggagcgggtttaacctgtacgacatttgagaacggcgcggaagtactggaggcgctggcgagcaaaacgccggatgtgctgctttcagatatccgtatgccgggaatggacgggctggcgctgctcaagcagattaaacagcgccatccaatgcttccggtcatcattatgaccgcacattccgatctggatgctgccgtcagcgcctatcaacaaggggcgtttgattatctgcccaaaccgtttgatatcgacgaagcagtggcgctggttgagcgcgctatcagtcattaccaggaacagcagcagccgcgtaatattcagcttaacggcccaacgaccgatatcatcggcgaagcgcaagccatgcaggacgtgttccgtattatcggtcggctttcgcgttcttctattagcgtgctgattaacggcgaatccggcaccggtaaagaactggtcgctcatgccctgcatcgccacagtccgcgcaccaaagcgccgtttatcgcgctgaatatggcagctatcccaaaagatttgatcgaatcagaactgtttggccacgagaaaggcgcgtttactggcgcgaataccattcgtcaggggcgttttgaacaggccgatggcggcacgttatttctcgacgaaattggtgatatgccgctggatgtgcagacgcgtttgctgcgcgtgctggcagacggtcagttttatcgcgttggcggctatgcgccggtgaaagtggatgtgcggattatcgctgccactcaccagaatcttgaacagcgggtgcaggaaggtaagttccgtgaggatctgttccaccgcctgaacgttatccgcgttcatctgccgccgctgcgcgaacgtcgggaagatattccccgtctggcgcgccattttttacaggttgccgcgcgcgaactgggcgtagaagcgaagttgctgcatccggaaaccgaagctgctctgacgcgtctggcgtggccaggcaacgtgcgccagctggaaaacacctgccgctggctaacggtgatggccgccgggcaggaagtgttgattcaggatttgcccggcgaactgtttgaatcaacggttgcggagagtacttcgcaaatgcaaccggacagttgggcgacacttttagcgcagtgggcagacagagcgctgcgttccggtcatcaaaatctgctttccgaagcgcagccagagctggagcggacgttactgacgaccgcgttgcgacatacgcaggggcataaacaggaagcggcgcggctactcggctggggccgcaacactctgacgcgtaagttaaaagagctggggatggagtga

SEQ ID NO: 43844 - protein, 469 aa, Shigella flexneri 2a str. 301
MQRGIVWVVDDDSSIRWVLERALAGAGLTCTTFENGAEVLEALASKTPDVLLSDIRMPGMDGLALLKQIKQRHPMLPVIIMTAHSDLDAAVSAYQQGAFDYLPKPFDIDEAVALVERAISHYQEQQQPRNIQLNGPTTDIIGEAQAMQDVFRIIGRLSRSSISVLINGESGTGKELVAHALHRHSPRTKAPFIALNMAAIPKDLIESELFGHEKGAFTGANTIRQGRFEQADGGTLFLDEIGDMPLDVQTRLLRVLADGQFYRVGGYAPVKVDVRIIAATHQNLEQRVQEGKFREDLFHRLNVIRVHLPPLRERREDIPRLARHFLQVAARELGVEAKLLHPETEAALTRLAWPGNVRQLENTCRWLTVMAAGQEVLIQDLPGELFESTVAESTSQMQPDSWATLLAQWADRALRSGHQNLLSEAQPELERTLLTTALRHTQGHKQEAARLLGWGRNTLTRKLKELGME

SEQ ID NO: 43845 - DNA, 1347 bp, Leptospira interrogans serovar Lai str. 56601
  CDS (1)..(1347)
atgaaaatttttatcgcagacgatgaaccagaaatcagaaaatctcttaaagaaattttagaggacgaaaatttcgaagtagaaactttcgctactggtaaaaccttactcaaacaactcaaaaatgatagaccttctctaattcttttggacgtatggttaggcaaagaagatgggattaccattttagaagagtgcaaaaaaatctatccaactcttcctatacttatgatttcgggtcacggaacgatagaaattgctgtggctgctacaaaaaaaggagctgtggattttttagaaaaacctctttcgatcgaaaaagttttacaagcgatagatgatctagtcaagtctgatcaaaaaaattcggcttccgatattaaattagaatatgatgaaattcttggaaactcccccgccattcaaaaagtaaagttcgcaatcgctcaagctgcgtctactaacgctcgagtttttatctacggagaaaacggaaccggaaaagaactcgttgcaaaaactatattcaaaaattctaaacgaaaagattctccttttgtagagatgaactgtgctgcaattccggaagaacttatagagtctgagttatttggatttacaaaaggagcttttacgggcgcgaccgattctagaatcggaaaattcgaagccgccaacggaggcactttgtttctggacgaaatttgtgacatgtcactttctactcaggcgaaagtattacgaattcttcaagagcaaagatttgaaaaattgggaagtacagagacgatcacagtagacgttagaattattgccgctacaaatattccagtagaagaggcgattcgagacggaaagtttagagaagacttatattatagattgaatgtgattccaataacaattccacctcttagagaaagaacttccgatattccattgcttgtggattattatatttccaaaaccttagaagaaaataatttactttctaaaaaaatagaatctgaagcggtttctatcttacaaaatcatttttggccaggtaacattcgggaactaaaaaatgtaatggaaaggctttgtattatgaccgtaggttccgtgattactgcaaacgacgcaagagacgcactcaaaggttttaaaactgcaaacgaaatggtggagttaggagattttagaaaagctaaagaagaatttgaaagacagtatattataaaaacattacaaacaaatgagggaaacgtgaccagaacttcccgagttttaggaattgaacgttctcacttatacagaaaaatgaagtcgcttaatatttcttcggatcagtatacagatggataa

SEQ ID NO: 43846 - protein, 448 aa, Leptospira interrogans serovar Lai str. 56601
MKIFIADDEPEIRKSLKEILEDENFEVETFATGKTLLKQLKNDRPSLILLDVWLGKEDGITILEECKKIYPTLPILMISGHGTIEIAVAATKKGAVDFLEKPLSIEKVLQAIDDLVKSDQKNSASDIKLEYDEILGNSPAIQKVKFAIAQAASTNARVFIYGENGTGKELVAKTIFKNSKRKDSPFVEMNCAAIPEELIESELFGFTKGAFTGATDSRIGKFEAANGGTLFLDEICDMSLSTQAKVLRILQEQRFEKLGSTETITVDVRIIAATNIPVEEAIRDGKFREDLYYRLNVIPITIPPLRERTSDIPLLVDYYISKTLEENNLLSKKIESEAVSILQNHFWPGNIRELKNVMERLCIMTVGSVITANDARDALKGFKTANEMVELGDFRKAKEEFERQYIIKTLQTNEGNVTRTSRVLGIERSHLYRKMKSLNISSDQYTDG

SEQ ID NO: 43847 - DNA, 1416 bp, Shewanella oneidensis MR-1
  CDS (1)..(1416)
atgcgaatcagtgaacaagtgtggatcctcgacgatgacagctcaatacgttgggtgctcgaaaaagcgctccaaggcgctaaacttagcaccgccagctttgccgcagcagaatcactctggcaagcattagagatttcccagccacgggtcatcgtctcggatattcgtatgccgggaaccgatggcttaactctgcttgaaagactacaaatccactatccgcatattcccgttatcatcatgacggcgcattcggacttagacagtgccgtgagtgcctatcaagctggggcgtttgagtatttgccaaaaccctttgatattgatgaggcaatttccctcgttgagcgcgctctgacccatgcaacagagcaaagtccaacgccagttgcgcaggaaactcaagtcaaaacccctgaaatcatcggtgaagcgcccgccatgcaggaagtgtttcgcgccatcggcaggctgtcgcgctcttcaatcagcgtactgatcaatggccaatcaggcacaggtaaagagctggttgcaggcgcactgcataagcacagtccgcgcaaggataaaccttttatcgccttgaatatggcggcgattcctaaggatttaatcgaatccgaactattcggccatgaaaaaggcgcctttactggtgcggccaatgtgcgccaaggacgcttcgagcaagccaatggtggcaccctgtttttagatgaaatcggcgatatgccactggacgtgcaaacccgtttactgcgcgtacttgccgatgggcagttttatcgcgtcggcggccatagtgctgttcaagtggatgtacggattattgctgccacccaccaagacctagagcaattagtgttgaaaggcggatttagggaagacttattccatcgcctcaatgtgattcgtatccacttgccaccgctgtcacaacgccgtgaggacataccacagcttgcaagccactttttagcctctgccgccaaggagattggtgtcgaagccaaaatcctcaccaaagagaccgcagctaaactgtcacaactgccatggccgggtaacgtcaggcagctcgagaacacttgtcgctggcttaccgtcatggcctcaggacaagaaattctcccccaagacttgccgccagaattacttaaggaacctaccagtatcaatccaatggcgaaaggcagccaagattggcaatcggcactcaccgagtggatcgaccaaaaactgtccgaaggaaatagtgatttattaaccgaagtgcagcccgcttttgagcgtattttgcttgaaactgcattgcgccatacgcaagggcataaacaagaagcggcaaaacgtttgggctggggacgaaatacactgacacgaaaattgaaagaattatcgatggattaa

SEQ ID NO: 43848 - protein, 471 aa, Shewanella oneidensis MR-1
MRISEQVWILDDDSSIRWVLEKALQGAKLSTASFAAAESLWQALEISQPRVIVSDIRMPGTDGLTLLERLQIHYPHIPVIIMTAHSDLDSAVSAYQAGAFEYLPKPFDIDEAISLVERALTHATEQSPTPVAQETQVKTPEIIGEAPAMQEVFRAIGRLSRSSISVLINGQSGTGKELVAGALHKHSPRKDKPFIALNMAAIPKDLIESELFGHEKGAFTGAANVRQGRFEQANGGTLFLDEIGDMPLDVQTRLLRVLADGQFYRVGGHSAVQVDVRIIAATHQDLEQLVLKGGFREDLFHRLNVIRIHLPPLSQRREDIPQLASHFLASAAKEIGVEAKILTKETAAKLSQLPWPGNVRQLENTCRWLTVMASGQEILPQDLPPELLKEPTSINPMAKGSQDWQSALTEWIDQKLSEGNSDLLTEVQPAFERILLETALRHTQGHKQEAAKRLGWGRNTLTRKLKELSMD

SEQ ID NO: 43849 - DNA, 1407 bp, Pseudomonas putida KT2440
  CDS (1)..(1407)
atgaccaccgagacactgatcgacagccgagcccaggtcatcctggtggacgatgacccccacctgcgccaagccttgagccagaccctggacctggccgggctcaaggtagtcgcgctggccgaagcccaaggcctggccgagcgtatcgaggccgactggcccggcgtggtggtcagcgacattcgcatgccgggcatcgatggcctgcagttgctggaacaactgcacggccgcgacagcgaactgccggtgctgctgattaccggccatggcgatgtgccgctggcggtgcaggcgatgcgcgccggggcttatgacttcctggaaaaaccctttgccacagacgccctgctcgacagcgtgcgccgcgccctggctttgcgccggctggtgctggacaaccgtagcctgcgtctggcactgagcgaccgccagcaactggcaacccgcctggtcggccattcaccggccatgctgcgcctgcgcgagcagatcggcgctttggccggcacccgcgccgacgtgttgattctgggcgaaaccggcgccggcaaagaggtggtggcccgcgcgctgcacgacctgtccagccgcagcgaagggccgttcgtggcgatcaacgccggcgcgctggccgaatcggtggtcgaaagcgaactgttcggccacgagcccggtgcgttcaccggcgcgcagaaacgccgtatcggcaagttcgaatttgccaacggcggcacgctgttcctcgacgaaatcgagagcatgagcctggatgtacaggtgaagttgctgcgcatgctgcaggagcgagtggtcgaacgcctgggcggcaaccagttgatcccgctggacatccgcatcatagccgcgaccaaggaagacctgcgtcagtctgccgaccaagggcgtttccgcgcagacctgtattaccgcctgaacgtggcgccgctgcgtattccgccactgcgtgaacgcggcgacgacatattggtgttgttccagcatttcgccgatgctgccagccaacgtcatggcctgtcgccgcatgcgctgcaacccgcgcaacgcgccctgctgctgcgtcatgactggccaggcaacgtccgcgagctacagaacgccgccgagcgtttcgcccttggcctggagctggcactggatggccaggcaccctcggcagcagccccggcagcgcccatgctcagcggcaacctcagcgaacaggtcgagcaattcgaacgttcgctgatcgccgccgaactggcccagccacacggctccatgcggagcctggccgaagcactgggtatcccccgcaaaaccttgcacgacaagctgcgcaagcatggcttgaacttcgacggcggcagcggcgggcatgacgatcaagaggacaaccgttaa

SEQ ID NO: 43850 - protein, 468 aa, Pseudomonas putida KT2440
MTTETLIDSRAQVILVDDDPHLRQALSQTLDLAGLKVVALAEAQGLAERIEADWPGVVVSDIRMPGIDGLQLLEQLHGRDSELPVLLITGHGDVPLAVQAMRAGAYDFLEKPFATDALLDSVRRALALRRLVLDNRSLRLALSDRQQLATRLVGHSPAMLRLREQIGALAGTRADVLILGETGAGKEVVARALHDLSSRSEGPFVAINAGALAESVVESELFGHEPGAFTGAQKRRIGKFEFANGGTLFLDEIESMSLDVQVKLLRMLQERVVERLGGNQLIPLDIRIIAATKEDLRQSADQGRFRADLYYRLNVAPLRIPPLRERGDDILVLFQHFADAASQRHGLSPHALQPAQRALLLRHDWPGNVRELQNAAERFALGLELALDGQAPSAAAPAAPMLSGNLSEQVEQFERSLIAAELAQPHGSMRSLAEALGIPRKTLHDKLRKHGLNFDGGSGGHDDQEDNR

SEQ ID NO: 43851 - DNA, 1428 bp, Pseudomonas putida KT2440
  CDS (1)..(1428)
atggagcacagcatcctggtcgtcgaggatgatgaaatccttgccgacaacattcgcacttacctcagcctcaagggctacgaagtcatcgtgtgccacagcgcggagctggcgttggagcagatcaagcgggcgcaacctgacgcggtgctgaccgacaactcgttgccaggcatgagcgggcacgacctgctgcgcacgctggtggcccaggcgccggacctgaaagtgatcatgatgaccggctacggcaatgtcgaagatgccgtgcaggcgatgaaggagggcgcctttcattacctgaccaagccggtggtactggccgagctcaaactgaccctggacaaggccctggctaccgagcgcatggagcgcacgctgtcgttctaccaggagcgcgaggcgcagaagtccgggttgcaggctttgatcggcgagtcgccggtgatgctcaccctcaagcacaccctgcgccaggtgctcgatgccgagcggcgcatggccagtgacgacctgccaccggtgctgatcgaaggcgagaccggtactggcaaggaactggtggcccgtgccctgcatttcgatggttcgcgcagtaaagggcctttcatcgagttcaattgcgcttcgatccctgccaacctgcttgaggccgaactgtttggccacgagaagggcgcgttcaccgatgccaaggaacgccgggtaggcctggtggaggctgccgatggcggtaccttgttccttgacgagatcggcgaaatggacctggtgctgcaggccaagctgctcaagttgctggaagaccgcagcatccgccggattggtgccgtgaaggaacgcaaggtcgatctgcgggtgatcagcgccaccaactgtaacctggagcaaatggtgcagcagggcaaattcaggcgtgacctgttcttccgccttcgcattatcgccctgaaggtgccgcgcctgtattcgcgtgggcaggacatcctgctactggcgcggcatttccttgcccaccatagccggcgctatggcaagccgaacctgcgcttttcggccgaggccgaaagcctgctgctcggttatagctggcctggcaatgtgcgtgaattgcgcaacatgctggagcagacggtgttgctggcgccgaacgaggtggtgcaagcgcatcagttgaacctgtgcatgaccttggttgacgagccgttggcgcaacagccgatggcggccatgttcgaaatgccgcggcacgagccagaaccggggacaagcctgcctgacatggagcgtgaccttgtctgcaagaccctggaccgcaccgactggaacgtgaccaagtcggcgcggatgcttgggttgtcgcgggatatgctgcgttaccggatcgaaaagctggggctgacccggcctgacaagcgtcagtggtag

SEQ ID NO: 43852 - protein, 475 aa, Pseudomonas putida KT2440
MEHSILVVEDDEILADNIRTYLSLKGYEVIVCHSAELALEQIKRAQPDAVLTDNSLPGMSGHDLLRTLVAQAPDLKVIMMTGYGNVEDAVQAMKEGAFHYLTKPVVLAELKLTLDKALATERMERTLSFYQEREAQKSGLQALIGESPVMLTLKHTLRQVLDAERRMASDDLPPVLIEGETGTGKELVARALHFDGSRSKGPFIEFNCASIPANLLEAELFGHEKGAFTDAKERRVGLVEAADGGTLFLDEIGEMDLVLQAKLLKLLEDRSIRRIGAVKERKVDLRVISATNCNLEQMVQQGKFRRDLFFRLRIIALKVPRLYSRGQDILLLARHFLAHHSRRYGKPNLRFSAEAESLLLGYSWPGNVRELRNMLEQTVLLAPNEVVQAHQLNLCMTLVDEPLAQQPMAAMFEMPRHEPEPGTSLPDMERDLVCKTLDRTDWNVTKSARMLGLSRDMLRYRIEKLGLTRPDKRQW

SEQ ID NO: 43853 - DNA, 1356 bp, Pseudomonas putida KT2440
  CDS (1)..(1356)
atggcaatcaaggtgctgctggtcgaggatgaccgcgtattgcgccaggcgctgggcgataccctggaaatcggcggtttcgcctaccaggcagtgggcagtgccgaagaagcgctggaggccgtactcgaagacgcgttcagcctggtggtcagtgacgtcaacatgcccggtatggatgggcaccagttgctgagccagttgcgccgccagcagccacagttgccggtgctgttgatgacggcgcatgccgccgtcgagcgtgcggtcgaggccatgcgccaaggcgccgccgactacctggtcaaaccgttcgagcccaaggcgctgctcaacctcgtggagcggcatgccgccgggcgtgtgaccggcgaagaagggccggtggcctgcgagccggccagtcgccagttgctggagctggcggcccgtgtggcgcgcagtgactcgaccgtactgatttccggcgagtccggtactggcaaggaagtgctggcgcgctacattcaccagcagtcgccgcgtgcggcgcagcccttcgtggcgatcaactgcgcggcgatccccgacaacatgctcgaggccaccctgttcggccacgagaagggcgccttcaccggcgctatcgcggctcaggctggcaagttcgagcaggccgaaggcggcaccttgctgctcgacgaaatctcggaaatgcccatggccttgcaggccaagctgctgcgtgtgctgcaggaacgcgaggtggagcgggtaggcgggcgcaagccgatcagcctggacattagggtgctggccaccaccaaccgcgacctggccggcgaagtggcggctgggcgcttccgcgaagacctgtactaccgcctgtcggtgttcccgctggcctggcgcccgctgcgtgagcggccgggcgatatcctgcagttggccgagcgcctgctggcgcgccatgtggccaagatgaagcatgcctcggtgcgcctctcgccagcggctcgggcctgcctgcaggcatatgcctggccgggcaacgtgcgcgaactggacaacgccctgcagcgggcgttgattctgcagcagggtggcgtgatcgaggcggcggatttttgtctggcaggcgccattccattgtcggctggcaccgagccatctctcgaggtggttgctgatgccggcggcctgggggatgacatgcgtcgtcacgagtaccagatgatcatcgacaccctgcgcgccgagcgcggccgccgcaaagaggcggccgaacgcctggggatcagtccgcggacgttgcgctacaagctggcgcagatgcgcgatgccgggtttgacgtcgaggccagcctgttcggctga

SEQ ID NO: 43854 - protein, 451 aa, Pseudomonas putida KT2440
MAIKVLLVEDDRVLRQALGDTLEIGGFAYQAVGSAEEALEAVLEDAFSLVVSDVNMPGMDGHQLLSQLRRQQPQLPVLLMTAHAAVERAVEAMRQGAADYLVKPFEPKALLNLVERHAAGRVTGEEGPVACEPASRQLLELAARVARSDSTVLISGESGTGKEVLARYIHQQSPRAAQPFVAINCAAIPDNMLEATLFGHEKGAFTGAIAAQAGKFEQAEGGTLLLDEISEMPMALQAKLLRVLQEREVERVGGRKPISLDIRVLATTNRDLAGEVAAGRFREDLYYRLSVFPLAWRPLRERPGDILQLAERLLARHVAKMKHASVRLSPAARACLQAYAWPGNVRELDNALQRALILQQGGVIEAADFCLAGAIPLSAGTEPSLEVVADAGGLGDDMRRHEYQMIIDTLRAERGRRKEAAERLGISPRTLRYKLAQMRDAGFDVEASLFG

SEQ ID NO: 43855 - DNA, 1443 bp, Pseudomonas putida KT2440
  CDS (1)..(1443)
atgccgcacattctgatcgtcgaagacgaaaccatcatccgctcggccctgcgtcgcctgcttgagcggaaccagtaccaggtcagcgaggccggctcggtgcaggaagcccaggaacgcttcagcattgccactttcgacctcatcgtcagcgacctgcgcctgcccggcgcgcccggcaccgagctgatcaagctcggccagggcaccccggtgctgatcatgaccagttacgccagcctgcgctcagcggtggactcgatgaaaatgggcgcggtggactacatcgccaagcccttcgaccacgacgagatgctgcaggcagtagcgcgtattctgcgtgaccggcagaacgcccccgctgctgcaccgccagccgagccacgcgccagcaatggcaaggctacagcgtccgacaaaggcagcgcggcaacggccaatggcgagatcggcatcatcggctcgtgccagcccatgcaggacatgtacagcaagatccgcaaggtcgcgcctaccgactccaatgtgctgatccagggcgagtcgggcaccggtaaagagctggtggcccgcgccctgcacaacctgtctcgccgggccaaggcaccgatgatctcggtgaactgcgcggccatccccgaaacgctgatcgaatccgaactgttcggccacgaaaaaggcgcgttcaccggcgccagcgccgggcgcgccggcttggtggaggccgccgatggcggtacgctgttcctcgatgaaattggcgaactgccgctcgaagcccaggctcgcctgctgcgtgtgctgcaggaaggcgagatacgccgggtaggttcggtgcagtcgcaaaaggtcgatgtgcgcctgatcgccgcgacccaccgcgacctgaaaaacctggccaaggccggccagttccgtgaagacttgtattaccgactgcacgtcatcgccctgaagctgccggccctgcgcgagcgtggcagcgacgtcaacgagatcgccaacgtcttcctcgcccgccagagcgctcgcatcggccgcgacgacctgcacttctcggccgaggccgagcaagccattcgtcactacagctggcccggtaacgtgcgtgaactggaaaacgccgtggagcgcgcggtgatcctcagcgagagcgcagaaatttccgccgagctgctgggcatcgacatcgagctgagcgacctggatgaggatgacatcctcgacaatgccctggtggtggccaacgcgggcaatgccagccacgagccgaccgaagacctgtcgctggaagactacttccagcacttcgtgcttgaacaccaggaccacatgaccgagaccgaactggcacgcaagctcggcgtaagccgcaagtgcctgtgggaacgccgccagcgcctgggcatcccacggcgcaagagcaacgctaccagcgaataa

SEQ ID NO: 43856 - protein, 480 aa, Pseudomonas putida KT2440
MPHILIVEDETIIRSALRRLLERNQYQVSEAGSVQEAQERFSIATFDLIVSDLRLPGAPGTELIKLGQGTPVLIMTSYASLRSAVDSMKMGAVDYIAKPFDHDEMLQAVARILRDRQNAPAAAPPAEPRASNGKATASDKGSAATANGEIGIIGSCQPMQDMYSKIRKVAPTDSNVLIQGESGTGKELVARALHNLSRRAKAPMISVNCAAIPETLIESELFGHEKGAFTGASAGRAGLVEAADGGTLFLDEIGELPLEAQARLLRVLQEGEIRRVGSVQSQKVDVRLIAATHRDLKNLAKAGQFREDLYYRLHVIALKLPALRERGSDVNEIANVFLARQSARIGRDDLHFSAEAEQAIRHYSWPGNVRELENAVERAVILSESAEISAELLGIDIELSDLDEDDILDNALVVANAGNASHEPTEDLSLEDYFQHFVLEHQDHMTETELARKLGVSRKCLWERRQRLGIPRRKSNATSE

SEQ ID NO: 43857 - DNA, 1500 bp, Bradyrhizobium japonicum USDA 110
  CDS (1)..(1500)
atggctgccagtattttgatcgccgacgacgacgctgtagcccgccggctgatcgagaacatggtgcagaaatgcggctatgagacggtcgtcgtggactccggcgatgccgcgatcgccgccctcaccgcccccgatgcacccgctatcgacggcgtcatcctcgatctcgtgatgcccggcctcgacggcatgggcgtactggcgaagatccgcgaagccggcctcagcgtgcccgtcatcgtgcagaccgcccatggcggcatcgacaacgtgatctcggcgatgcgcgccggtgctgctgatttcgtggtcaagccggtcggcatggagcggctccaggtctcgcttcgcaacgcgctcaacgcctccgcgctgaagggcgaactacagcgcatccgtcacagccgcgagggccggctgaccttctccgacatcatcacccgcgccgaggcgatggccggcgtgatgcgcaccgcgcagaaggcggcgaactcctcgatcccggtgctgatcgagggcgagtccggcgtcggcaaggagatgttcgcgcgcgccatccatggcagcggcgagcgcaaggccaagccgttcgtcgcggtcaattgcggcgcgatccccgacaacctcgtcgagtccatcctgttcggccacgagaagggcgccttcaccggcgccaccgaacgccacaccggcaagttcgtcgaggctcatggcggcacgctgtttctggacgaggtcagcgagctgccgctggctgcgcaggtcaagctgctgcgcgcgctccaggaaggcgcggtcgaggccgtcggcggccgcaagccggtgaaggtcgatgtccgcatcatctcggcaaccaatcgcaggctgctggaacgggtgaagcagggacatttccgcgaagacctgttctatcgcctgcacgtgctgccgctgacgatcccctcgctgcggacccggcgcgaggacatcccgcatctgctccggcatttcctggcgcgctttgccgccgaggagaaccgcaccatcaccggcatcagcggcgaggccgtggcgcatctcgcgcaactcgactggcccggcaacatccgccagctcgaaaatgcggtgtaccgcgcggtggtgatgagcgagggcgaccagcttggccttggcgatttcccgctgctcgcctcgcagccgtatcccgcaaccgagattccgaccgcgccgctgatgctcgagccgatcgcggcgccttccgttgtgtcgtcgggtagcgaaataccgattgcgccgctcccctcggtgggaactcttcccatgctgaccgcgaccggcgacgtccgcccgctggaggacatggagaacgagatcatccgcttcgcgatctcgcattaccgcgggcagatgtccgaggtcgcccgccgcctcaaaatcggccggtccacgctctatcgaaaactcgacgaggccggggttcccggacatggcgggaaaagcggcgaggagacgcactga

SEQ ID NO: 43858 - protein, 499 aa, Bradyrhizobium japonicum USDA 110
MAASILIADDDAVARRLIENMVQKCGYETVVVDSGDAAIAALTAPDAPAIDGVILDLVMPGLDGMGVLAKIREAGLSVPVIVQTAHGGIDNVISAMRAGAADFVVKPVGMERLQVSLRNALNASALKGELQRIRHSREGRLTFSDIITRAEAMAGVMRTAQKAANSSIPVLIEGESGVGKEMFARAIHGSGERKAKPFVAVNCGAIPDNLVESILFGHEKGAFTGATERHTGKFVEAHGGTLFLDEVSELPLAAQVKLLRALQEGAVEAVGGRKPVKVDVRIISATNRRLLERVKQGHFREDLFYRLHVLPLTIPSLRTRREDIPHLLRHFLARFAAEENRTITGISGEAVAHLAQLDWPGNIRQLENAVYRAVVMSEGDQLGLGDFPLLASQPYPATEIPTAPLMLEPIAAPSVVSSGSEIPIAPLPSVGTLPMLTATGDVRPLEDMENEIIRFAISHYRGQMSEVARRLKIGRSTLYRKLDEAGVPGHGGKSGEETH

SEQ ID NO: 43859 - DNA, 1428 bp, Xylella fastidiosa Temecula1
  CDS (1)..(1428)
atggttgagattgatgcgacttccccacgcatctgggtggttgacgacgatcgctcggtacgcttcgtgttatctactgcactgcgtgatgcaggctatatcgtggaaggtttcgagagtacttgcgcagcgttgcaagccctagcagcctccccaatcccagacttattgttcaccgacgtacgcatgcctggtgatgatggtttgattttgctggacaagctcaaagcacgccatccgcaccttccagtaattgttatgtctgcctacaccgatgtggctagcactgccggtgcatttcgcagtggtgcacatgaattcttgtccaagccatttgatctagacgatgcggttgcgttggcagctcgtgtgttgccacatacacaaggatctcatgggggatcacccatattgcctgctgccaacagtaatcccgtcttgatcggcagcactccggtgatgcgtgctttgttccgtgcaatcggacggttggcgcaggcaccactctcggtgctgattaacggtgaaacaggtactggcaaagagctcgttgcacgtgcgttacacaacgaatctccgcgtgcgcaggcgccgttcgttgcgctgaatgctgcggcgattccaaccgagcttttggagagcgagttgttcggtcacgaggccggcgcgtttacaggagcgaccaaacgtcatattggccgctttgagcaagccgatggcggcactttatttttggatgaaatcggcgatatgccgttgtctttgcagacgagactgttacgtgtactggctgaaaatgaattcttccgggtcgggggccgcgaactgatccgtgtcaatgtccgtgtgattactgcgacccatcaggatcttgatatgttggtcgagcaggggcgttttcgttccgatctcttgcaccgtttagatgtagtgcgcttgcaactgccatcgttacgtgagcggcgtgatgatgtggcacagttggccgagaattttttggtaatggctgggcacaagctggatatctcagttaaacgtttgtctgccgatgcgctagagatactgcgtcgctacgattggccaggtaatgtccgtgagctcgaaaatatttgctggcgattagctgctttggtgaacactgagacaattgatgccaatgatgttgaagctgtgttaacacatggcaagcgcaagcgttgtaacactgaaagcgattgggatatccatttagccaaatgggcggaagaccgcttagctgcaggcgcaactgctgtgcatgccgaagctcgcaaatgtttggaccgaacgctactggatgtggcattgcgtttgacgcagggccgtcgtgccgaagcagctgcacgtcttggtctgggtcgtaacacgttgacccgcaagcttggctcaagtcaacgtcgtaggaggtaa

SEQ ID NO: 43860 - protein, 475 aa, Xylella fastidiosa Temecula1
MVEIDATSPRIWVVDDDRSVRFVLSTALRDAGYIVEGFESTCAALQALAASPIPDLLFTDVRMPGDDGLILLDKLKARHPHLPVIVMSAYTDVASTAGAFRSGAHEFLSKPFDLDDAVALAARVLPHTQGSHGGSPILPAANSNPVLIGSTPVMRALFRAIGRLAQAPLSVLINGETGTGKELVARALHNESPRAQAPFVALNAAAIPTELLESELFGHEAGAFTGATKRHIGRFEQADGGTLFLDEIGDMPLSLQTRLLRVLAENEFFRVGGRELIRVNVRVITATHQDLDMLVEQGRFRSDLLHRLDVVRLQLPSLRERRDDVAQLAENFLVMAGHKLDISVKRLSADALEILRRYDWPGNVRELENICWRLAALVNTETIDANDVEAVLTHGKRKRCNTESDWDIHLAKWAEDRLAAGATAVHAEARKCLDRTLLDVALRLTQGRRAEAAARLGLGRNTLTRKLGSSQRRRR

SEQ ID NO: 43861 - DNA, 1356 bp, Clostridium tetani E88
  CDS (1)..(1356)
ttgtataaattaatgatagtggacgatgaagctaccataagaagatccttagaatttgctctagaagataactataatatattttcttgtgacaacaaaaatgatgtattacatttattaataaaggaaaatatagatataattttattggatttaagattaggtacagaagatggtttggaaatactaaaggaaataaagaaaataaaaaaagaaactatagtgattattatgacagcttatggaactatagaatcttctgtacaagctatgaaattaggtgctttttattatgtaactaaaccaattaatatagaagaacttagtttatttctaagcaaagtaaatgaatatataaatctaaattctcaaataaaatatttaagcagccaaatagaggtttctaattctagatatgatattataggaaattcaaaggaaatgaacaagatatttgaacttatagatagagtgaaggatatagatgttaatgtacttataactggagaaagtggtacgggaaaggaattagttgctaaggctatacattttaatggaaatagaaaagaaggtccttttaatgctataaattgttcagcaattccaagtaatttgttagaaagtgaattatttggtcataaaaagggagcttttactggagcagtagaagataaaaaaggtataattgaactatctcaaaagggaacattgtttttagatgaaataggggatatggacataaatttacaaactaaacttttaagagttttacaggataaggagataagacctatagggtctagttcatcaataaatgtagactttagatttatagcagctactaataaaaatttaatagaagaaatagaaaaaaataattttagacaagatttgttttatagaataaatgttataaatatagaattgccaccattaaggcagagaaaagacgatattgctaaattaatagaatactttataaaaaagtataaattaaaattagaaaaagatataaaaggaataactggggatgctttagatagccttgagaaatataaatatcatggaaatgttagagaactacaaaatattatagaaagggcaatagtgcttacagaagacaattatataaaaaaagaagatttacctgaggagatatttcaaaacagaaatattgatagagaaaaagatgatttaattcctatatatataggagaagactttaaaaccatagaaaaaaaggttatagaatataatctaaaacatttccatggaaataggagaaaaacagctgaaattctgaagataggtgaaagaactttaaggtataaaataaagggctacaatataaactaa

SEQ ID NO: 43862 - protein, 451 aa, Clostridium tetani E88
MYKLMIVDDEATIRRSLEFALEDNYNIFSCDNKNDVLHLLIKENIDIILLDLRLGTEDGLEILKEIKKIKKETIVIIMTAYGTIESSVQAMKLGAFYYVTKPINIEELSLFLSKVNEYINLNSQIKYLSSQIEVSNSRYDIIGNSKEMNKIFELIDRVKDIDVNVLITGESGTGKELVAKAIHFNGNRKEGPFNAINCSAIPSNLLESELFGHKKGAFTGAVEDKKGIIELSQKGTLFLDEIGDMDINLQTKLLRVLQDKEIRPIGSSSSINVDFRFIAATNKNLIEEIEKNNFRQDLFYRINVINIELPPLRQRKDDIAKLIEYFIKKYKLKLEKDIKGITGDALDSLEKYKYHGNVRELQNIIERAIVLTEDNYIKKEDLPEEIFQNRNIDREKDDLIPIYIGEDFKTIEKKVIEYNLKHFHGNRRKTAEILKIGERTLRYKIKGYNIN

SEQ ID NO: 43863 - DNA, 1341 bp, Pseudomonas syringae pv. tomato str. DC3000
  CDS (1)..(1341)
atgagccaacggcaaaagatcctgatagtcgatgatgagccggatattcgcgaactcctggagatcaccctcgggcgcatgaagctcgacacgcgcagcgcccgcaacgttgccgaggcccatgactggctggcccgcgagccgttcgatatgtgcctgaccgacatgcgcctgcccgatggcaacggcctggaactggtgcagcacatccagcacggctacccccatgtgccagtggcgatgatcaccgcccacggcaacctggacacggcgattcatgcgttaaaagccggggccttcgatttcgtgaccaaaccggtggacctcaaccggctccgcgaactggtcaatagtgctctgagcctgccctccgccactcaaccggtgcacagcatcgacagccgtctgctgggtgattcgccgccgatgcgcaccctgcgcaaccagatcggcaagctggcgcgcagccaggcacccatctacatcagcggcgaatcgggcagtggcaaagagctggtagcccgactgattcacgagcaagggccgcgcatcgacaaaccgttcgtgccggtcaactgcggggctatcccttccgaattgatggagagcgaattcttcggccatcgcaaaggcagcttcagcggtgcccacgaagacaagccagggttgtttcaggcggcgcacaacggcacgctgtttcttgatgaggtcgctgatctgccgctggccatgcaggtaaaactgctgcgcgcgatccaggaaaagtccatccgcagcgtcggcggtcagcaggagcaggtcgttgacgtgcgcattctatgcgccacccacaaggacctgaatatcgaagtcgctgcaggtcgtttccgtcaggacctgtattaccgactgaacgtgatcgaactgcgcgtaccttcactgcgcgagcggcgtgaggatatcgatcagttggcagccagtgttttgcgacgacttgccggcaacggcgctcagcccgtcgcgcgcctgcatgcgcatgcactggaaacgctaaaaagttatcgattccccgggaacgtgcgcgaactggaaaacatgctggaacgcgcttacaccctctgtgaaaactatgagatccacgccagcgacctgcgtctggcagagtccgccagcccccaggcacaacagggtgcgaacctggctgatatcgataacctggaagactacctggaaagcatcgaacgcacactcatcctccaggcgctggaagaaacccgctggaaccgcaccgcagcggccgagcggctcagtttgtcattcagatcgttgcgttaccggttgaagaagctggggctggattga

SEQ ID NO: 43864 - protein, 446 aa, Pseudomonas syringae pv. tomato str. DC3000
MSQRQKILIVDDEPDIRELLEITLGRMKLDTRSARNVAEAHDWLAREPFDMCLTDMRLPDGNGLELVQHIQHGYPHVPVAMITAHGNLDTAIHALKAGAFDFVTKPVDLNRLRELVNSALSLPSATQPVHSIDSRLLGDSPPMRTLRNQIGKLARSQAPIYISGESGSGKELVARLIHEQGPRIDKPFVPVNCGAIPSELMESEFFGHRKGSFSGAHEDKPGLFQAAHNGTLFLDEVADLPLAMQVKLLRAIQEKSIRSVGGQQEQVVDVRILCATHKDLNIEVAAGRFRQDLYYRLNVIELRVPSLRERREDIDQLAASVLRRLAGNGAQPVARLHAHALETLKSYRFPGNVRELENMLERAYTLCENYEIHASDLRLAESASPQAQQGANLADIDNLEDYLESIERTLILQALEETRWNRTAAAERLSLSFRSLRYRLKKLGLD

SEQ ID NO: 43865 - DNA, 1437 bp, Pseudomonas syringae pv. tomato str. DC3000
  CDS (1)..(1437)
atgccgcatattttgatcgtcgaagacgaaacgattatccgctcagccctgcgtcgcctgcttgaacgcaatcaatatgaagtcagtgaagccggttccgttcaggaggctcaggaacgcttcagcattccctcgtttgatctgatcgtcagcgacctgcgcttgccgggcgcaccggggaccgaactgatcaagctgggcgaaggcaaaccggtgctgatcatgaccagctacgccagcctgcgctcggcggtcgattcaatgaagatgggcgcggtggactacatcgccaagcctttcgatcacgtcgaaatgctccaggccgtttcgcgcatcctgcgcgatcgccagactgtcaaaagtctccaggatgagcgcagcgtgctggccgccaaggcgagcagcgccgacactcccgcagtgcagaaccacaatggcgagatcggcatcattggctcctgcccccccatgctcgatctctacagcaagattcgcaaagtcgcaccgaccgactccaacgttctggttcagggcgagtcgggcaccggtaaagaactggttgcccgcgcgctgcacaacctgtcgcgccgcgccaaggcgccgatgatttccgtcaactgcgcggccatcccggaatcgctgatcgaatccgaattgttcggtcacgaaaaaggcgcgttcaccggtgccagcgcaggccgtgcaggcctggttgaagcagccgacggcggcacgctgtttctcgatgaaatcggtgaactgccgctggaagctcaggcccgcctgctgcgcgtgttgcaggaaggtgaaattcgacgcgtcggctcggtgcaatcgcagaaggtcgatgtgcgcctgatcgccgcgacccaccgggacctcaagacgctggccaaaaatggcgagtttcgtgaagacctgttctaccgcctgcacgtcatagccctgaagctgccggccctgcgtgagcgtggcagcgacatactggaaattgcccgtgcgtttctcgtgcgccagagcgccaaggtcggtcgcgacgacctcaagtttgcccccgacgccgaacaggccatccgtcattacagctggccgggcaacgtgcgcgaactggaaaacgccgtggaacgctcagtgatcctttgcgagaacccggaaatcaccgccgacctgctgggtatcgacatcgaactggacggtctggacgacgatgagtacatgggcatggcaccgctgccaggctcttccagctcgacaggcaacgagccggccgaagacctgtcgcttgaagactactttcagcactttgttctggagcatcaggaccacatgaccgaaaccgagctggcgcgcaaactgggcgtcagtcgcaagtgcctgtgggaacgccgtcagcgtctgggcattccgcgtcgcaagggtgtggccaacgaaacgtaa

SEQ ID NO: 43866 - protein, 478 aa, Pseudomonas syringae pv. tomato str. DC3000
MPHILIVEDETIIRSALRRLLERNQYEVSEAGSVQEAQERFSIPSFDLIVSDLRLPGAPGTELIKLGEGKPVLIMTSYASLRSAVDSMKMGAVDYIAKPFDHVEMLQAVSRILRDRQTVKSLQDERSVLAAKASSADTPAVQNHNGEIGIIGSCPPMLDLYSKIRKVAPTDSNVLVQGESGTGKELVARALHNLSRRAKAPMISVNCAAIPESLIESELFGHEKGAFTGASAGRAGLVEAADGGTLFLDEIGELPLEAQARLLRVLQEGEIRRVGSVQSQKVDVRLIAATHRDLKTLAKNGEFREDLFYRLHVIALKLPALRERGSDILEIARAFLVRQSAKVGRDDLKFAPDAEQAIRHYSWPGNVRELENAVERSVILCENPEITADLLGIDIELDGLDDDEYMGMAPLPGSSSSTGNEPAEDLSLEDYFQHFVLEHQDHMTETELARKLGVSRKCLWERRQRLGIPRRKGVANET

SEQ ID NO: 43867 - DNA, 1404 bp, Vibrio parahaemolyticus RIMD 2210633
  CDS (1)..(1404)
atgagtaaaggatatgtttgggtcgtcgatgacgacagttcaattcgctgggtgatggaaaaaaccctctcttcagccaacataaagtgcgaaacctacgctgacggggaaagcgttttgatggcgcttgagcgcgaagtgccagacgtactggtgtctgatattcgcatgcccggcatcgacggattagaactgctcaagcaagtgcaacgtgattaccctgatttgcccgtgatcatcatgaccgcgcattccgacttagatgccgccgttaacgcctatcaaaaaggcgcgttcgagtacctgccaaaaccgtttgatatcgatgaaaccttaacgctggtcgaacgtgcgattgcccacagccatgaaaacaaacgcgagcaattgtcttcagaagatgccccagccgacacgccagagatcatcggtgaagcgccagcaatgcaggaagtgttccgcgctattggccgcctttctcgctcgtcgatttccgttctgatcaacggggagtccggtacgggtaaagagctggttgctcatgcccttcaccgccatagccctcgcgccaacaaaccttttatcgctctcaatatggccgcgattccaaaagacttgattgagtctgagttgttcggtcacgaaaaaggcgcatttacgggcgcgaacagtgttcgtcaaggccgcttcgagcaagccaacggaggcacgctctttttggacgaaatcggggacatgccgctggatatccaaactcgtttgctgcgcgtgttggcggatggccagttctaccgtgttggtggtcactctccgattcgtgtcgatgtacgtattgtcgccgccacgcaccaaaacctcgaaaagctggtacaccaaggcgattttcgtgaagacttgttccaccgcttgaacgtcattcgcgtacaaattcctgcgcttcgtgaacgcaaacaagacattgaaaagctcacacaacactttctggtacgcgccgcagatgagcttggagtggaaaccaaaaccttgcacccgtcgacagtcgaaattctcaatcgactcaattggccgggcaacgtacgtcagctagaaaacatttgtcgctggttaaccgtgatggcgagtggcagtgaagtattaccgaacgatttgccttcagagcttttggaagagaagaagaccgtttcggattcaaccaaaggtagctggcaagaacaattggcggactgggcacgtcaatcgctcgctgcgggggataaagaactactttctttcgcattaccagaatttgagcgcattttattagaagctgcactggagcacactaaaggtcacaagcaagatgccgctaaagtattaggctggggacgcaatacgctaaccagaaagttaaaagagttgtactga

SEQ ID NO: 43868 - protein, 467 aa, Vibrio parahaemolyticus RIMD 2210633
MSKGYVWVVDDDSSIRWVMEKTLSSANIKCETYADGESVLMALEREVPDVLVSDIRMPGIDGLELLKQVQRDYPDLPVIIMTAHSDLDAAVNAYQKGAFEYLPKPFDIDETLTLVERAIAHSHENKREQLSSEDAPADTPEIIGEAPAMQEVFRAIGRLSRSSISVLINGESGTGKELVAHALHRHSPRANKPFIALNMAAIPKDLIESELFGHEKGAFTGANSVRQGRFEQANGGTLFLDEIGDMPLDIQTRLLRVLADGQFYRVGGHSPIRVDVRIVAATHQNLEKLVHQGDFREDLFHRLNVIRVQIPALRERKQDIEKLTQHFLVRAADELGVETKTLHPSTVEILNRLNWPGNVRQLENICRWLTVMASGSEVLPNDLPSELLEEKKTVSDSTKGSWQEQLADWARQSLAAGDKELLSFALPEFERILLEAALEHTKGHKQDAAKVLGWGRNTLTRKLKELY

SEQ ID NO: 43869 - DNA, 1338 bp, Salmonella enterica subsp. enterica serovar Typhi Ty2
  CDS (1)..(1338)
atgataagccgtaaaccggcgcacctgctgctggtcgatgacgatcccggattactgaaattgctcggtatgcgcctgaccagtgaaggatacagcgtcgtgaccgcagagagcggccaggaaggactacgggtactgcatcgggaaaaagtggatctggtaataagcgacctgcgcatggacgaaatggatggtatgcaactgttcacagaaattcagaaagtacagccgggaatgccggttattattctgacggcgcatggttctattccggatgcggtggccgctacccagaagggcgtattcagctttttgacgaagccgatcgacagagacgcgttatataaagcgatagatgaagcgctggagcagtccgctcccgcgacggacgatagctggcgcaacgctatcgttacccgtagcccgctgatgctgcgactgcttgaacaggcgcgcatggtcgcgcagtcggatgtcagcgtattgattaacggacaaagcggcaccgggaaagagattttcgcacaggcgattcataatgccagcccgcgcaataacaagccgtttgtcgccatcaactgcggcgcgttaccggaacagttgctggagtccgaattattcggccatgcgcgcggcgcctttaccggcgcagtgagcaatcgtgaagggttgttccaggcggcggaaggcggcacgctgtttctggatgaaattggcgatatgcccgcgccgttacaggtgaagctgctgcgggtgttacaggagcgcaaagtcaggccgctgggcagcaatcgcgatattgatatcgacgtgcgaattatttccgcgacgcaccgcgatctgccgaaggcgatggcgcggggcgaatttcgtgaagatttgtactaccggctgaatgtcgtgagcctgaaaattccggcgctggcggagcgtaccgaggatattccgctgctggctaatcatctgctcagacagtcggcacagcggcataaaccgtttgttcgcgccttttctactgatgcaatgaaacggctgatgacggcaagctggccgggcaacgtgcgccaactggtcaacgtcattgaacaatgtgtggcgttaacctcttcgccggtgatcagcgatgcattggtcgagcaggcgctggaaggcgaaaacaccgcgctgccaacttttgccgaagcgcgaaaccaatttgaactgaactatctgcgcaagttactgcaaattaccaaaggtaacgtgacgcacgcggcaaggatggcggggcgcaaccgcacggaattctataagctactctcccgtcacgaactggatgcgaatgatttcaaagagtag

SEQ ID NO: 43870 - protein, 445 aa, Salmonella enterica subsp. enterica serovar Typhi Ty2
MISRKPAHLLLVDDDPGLLKLLGMRLTSEGYSVVTAESGQEGLRVLHREKVDLVISDLRMDEMDGMQLFTEIQKVQPGMPVIILTAHGSIPDAVAATQKGVFSFLTKPIDRDALYKAIDEALEQSAPATDDSWRNAIVTRSPLMLRLLEQARMVAQSDVSVLINGQSGTGKEIFAQAIHNASPRNNKPFVAINCGALPEQLLESELFGHARGAFTGAVSNREGLFQAAEGGTLFLDEIGDMPAPLQVKLLRVLQERKVRPLGSNRDIDIDVRIISATHRDLPKAMARGEFREDLYYRLNVVSLKIPALAERTEDIPLLANHLLRQSAQRHKPFVRAFSTDAMKRLMTASWPGNVRQLVNVIEQCVALTSSPVISDALVEQALEGENTALPTFAEARNQFELNYLRKLLQITKGNVTHAARMAGRNRTEFYKLLSRHELDANDFKE

SEQ ID NO: 43871 - DNA, 1410 bp, Salmonella enterica subsp. enterica serovar Typhi Ty2
  CDS (1)..(1410)
atgcaacgaggaatagtctgggtcgtcgatgatgatagttccatccgttgggtgcttgaacgtgctctcgccggggcagggttgacctgtatcacctttgagaatggtaatgaagtactggctgcgctggccagtaaaacgccggacgtcttgctgtcggatatccgaatgccaggaatggacgggctggcgctattaaagcagattaaacaacgtcatccgatgcttccggtcatcattatgaccgcgcattccgatttagatgccgccgtgagcgcttatcagcagggggcgtttgattatctgcctaaaccgtttgatattgatgaagccgtcgctctggtcgagcgagcgattagccactatcaggagcagcagcagccgcgtaatatcgaggttaacggcccgacaacagacatgataggcgaagcgcccgccatgcaggatgtgtttcgcattattggtcggctgtcgcgttcttcgattagcgtgctgattaacggcgaatcaggaaccggtaaagaactggtcgcccatgcgctacatcgccatagcccacgcgccaaagcgccgtttatcgcgctcaatatggcggccatcccgaaagatttgattgaatccgaattgtttggccatgagaaaggcgcttttaccggggcgaataccatccggcagggccgtttcgagcaggctgacggcggtacgctgtttctggacgaaattggcgatatgccgctggatgtccagactcgtctgttacgcgtgctggctgacggacagttctaccgtgtgggcgggtacgcgccggtaaaagtggatgtgcgcattattgccgccacccaccagaacctcgaacgacgcgttcaggaagggaaattccgtgaagacctgttccaccgcctgaacgtgattcgtatccatctcccgccgttgcgcgagcgccgtgaggatattccgcgcctggcgcgccattttttgcaggtcgccgcccgtgaattaggcgtggaagccaaattattacatccggaaaccgaaacggcgttaacgcgcctggcatggcctggtaacgtgcgtcagttagaaaatacctgccgctggctcaccgtcatggccgccggacaggaggtattgacccaggatttaccgggcgaactgtttgaagcctcggcgccggatagcccgtcccacctgccgccggatagctgggctacattactggcgcaatgggcggatcgcgccttgcgatccggtcatcaaaacctgctttctgaagcgcagccagaactggaaagaacgctactgaccacggcgttacgccatacgcagggtcataaacaggaagccgccaagctgctcggttggggtcgaaacaccctaacgcggaagttgaaagagctgggaatggagtaa

SEQ ID NO: 43872 - protein, 469 aa, Salmonella enterica subsp. enterica serovar Typhi Ty2
MQRGIVWVVDDDSSIRWVLERALAGAGLTCITFENGNEVLAALASKTPDVLLSDIRMPGMDGLALLKQIKQRHPMLPVIIMTAHSDLDAAVSAYQQGAFDYLPKPFDIDEAVALVERAISHYQEQQQPRNIEVNGPTTDMIGEAPAMQDVFRIIGRLSRSSISVLINGESGTGKELVAHALHRHSPRAKAPFIALNMAAIPKDLIESELFGHEKGAFTGANTIRQGRFEQADGGTLFLDEIGDMPLDVQTRLLRVLADGQFYRVGGYAPVKVDVRIIAATHQNLERRVQEGKFREDLFHRLNVIRIHLPPLRERREDIPRLARHFLQVAARELGVEAKLLHPETETALTRLAWPGNVRQLENTCRWLTVMAAGQEVLTQDLPGELFEASAPDSPSHLPPDSWATLLAQWADRALRSGHQNLLSEAQPELERTLLTTALRHTQGHKQEAAKLLGWGRNTLTRKLKELGME

SEQ ID NO: 43873 - DNA, 1362 bp, Bacteroides thetaiotaomicron VPI-5482
  CDS (1)..(1362)
atggaaaacggaactattttaatagtagatgataataaaagcgtgctagcttcactggagttattgctcgagaatgagttcggtacagttcgcaccgccgccaatcccaatcaaatcaccacgttactgactaccacctctatcgacgtcgttatccttgacatgaatttctctgccggcataaacaatggcaatgaagggctgtactggttaaaacaaatccacgaaatccgcccatctttgccggtggttatgctgactgcttacggagacgttgaattggcggtaaaagcactaaaaaacggggctactgattttttactcaaaccttgggataatcagattctgattcggaagataaaggaggcttataaaagtaacaacagcaaagccaaaagcgcttcaaaggcaaccggcaaacagggggataccgagaaaccgagcaaaccggaaatgttgatcggccactctcccgcaatgctccagttgattaaagtggtcacgaaagtagccaaaaccgacgccaacatcctgatcacaggagagaacggaacaggaaaagagatgttagccaaagagatacatcgtttatctccccgaaattcccgtcaaatgcttggcattgatatgggcgctatcagtgaatcactcttcgaaagtgaactgttcggacacgaacgcggagcgtttaccgacgcatacgaaagtcgcccgggaaaattcgaagcggccaacggcagttccctctttatggacgaaatcggaaacctttccattgcactgcaagccaaactattgactgtactacagaaccggaatgtcacccgaatcggaagtaacaaagtgattcccgttgatatccggctgatctctgctaccaataaagatattccggaaatggtaaagcaaggactgtttcgggaagatttgttctaccgtatcaacaccattcatctggaaatccctcctttaagggaacggggagacgatatcctattattcatagatactttcctccgtcgttttacttccaaatatcaacggccggacatacggatgcacgagcaaacgattgagaaactacgctcctatcactggccgggcaatatccgcgaactgcaacacgccatcgaaaaagcggtgatcttatgcgaaggcaacgtgatacgccccaaagatattctggtaaagcaaagctggaaacctcagacggcaagtgtcgtccccaatctggaggaagtagaacggcaagccatcgaaacagcaatcctccaaaacaatggaaatctgacagccgccgccgaacaattaggcatcagccgacaaactctctataataaactgaaacgattcaaaccctga

SEQ ID NO: 43874 - protein, 453 aa, Bacteroides thetaiotaomicron VPI-5482
MENGTILIVDDNKSVLASLELLLENEFGTVRTAANPNQITTLLTTTSIDVVILDMNFSAGINNGNEGLYWLKQIHEIRPSLPVVMLTAYGDVELAVKALKNGATDFLLKPWDNQILIRKIKEAYKSNNSKAKSASKATGKQGDTEKPSKPEMLIGHSPAMLQLIKVVTKVAKTDANILITGENGTGKEMLAKEIHRLSPRNSRQMLGIDMGAISESLFESELFGHERGAFTDAYESRPGKFEAANGSSLFMDEIGNLSIALQAKLLTVLQNRNVTRIGSNKVIPVDIRLISATNKDIPEMVKQGLFREDLFYRINTIHLEIPPLRERGDDILLFIDTFLRRFTSKYQRPDIRMHEQTIEKLRSYHWPGNIRELQHAIEKAVILCEGNVIRPKDILVKQSWKPQTASVVPNLEEVERQAIETAILQNNGNLTAAAEQLGISRQTLYNKLKRFKP

SEQ ID NO: 43875 - DNA, 1350 bp, Bacteroides thetaiotaomicron VPI-5482
  CDS (1)..(1350)
atgattttaataatagacgacgacagtgcggtacgctcttcactcagttttatgttgaagcgggctggatatgaagcacaaacggtttccggtccccgagaagctatggaggtggtgcgttccgtagcaccggatttaatcttaatggatatgaacttcaccctttctactacaggtgaagaagggctgactttgctcaggcaagtgaaaatattccgtccggaaactccggtgatactgatgaccgcctggggaagcatacagcttgccgtgcaaggtatgcaggcaggagccttcgattttatcaccaaaccttggaataatgcggcattgttgcaacgtatcgagacggctttggaactggcaggctctcccaaagagacaacgcaggaacagaatgacgctttcgaccgtcgtcatatcatcggccgtagtcagggactgacggaagtactgaacaccattgcccgtatagcaaagacgaatgcttccgtactgatcaccggagaaagtgggacgggcaaggaactgatagccgaggcgatacacatcaacagccagcgtgccaaacagccttttgtcaaagtgaacttgggaggaatctcccaaagtctgttcgaaagtgaaatgttcggccataagaaaggagcttttacggatgcttcctccgaccgtatcggacgctttgagatggcgaacaaaggaaccatctttctggacgagatcggtgatctcgacccttcttgtcaagtgaagctcttgcgggtgttacaagatcagacgtttgaagtattgggagacagccgtccccgtaagacggatattcgtgtcgtctccgctaccaatgccgatttacgcaagatggtgggcgaacgtactttccgcgaagatttgttttaccgtattaatctgattaccgtcagactgccggctttgcgtgagcgtcgggaggatattcccttgctggcacgtcactttgccgatcgtcaggcagaggccaacggttttcctcgcaccgaattttcggcggatgccttgcagtttctgagtcgcttaccttatccgggaaatatccgtgaattgaagaatctggtagaacgtacgattctggtcaatggaaagccgacgcttgatgccgccgactttgatgctcagtatatccgtcacgaagatcagaaagtcgccgaaggcgcatcctttgctggtatgactctggatgaaatagaacggcagacgattttgcaggctttggagcgtcataagggaaatttgagtcaggtagctacagcgcttggcatcagtcgtgccgccctttaccgtcgtttggagaagtttggaatcagtgtttag

SEQ ID NO: 43876 - protein, 449 aa, Bacteroides thetaiotaomicron VPI-5482
MILIIDDDSAVRSSLSFMLKRAGYEAQTVSGPREAMEVVRSVAPDLILMDMNFTLSTTGEEGLTLLRQVKIFRPETPVILMTAWGSIQLAVQGMQAGAFDFITKPWNNAALLQRIETALELAGSPKETTQEQNDAFDRRHIIGRSQGLTEVLNTIARIAKTNASVLITGESGTGKELIAEAIHINSQRAKQPFVKVNLGGISQSLFESEMFGHKKGAFTDASSDRIGRFEMANKGTIFLDEIGDLDPSCQVKLLRVLQDQTFEVLGDSRPRKTDIRVVSATNADLRKMVGERTFREDLFYRINLITVRLPALRERREDIPLLARHFADRQAEANGFPRTEFSADALQFLSRLPYPGNIRELKNLVERTILVNGKPTLDAADFDAQYIRHEDQKVAEGASFAGMTLDEIERQTILQALERHKGNLSQVATALGISRAALYRRLEKFGISV

SEQ ID NO: 43877 - DNA, 1374 bp, Bacteroides thetaiotaomicron VPI-5482
  CDS (1)..(1374)
atgatgaaatccatattgataatagaagacgatatcactttcggaatgatgctgaaaacctggctaagtaaaaaagggtttgaggtgtcatcagtcagtaacattgcccgtgcccagaagcacattgaaggacaaggggcagacttaatcctgtccgatttacgcttaccggatcacgacggaatcgatcttctgaaatggatgaacgaaaaaggaatcgatattcctttgatcatcatgaccggttatgccgatatccaatcggcagtacaagcgatgaaactgggagcacgcgattatgttgccaaaccggtgaatccggaggaactactcaaaaagatgtcagaagctttgcaagcgaaagaagcgccgactacgcataccgcagccaaaacttctgcaaagaaaggttcttccatttcgtccggaaacgccaccgaaacccatcatgcttatctggaaggagaaagtgatgccgccaagcaactctataattatgtaggtctggtagctcccaccaatatgtccgtactgatcaacggttccagcggaacggggaaagagtatgtggcgcaccgcatccatcaactgagcaaacggaatgacaagccgtttatcgcggtagactgcggttcgattcccaaagaattagctgcatccgagtttttcggccatgtgaagggctcttttacaggagcactgacggacaagaccggagcgttcgttgccgccaatggaggcactatcttcctggatgaaataggaaatctcagttacgaggtacagatacaacttctccgtgccttgcaagagagaaagattcgtccggtcggttccacgcaagaggtatcggttgatatccgtctggtatccgccaccaacgagaatctggaacaggctatcgagaaaggtactttccgtgaagaccttttccatcgcatcaatgaatttaccctgcggatgcccgacctgaaagaacggaaagaggatatcctgttgtttgccaacttcttcctcgatcaggcaaacaaggaactggacaagcatctgatcggttttgactcgaaagcctcacaagccttactcaattatcactggccgggcaacttacgccaaatgaagaatatcgtaaaaagagcgactttactggcacaaggaagtttcatcactcttcttgaattagggaccgaattactggaaacaagtaccgtttgttccgcaagcatggcgctacgcaacgaagaaacagagaaagaacacattctggaggcattgcgccaaaccggaaataacaagagcaaagcggcacaattactgaatatcgaccggaagacattatataataagctgaaactatataatatcgacttgtag

SEQ ID NO: 43878 - protein, 457 aa, Bacteroides thetaiotaomicron VPI-5482
MMKSILIIEDDITFGMMLKTWLSKKGFEVSSVSNIARAQKHIEGQGADLILSDLRLPDHDGIDLLKWMNEKGIDIPLIIMTGYADIQSAVQAMKLGARDYVAKPVNPEELLKKMSEALQAKEAPTTHTAAKTSAKKGSSISSGNATETHHAYLEGESDAAKQLYNYVGLVAPTNMSVLINGSSGTGKEYVAHRIHQLSKRNDKPFIAVDCGSIPKELAASEFFGHVKGSFTGALTDKTGAFVAANGGTIFLDEIGNLSYEVQIQLLRALQERKIRPVGSTQEVSVDIRLVSATNENLEQAIEKGTFREDLFHRINEFTLRMPDLKERKEDILLFANFFLDQANKELDKHLIGFDSKASQALLNYHWPGNLRQMKNIVKRATLLAQGSFITLLELGTELLETSTVCSASMALRNEETEKEHILEALRQTGNNKSKAAQLLNIDRKTLYNKLKLYNIDL

SEQ ID NO: 43879 - DNA, 1161 bp, Chlamydophila caviae GPIC
  CDS (1)..(1161)
atgaatatagaaagagtgctaataatagacgatgaacccttgctcagagactttctttctgaacttcttttatcgcgaggattctccccatgtactgcggataatgtgaagcagggttgtcaaaagattcggtctgagaaatatgacctgatcatctccgacatgaatatgcccgacggtagtggcttggatattattaaagtagctaaagcatatgctccgcaaacccccgtcttggtgatcacagcttatggcactatagagaatgctgtaaaggctatgcatcaaggcgctttcaactatctcaccaagcctttctcctccgaggcactgtttgcattcatagcaaaagctgaagaactacaaaatcttgtaaacgagcatcttttgctaaagtcgcaaatttcatcggaatcgcaccctctaatcgcagaaagcccttcaatgaaggatttattgtctaaagcaagaaaagccgccgatagctccgcaaacatctttattcatggggaatctggatgtgggaaagaagtcctttcctttttcattcataaaaactctcctagagcttgccaaccctacataaaggtgaattgtgcagctattcccgaaactctgttagagtcagagttttttggtcatgaaaagggtgcgtttacaggagctacggcaaaaaaagccgggcgttttgaacttgcacatacagggactctcttattagatgaaattacagaagtccccattaatcttcaagcaaagctccttagagctattcaagagaaagaattcgaacatctcggcgggaccaaaaccctatcggtagatgtgcgcatcctcgcgacatccaaccgcaaccttaaggaagctgtagatcaaaagatcttcagacaagacctgttttaccgtcttaacgtcattcccctctaccttcctcctttaagggagagaaaagaagatatcctccccctggcgcagtacttcttagaaaaattttgtagattgaacaataagcctataaaaactctctcagaaagcgcacgttctgctcttcttgactactcatggccgggaaatatccgagagctctctaatgtattggaaagggtggttatcctagaaagccccacctacctcaccgatactatgctcgctctctgctaa

SEQ ID NO: 43880 - protein, 386 aa, Chlamydophila caviae GPIC
MNIERVLIIDDEPLLRDFLSELLLSRGFSPCTADNVKQGCQKIRSEKYDLIISDMNMPDGSGLDIIKVAKAYAPQTPVLVITAYGTIENAVKAMHQGAFNYLTKPFSSEALFAFIAKAEELQNLVNEHLLLKSQISSESHPLIAESPSMKDLLSKARKAADSSANIFIHGESGCGKEVLSFFIHKNSPRACQPYIKVNCAAIPETLLESEFFGHEKGAFTGATAKKAGRFELAHTGTLLLDEITEVPINLQAKLLRAIQEKEFEHLGGTKTLSVDVRILATSNRNLKEAVDQKIFRQDLFYRLNVIPLYLPPLRERKEDILPLAQYFLEKFCRLNNKPIKTLSESARSALLDYSWPGNIRELSNVLERVVILESPTYLTDTMLALC

SEQ ID NO: 43881 - DNA, 1368 bp, Nitrosomonas europaea ATCC 19718
  CDS (1)..(1368)
atgatacaagacaagaaaattcttctggtggatgatgacagggatttgcttgaactgctttccatccgtctgacggcagccgggtatgaaaccacgcttgcagacagtactgaggcagcaatcaattatctcgacatttcccgtccccatctcgttatcagtgacatgcaaatgggcggtctcgatggcatggcgctgttcgagtacatccatcgcaacattccgacactgccggtcatcattttgactgcttacggtactatcccggatgccgtggcagcgacgcaacgcgggatttttggctatctcaccaagccttacgatcctaaaattctgctgggtcaggttgaacgcgccctcaatcttgcccctgccgttgaaacgctttccagcacgacacccgtttcctcatggcgcaagaccatcgttacccggagcgcggtcatggaagatctgcttgcaaaagtaggccgagtggcgcaaggggatgccagtgtgctgctgtccggtgaaagcggtgttggcaaggaattgcttgcccgtgccattcatcaggcttcccgacgttgtgatcagccgttcgttaccatcaattgcgcggccattccggaacaactgctggaatccgagctgtttggccatgccaaaggtgcatttaccggtgctgtgcgggatcataagggattattccagctggctgatggtggcagtctgtttctggatgagatcggtgacatgcctctgctgttacaggcaaaactgttgcatgcgctgcaggaaagagtcatccggcctgttggttccacccagagtattccaatcaatgtgcgcatcatctccgctacgcaccgggatctgaaatcggaaatccaggcgggaaattttcgtgaagatctgtattaccggcttttcgtggtggggctgacgattccctcacttgcccagcgcagtgaagatattcccctgctggccaatcattttctgcgtgtatttgccgagaaacatcagaaagatatcaatgtattttccccggaagcgatcagctttctgctggcatcctcctggccgggtaatattcggcagctcatgaatgtcgtcgaacaaagtgtcgtcatgagtgcggtgccgctcatctccggtgagcttgtccgtgatgccatgcacaaggatgaagagcagatgacgtcattcgatgaagcccgcagacagtttgaaagagattatctggtcaagatactgaaaattactgccggaaatgtgactcaggcagccaagctggccaaacgcaatcgcacggagttttataaattgctgcagcggcaccagcttgatttcacactctataaatcgttacaggaaaaggtctga

SEQ ID NO: 43882 - protein, 455 aa, Nitrosomonas europaea ATCC 19718
MIQDKKILLVDDDRDLLELLSIRLTAAGYETTLADSTEAAINYLDISRPHLVISDMQMGGLDGMALFEYIHRNIPTLPVIILTAYGTIPDAVAATQRGIFGYLTKPYDPKILLGQVERALNLAPAVETLSSTTPVSSWRKTIVTRSAVMEDLLAKVGRVAQGDASVLLSGESGVGKELLARAIHQASRRCDQPFVTINCAAIPEQLLESELFGHAKGAFTGAVRDHKGLFQLADGGSLFLDEIGDMPLLLQAKLLHALQERVIRPVGSTQSIPINVRIISATHRDLKSEIQAGNFREDLYYRLFVVGLTIPSLAQRSEDIPLLANHFLRVFAEKHQKDINVFSPEAISFLLASSWPGNIRQLMNVVEQSVVMSAVPLISGELVRDAMHKDEEQMTSFDEARRQFERDYLVKILKITAGNVTQAAKLAKRNRTEFYKLLQRHQLDFTLYKSLQEKV

SEQ ID NO: 43883 - DNA, 1359 bp, Nitrosomonas europaea ATCC 19718
  CDS (1)..(1359)
atgaatgcaaatcagatacaaaaaaaactgctcgtaatagaagatgatccagggctccagaaacagttacgctggagtttcgatgattgcaatgtggctgttgcctcagatcgtgaaagtgcgcttgcacaagtccgccggcatgagcctgctgtcgtgaccatggatttgggattgccacctgatccggatggtgcaacggaaggattggcaactttgcagcagattcttgccgtggcacctgataccaaggtaatcgtgctgacgggcaaccagaatcacgaaaatgcactgaaagcaatcaatatgggtgcatatgattttcaccagaaacctctcgatgccaacgtgctcagcctgatcgtaaaccgggcgttctatttgcaccggttgcagcgcgaaaatcgcgaactgttgaaatcttcttcaagcactgccattcccggactcatcaccaatgatcctggtatggtcaaaatatgccagcaaatcgagcgtatcgcgtcttccgacgttacggtcaccctgctgggtgaaagtggaaccggcaaggaagtattggccaaggcacttcaccagttgagcgaccggaacagtaaacgcatggttgcagtcaattgtgcggccattcctgaatccctgctggaagcagagttgtttggctatgaaaaaggtgccttctcaggagcagtcaaacagacaccaggcaaaatcgaactggcacagggaggtacatttttcctggatgagatcggtgatttgccgctatcgttacaggcaaaactgctgagattcctgcaggagcgcgtcatcgaacgcatcggtggcagggagctgatcccggtagatgtacgaatcgtctgcgcaacccaccagaacctgaaaaaaatgatcgaggccggtaccttccgcgaggatttgtattatcgtctgtgtgaaatcagtatccatattccggcgcttcgcgatcgtatcggcgacgctgtcttacttgcgcatcacttcaaaaaccagttccgggtaaaagaaaaacgccaatccctcaatttcagccaggatgcactggatgcaatcggcagctattcctggccgggaaatatccgcgaaatcgaaaactgcatcaaacgcgcagtcatcatggcagaaggctcacaaatcactgctgccgatctcggattacaaccggcagccgatagttttgcgccagtcaccttgcgtgaagtcagagacaaggctgaacacgagatgctcatcaaagtgctggcacgggtaaatggcaatgttgccagggcagcagagcttctaggggttacccgccccactctttatgacctgatgaatcgtcacgggctcaaatag

SEQ ID NO: 43884 - protein, 452 aa, Nitrosomonas europaea ATCC 19718
MNANQIQKKLLVIEDDPGLQKQLRWSFDDCNVAVASDRESALAQVRRHEPAVVTMDLGLPPDPDGATEGLATLQQILAVAPDTKVIVLTGNQNHENALKAINMGAYDFHQKPLDANVLSLIVNRAFYLHRLQRENRELLKSSSSTAIPGLITNDPGMVKICQQIERIASSDVTVTLLGESGTGKEVLAKALHQLSDRNSKRMVAVNCAAIPESLLEAELFGYEKGAFSGAVKQTPGKIELAQGGTFFLDEIGDLPLSLQAKLLRFLQERVIERIGGRELIPVDVRIVCATHQNLKKMIEAGTFREDLYYRLCEISIHIPALRDRIGDAVLLAHHFKNQFRVKEKRQSLNFSQDALDAIGSYSWPGNIREIENCIKRAVIMAEGSQITAADLGLQPAADSFAPVTLREVRDKAEHEMLIKVLARVNGNVARAAELLGVTRPTLYDLMNRHGLK

SEQ ID NO: 43885 - DNA, 1314 bp, Nitrosomonas europaea ATCC 19718
  CDS (1)..(1314)
atgcggaatttgcctgtattgatagtggaagatgatccggatctgctggaggcattgtgcgcaacgctcaagctggacggatacaccaccctggctgccagtagtggcgagcaggcgatcgatctgctgcggactcatccggcagggctggtcatcagtgatgtgcagatgcgcccgatggatggttatacattgctgcaggctatcaagcggagtcatccctggattccggtcgtattgatgaccgcttatggcgaagtggacaaggccgtggctgcgatgcgttccggcgccagtgattacctgctcaagccgtttgatccgcacagtctgctggcgcatgtcaggcattatctgctgaccgtcagcgatgaggatgaatcggaaatcgttgctgaagaccctcgcaccctgacattgttgtctcttgcgaagaaggtggctgcaaccagcgccacggtgatgctgacgggcgagagcggtagtggcaaggaagtactggcccgattcattcatcgccattcaccgcgtgcatctcgaccgtttgtcgccatcaattgtgctgccatccctgaaaatctgctggaatcgacgctgttcggatacgaaaaaggatcgtttaccggggcatctcaggcgcaggcaggaaaattcgagcgggccaacgggggaactttgctgttggatgaaatttcggaaatgccgctcggtcttcaggcgaaactgctgcgtatcctgcaggaacgtgaggtggagcggataggcgggagtaaacccgtcaagctggatatacgcctgattgcgacttccaatcgggatatgccgatgtatgtgcaggaaggccgctttcgggaagatttgtactatcgcctcaatgtttttcctctggaaattttgccgctgcgtgaacgtccgcaggatatcgtgccgctggcgcagcgtattctggatcgatctgcccagccgcgctgtgtgttggcgcaatcagccatacgcagtctggaacggtatacctggccgggaaatgtacgggagctggaaaatgtgattcagcgtgccatgattctggcaacgggttcgatcgaggctgaacacctgaatctgccgggatcctctgccagagataccttccggggagaagcacagagggaaggtgattcaccgctacgcgatatcaaatcactcgaacgggatcatattctgcaaacgctggcggcggtgaatggctcacgtaagctggcggtgcagaaactcggtatctccgagcgcaccttgcgttacaaactgcagcaataccggcttgcccggtgttga

SEQ ID NO: 43886 - protein, 437 aa, Nitrosomonas europaea ATCC 19718
MRNLPVLIVEDDPDLLEALCATLKLDGYTTLAASSGEQAIDLLRTHPAGLVISDVQMRPMDGYTLLQAIKRSHPWIPVVLMTAYGEVDKAVAAMRSGASDYLLKPFDPHSLLAHVRHYLLTVSDEDESEIVAEDPRTLTLLSLAKKVAATSATVMLTGESGSGKEVLARFIHRHSPRASRPFVAINCAAIPENLLESTLFGYEKGSFTGASQAQAGKFERANGGTLLLDEISEMPLGLQAKLLRILQEREVERIGGSKPVKLDIRLIATSNRDMPMYVQEGRFREDLYYRLNVFPLEILPLRERPQDIVPLAQRILDRSAQPRCVLAQSAIRSLERYTWPGNVRELENVIQRAMILATGSIEAEHLNLPGSSARDTFRGEAQREGDSPLRDIKSLERDHILQTLAAVNGSRKLAVQKLGISERTLRYKLQQYRLARC

SEQ ID NO: 43887 - DNA, 1458 bp, Rhodopirellula baltica SH 1
  CDS (1)..(1458)
atgatgcccgctgcttcgatcctacttgtcgacgacgaccatcacttggcaacctcgctaggtgagtggctcgccgaagaaggattcgaaacccatctcgccggcacgctcgaggacgcacgccaacagctcaagcaacatgcgttcgaattggtgatcaccgatttgcgtttgggtggtgaagatggaatgacgctggtatcggacgttaagaaacaccattccgacacaccggtcttggtgatgaccgggtacgccacgccaaataccgctgtggaagccgtccgcgccggggcggtggacctgctgaccaaaccagtcatcgacgacgaattgctgctcgccatcgatcgggcgatgaaccaacgcaagatcgaagccgaaaacgaaactctgcggcgacaacttgatcaacgcagtggtctcgagaacattctcagtcatgactaccgaatgatgaaaatcttcgatgtcatcgacagtgttgctgatgccaaagcctccatcttgatcaccggagaaaacggtaccggcaaaagcatgatcgcgcgtgcaatccacaaccgatgtgctcgccgcagtggtccgtttatcgaagtcgcctgcggtgctcttccggacacattgctcgaaagtgaactgttcggtcacgttgccggtgcctataccggtgccaacaccgatcgtcgcggcaaattcgagctggctgacggcggaactttgttcctggacgaaatcgcgacggcgactcccgccatgcaagtcaaattgcttcgcgttttgcaggaactgcaatttgaaccgctcggtggaatggaaacgcgaagtgtcgacacacgcgtgatcttggcgaccaacgaaaacctggatcaagccgtcgcggatggttcgtttcgccaagatttgtattaccgaatcaacgtcgtgaacatcgttttgccatcgcttcgcgagcgaaccggtgacattccattgctcgtcgatcacttccttcgtgaggccgctgaaaccgccggtcgagacatcgacggctttgatcgcgaagcgatgaaatgcctgcagtcatacgcatggcccggcaacgttcgacaactcgaaaacgtggtcgaacgcgccgtcttgctcgccaccgatcgtgtgctcaccaaagatgatttgccgccggacgtactcggcacatccgctaaccaacacgcttccatcggcagtgtcggacattcgccgggagtgaccgcatccagcggtgcatcgtcattcaatcccgcggtcttggatggttgcagcctgcgggaagctctcgaaggtccggaacgcgaaatcattctgcattcgctccgccggcacaattggaaccgagccgccaccgccgacgagcttgaaatcaatcgcacaacgctctacaagaaaatgaaacgtttgggtctcgatgacccgcgacttcaatacgccaaccattga

SEQ ID NO: 43888 - protein, 485 aa, Rhodopirellula baltica SH 1
MMPAASILLVDDDHHLATSLGEWLAEEGFETHLAGTLEDARQQLKQHAFELVITDLRLGGEDGMTLVSDVKKHHSDTPVLVMTGYATPNTAVEAVRAGAVDLLTKPVIDDELLLAIDRAMNQRKIEAENETLRRQLDQRSGLENILSHDYRMMKIFDVIDSVADAKASILITGENGTGKSMIARAIHNRCARRSGPFIEVACGALPDTLLESELFGHVAGAYTGANTDRRGKFELADGGTLFLDEIATATPAMQVKLLRVLQELQFEPLGGMETRSVDTRVILATNENLDQAVADGSFRQDLYYRINVVNIVLPSLRERTGDIPLLVDHFLREAAETAGRDIDGFDREAMKCLQSYAWPGNVRQLENVVERAVLLATDRVLTKDDLPPDVLGTSANQHASIGSVGHSPGVTASSGASSFNPAVLDGCSLREALEGPEREIILHSLRRHNWNRAATADELEINRTTLYKKMKRLGLDDPRLQYANH

SEQ ID NO: 43889 - DNA, 1368 bp, Rhodopirellula baltica SH 1
  CDS (1)..(1368)
atgaaccgcagcgaattttcggtactgatcgtcgatgatgaacccaacattcgttcggggcttcagaaggggttggtcaatgaagcggatcgaatcgaaaccgcagccgacgctgaacaaggtttggcaacgtttgaaacaggtgtttaccaattggtgatcgccgacgttcggctgggtggtggcatggacgggatcgaattgctggggcgaattcggcatatcgatccggaggtcgccgtcatcgtcatcaccgcccacggcacagttgaaaccgccgtcgatgcgatgcgtgccggcgcgtttgatttcatctccaaaccgctcgatttgaatttggttcggcaacaggttcggaaagcccgagagcaccgagagctgcgtcaagaaaaccagtctttgcgaactcgattggccgacgccggtgagttgtcaaacatcatcggtcagtgtgccgcgatgcaggacgtatttcatcaaatccgacaggtcgccgcgaccgaagccacggtgatgatccagggcgagagcggttcgggcaaagaactggtggcgcgagcgttgcatgatttgagcgaccgaagcggtggaccattcgtggcggtcaatctgggcgcgatgcccgagacacttcttgagagcgagttgtttggccacgaaaaaggatcattcagcggcgcttcgcggcaaaagccaggctgtttcgagcaagcgaccggtgggactttgtttctcgacgaagtgacggagatgtcagcgaaaagccaagtggatttgctgagggtgttggagtcacgtcgcttcacgcgtgtcggcggagagaagttgctggaaacggacgtgcgagtggtttccgccaccaacaaatcggtgcccgagttgattcaagacggttcctttcgcgaggatctttactaccgactgaatgtcattccgatcgaagtgccgtcgcttcgtcagcgtcgcgatgacatccctttgttgatcgaacacttccttcaacatttctgttcgcgtcatggtcgcccgatgaagcagattgctccggatgccatgcgtgtgctggttggtgcccagtggccggggaacgtccggcagcttcgcaatttggtcgagcgattggtggtgactcacaccggcgacgtgatagactcaaacgaactgcccaccgatttgcagccggccatgacggaccgaggggtcaagacgcagccggcctcgctcagcgaagcggtcgaaaactgcgaacgtgagatgatctcgaccattctggccgaatgcgattttcatcgagaaaacacggccaagcggctcggtgtcagcgtccggacactccactacaaaatgggtcgctacggtctgcactga

SEQ ID NO: 43890 - protein, 455 aa, Rhodopirellula baltica SH 1
MNRSEFSVLIVDDEPNIRSGLQKGLVNEADRIETAADAEQGLATFETGVYQLVIADVRLGGGMDGIELLGRIRHIDPEVAVIVITAHGTVETAVDAMRAGAFDFISKPLDLNLVRQQVRKAREHRELRQENQSLRTRLADAGELSNIIGQCAAMQDVFHQIRQVAATEATVMIQGESGSGKELVARALHDLSDRSGGPFVAVNLGAMPETLLESELFGHEKGSFSGASRQKPGCFEQATGGTLFLDEVTEMSAKSQVDLLRVLESRRFTRVGGEKLLETDVRVVSATNKSVPELIQDGSFREDLYYRLNVIPIEVPSLRQRRDDIPLLIEHFLQHFCSRHGRPMKQIAPDAMRVLVGAQWPGNVRQLRNLVERLVVTHTGDVIDSNELPTDLQPAMTDRGVKTQPASLSEAVENCEREMISTILAECDFHRENTAKRLGVSVRTLHYKMGRYGLH

SEQ ID NO: 43891 - DNA, 1476 bp, Rhodopirellula baltica SH 1
  CDS (1)..(1476)
ttgatcggtatcaccatgagtcaaactgccatcaaaatccttctcgtcgatgacgaagatgactaccgtcgcagttgcggcaagttcatggagcggatgggacacacggtccggttggcagccagtggtgccgaagccatgtcgttcctcgaccgagaggcgtttgacgtggccgtgttcgacatcgacatgccgggcatgagtggactggagttaatgcaacgcgtccacgaggaatcgcacgacgtcgaagtcgtgtttttaactggcaaagggaccatcgaggcgtgcgtgcaagcgatgcaaatgggtgcatgtgactttctcaccaaaccatgttcactcgccgatctcgaacaccgggttcaattggctcagcagcgcgggcatctcaagaaagaaaaccaacagctcaaagcgatcgtgcatcggaaccgcccgtctcccaagctcatcgggaattccctcgcaatgaaagaactctcgcgaatgatcgcgaaagttgctccgactcgaaaaccggtgctaatcgaaggtgaaagtgggacggggaaggaagtcgtcgcgcgttcggtccagcaacaaagcgatttggccgaccgaccctttgtcactatcaactgtgccgccttgccggcccagttggtcgagagcgaactctttggtcaccaaaaggggtcgttcacaggtgccaccgccgatcaacccggtttgttcgaagtcgccgatggaggaacactctttatcgacgaagtcggcgagttgcctcccgcgttgcaaccaaaattgctccgcgtcctagaagatggatcgcttcgccggatcgggtgccatcgagaacgcaaagtaaaagtgcgactgatcgcggccaccaatcgtgatctgttggaagaagtcaaagcgggcagatttcgagaggatttgctctaccgcatcaatgttctcacgctgaatttgccgccgcttcggcaacgtgaaggcgacattgaattgttgcttcatcattttctgccgcgaggttggtctttcgacaaagaggctctcgatacgatggttcagtaccattggcccggcaatgttcgacagctgatcaatgtcgttgagcgagccacaatcctggcggaccatcaagtgatcaccatggatgacttgccccgcgaactatccaatctgccatcaaactccggctcgttcgccgcttcgccaatacatgcggacgcctcacatctcggccaagacctcacttgcgaggatcccattgatgaggaatcgaccgccgaatcggcaccgcctctgatgctgggcgacagcagcctgaaagtggacgatctgatcaagacacacgtgttgaaagttctggaacagctcggtgggaacaaagccaaaacggcgcgtcatttgggcattcatcgacgcaaactgtatcgattgctggaacggttcgaacaaggcatgccagcggaagaaacgctatga

SEQ ID NO: 43892 - protein, 491 aa, Rhodopirellula baltica SH 1
MIGITMSQTAIKILLVDDEDDYRRSCGKFMERMGHTVRLAASGAEAMSFLDREAFDVAVFDIDMPGMSGLELMQRVHEESHDVEVVFLTGKGTIEACVQAMQMGACDFLTKPCSLADLEHRVQLAQQRGHLKKENQQLKAIVHRNRPSPKLIGNSLAMKELSRMIAKVAPTRKPVLIEGESGTGKEVVARSVQQQSDLADRPFVTINCAALPAQLVESELFGHQKGSFTGATADQPGLFEVADGGTLFIDEVGELPPALQPKLLRVLEDGSLRRIGCHRERKVKVRLIAATNRDLLEEVKAGRFREDLLYRINVLTLNLPPLRQREGDIELLLHHFLPRGWSFDKEALDTMVQYHWPGNVRQLINVVERATILADHQVITMDDLPRELSNLPSNSGSFAASPIHADASHLGQDLTCEDPIDEESTAESAPPLMLGDSSLKVDDLIKTHVLKVLEQLGGNKAKTARHLGIHRRKLYRLLERFEQGMPAEETL

SEQ ID NO: 43893 - DNA, 1458 bp, Rhodopirellula baltica SH 1
  CDS (1)..(1458)
atgacttccgatctcactgccgcccccgattccaccgccgaaccgccggatcgttcgaagtaccgtctgctggtggtcgacaatgaggctgcccacgcgcgggcgatgacggagagcctggaaaaggttggctacgtttgcgaggtcgcgaccagcggccccgacgccgccgcactgatccagcgagaaacgttcgacatcatcatcaccgacatggtgatgaacgatgtcgacggaatgaaaatcctggctctggcaaaagaacgattgcccgaatgcgaagtcgtcatggtgaccgggcacgcgacggtgccgatcgctgtcgaagcgatgcagcagggcgcgttcaattttctcgagaaaccgatcacccccagtcgcttgcgagccatcgtcgagaaggcggccgagaacgtcgaactccgacggacaaacaccgagttgatgcagcggctcgacgagcgttttggcttcgaaggcatcatctacaccagcaaaaagatgcaaacggtcatcgaccgtttgcgacgcattgccgccaccgacgcgacggtgcttatcaccggtgaatccggaaccggaaaagaaatggtggcgcaggccatccatcaaaacagcccccgcaaaaacaaacgcatcgttgcactcaacacgcgagctgtttctgagaacttggtcgagagcgaactgttcggccatgtcaaaggttcgttcaccgacgcggtctccgaccgggaaggtgcgtttgaatacgccaatggcgggacgctgttcctggacgaagtcggcgacatgccgatgagcacccagatcaaattgttgcgagtgctggaggaaagccagatcactcgcgtcggtgggaacaagtcgatcaaggtcaacgttcgtttgatctcagcgaccaaccgaccactcgaagaaatgatcgatgcaggaacattccgaaacgatctctacttccgtttgaaagtcgtgacgatcgagttgccgccactccgagagcgacgcgatgatgtgatcgctctcatggaccatttccgaaaaatgttcttgcggcgacatggcaaatcgtctgcccatttcactcccgcagtgaccaagaaattcttcgcgtacgactggcccggcaacatccgccagcttcgaaacttcgtcgaaaccatggtggtgctggacaccgatgggtcactcgacgaagacgacttgccgccggaactgatcgacgagacacctcaagagggcgaagaatctcaaggccccgctttgatcgaaggcaacatgagtttcgtcggcagaccactcgctgaaatcgaacgctgggcgatcgaagagacgctgaaactgaccggcaacaatcgagaagaggcggcaaagatcctgcaaatcggtgcccgaactctttaccgtcgactcgaccaatacaaaaaagatgaagacgaagcagcagctcaatcgtag

SEQ ID NO: 43894 - protein, 485 aa, Rhodopirellula baltica SH 1
MTSDLTAAPDSTAEPPDRSKYRLLVVDNEAAHARAMTESLEKVGYVCEVATSGPDAAALIQRETFDIIITDMVMNDVDGMKILALAKERLPECEVVMVTGHATVPIAVEAMQQGAFNFLEKPITPSRLRAIVEKAAENVELRRTNTELMQRLDERFGFEGIIYTSKKMQTVIDRLRRIAATDATVLITGESGTGKEMVAQAIHQNSPRKNKRIVALNTRAVSENLVESELFGHVKGSFTDAVSDREGAFEYANGGTLFLDEVGDMPMSTQIKLLRVLEESQITRVGGNKSIKVNVRLISATNRPLEEMIDAGTFRNDLYFRLKVVTIELPPLRERRDDVIALMDHFRKMFLRRHGKSSAHFTPAVTKKFFAYDWPGNIRQLRNFVETMVVLDTDGSLDEDDLPPELIDETPQEGEESQGPALIEGNMSFVGRPLAEIERWAIEETLKLTGNNREEAAKILQIGARTLYRRLDQYKKDEDEAAAQS

SEQ ID NO: 43895 - DNA, 1488 bp, Bordetella pertussis Tohama I
  CDS (1)..(1488)
atgaaacccgtttggattgtcgacgacgaccaggctatccgctgggtgctcgagaaggccctggcgcgggccggcatcgccacccgcagcttctcccgggccgccgatgtcctgcaggcgctggcggccgacgtgccgtcggtgctggtgtcggacatccgcatgccgggcggcgatgggcttgaactgctgcgccagatcaaggagcgcaatcccgggctgccggtgatcgtcatgaccgccttcgccgacctggacagcacggtgtcggcgttccagggcggcgcgttcgattacctggccaagccattcgacgtcaacgaggcggtggcgctgatccagcgcgccatgcaggagggcgagccggcggccgacgcgggcgcggcgggcgagccggcgcagaacggcgagcgctgggtgatgacgcagtcctcgtccaccgcgatgcaggaagtgtttcgcgccataggccggctggcccagtccaaggtgacggtgctgatcaccggcgagtccggcaccggcaaggagctggtggcgcgggccctgcatgggcacggcgcgcgcgccggcgggccgttcgttgcgctgaacgccgcggcgattccgcgcgacctgctggaggccgagttgtttgggcacgagcgtggcgccttcaccggagccaatacgctgcggcgcggacgcttcgaggaggcgcatggcggcacgctgttcctcgacgagatcggcgatatgccgatcgagttgcagacccgcctgctgcgcgtgctggccgagggcagtttctaccgcgtgggcggggcgcaaccggtgcgcgtggatgtgcgcatcgtcgcggccacccaccagccgctcgaacagcgcgtcgagcagggcctgttccgggaggacctgttccatcgtctcaatgtgatccgcctgcgcctgccgccgctgcgcgaacgggtcgaggatattccggcgctggcccagcacttcctggccaccagcgcccgggcgctgggcgtgccggtcaagcgcttgacgcccgacgcgctggccgtgctggcgcgtttcgattttcccggcaatgtgcgccagctggagaacttctgccattggctgacggtcatggctccggggcagacgatcgatcgcaacgacctgccgcccgaaatccgggcggtcgaacaccagcaggcggcggcccggcaggccgaaccggctgccgcggctgccgcggccgggacggcgccggccccggccgaggcgccggatgccgcgccgcgcaactggcacgcagccttgctgcgcgatgcgcagttccgcctcgagcgcggcgagccggcggtcatggcgacgctgacgcgccagttcgagaagatcctgctgcaaagcgccctggatgcgagccgggggcggcgggtggaggctgcatcgcggctgggcatcggccgcaataccatcacgcgcaagctgcgcgagctgggtatcgacgacgaatag

SEQ ID NO: 43896 - protein, 495 aa, Bordetella pertussis Tohama I
MKPVWIVDDDQAIRWVLEKALARAGIATRSFSRAADVLQALAADVPSVLVSDIRMPGGDGLELLRQIKERNPGLPVIVMTAFADLDSTVSAFQGGAFDYLAKPFDVNEAVALIQRAMQEGEPAADAGAAGEPAQNGERWVMTQSSSTAMQEVFRAIGRLAQSKVTVLITGESGTGKELVARALHGHGARAGGPFVALNAAAIPRDLLEAELFGHERGAFTGANTLRRGRFEEAHGGTLFLDEIGDMPIELQTRLLRVLAEGSFYRVGGAQPVRVDVRIVAATHQPLEQRVEQGLFREDLFHRLNVIRLRLPPLRERVEDIPALAQHFLATSARALGVPVKRLTPDALAVLARFDFPGNVRQLENFCHWLTVMAPGQTIDRNDLPPEIRAVEHQQAAARQAEPAAAAAAAGTAPAPAEAPDAAPRNWHAALLRDAQFRLERGEPAVMATLTRQFEKILLQSALDASRGRRVEAASRLGIGRNTITRKLRELGIDDE

SEQ ID NO: 43897 - DNA, 1407 bp, Bordetella parapertussis 12822
  CDS (1)..(1407)
ttgcattgcgggggaacgatgcctcacttgctgatcgttgacgatgacgatgcggtacgcgacaacctggtggaaatcggccgcgagcacggctacaccgtggcgcaggccggcacggtgcgcgatgcgctgatccaggtggaacggcaactgccggacctggtgctgaccgatgtgcgcctgcccggcgccaccggcatggacctgttctcccgcatttcgcatgccggggtcgaggtggtggtgatcaccggctacggcagcatggaaaacgccatcgaagcgctgcgcgccggcgccaccgattacctggtcaagcccatctgcatggaacgcctcgaacagattcttgcgcgcgtggcgtcggcggggcaggacggcgactgggatccctcccagccgttccagcaggaagaccgcttcggacgcctggtaggggcgtcggcgcccatgcaggcgctgtatcgccagatctcgcgcgtggcgcctaccgaggtcacgacgctgctgatcggcgagagcggcaccggcaaggaactggccgcgcatgcggtgcacgagctcagcgcgcggcgcgccggccccttcgtggcggtcaactgcggcgcgatctcgcccaacctgatcgagagtgaactgttcgggcacgaacgcggcagctttaccggcgccgagcgccagcacaagggctatttcgaacgcgccgacaacggcacgctgttcctggacgaagtgaccgaaatgccgctggacttgcaggtcaagctgctgcgcgtgctggagaccggcgccttcatgcgggtgggcaccaaccgcgagatttcctgcagcgtgcgcgtggtggccgccaccaaccgcagccccgagcaggcggtgcgcgacggcaggctgcgcgaggacctctattaccgcctgagcgtgtttcccatcgagctgccgccgctgcgcgagcgcggcgacgacctcgccatgctggccgggcgtttcctcgacggactgaatcgcgagtacggcaaggacaagcgcttcgcgccgcaggcgctgcagaccatggcggagtacgcctggcccggcaatgtgcgggaactgaagaacttcgtgcggcgcgcgttcatcctggccgaatccgacacgctggacgccagcgcgctcacgccgcagatctcgcccagcgacgcggctggcggcgggcaggtgatcgtgccggtgggctcgacgctggccgaggcggaccggcgtctgatcctggccaccttgcagcgttgcggcggcgtcaagaaacagaccgccgcgatgctgggcatcagcgccaagacgctctacaaccggctggaagagtatggcgaggcaggtccgccggacgcggcgcccggcgcagagggggccgcctcgcgcgcgcagcactga

SEQ ID NO: 43898 - protein, 468 aa, Bordetella parapertussis 12822
MHCGGTMPHLLIVDDDDAVRDNLVEIGREHGYTVAQAGTVRDALIQVERQLPDLVLTDVRLPGATGMDLFSRISHAGVEVVVITGYGSMENAIEALRAGATDYLVKPICMERLEQILARVASAGQDGDWDPSQPFQQEDRFGRLVGASAPMQALYRQISRVAPTEVTTLLIGESGTGKELAAHAVHELSARRAGPFVAVNCGAISPNLIESELFGHERGSFTGAERQHKGYFERADNGTLFLDEVTEMPLDLQVKLLRVLETGAFMRVGTNREISCSVRVVAATNRSPEQAVRDGRLREDLYYRLSVFPIELPPLRERGDDLAMLAGRFLDGLNREYGKDKRFAPQALQTMAEYAWPGNVRELKNFVRRAFILAESDTLDASALTPQISPSDAAGGGQVIVPVGSTLAEADRRLILATLQRCGGVKKQTAAMLGISAKTLYNRLEEYGEAGPPDAAPGAEGAASRAQH

SEQ ID NO: 43899 - DNA, 1389 bp, Bordetella bronchiseptica RB50
  CDS (1)..(1389)
atgcctcacttgctgatcgttgacgatgacgatgcggtacgcgaaagcctggtcgagatcggccgcgagcacggctataccgtggcgcaggccgcgacggtgcgcgacgcgctgatccaggtggaacggcaattgccggacctggtgctgaccgatgtgcgcctgcccggcgccaccggcatggacctgttctcccgcatttcgcatgccggggtcgaggtggtggtgatcaccggctacggcagcatggaaaacgccatcgaagcgctgcgcgccggcgccaccgattacctggtcaaacccatctgcatggaacgcctcgaacagattcttgcgcgcgtggcgtcggcggggcaggacggcgactgggacccctcccagccgttccagcaggacggccgcttcggacgcctggtaggggcgtcggcgcccatgcaggcgctgtaccgccagatctcgcgcgtggcgcccaccgaggtcacgacgcttctgatcggcgagagcggcaccggcaaggaactggccgcgcacgcggtgcacgagctcagcgcgcggcgcgccggccccttcgtggcggtcaactgcggcgcgatctcgcccaacctgatcgagagcgaactgttcgggcacgaacggggcagcttcacgggcgccgagcgccagcacaagggctatttcgaacgcgccgacaacggcacgctgttcctggacgaagtgaccgaaatgccgctggacttgcaggtcaagctgctgcgcgtgctggagaccggcgccttcatgcgggtgggcaccaaccgcgagatatcctgcagcgtgcgggtggtggccgccaccaaccgcagccccgagcaggcggtgcgcgacggcaggctgcgcgaagacctttattaccgcctgagcgtgtttcccatcgagttgccgccgctgcgcgagcgcggcgacgacctcgccatgctggccgagcgtttcctcgacggactgaaccgcgagtacggcaagagcaagcgcttcgcgccgcaggcgctgcagagcatggcggagtacgcctggcccggcaacgtgcgggaactgaagaacttcgtgcggcgcgcgttcatcctggccgaatccgacacgctggacgccagcgcgctcacgccgcagatctcacccagcgacgcggctggcggcgggcaggtgatcgtgccggtgggctcgacgctggccgaggcggaccggcgtctgatcctggccaccttgcagcgttgcggcggcgtcaagaaacagaccgcggcgatgctgggcatcagcgccaagacgctctacaaccggctggaagagtatggcgaggcaggaccgccggacgccgcggccaacgaagagggagcagccccgcgcgcgcagcactga

SEQ ID NO: 43900 - protein, 462 aa, Bordetella bronchiseptica RB50
MPHLLIVDDDDAVRESLVEIGREHGYTVAQAATVRDALIQVERQLPDLVLTDVRLPGATGMDLFSRISHAGVEVVVITGYGSMENAIEALRAGATDYLVKPICMERLEQILARVASAGQDGDWDPSQPFQQDGRFGRLVGASAPMQALYRQISRVAPTEVTTLLIGESGTGKELAAHAVHELSARRAGPFVAVNCGAISPNLIESELFGHERGSFTGAERQHKGYFERADNGTLFLDEVTEMPLDLQVKLLRVLETGAFMRVGTNREISCSVRVVAATNRSPEQAVRDGRLREDLYYRLSVFPIELPPLRERGDDLAMLAERFLDGLNREYGKSKRFAPQALQSMAEYAWPGNVRELKNFVRRAFILAESDTLDASALTPQISPSDAAGGGQVIVPVGSTLAEADRRLILATLQRCGGVKKQTAAMLGISAKTLYNRLEEYGEAGPPDAAANEEGAAPRAQH

SEQ ID NO: 43901 - DNA, 1314 bp, Chromobacterium violaceum ATCC 12472
  CDS (1)..(1314)
atgactaagacactgcgcgtattgatcgtcgacgacgaaccggacatccgcgaactgctggaactgaccttgctgaaaatgggcctcgccccggtatgcgccggcagcgtggccgaggcgcgttccgcgctggacgcgggcggattcgacctggcgctgaccgatatgcggctgcctgacggcgagggcttggaggtggtcaaccacatcggcgagtccgggctggatgtgcccatcgccgtgatcaccgcctacggcagcgccgacaacgcggtgcgggcgatgaaggctggcgctttcgactacttgcagaagccggtcagcctggcccagctgcgcagcctggtgaagacggcgctgaaggtggaaacgccggtccgcgccgccgtccagcagcggctgctgggcgagtcgccggcgatacaggaagtgctgcggctgacggacaagctgtcgcgcagccaggccgcggtgtacatcggcggggagtccggcaccggcaaggaacaggcggcgcggctgatccacgagctgggtccgcgcgccgacaagcccttcgtcgccgtcaactgcggcgcgatcccggaaagcctgatggagagcgagttcttcggctgccgcaagggcgcgttcaccggcgcggacgccgaccgcgacggcttcttccagcaggcgcagggcggcaccctgttcctggacgaagtggccgagctgccgctggcgatgcaggtcaagctgctgcgcgcgatccaggaaaagaccgtgcgcaagctgggtgccagccaggaagaggcggtcgatgcccgcatcatctgcgccacccaccgcgatctggcggcgcgggtggagtccgggcagttccgacaggacctgtactaccgcctcaacgtgctgccgctgagaatgccgccgctgcgcgagctgcgcgacgacatcccgctgttcgccgagcggctgctgcagcgcttcggcggcgcgtccgcgccgcagttgtccgccgacgcccgccgcgcgctgcaggactacgcctaccccggcaatttccgcgagctggagaacatcctggagcgggcggtggcgctggccgccgggcccgcgctgtcgcgcgaagacctgcagctgacgccctgcgccgagcacgcgccggagcccggcagcggcgagccgctgcaggactacctggaccgcgtcgagcgcgaggccatcgtcaaggcgctggagggcacccgctacaaccgcacccaggccgctaagaaactgggggtcaccttccgctcgctgcgttaccggatggagcggctgggcgtgaagtga

SEQ ID NO: 43902 - protein, 437 aa, Chromobacterium violaceum ATCC 12472
MTKTLRVLIVDDEPDIRELLELTLLKMGLAPVCAGSVAEARSALDAGGFDLALTDMRLPDGEGLEVVNHIGESGLDVPIAVITAYGSADNAVRAMKAGAFDYLQKPVSLAQLRSLVKTALKVETPVRAAVQQRLLGESPAIQEVLRLTDKLSRSQAAVYIGGESGTGKEQAARLIHELGPRADKPFVAVNCGAIPESLMESEFFGCRKGAFTGADADRDGFFQQAQGGTLFLDEVAELPLAMQVKLLRAIQEKTVRKLGASQEEAVDARIICATHRDLAARVESGQFRQDLYYRLNVLPLRMPPLRELRDDIPLFAERLLQRFGGASAPQLSADARRALQDYAYPGNFRELENILERAVALAAGPALSREDLQLTPCAEHAPEPGSGEPLQDYLDRVEREAIVKALEGTRYNRTQAAKKLGVTFRSLRYRMERLGVK

SEQ ID NO: 43903 - DNA, 1377 bp, Chromobacterium violaceum ATCC 12472
  CDS (1)..(1377)
atgaagtatcttccgattctggtggtcgaagacgacgcggatctgcgcgaggccatcgtcgacacgctttccctggcgggctatccgacgctggaggccgccgatggcggctccgctctgcagaagctggcccaggagccggtggggctgatcatttccgacgcccagatggcgccgatggacggctatgacctgttcgaggaggcgaagaagcgctatcccggcgtgcccttcatcctgatgaccgcctatggcgtgatcgagcgcgcgatcgagctcttgcgcgccggggccgcgcattacctgctcaagcccttcgagccgcagagcctgttggccgaggtggacaagcatctgctggcgatgccgggagacggcggcggcgatgtggtggctgaatccgcggcgatgcgccagttgttcgcgttggcgggccgggtggcgcagagcgacgccagcgtgatgatttccggccccagcggcagcggcaaggaagtgctggcgcgttacatccaccgccactccaagcgcggcagcgggccgttcgtcgcggtcaattgcgcggctatcccggacaatctgctggagtccacgctgttcggccatgagcgcggcgccttcaccggcgcggcgcaggccttgccgggcaagttcgagcaggctcagggcggcaccatcctgctggacgaagtgaccgagatgccgctgcccttgcaggccaagctgttgcgggtgctgcaggagcgcgaggtggagcggataggcgccacgcgcaccatcaagctggacattcgcgtgctggccacctccaatcgcgatctgcaggcggcggtggaggctgggaatttcagagaagacctgtatttccgtctgaatgttttcccgctgagaataccggcgctcgccgagcggccggaggatattctacctttggcacgattcctgcttaaaaaacatgcggaggccgctggacgggcatctctggtgttttccagggatgcggaacgtcatttgacggcctatagttgggagggtaacatccgcgaactggataatgtcgtgcagcgggcggtgattcttgccgccggagcggaaattcttgccgccgatctgatgctgggcgatattgctggcgtggggcagtttacccgagcggagtccgaatcggacagttcggtgtcgggtgaaaccgacatgaaaacccttgagaaacgccatatcctggaaacattggcggcagtcggcggcgtgaagaagctggctgcggagaaactgggcatcagcgagcgcactttgcgctacaaactgcagcgctaccgtgatgaggatgctgcggatgccggtggaaatgttccggagggaagtggcacggagtag

SEQ ID NO: 43904 - protein, 458 aa, Chromobacterium violaceum ATCC 12472
MKYLPILVVEDDADLREAIVDTLSLAGYPTLEAADGGSALQKLAQEPVGLIISDAQMAPMDGYDLFEEAKKRYPGVPFILMTAYGVIERAIELLRAGAAHYLLKPFEPQSLLAEVDKHLLAMPGDGGGDVVAESAAMRQLFALAGRVAQSDASVMISGPSGSGKEVLARYIHRHSKRGSGPFVAVNCAAIPDNLLESTLFGHERGAFTGAAQALPGKFEQAQGGTILLDEVTEMPLPLQAKLLRVLQEREVERIGATRTIKLDIRVLATSNRDLQAAVEAGNFREDLYFRLNVFPLRIPALAERPEDILPLARFLLKKHAEAAGRASLVFSRDAERHLTAYSWEGNIRELDNVVQRAVILAAGAEILAADLMLGDIAGVGQFTRAESESDSSVSGETDMKTLEKRHILETLAAVGGVKKLAAEKLGISERTLRYKLQRYRDEDAADAGGNVPEGSGTE

SEQ ID NO: 43905 - DNA, 1413 bp, Chromobacterium violaceum ATCC 12472
  CDS (1)..(1413)
atggccaagccggtctggatcatagacgacgacaaggcgatacgctgggtgctggaaaaggcgctgacccgcgccggcatcggcttcgacagcttcgccagcgccgacgacgcgctcaacgcgctatacgacgacaagccgcaagccatcatctccgacatccgcatgccgggcaccgacggcctgaagttcctgtccaaggtgaagaccgagcatccgcagctgccggtcatcatcatgaccgcccactccgacctggactccgcggtgtcggccttccagggcggcgccttcgaatacctgcccaagccgttcgacatcgaccaggcggtgctgctgatcgagcgcgcgctggccgaaagcgaggcgcaaggcggcggcgccgacagcccggaagcgatgccggtgctgctgggccaggcgccggcgatgcaggacgtattccgcgccatcggccggctggcccaatccaacgtcaccgtgctgatcaccggagaatccggcaccggcaaggaacgggtggccgaggcgctgcaccgccactcggtgcgcgccggcaagcccttcatcgcgctcaacaccgcggcgataccgaaggacctgctggaatccgaactgttcggccacgaaaaaggcgcgtttaccggcgcgctggccacgcggcgcggccgcttcgaggaagccgaaggcggcacgctgttcctggacgagatcggcgacatgccgaccgagctgcaaacccggctgctcagagtgctgtccgacggccatttctaccgcgtcggcggccacacgccgatcaaggccaatgtccgggtgatcgccgccacccaccagaacctggagcaacgggtgcgcgacgggctgttccgcgaagacctgtaccaccgcctcaacgtgatccgcctgcggctgccgccgctgagggagcggcgcgaggacatcccgctcttggcccgccacttcctggccaagagcgcctcccagctgggcgtcgaacccaagcgcctgtccgaggcggcgatggcgctgatccagcgcagcgctttcaccggcaacgtgcgcgagctggaaaacctgtgccagtggatatgcgtgatggcgccgggccagaccgtcgaagtggccgacctgccgccggagctgcgcgagccgcaagccgaggccgccggttgcccgcacggcgactgggaccggatgctggaggacgagatccgccggcgtctgcgcgccggcgaggtcggcatcgtcgatgagctgacgcgccgcttcgaaaccacctgcatccgcgccagcctcggccataccggcgggcgccgggtggaagccgcgcacctgctgggctgggggcgcaacaccctgacccgcaagattcaggaactagggctggagcacgacgctcagcacagttaa

SEQ ID NO: 43906 - protein, 470 aa, Chromobacterium violaceum ATCC 12472
MAKPVWIIDDDKAIRWVLEKALTRAGIGFDSFASADDALNALYDDKPQAIISDIRMPGTDGLKFLSKVKTEHPQLPVIIMTAHSDLDSAVSAFQGGAFEYLPKPFDIDQAVLLIERALAESEAQGGGADSPEAMPVLLGQAPAMQDVFRAIGRLAQSNVTVLITGESGTGKERVAEALHRHSVRAGKPFIALNTAAIPKDLLESELFGHEKGAFTGALATRRGRFEEAEGGTLFLDEIGDMPTELQTRLLRVLSDGHFYRVGGHTPIKANVRVIAATHQNLEQRVRDGLFREDLYHRLNVIRLRLPPLRERREDIPLLARHFLAKSASQLGVEPKRLSEAAMALIQRSAFTGNVRELENLCQWICVMAPGQTVEVADLPPELREPQAEAAGCPHGDWDRMLEDEIRRRLRAGEVGIVDELTRRFETTCIRASLGHTGGRRVEAAHLLGWGRNTLTRKIQELGLEHDAQHS

SEQ ID NO: 43907 - DNA, 1341 bp, Chromobacterium violaceum ATCC 12472
  CDS (1)..(1341)
atgaacgcccccgcccgcatcgtcctggtggacgacgatcccgatctgctgtgcctggtccggctgcggcttgaggccgccggccacgaagtggaggcgctcgccagcgccgaggccgcgctggcagcgctggccgcgcgccgcgccgacctgttgctgaccgactggcgcttgcccggcatggacgggctgcagctgttcgaaaccgcgcgccgccgctatccgacgctgccggtcatcctgttcaccgcccacggcacggtgccggacgcggtggaggcggtcagccgcggcgtgttctgctacctggaaaaaccgttcgacggccagctgctgctggacaaggtggcccagggactggcgctgtccgcgggcgacggcgccgccggcgacgactggcgcgccggcatcgtcagccggggcccggcgatggaggaactgctgagcgaagcgcgcatggtggccgccaccgacgccagcgtgctgctgcagggcgaaagcggcagcggcaaggaagtgctggcgcgcgccattcatcaggccagccgccgcgctggccggccctttgtcgccgtcaactgcggcgcgatcccggaaaacctgctggaaagcgagctgttcggccacgagaagggcgccttcaccggcgccgccgcgcgccacgacggcctgatccgccaggcggacggcggcacgctgttcctggacgagatcggcgacatgccgctgccgctgcaggtgaagctgctgcgggtgctgcaggatcgcgaggtcaggccggtgggcgccagccggccgctgccggtggatatccggctgctgtcggccacccaccgcgatttgccggcccgcatcgccgacggccagttccgcgaggacctctactatcggctgaacgtggtgtcgctgaccctgccgcccttggccgagcggcgcgaggacatccccttgctggcgcagcatttcctgcagcaggtggccgcgcgctacggcaagtccgtcagcggcttcgcgcccgacgccctggccttcctcgccgccgcgcgctggccgggcaatatccgccagctggccaatgtggtggagcaatgctgcgtgctggcgaccggccccttgctgaccctggcccaggtggaaaaggcggtagccggcgagtcgcgcgcgattccgacgctggccgaggcgcggcgggacttcgaacgcgactacctggagcggctgctgcgcctgaccggcggcaacgtcagcgacgccgcccggctggccgaccgcaatcgcaccgagttctaccggctgctgcagaaacacgagctgaatgccgccgcgttcaaggacggctga

SEQ ID NO: 43908 - protein, 446 aa, Chromobacterium violaceum ATCC 12472
MNAPARIVLVDDDPDLLCLVRLRLEAAGHEVEALASAEAALAALAARRADLLLTDWRLPGMDGLQLFETARRRYPTLPVILFTAHGTVPDAVEAVSRGVFCYLEKPFDGQLLLDKVAQGLALSAGDGAAGDDWRAGIVSRGPAMEELLSEARMVAATDASVLLQGESGSGKEVLARAIHQASRRAGRPFVAVNCGAIPENLLESELFGHEKGAFTGAAARHDGLIRQADGGTLFLDEIGDMPLPLQVKLLRVLQDREVRPVGASRPLPVDIRLLSATHRDLPARIADGQFREDLYYRLNVVSLTLPPLAERREDIPLLAQHFLQQVAARYGKSVSGFAPDALAFLAAARWPGNIRQLANVVEQCCVLATGPLLTLAQVEKAVAGESRAIPTLAEARRDFERDYLERLLRLTGGNVSDAARLADRNRTEFYRLLQKHELNAAAFKDG

SEQ ID NO: 43909 - DNA, 1350 bp, Porphyromonas gingivalis W83
  CDS (1)..(1350)
atgaagaaaagcggcaatatcatcgtggtcgatgataacaaacatgtactgacggctttgaaattgctcctgacggggagtttcgagaccgtgacgctcctaccttcccccaagacactgctttccacgatcgtagaggtgcatccggatgtactcctgctggatatgaatttttctaccggcatcaatacgggtaatgaaggattatattggctggatcaggtccgtagccgtttccctgacctccctgtggtactctttaccgcttatgcggacattcgtctggcagtggaagccttgaagcgtggagcaagcgatttcgtagtcaagccgtggaacaacaccgagctgttggagtcgcttcgcatggcgatgaataaggccgcaagcactcaagtgacggctacacctaaagaaggcgattcggtatttctcagcaaaagcaaggccatgtgtgaggtgttggagctggctggtcgtatcggcgatactgcagcccatgtcctcattacgggtgagaatggtaccggcaagggcgttttagccgagtatatccatgcccgttctcctcgtagccggcagccgatgctgactgtggatatgggagctttgagcgagacgctgttcgagagcgaactgttcggccatgtgaaaggagcctttaccgatgccaaaagcgatcgcgccggcaagttcgagacggcgtccggcggcacgatcttcatggacgagattggcaatctgagccttgccttgcaagccaagttgttggctgtactacagcaaaaagtggtgacccgtgtgggcagcaatacaccgatccctgtggatgttcgtgtcatctctgccacgaatagcgatttgcccctctccgtggcagaaggccggtttcgagaagatttgctttatcgtctcaatacgattcatatcgagatgccgccgctacgtcgtcgcagggaagatatagtgccgatggccgtattcttcctgcatcgttatgcacgacagtatggaaaagaggtgccggaattgactcccgaagcagaggccctactctccgattatccgtggccgggcaatgtgcgtgagcttcagcattgcatagagaaggctgtgatccttagccgtagcagtagcctttctgctgcggatctgtcgttgccgaagtcggtcgatgcacatccgactgctaccggtgtagcaagcactcctcagacgttggatgaaatggaaaagaccgctatcgagcaagccttggcacgaaacggcagcaacctttcgaatgtggcaagggaattaggcatcagccgccagactctgtataataagatgaaacgctacgggctgtag

SEQ ID NO: 43910 - protein, 449 aa, Porphyromonas gingivalis W83
MKKSGNIIVVDDNKHVLTALKLLLTGSFETVTLLPSPKTLLSTIVEVHPDVLLLDMNFSTGINTGNEGLYWLDQVRSRFPDLPVVLFTAYADIRLAVEALKRGASDFVVKPWNNTELLESLRMAMNKAASTQVTATPKEGDSVFLSKSKAMCEVLELAGRIGDTAAHVLITGENGTGKGVLAEYIHARSPRSRQPMLTVDMGALSETLFESELFGHVKGAFTDAKSDRAGKFETASGGTIFMDEIGNLSLALQAKLLAVLQQKVVTRVGSNTPIPVDVRVISATNSDLPLSVAEGRFREDLLYRLNTIHIEMPPLRRRREDIVPMAVFFLHRYARQYGKEVPELTPEAEALLSDYPWPGNVRELQHCIEKAVILSRSSSLSAADLSLPKSVDAHPTATGVASTPQTLDEMEKTAIEQALARNGSNLSNVARELGISRQTLYNKMKRYGL

SEQ ID NO: 43911 - DNA, 1473 bp, Photorhabdus luminescens subsp. laumondii TTO1
  CDS (1)..(1473)
atgcaacagggaaaaatttggatcgtcgatgatgacagttcaatccgctgggtactggaacgggcgttaagtaacgcggggatggaatgtaccagttttgccgacgcggatagcgccctgaccgcgctggcccaaaacacacctgatgtactgatttcggatatccgtatgccgggaatgaatgggctaaacctactgaataatatcaaacagagcaacccgttgctgccagtcatcattatgaccgcccattctgatctggatgctgcggtcaatgcttaccaacaaggcgcttttgattacttaccaaaaccctttgatattgatgaagccgtcgcattgctggaacgagcgcttagtcactcccgcgatcagaatcaatcaattaaaagtccacaggttgtcacacccgtttctgacatgataggagaagcgcctgccatgcaggacgtttaccgcattatcggccgcctctcccgttcctctatcagcgtcctaattaatggcgaatccggtaccggaaaagagctggtggctcatgcgctgcaccgtcacagccctcgggccaatgagccatttattgcccttaacatggcagctatccctaaagatttaattgagtcagagttgtttggtcatgaaaaaggggctttcactggcgctaatcaagtacgtcatgggcggtttgaacaggctaatcgtggctcactgtttctggatgaaattggtgatatgcctctggacattcagacccgtctgttacgggtattggcggaaggtcagttctaccgagttggcgggtatgctcccgtaaaagtggatgtgagaattatcgcggcaacccatcaggatctagagcgcttggtacagaaaggcaaattccgtgaagatctctatcaccgcctcaatgttattcgtatgcaattaccgcccttacgtgacagagtagaggatatccctcgcctgacccgccatttcctacaacagaccgcaaaagaattgggcgtagaaacaaagattctccatcctgacgcagaaatagccttaatgcgtttaccttggccgggcaatgttcgccagttggaaaatatctgccgctggctgacggtcatggcggcaagccaggaagtattagtgcaagatttgccatctgaattatttgaaactcatcataataccgaaagcggtatgacaacatctgtaaatacagtatctataaataccgtacccgcaaatacaacacctacaaatacaataccgaaaaattggtcgcagctacttgcccagtgggcaacaactgcattggaacatggtcagcaggatctgttatcggaagcattaccgttattggagcgtaccttacttgattgtgcactgaagcataccaaaggccataaacaagaggctgcacgattgctaggttggggacgcaatacgattacacggaagttaaaagaactcgggttggagtaa

SEQ ID NO: 43912 - protein, 490 aa, Photorhabdus luminescens subsp. laumondii TTO1
MQQGKIWIVDDDSSIRWVLERALSNAGMECTSFADADSALTALAQNTPDVLISDIRMPGMNGLNLLNNIKQSNPLLPVIIMTAHSDLDAAVNAYQQGAFDYLPKPFDIDEAVALLERALSHSRDQNQSIKSPQVVTPVSDMIGEAPAMQDVYRIIGRLSRSSISVLINGESGTGKELVAHALHRHSPRANEPFIALNMAAIPKDLIESELFGHEKGAFTGANQVRHGRFEQANRGSLFLDEIGDMPLDIQTRLLRVLAEGQFYRVGGYAPVKVDVRIIAATHQDLERLVQKGKFREDLYHRLNVIRMQLPPLRDRVEDIPRLTRHFLQQTAKELGVETKILHPDAEIALMRLPWPGNVRQLENICRWLTVMAASQEVLVQDLPSELFETHHNTESGMTTSVNTVSINTVPANTTPTNTIPKNWSQLLAQWATTALEHGQQDLLSEALPLLERTLLDCALKHTKGHKQEAARLLGWGRNTITRKLKELGLE

SEQ ID NO: 43913 - DNA, 1338 bp, Photorhabdus luminescens subsp. laumondii TTO1
  CDS (1)..(1338)
atgacagcgcgtaaaccagcccatcttcttctggttgatgatgatcctggtttgttgaaattgttgggaatgcgtcttaccagtgaaggttttcgtgtcacaaccgcagaaagtggcggtgaagcgttgagattgctaactaaagaaaaaatcgatttggtgatcagtgacctgcgtatggatgaaatggatggtatggcactgttcgctgaaatccagaagcagcaaccgggtatgccagttatcattctaacggctcatggctcaattccagaggcagtagcggccactcaacagggtgtctttagttttctgactaaacccgttgatcgggatgcgctttataaagcgattgatggtgcattggcgttgaccacgcctgccagtgatgaacagtggcgggaacagatagttacccgcagtcctgctatgttgcgtttgttggagcaggcgcgaatggttgctcaatctgatgtcagtgtactgataaacggtcagagtggtaccgggaaggaagtgctagcccaggcaattcaccgtgccagtccacgggcgaaaaaaccatttatcgcgattaactgtggtgctttgccggaacaactccttgagtcagaactgtttggtcatgctaaaggtgcatttaccggtgcggtcagcagccgtgaagggttattccttgctgcgcaggggggaacgctgtttcttgatgaaatcggtgatatgccacaggctttgcaggttaaattgttgcgcgtattgcaggaacgtaaaatacgtccgctcggaagtaaccgtgatctggatattgatgtacggattatctcagcgactcaccgtgatttaccgaaggcaatggcaaaaaatgagtttcgcgaagatctctattaccgcctaaatgtggtgaacttgaaaattccagctttgaatggccgggttgaagatattcctttattggcgaatcatctgttgcgtgaatcagcgaaacgccataaaccttttgtccgtagtttctcagttgatgcgatgaaatgcctgatggcggcaagttggcctggcaatgtgcgtcagcttgttaatgtgatcgaacagtgtgttgcgctgactactgcgccggttattagtgaagccttggttacgcaggcactagaaggggaaaatacagcgttacccacttttgtagaagccagaaatcagtttgaactgaattatctgcgtaaattactgcaaatgaccaaagggaatgtgactcatgcggcgcgtatggcggggcgtaaccggactgaattctacaaattactggcgcgccatgaattggatgcgaatgattttaaagaataa

SEQ ID NO: 43914 - protein, 445 aa, Photorhabdus luminescens subsp. laumondii TTO1
MTARKPAHLLLVDDDPGLLKLLGMRLTSEGFRVTTAESGGEALRLLTKEKIDLVISDLRMDEMDGMALFAEIQKQQPGMPVIILTAHGSIPEAVAATQQGVFSFLTKPVDRDALYKAIDGALALTTPASDEQWREQIVTRSPAMLRLLEQARMVAQSDVSVLINGQSGTGKEVLAQAIHRASPRAKKPFIAINCGALPEQLLESELFGHAKGAFTGAVSSREGLFLAAQGGTLFLDEIGDMPQALQVKLLRVLQERKIRPLGSNRDLDIDVRIISATHRDLPKAMAKNEFREDLYYRLNVVNLKIPALNGRVEDIPLLANHLLRESAKRHKPFVRSFSVDAMKCLMAASWPGNVRQLVNVIEQCVALTTAPVISEALVTQALEGENTALPTFVEARNQFELNYLRKLLQMTKGNVTHAARMAGRNRTEFYKLLARHELDANDFKE

SEQ ID NO: 43915 - DNA, 1410 bp, Vibrio vulnificus YJ016
  CDS (1)..(1410)
atgagtaaaggctatgtttgggttgtcgacgacgacagttcgattcgctgggtaatggaaaaaaccttatcctctgccaacatcaaatgcgaaacctacgccaacggcgaaagtgtgttgatggcgttagaacgtgaagtcccggatgttttagtctccgatattcgcatgccaggcatcgatggcattgaactgctgcgtcaagtgcatgagaagtgcccgaatttgcccgtcatcatcatgacggcacattcggatttggatgcggcggttaacgcttaccaaaaaggggcgtttgagtacctgccaaaacccttcgatatcgatgagacgctgacgctggttgaacgcgccattgcgcatggccaagaacaaaaacgtgaacaaatggcttcagcgcagacccacaccgcgcacaccccagaaatcatcggtgaagcaccggcgatgcaagaggttttccgcgctattggtcgcctgtctcgctcttccatttcagtgctgattaacggtgagtcaggcacaggtaaagagctcgtcgcccatgctttgcaccgccacagtcctcgctcaagcaaaccctttattgcgttgaacatggcagccatcccaaaggatttgattgagtccgaactgtttggccacgaaaaaggcgcgtttacaggtgccaactcggtgcgccaaggtcgatttgaacaggccaacgggggcacgttgtttctcgatgagatcggcgacatgccgcttgatattcaaacccgcctcctgcgcgtgctcgcagacggtcagttttatcgtgtcggtggccactcaccaattaaagtggatgtccgtattgtcgcggcgacccatcaaaatctcgaacgtttggtgcaacaaggcaaatttcgtgaagacctttttcaccgcctcaacgtcattcgcgtgcagatcccagcccttcgcgagcgcaagcaagacatcgaaaaactgacccagcacttcttgctgcgagccgcagaagagctcggtgtagaagccaaaacactgcatggcagcacggtggaaatacttaaccgtttgaactggccaggcaacgtacgtcagttggaaaacatttgtcgctggcttaccgtaatggccagtggcagcgaagtgttgccaagtgatttgccgagcgagttggtcaatgaaaaacgcgtggtggatgacaacaacgcttctggcacttggcaagaaaccttgtcgaactgggctgaacacgcattggaatctggagaaaaagaactgctggcttatgcacttcctcaattcgaacgtatactgttagaagcagcactaaagcacaccaatggacacaagcaggatgccgccaaggttttaggctggggacgcaacacgttgacgagaaaactaaaagagctgtactaa

SEQ ID NO: 43916 - protein, 469 aa, Vibrio vulnificus YJ016
MSKGYVWVVDDDSSIRWVMEKTLSSANIKCETYANGESVLMALEREVPDVLVSDIRMPGIDGIELLRQVHEKCPNLPVIIMTAHSDLDAAVNAYQKGAFEYLPKPFDIDETLTLVERAIAHGQEQKREQMASAQTHTAHTPEIIGEAPAMQEVFRAIGRLSRSSISVLINGESGTGKELVAHALHRHSPRSSKPFIALNMAAIPKDLIESELFGHEKGAFTGANSVRQGRFEQANGGTLFLDEIGDMPLDIQTRLLRVLADGQFYRVGGHSPIKVDVRIVAATHQNLERLVQQGKFREDLFHRLNVIRVQIPALRERKQDIEKLTQHFLLRAAEELGVEAKTLHGSTVEILNRLNWPGNVRQLENICRWLTVMASGSEVLPSDLPSELVNEKRVVDDNNASGTWQETLSNWAEHALESGEKELLAYALPQFERILLEAALKHTNGHKQDAAKVLGWGRNTLTRKLKELY

SEQ ID NO: 43917 - DNA, 1401 bp, Vibrio vulnificus YJ016
  CDS (1)..(1401)
atgcaacaaataacgacaacgaaacagcgctacttgctgatggtagaagacaccgcttctgtcgcagccctctatcgctcctatctcatgccattgggtatcgatatcaatatcgtgggtactgggcgcgacgcgatagacagtttaaaacatcgcattccagatcttattctgctggatttacgtctaccggacatgacgggaatggacgtattgcatgcagtgaaagcaagtcaccctgatgttcctatcattttcatgaccgcacacggctcgatcgatactgccgttgaagcaatgcgacatggttctcaggattttcttatcaagccatgcgaagcggatcgcttgagggtcacggtaaacaacgctatccgcaaagcgagtaaattgaagaatgatgcggacagtgcaggcagccaaaattatcaaggctttatcggcagtagccaaaaaatgcagcaggtttatcgcaccattgactccgcggcgagcagtaaagcaagcatctttatcacaggtgaaagtggtacaggtaaagaggtgtgcgcagaagccattcatgcggccagtcgacgtggagacaagccatttattgcgattaactgtgctgcgattcccaaagatttgattgaaagcgagctatttggtcatgtcaaaggtgcgtttaccggcgctgcgaccgatcgccaaggggcggcagagctcgctgatggaggcacacttttcctggatgagctgtgtgaaatggacttggatctgcaaacaaaattgctgcgttttatccaaacgggtactttccaaaaagtaggctcttcaaaaatgaagagtgttgacgtgcgttttgtgtgcgcgacaaaccgagacccctggaaagaggtacaagaagggcgctttcgtgaagatttgtactaccgactttatgtgattccactgcacttgccaccacttcgtgaacgtggagaggatgtcatcgagatcgcttactcgttactgggttacatgtcacacgaggaagggaaaaactttgttcgtttctctcaacctgtgatagatagatttaacgaatatgagtggccaggtaatgtgcgtcagttacaaaatgtgctgcgtaatgtggtggtgcttaacaacggtaaagagattaccatggagatgctgccgcctcctttgaaccagccctttgaacgcaaagaaagtgtgcagcctgatctgagtgagttgatttccgtcagggatatttgtccattgtggttgacagagaaactggcgattgaacaagcgatcaaagcgtgtgatggtaacattccgagagccgccggctatctggatgtcagcccgtcaacgatttatcgcaagttacaggcgtggaacgaaaaagaagaaaaacagaaagcataa

SEQ ID NO: 43918 - protein, 466 aa, Vibrio vulnificus YJ016
MQQITTTKQRYLLMVEDTASVAALYRSYLMPLGIDINIVGTGRDAIDSLKHRIPDLILLDLRLPDMTGMDVLHAVKASHPDVPIIFMTAHGSIDTAVEAMRHGSQDFLIKPCEADRLRVTVNNAIRKASKLKNDADSAGSQNYQGFIGSSQKMQQVYRTIDSAASSKASIFITGESGTGKEVCAEAIHAASRRGDKPFIAINCAAIPKDLIESELFGHVKGAFTGAATDRQGAAELADGGTLFLDELCEMDLDLQTKLLRFIQTGTFQKVGSSKMKSVDVRFVCATNRDPWKEVQEGRFREDLYYRLYVIPLHLPPLRERGEDVIEIAYSLLGYMSHEEGKNFVRFSQPVIDRFNEYEWPGNVRQLQNVLRNVVVLNNGKEITMEMLPPPLNQPFERKESVQPDLSELISVRDICPLWLTEKLAIEQAIKACDGNIPRAAGYLDVSPSTIYRKLQAWNEKEEKQKA

SEQ ID NO: 43919 - DNA, 1488 bp, Rhodopseudomonas palustris CGA009
  CDS (1)..(1488)
atggttgagcgtattctgatcgccgacgacgatgcagtacagcgtcggctggtcgagaacatggtgcagaagtgcggctatgaggcggtttcggtcgatagcggtgacgctgcggtggaggccctgaccgcgccggatgcgcctgcgatcgacgccgtggtgctcgacctggtgatgcccggactcgatggcctcggcgtgctgtcgaagattcgcgccagcggactcgacgtgccggtgatcgtgcagaccgcacatggcggcatcgacaatgtggtgtcggcgatgcgtgccggtgcgcacgatttcgtcgttaagccggtcggcatcgagcgcctgcaggtgtccttgcgcaacgcactgaacgccagcgcgatgaagggcgagctgcagcgcatccgccatgcccgcgaaggccggctgacattttccgacatcatcacccgcagcgaggcgatggcgccggtgttgcgcgcagccgagaaggctgcaggctccgcgatcccggtgctgatcgaaggtgaatccggcgtcggcaaggagctgttcgcgcgcgccatccacggctccagcgaccgccgttcaaaaccattcgtggccgtgaactgcggcgcgattcccgacaatctcgtcgagtcgattctgttcggccacgagaagggtgcgttcaccggcgccaccgagcgccacgacggcaagttcgtcgaagcctccggcggcacgctgtttctcgacgaggtcagcgagctgccgctggctgcgcaggtcaagctgctgcgcgcgctgcaggaaggcgcggtcgaagcggtcggcggacgccggccggtcaaggtcgatgtccgcatcatctcggccaccaaccgccggttgctcgaccgggtgaaagcgggccaattccgcgaagatctgttctaccggctgcacgtgctgccgctgacgatcccgccgctgcgcacccgccgcgaagacattccgccgctgctgcgacacttcctgatgcggttctgcgccgaagagaagcgcagcatcggcggcatcaccggcgaggcgatggtgcggctggcgcaactcgactggccgggcaatatccgccagctcgaaaatgcggtgtatcgcgccgtggtaatgagcgacggcgatcagctcggcctcgccgacttcccgctggcgatcgcgccgtcggtcgtccctgcagaagatacaaccggcgagccgctggtgatcgaacgcagcgagccacaatttgtcgccgcaagcgaagtgccgatcgcgccgctgccgagcgtcggcaatctgtcgatgctgacagcggacgacgaagtgcgtcccctcgacgaaatggagcgggagatcatccggtttgcgatctcgcattatcgcggccagatgtcggaagtggcgcggcggctgaagatcggccgctcgacgctgtatcgcaaactcgacgagatcgaagccgaccgcgccgcgcaggccgaggcgcgataa

SEQ ID NO: 43920 - protein, 495 aa, Rhodopseudomonas palustris CGA009
MVERILIADDDAVQRRLVENMVQKCGYEAVSVDSGDAAVEALTAPDAPAIDAVVLDLVMPGLDGLGVLSKIRASGLDVPVIVQTAHGGIDNVVSAMRAGAHDFVVKPVGIERLQVSLRNALNASAMKGELQRIRHAREGRLTFSDIITRSEAMAPVLRAAEKAAGSAIPVLIEGESGVGKELFARAIHGSSDRRSKPFVAVNCGAIPDNLVESILFGHEKGAFTGATERHDGKFVEASGGTLFLDEVSELPLAAQVKLLRALQEGAVEAVGGRRPVKVDVRIISATNRRLLDRVKAGQFREDLFYRLHVLPLTIPPLRTRREDIPPLLRHFLMRFCAEEKRSIGGITGEAMVRLAQLDWPGNIRQLENAVYRAVVMSDGDQLGLADFPLAIAPSVVPAEDTTGEPLVIERSEPQFVAASEVPIAPLPSVGNLSMLTADDEVRPLDEMEREIIRFAISHYRGQMSEVARRLKIGRSTLYRKLDEIEADRAAQAEAR

SEQ ID NO: 43921 - DNA, 1386 bp, Geobacter sulfurreducens PCA
  CDS (1)..(1386)
atgcagaacggagaaaccatgcccgcaaccatactgatcgtcgacgatgaacgggggcagcgcgagatcctccagaccatcctggagggagaacgctacgaaaccacgacggcggccggcggacaggaggccctggccttgctggacgagcgggagttcgatgtcatcctcacggatctgaagatgcagggaatgtcgggaatggagctgctggagcggctgttggcggctgacccgcagcagtgcatcatcatgatgactgcccacggcaccgttgactcggcagtggaagctatgaagaaaggggcctttgactatctggaaaagcccctggagcgggacaccctgctgctcaccctgcggcgggcggtagagcgggtccggttgctgaaggagaaccgggcgctccacaaaaaactggaggaaacgggcgccattccggacatcatcggcgagcaccccaagatgaaagaggtctttcggatcgtcaccaagatcgcgcccaccgcctccacggtcctcatccagggcgaatcgggcaccggcaaggagctggtggccagcgccatccacgaaaggagcccccgggcggacaagccctttttcgccatcaactgtgccgccatcccggaaaccctcatggagagcgagctgttcggccacgagaagggtgccttcaccggcgccagttcccgcgagatcggcatcttcgaggccgcgaacggcggcaccgtttttctggacgagatcggggagatgagcgtggccatgcaggcgaaactcctgcgggcgatccaggccaaggagatccggcgggtggggggcaaggtcaacatcccggtggatgtccggatcatctcggccaccaaccgtgacctggaagcggagatccgccggggcaacttccgggaggacctcttctatcgccttaacgtgatccggatcagccttccgccgctgcgggaacggggaagcgacatagctgccctgaccgacttcttcgtggcgaaataccggggcgatacgggggtgaaggggctctcccgcgccgccctgaagctcctcatgaactacagctggcccggcaacgtccgtcagctggagtcggtgatcgagcggggcatcctcatggcggagggagagctggtcgaacccggcgacctgccggcggagatcggcgaaggggtgtcgccgggcggcggactccccttcgagcttcccgccgacggcatccagttcgaggaactggaaaagaacctgatcatcaaggccatggagcgggccggtggggtcattgcaaaggcggcgccgctgctcggcatgagctacaaaacactccagtaccggctggaaaagttcggcataacccgggaccaggggccgtga

SEQ ID NO: 43922 - protein, 461 aa, Geobacter sulfurreducens PCA
MQNGETMPATILIVDDERGQREILQTILEGERYETTTAAGGQEALALLDEREFDVILTDLKMQGMSGMELLERLLAADPQQCIIMMTAHGTVDSAVEAMKKGAFDYLEKPLERDTLLLTLRRAVERVRLLKENRALHKKLEETGAIPDIIGEHPKMKEVFRIVTKIAPTASTVLIQGESGTGKELVASAIHERSPRADKPFFAINCAAIPETLMESELFGHEKGAFTGASSREIGIFEAANGGTVFLDEIGEMSVAMQAKLLRAIQAKEIRRVGGKVNIPVDVRIISATNRDLEAEIRRGNFREDLFYRLNVIRISLPPLRERGSDIAALTDFFVAKYRGDTGVKGLSRAALKLLMNYSWPGNVRQLESVIERGILMAEGELVEPGDLPAEIGEGVSPGGGLPFELPADGIQFEELEKNLIIKAMERAGGVIAKAAPLLGMSYKTLQYRLEKFGITRDQGP

SEQ ID NO: 43923 - DNA, 1362 bp, Geobacter sulfurreducens PCA
  CDS (1)..(1362)
atgacgacacgcatactcatagccgaagatgacagcaccttccggggatttctcaggacagtcctcaagggagagggatacgacatcagggaggccgctgacggagaagaagccctggccctgctgcgccgcgaatccttcgacttggtcctctctgacctgaggatgcccggcatcggaggactggaacttctccgggcgagccgtgatgatgactatccgcctgcattcgtcattctcacggcattcggaaccatcgaagaagcagtggccgcggtgaaagagggggcggctgatttcctcaccaagcccctgaaggacccggacaccctgcgagttctcgtaggacgggtcctgtccggaaagagccgtgagcgggaatacctggccctcaaggaaaccgaagcggcgggactcccgccggaggatctcatcttcgccggcgaggccatggccccggtacggcgactcgtgggagaggtcgcccccaccggcaccaccgttctggtaagcggggaaagcggcaccggcaaggagctcatcgcccgggccgtgcatctcctgtcaccccgacacggtgccggcttcgtggcggtaaactgtgcggcaatccccgaaaccctgctcgaaagcgagctgttcggccacgagcggggagccttcaccggcgcggtccaggcccggcgggggaaattcgaactggcccaggggggaactctcttccttgacgaaatcggggagctctctctcccccttcaggcgaagctcctgcgggtcctccaggagcgggccttcgagcgggtgggaggaaaccgggaaattcgggcggacgtgcgggtagtggctgccaccaaccgggatctggtcgttgaaatccgcgaacggcgcttcagggaagaccttttctatcgcctgaacgtgttccccgtcgcgcttccccccctacgggagcgccgcgacgccctgccacacctggtgaactggttcatccgtcgattttcgggagtaaccggcaaaaaaatccgggggatcgaacccgatgctatggcggccctcaagcgctacccctggcccggcaacatccgcgaactccagaacgtcattgaacgaggagtaatcctcgcccggcacgccctgaccctggacgatctccctgagaccttcagggcacctcttcctgccgggcaggacggggaaggagttctcaaggggctggagcgggaagcaatcctggccgccctcaaaagctgcggcaacaaccggcgcctgaccgccgaaaagcttggcatctcccggcgtaccctccagtaccgccttcgggagtatgggttggtgggggatgatcgggacggtgcaaattag

SEQ ID NO: 43924 - protein, 453 aa, Geobacter sulfurreducens PCA
MTTRILIAEDDSTFRGFLRTVLKGEGYDIREAADGEEALALLRRESFDLVLSDLRMPGIGGLELLRASRDDDYPPAFVILTAFGTIEEAVAAVKEGAADFLTKPLKDPDTLRVLVGRVLSGKSREREYLALKETEAAGLPPEDLIFAGEAMAPVRRLVGEVAPTGTTVLVSGESGTGKELIARAVHLLSPRHGAGFVAVNCAAIPETLLESELFGHERGAFTGAVQARRGKFELAQGGTLFLDEIGELSLPLQAKLLRVLQERAFERVGGNREIRADVRVVAATNRDLVVEIRERRFREDLFYRLNVFPVALPPLRERRDALPHLVNWFIRRFSGVTGKKIRGIEPDAMAALKRYPWPGNIRELQNVIERGVILARHALTLDDLPETFRAPLPAGQDGEGVLKGLEREAILAALKSCGNNRRLTAEKLGISRRTLQYRLREYGLVGDDRDGAN

SEQ ID NO: 43925 - DNA, 1413 bp, Geobacter sulfurreducens PCA
  CDS (1)..(1413)
atggaaaacattgatgtacttgtagttgacgatgaagcgattatccgggagggtctgcggaggatcctcgaaaaggagggctaccatgtggagacctccgccagcggacagattgccctggagagactgcaggatgagaactacggtctggttattaccgaccttaaaatgcccggcatgagcggcatggaagttctcaaggccatcaaggtcctgcagcccgaagttcccgtcatcatcattaccggattctccaccgtcgataccgcggtcgaggctatgaaaaacggcgccttcgactatattgcgaaaccttttactccggaccagattacggagaaagtgaggaaagccctcgagcagcgagcagtactgctcgagaacatctttctgaaaaaggagctgggcgagcaccacggtttcgatatcttcgtgggcgagagcaaagagatgcagaaggtttatcgccgcatcatccaggttgctcccaccgacagcaccgttctcattaccggtgaaagcgggaccggcaaagaactggtggcccgggccgtccacaacaacagtcaccgtcgcgacaacccctttgtggcggtggactgcacctcccttgctgaaaatcttctggaaagcgagctgttcggccacatcaagggctcgttcaccggggccatccagaccaaaaccggcttgttcaaggtggccgacggcggcacgctctttttggacgaaatctccaacatcagtctcaccactcaggcaaaactgctgagggtgctgcaggagcgggagattacccccatcggcggtacccagccgatccccatcgacatccggctcgtggccgccaccaacaagaatctgcgcactctcgtctcccaagggacgttccgggaggacctcttcttccggctcaacatcattcccattgatctgccgcccctacgggagcgcaagggcgatctccacctcctcatcgggcattttctcgccaccttttccgaggagatggggcgggatatccgcgggctagcccctgatgccctggcccttctggaagactatgccttcccgggcaacgtacgggagcttgagaacatcattgaacgggccgttgttctcgcagagggagacctgattcagaaggaggacctggagcttcgcgtcgctacggactcccaggccggggttggtggctatgttccccagaatgtggaagagctcaaggagacaaagcgccagatacgggagcgggccgtggagcccatagagaaggcgttcgtgctccaggcgctcaagcgcaacaactggaacattaccagggcagccgaagagacggggatgttgcgtcccaactttcaggcattgctcaaaaaactccggatttcagtacgtaaccagatgacgaactga

SEQ ID NO: 43926 - protein, 470 aa, Geobacter sulfurreducens PCA
MENIDVLVVDDEAIIREGLRRILEKEGYHVETSASGQIALERLQDENYGLVITDLKMPGMSGMEVLKAIKVLQPEVPVIIITGFSTVDTAVEAMKNGAFDYIAKPFTPDQITEKVRKALEQRAVLLENIFLKKELGEHHGFDIFVGESKEMQKVYRRIIQVAPTDSTVLITGESGTGKELVARAVHNNSHRRDNPFVAVDCTSLAENLLESELFGHIKGSFTGAIQTKTGLFKVADGGTLFLDEISNISLTTQAKLLRVLQEREITPIGGTQPIPIDIRLVAATNKNLRTLVSQGTFREDLFFRLNIIPIDLPPLRERKGDLHLLIGHFLATFSEEMGRDIRGLAPDALALLEDYAFPGNVRELENIIERAVVLAEGDLIQKEDLELRVATDSQAGVGGYVPQNVEELKETKRQIRERAVEPIEKAFVLQALKRNNWNITRAAEETGMLRPNFQALLKKLRISVRNQMTN

SEQ ID NO: 43927 - DNA, 1398 bp, Geobacter sulfurreducens PCA
  CDS (1)..(1398)
atgctcaaggcgaaaatactcatttgcgacgatgaagaaggaatccggcgctaccttcagaagatgttccaggccaaggagttcgaggtggagacctttgccgacggcacgagcctgctggcccggatcgaggccggcaccgacggcgatgcggacatcctgctccaggatgtgcggatgcccgacatggacggcatcgaagtgctcaagcgggtcaagaagctccgcccctccctgccggtggtggtcatgaccgccttcggcaccatcgattcggccgttgacgccatcaagctgggggcctacgactacgtcaccaagccgttcccgcgcgagaagatcctcggcgtcatcgacaacgcccttgagctggacctgctcatgaaggagaacaaggccctcaaggaggagctggcgcggcccgacacccccgacaacatcatctttaccagcgccaagttccgggaggtctacgaactcaccctccaggtggccggcagcgacgccaacatcctgattctcggcgaatccggcaccggcaaggagctgatcgccggcgccgtccactacaacagcccccgccgggggcggcgtttcctctccatcaactgcgccgccctgtccgacacgctgctcgaaagccagctcttcggccacgtgcgcggcgccttcaccggcgccatcaccacccagaaggggcttctggaggaggccgacggcggcaccctcttcctggacgagatcggcgacgtgtcggccgcggtccaggcgaagctgctccgggttatccaggagcgtgacttcatcccggtgggcgccaccaaggccaagaacgtggatatccgcttcgtggccgccaccaacaaggatctggccaaagaagtacgggaggggcgcttccgcgaagacctctactaccgcctgaacgtcatcaccatcaacctccctccgctgcgggagcggaccgaggacatcattcccctggccgagcatttcctccagaagtactcccgtcgcgtcaggaaagagctgaagggaatctcgcccgaggcggcccaggtactgcaggcctaccactggcccggcaacgtccgcgagctggagaacgtggtggagcgggccgccatcctcgcccggggggagttcgtgacccccgacgtccttcccatgtaccggcaggcagcaggagcccccgcccctatcgccccgccgaaggaagaccgtcttatctcccttgaggtgatcgagaaggagcatatcgagcgggtcctccaccagaccggctggcacaagagccggtccgccgagatcctgggcatctcgcgcaagaccctcgaccgcaagatcgtcgagtacgccctgaccctcccgggaggcgtcccggccgacgacgaatga

SEQ ID NO: 43928 - protein, 465 aa, Geobacter sulfurreducens PCA
MLKAKILICDDEEGIRRYLQKMFQAKEFEVETFADGTSLLARIEAGTDGDADILLQDVRMPDMDGIEVLKRVKKLRPSLPVVVMTAFGTIDSAVDAIKLGAYDYVTKPFPREKILGVIDNALELDLLMKENKALKEELARPDTPDNIIFTSAKFREVYELTLQVAGSDANILILGESGTGKELIAGAVHYNSPRRGRRFLSINCAALSDTLLESQLFGHVRGAFTGAITTQKGLLEEADGGTLFLDEIGDVSAAVQAKLLRVIQERDFIPVGATKAKNVDIRFVAATNKDLAKEVREGRFREDLYYRLNVITINLPPLRERTEDIIPLAEHFLQKYSRRVRKELKGISPEAAQVLQAYHWPGNVRELENVVERAAILARGEFVTPDVLPMYRQAAGAPAPIAPPKEDRLISLEVIEKEHIERVLHQTGWHKSRSAEILGISRKTLDRKIVEYALTLPGGVPADDE

SEQ ID NO: 43929 - DNA, 1371 bp, Geobacter sulfurreducens PCA
  CDS (1)..(1371)
gtgaacgaaacgatactcgtcgtggacgacgaacaggacatccgcacggccctggccggcattctggaggacgaggggtaccggaccgccttcgcgcgcgacggcgtcgaggccctggagacggtccagaaagatcggcccgacctggtgcttttggacatctggatgcccaggctggacggcatggagaccctccaacggctcaagacggccgaccccggcctcacggtggtcatgatgtcgggccacggcaccattgaaacggcagtgaagtccaccaaaatgggggccttcgacttcatcgagaaacccctctccctggaaaagatcctggtcacggtccgcaacggcctggacgcaggacggctccgggccgagaacgattcgctgcgcgccctgagcttcaggggacacgagatcatgggggagtcggaggccatgggacggctgcgggagcaagtccggctggccggcccggccgacgcgccggtgctcatcaccggcgaaaacggggccggcaaggaactggcggcccggtcgctgcactaccacagcccccgccgcgaccggcccttcgtggaactcgactgcgccgccctgcccgaagaactcatcgagagcgagctcttcggccacgaaaagggctttgccggtgccgcgacccagaaaaaggggaagctcgacctggccaacggcggcaccatgtttctggatgagatcggcgacatgccgccccgcgcccaggcgaagctcctgcgcctcatccaggagcggaaattcgagcgggccggtggaactaggtccatcgaggcggacgtgcgcatcatggccgccagcacgaggaatctggaggaagaggtccgggcgggccgcttcagccccgacctgttttaccggctgaacgtggtcagcctcgcggtgccgccgctgcgggagcggcaggatgacatcgtgccgctggtggagcacttcctcgacatcttcgcccgccgggagggccaggaacgcaaaaccatgcctcccgaagccttggccatcctggcccggcacgactggcccggcaacgtgcgggagctgcgtaccatcgtggagcggctcgtcatcatgaccccggggcgggtgatcaccccggacagcattcccccgtcgattggcgaaggcgcgggtcgcgagggagttctgccccgaagcgaggccgccctggagccctcgtcgctccgagaggcacgggaagaattcgagcgggaattcatcatccagaaactggaggagtacggctggaacatctcgcgcaccgccgacgccatcgagctggagcggagcaacctctaccgcaagatgaagagttacgggatcgacgctaaaaaatga

SEQ ID NO: 43930 - protein, 456 aa, Geobacter sulfurreducens PCA
MNETILVVDDEQDIRTALAGILEDEGYRTAFARDGVEALETVQKDRPDLVLLDIWMPRLDGMETLQRLKTADPGLTVVMMSGHGTIETAVKSTKMGAFDFIEKPLSLEKILVTVRNGLDAGRLRAENDSLRALSFRGHEIMGESEAMGRLREQVRLAGPADAPVLITGENGAGKELAARSLHYHSPRRDRPFVELDCAALPEELIESELFGHEKGFAGAATQKKGKLDLANGGTMFLDEIGDMPPRAQAKLLRLIQERKFERAGGTRSIEADVRIMAASTRNLEEEVRAGRFSPDLFYRLNVVSLAVPPLRERQDDIVPLVEHFLDIFARREGQERKTMPPEALAILARHDWPGNVRELRTIVERLVIMTPGRVITPDSIPPSIGEGAGREGVLPRSEAALEPSSLREAREEFEREFIIQKLEEYGWNISRTADAIELERSNLYRKMKSYGIDAKK

SEQ ID NO: 43931 - DNA, 1404 bp, Geobacter sulfurreducens PCA
  CDS (1)..(1404)
gtgccgatcgtgtcagataaaaagcgcatcatgcttatcgataacgaagaagggctctgccgcatgatggaggcggtgctcgccgacagcggctatgccgtgaaggggtatacccgctccttcgaggcggtggaggagttcaaggccggcgattgggatctggtggtgagcgacatcaagatgcccggcatggacggtcttgaggtgctccagcggatcaaggccaaggatccccttgtcccggtcatcatgatcaccgcctacgccacggtggagacctcgatccaggcgctccggcgcggggcctacgacatggtcaccaagcccttcgagcccgaggagctcctctaccgggtcaagaacgccctcaagcacacccagcttctggaagagaaccgggaactgcgggaagagctggtgggcaagttccgcttcgacaacatcatcggcgcatccaccggcctcaaggatgtgctggacaaggttgagaagatcgctatccgcgacacgtcggtcctgatcaccggcgagtccgggaccggcaaggagctcatcgcccaggccatccattacaactcgctgcgcaaggaaaagaagttcgtggccatcaactgcggggcgctgcccgaatcgctgctggagagcgagttgttcggctaccgcaagggggcctttaccggcgccaaggagaaccgccaggggctcctggaggcggccgacggcggcacgctctttctggacgaggcgggcaacctccccatgaacgtgcagaagacgctgctccgctttctccaggaacaggagtttctgcgcatcggcgacaccacccccaccaaggtcgacgtgcggatcatctccgccaccaatgccgagctgaaggaggcggtcaagagcggtgccttccgcgaggatctttactaccggctcaacgtgctgaatcttcacctgccccccctgcgggagcggcgggccgacatcccgctgctggcggcccacttcatcacgctgcagaacaagaaattcggcaccgccatcaaggggctcgcccccgacgcgttggaggcggtcatggagttctcctggccggggaatatccgccagctcaagaacgtgatcgaagcctgcaccgccatggaaaacggtgattatctctcgctggccgtgctttcgcagttcatcgagatatctcaccatgtgcccggggaagaaggggacacggccggcgatgtggatgagagcgactattcccaggccctgtcgcggttcgaggtcgactacctgaaggggctcctgcgcaagaatcgcggcaacgtggaggctgcggcccgcgatgcggggatgaacatggccaccatctaccgcaagctcaagaagtacaatatccgccgcgaagactacgcctga

SEQ ID NO: 43932 - protein, 467 aa, Geobacter sulfurreducens PCA
MPIVSDKKRIMLIDNEEGLCRMMEAVLADSGYAVKGYTRSFEAVEEFKAGDWDLVVSDIKMPGMDGLEVLQRIKAKDPLVPVIMITAYATVETSIQALRRGAYDMVTKPFEPEELLYRVKNALKHTQLLEENRELREELVGKFRFDNIIGASTGLKDVLDKVEKIAIRDTSVLITGESGTGKELIAQAIHYNSLRKEKKFVAINCGALPESLLESELFGYRKGAFTGAKENRQGLLEAADGGTLFLDEAGNLPMNVQKTLLRFLQEQEFLRIGDTTPTKVDVRIISATNAELKEAVKSGAFREDLYYRLNVLNLHLPPLRERRADIPLLAAHFITLQNKKFGTAIKGLAPDALEAVMEFSWPGNIRQLKNVIEACTAMENGDYLSLAVLSQFIEISHHVPGEEGDTAGDVDESDYSQALSRFEVDYLKGLLRKNRGNVEAAARDAGMNMATIYRKLKKYNIRREDYA

SEQ ID NO: 43933 - DNA, 1362 bp, Geobacter sulfurreducens PCA
  CDS (1)..(1362)
atgaaagagcggaccaaaatcctcctgatcgacgatgaagaaacgggacgcgaagccctcaccctcctgctgaaggcggccggtcatgcggtgaaaagcgccggggcgggcagcgaggccttccagacccttactcgcgacaccttcgacattgtcattaccgacctttttctccccgacgccagcggtatcgacatcctgaaaaaagtcaaggaagacgccccgctcaccgaagtgatcctcatcaccggccacgcctcggcagaaacggcagtgaaggcgatgaaagagggtgctttcgactacatcaccaaacccctcaacttcgacgaactgaagatcattatcggcaaggccgtggagaagcggcagctcttgtccgaaaacgtctacctccggaagcagctgcgcgacaagttcgaattcgccaatatcatcggcagctctcccgccatgcagcacgtcttcgccctcatgaagcggatcgtcaaaaccgactcgaccgtgctgatagccggcgaatcggggaccggcaaagaattggtggccaaggcgatccacttcaacggcgggcgacgcgacaaaccgttcattgccgtccactgcggggctatcccggaaaacctgctggaatcggaacttttcggctacgtcaagggtgcgttcaccggtgcgatgcgggacaaaatcggcaagttcgaagcagccaacggcggaaccatcttcctcgatgaaatcggcaccatgccgatgcagttgcagacaaagctcctgcgcgtgcttcaggaagaggaagtggaacgagtgggctccacccgccccgtcaagatcgatgtccggatcatatcggccaccaacctggatctggcggaggaggtcaaaaagggcaacttcagggaagatctcttttaccggctcaacgtgatccccctgcagctcccccccttgagggagcgggtcgaggacatcctccccctggccaaacactttcttgccaagtactgcaaggagatgcagcgacggaacatgtcgcttgccagcgacacgctcgaggcactggaaagctaccagtggcccggtaacgtgcgggagctggagaacgtcatggagcgggtggcggcccttaccgaagacaacaccgttaccgttcaggacctgccgcacaatatccgggaggagggattgacccgcctgaccggcaagggggtcgacctcgtaaaggtgctggctgaaatcgagcgggggatgatcagggacgcgctggtcctgtcagagggggtcaaggctagggccgcggcgctgctcaacctgaacaggacaaccctggtggaaaagatgcggcggctcggcatgccgctctga

SEQ ID NO: 43934 - protein, 453 aa, Geobacter sulfurreducens PCA
MKERTKILLIDDEETGREALTLLLKAAGHAVKSAGAGSEAFQTLTRDTFDIVITDLFLPDASGIDILKKVKEDAPLTEVILITGHASAETAVKAMKEGAFDYITKPLNFDELKIIIGKAVEKRQLLSENVYLRKQLRDKFEFANIIGSSPAMQHVFALMKRIVKTDSTVLIAGESGTGKELVAKAIHFNGGRRDKPFIAVHCGAIPENLLESELFGYVKGAFTGAMRDKIGKFEAANGGTIFLDEIGTMPMQLQTKLLRVLQEEEVERVGSTRPVKIDVRIISATNLDLAEEVKKGNFREDLFYRLNVIPLQLPPLRERVEDILPLAKHFLAKYCKEMQRRNMSLASDTLEALESYQWPGNVRELENVMERVAALTEDNTVTVQDLPHNIREEGLTRLTGKGVDLVKVLAEIERGMIRDALVLSEGVKARAAALLNLNRTTLVEKMRRLGMPL

SEQ ID NO: 43935 - DNA, 1383 bp, Geobacter sulfurreducens PCA
  CDS (1)..(1383)
atggctgaagagcggcaacctgcccgggtgctgatcgtcgacgatgacgtatcgctgcgccgggtactcgaatacaacctccaggaggaggggtacgacgtgatcacggcgggcagcggcgaggaggggctgcgcctgttcgatgagcgttcgccggccctggtggtcaccgacctgaaaatgcccggcatggggggattccggctcctgcaggaaatcaagggacgttcgcccgacacggcggtcatcgtgatcaccgcctttggtgccgtggagacggcggtcgacgccatgaaagccggggcctacgactacatcaccaagcccttcaaccgtgatgccttgaagctgacggtgaaaaaggccctggagatgctcgggctttcccgggaaaaccgccgcctgcgggaggctctcacggagcgggaggattaccggagtatcgtgggcatctcccgccggatggaggaggtcttccgggtcgtggaccgggtggccgacacggacgctacggtcctcatcaccggcgaatccggcaccggcaaggaactggtggcccgtgccgtgcacacccgcagctcacggagagcagcccccttcgtggcggtcaactgcgcggccatcccccgcgatttgcttgagagcgagctgttcggccacgtcaagggttccttcaccggcgctgtgcgcgacaaggcgggaaaattccagcaggccgagggagggaccctcttcctcgacgaagtgggcgagttgcccgttgaactccagtcgaagctcctgcgggcgctccaggaaaaggaggttcagcaggtggggggcaccgaggtccggaagctggacgtccgggtggtggccgccaccaacgccgatctggagcaggccatcgaggagggccgcttccgcgaggacctctactaccgcctctcggtcataccgattcacctgccgccgctgcgggagcggaaagaagacatccccctgctggtgcgccactttgctgcgcggcacggcggcgatcgggtagcctttgccccggagaccctggaggtcatggctgactatggctggccgggcaacgtccgggagttggaaaataccgtggagcggctcctcatcatgcgctgcagcgacactatcaccccggcggaccttcccgacaaggtacgcagccgccgcgcaccgtcgacggaatgtcccgttatcagcctacccgacgagggatactcccttgagcaactggagcgggaaatcgtggtggaagccctggaacggaacaactggaatcagagttcggcggcgcgctttcttcgcattccgcgccatacactcatctacaggatggagaagtatcagatcactgcaccggagagaaaaaaatga

SEQ ID NO: 43936 - protein, 460 aa, Geobacter sulfurreducens PCA
MAEERQPARVLIVDDDVSLRRVLEYNLQEEGYDVITAGSGEEGLRLFDERSPALVVTDLKMPGMGGFRLLQEIKGRSPDTAVIVITAFGAVETAVDAMKAGAYDYITKPFNRDALKLTVKKALEMLGLSRENRRLREALTEREDYRSIVGISRRMEEVFRVVDRVADTDATVLITGESGTGKELVARAVHTRSSRRAAPFVAVNCAAIPRDLLESELFGHVKGSFTGAVRDKAGKFQQAEGGTLFLDEVGELPVELQSKLLRALQEKEVQQVGGTEVRKLDVRVVAATNADLEQAIEEGRFREDLYYRLSVIPIHLPPLRERKEDIPLLVRHFAARHGGDRVAFAPETLEVMADYGWPGNVRELENTVERLLIMRCSDTITPADLPDKVRSRRAPSTECPVISLPDEGYSLEQLEREIVVEALERNNWNQSSAARFLRIPRHTLIYRMEKYQITAPERKK

SEQ ID NO: 43937 - DNA, 1377 bp, Geobacter sulfurreducens PCA
  CDS (1)..(1377)
atggaaattcatgttctcgtagtggacgatgaactgagcatgcgcgaattcctcgccatcctgctcgaccgggagggctataccgtcgaccaggccgccagcgccgaagaggcgctggcctgtcttgaacgcaagacgtatgatctggtcatctccgacgtaaagatgccggggcttgatggcattaccctcctgggccgcatcaaggagatgacgcccgacactgccgtcctcctcatgacggccttttccactgccgagcaggccgtggaagccatgaagctcggggcgtacgactacattgccaaacccttcaaggtggaagaggtcaagattctcgcccgcaacgccctggaaaagagggatctcaagagggagaacctgcggcttcgccaggaggtgcaggagcggtacagcttcagcggtctgatcggtaagagcaagaagatgcgcgaggtctactccctgatcgaaaaagtggcgccaagtaccgcgaatgttctcattctcggtgagagcggcaccggcaaggagctggtggcccgcgccatccactacaacagccaacgcaagggaaaaccctttgtggcggtcaactgcggcgccattcccgaaaccctcatggagagtgaattcttcggtcacaaaaagggggcgttcaccggcgccgttggtgaccgggcggggctcttcgagcaggccgagggtggtacccttttcctggacgaaatcggagaagtgccgctccagcttcaggccaaacttttgcgggccatccaggaaaaggaattccgcagggtagggggaacccttgaccagaaggccgacgtgcggctggtggccgcctccaatcgtgatttggaagagcaggtgaaggaagggagtttccgggaggatctcttttatcgcctcaacgtggtccaggtcaaaatgcccccactccgtgagcgtggagatgatatccccatcctggttgagcacttttacaaaaagtacgtccagcccccctacagcgaccgcatcataacccagggggcgctgaagctgctcatgtcatacggatttccgggcaacgtccgtgagctggagaacctggtcgagcgctgctccgtgctcggcaatcgcgagatctcggaagaatgtctcccgccgcagctccacgcgggtaaacggcctgaatgtggcgcggtcaccgagtgcgaactgccggaagagggcatggacctcgaagcctacctggacggcattgaaaagcgaattctgcttcaggcactggaacgcagcggcggtgtgaaaaagaaggcggccgaacttttgaagcttacgttccgttctttccggtatcgcctggcaaaatttggcatggatgaggagtga

SEQ ID NO: 43938 - protein, 458 aa, Geobacter sulfurreducens PCA
MEIHVLVVDDELSMREFLAILLDREGYTVDQAASAEEALACLERKTYDLVISDVKMPGLDGITLLGRIKEMTPDTAVLLMTAFSTAEQAVEAMKLGAYDYIAKPFKVEEVKILARNALEKRDLKRENLRLRQEVQERYSFSGLIGKSKKMREVYSLIEKVAPSTANVLILGESGTGKELVARAIHYNSQRKGKPFVAVNCGAIPETLMESEFFGHKKGAFTGAVGDRAGLFEQAEGGTLFLDEIGEVPLQLQAKLLRAIQEKEFRRVGGTLDQKADVRLVAASNRDLEEQVKEGSFREDLFYRLNVVQVKMPPLRERGDDIPILVEHFYKKYVQPPYSDRIITQGALKLLMSYGFPGNVRELENLVERCSVLGNREISEECLPPQLHAGKRPECGAVTECELPEEGMDLEAYLDGIEKRILLQALERSGGVKKKAAELLKLTFRSFRYRLAKFGMDEE

SEQ ID NO: 43939 - DNA, 1437 bp, Geobacter sulfurreducens PCA
  CDS (1)..(1437)
atggggaccaaacttctggtactcgacgacgattcggtggttcttgaacaactgaagcaggtcttcggcgccgaaggctatgaagtctttaccgtcagccaggatcgggaggcctatcgcatcatcgctgctgaacatccgaacgtggccatcatcgatctgaaccttgagggcgcctcggggctcgatgtgctgcgtgaggcgaaacggctcgaccatgccctcgccgtaatcatcaccaccggctcccgggccacccgcaatgccatagaggccatgcggcagggagcctacgattacattatcaagccgttcaacctgccggctctgaccgagacggtccgcaaggccgtcgaatgcaacctcatgacccggacggtccgcttcaccggtggcggcggcggtatcgacgacgatgtcgattatgaagacgtgatgatcgggtcttcgccggagatgctcgaagtctggaagatggtcgggagggtcgccgattcggatgcatcggtgctgattcagggggagagcggtaccggcaaggagcttctcgcccgagccatttaccactattcacgtcggcgccaccgtccgtttcttgcggtcaactgtgcggctctgcccgaaacgctgcttgaaagcgaactgttcggccacgaaaagggtgccttcaccgatgcccactcgcgtcgcatcggcaagttcgaacagtgcaacggcggaacgatttttctcgatgaagtggcggagatgagcctcgccaaccaggggaagctcctgcgggtgcttgagaaccaggagttcgagagggtgggggggaacgagacggttcgggtcgacgtgcgcgtgctcactgccactaatcgcagcctagtgcaggccgtgaaggaaaaagccttccgtctcgacctcctctatcgtctgcgcgtggtctcgttctacctgccgcccctgcgggagcgggtcgaggacgtcccccttctgactgatttgttcatcaagaccttttcccggaaacacggcaagaagatcaaaggaatcgcccccagggcactggagatgctgaaggtgggacattgggaaggaaacatccgcgagctgaaaaatgtcatcaattcggcaactgtcctctgcaagggagactttctcatgcccgaggacttcgcgccactactgcccgctgccgtgttgccgcgaaaggtcgagggaggtgtgggtgacgattacttcggatttttcaggaaggttctagagccggagtttgataccctgtgccggaagagcaaaggggccgtgttcgaaaccgtcagcagtagtctgcagggagcattgatccggctggcccttgaacgatgcggcaacaatcaggtagtggcggcccgccttctcggcataagtagaaataccctacgcgaccgattggcccgctcggaagggtga

SEQ ID NO: 43940 - protein, 478 aa, Geobacter sulfurreducens PCA
MGTKLLVLDDDSVVLEQLKQVFGAEGYEVFTVSQDREAYRIIAAEHPNVAIIDLNLEGASGLDVLREAKRLDHALAVIITTGSRATRNAIEAMRQGAYDYIIKPFNLPALTETVRKAVECNLMTRTVRFTGGGGGIDDDVDYEDVMIGSSPEMLEVWKMVGRVADSDASVLIQGESGTGKELLARAIYHYSRRRHRPFLAVNCAALPETLLESELFGHEKGAFTDAHSRRIGKFEQCNGGTIFLDEVAEMSLANQGKLLRVLENQEFERVGGNETVRVDVRVLTATNRSLVQAVKEKAFRLDLLYRLRVVSFYLPPLRERVEDVPLLTDLFIKTFSRKHGKKIKGIAPRALEMLKVGHWEGNIRELKNVINSATVLCKGDFLMPEDFAPLLPAAVLPRKVEGGVGDDYFGFFRKVLEPEFDTLCRKSKGAVFETVSSSLQGALIRLALERCGNNQVVAARLLGISRNTLRDRLARSEG

SEQ ID NO: 43941 - DNA, 1335 bp, Geobacter sulfurreducens PCA
  CDS (1)..(1335)
gtgcagggtcttgttcttatcgtcgacgatgagccgaatgcggccagggttctttcggcaatcctggccggtgaagggcataccgtacttaccgcttctgatgcctcaaaggcagagcatatcctcaagtcgcgcgacgttgacgctatcataaccgacctgcgcatgccgggcagggatggcatgcagttgttcgagcacgtgaccgaacatctgccggatattccggtgatttttctgaccgcctacggaacggtcgactccgccgtcaacgccatcacccgtggcgccttttactatttcatcaaacctcctgattacgtgaagctcaagagcatggttgcgcgagccgtggagcagcgcgcactcaagcgcgaagtggccgagctgcgcaaacgggtggctgcgggcagcggggctgatcggattatcggtgtcagtccgggaatgctcaaaatattcaatacgatcgaggcggtcaaggactccatgagcagtgtgctggtcagtggggaaaccggaaccggcaaggagctcatcgcccgttcgctccattacggcagtgtgcggcgcgatcgccctttcgtggccgtaaactgtgcagccataccccgcgagctcatggagtcagagctgttcggttatgagaaaggagcgttcagcggcgcttccgcccgtcgaatcgggcgcttcgaagctgctgccgatggcactatatttctcgatgaaatcagcgagttggagctctctctccaggcaaagctgctgagagtgctccaggaaaaggaggttgagcggctcggcagcaatcgcaagatcaaggttaacttccgggtgatttcatccacaaaccgtgatctcatgcgtgaaatagctgccggtacgttccgggaagatctttactaccggctcaatgtcgtccagttgaatgtaccgtctctgcgcgaacgcagagaggatattcctctcctggtctccgagttcgtcaaagagtttggtctcagggagggcaagtcccttactctttctgacgatgtgttgcgcgctcttgtcggctacgagtggcccggcaatatcaggcagctgcgtaacaccatcgaacgggccgtcgtcctcgcccgcggagctaagatcaccctgaagcacttgcctgaggaggttgccgctggtgccggttgtcgcgacgtagccgagccgcggacgctccgcgaacttgaggaggaggcaatccagagtgccctgcgggaatgccggggcaataaatcactggttgcgaagaagctcggcatatcccgcaagaccctttataagcgtctggagcaactgggactttga

SEQ ID NO: 43942 - protein, 444 aa, Geobacter sulfurreducens PCA
MQGLVLIVDDEPNAARVLSAILAGEGHTVLTASDASKAEHILKSRDVDAIITDLRMPGRDGMQLFEHVTEHLPDIPVIFLTAYGTVDSAVNAITRGAFYYFIKPPDYVKLKSMVARAVEQRALKREVAELRKRVAAGSGADRIIGVSPGMLKIFNTIEAVKDSMSSVLVSGETGTGKELIARSLHYGSVRRDRPFVAVNCAAIPRELMESELFGYEKGAFSGASARRIGRFEAAADGTIFLDEISELELSLQAKLLRVLQEKEVERLGSNRKIKVNFRVISSTNRDLMREIAAGTFREDLYYRLNVVQLNVPSLRERREDIPLLVSEFVKEFGLREGKSLTLSDDVLRALVGYEWPGNIRQLRNTIERAVVLARGAKITLKHLPEEVAAGAGCRDVAEPRTLRELEEEAIQSALRECRGNKSLVAKKLGISRKTLYKRLEQLGL

SEQ ID NO: 43943 - DNA, 1368 bp, Geobacter sulfurreducens PCA
  CDS (1)..(1368)
atgaaaaagcggatactggtcgtcgacgacgaagaaaacatgaggcacatgctgtgcgccatgctccgcaagcagggctacgaggcggtggaggccgccgatggcgaagcggccctggcccaggcatccgctgctgcctacgactttatcctctgtgacatccggatgccgatcatggatggtgtcgggtttctgcggacctttcagaaggccgaactccccggcaccgttatcatgatgtccgcctatggtaccgtggatgccgccatcgcctgcatgaaggaaggggcctacgattacgtttcgaaaccgtttaaaaacgacgagatcctgctggtcctcaggaaggcggaggagcgcgagcgacttaaaaatgaaaaccgccggttgcgggaagtggtggggcgagagtatgcgttcggcagcattgtaagccgtaacccgcgcatgcgcgagatcttcaaccttatccgcaaggtgtgcgacgtgcggaccaccgttctcatcctcggcgagtcgggaaccggcaaggagctggtggcgcgggccatccaccataacggcagccgcagtgacggaccctttgtggcggtcaactgcggcgcaattcccgaaagccttctggagtcggaactgttcggtcacgttcgcggcgcctttaccgatgcctcgtcggaccgcgccgggcttttcgaggaggccaacggcgggacgctttttctcgacgagatcggtgaaatgcccccggcgctccaggtgaagcttttgcgcgtactgcaggagggtgaggtccggcgagtgggcggatccaaagcccagcgcgtcgatgtccggatcatttccgccacctctcgggatctggcccgggatgccgcggaggggcgttttcgcgaggacctttttttccgcctcaatgtgttcgccattaccctgcctcccctgagggagcggttggaagacatccctctactcgtgaaccacttcctgcacaagtacggtgagtctttcggccggtccggaatggtcgtgtcgccggaggccatgaagctgcttgctgcctatggctggcccggcaatgtgcgagaacttgaaaactgcattgagcgcgcgttcattctcagcgacggagaaatcctcgatgccggaagcctgcccgatgttgtgcggggagactcggccgcatcggcggcggggttccacctgcccgaggataccctttccatcaagcgggccgaagagtgccttgagcgggaattcatccgcagagccctggccaaaaccggcgggaacaggacccatgccgcgcgtttgctggaaatcagccatcgggcgttgctctacaagctcaaggaattcggcatcgattaa

SEQ ID NO: 43944 - protein, 455 aa, Geobacter sulfurreducens PCA
MKKRILVVDDEENMRHMLCAMLRKQGYEAVEAADGEAALAQASAAAYDFILCDIRMPIMDGVGFLRTFQKAELPGTVIMMSAYGTVDAAIACMKEGAYDYVSKPFKNDEILLVLRKAEERERLKNENRRLREVVGREYAFGSIVSRNPRMREIFNLIRKVCDVRTTVLILGESGTGKELVARAIHHNGSRSDGPFVAVNCGAIPESLLESELFGHVRGAFTDASSDRAGLFEEANGGTLFLDEIGEMPPALQVKLLRVLQEGEVRRVGGSKAQRVDVRIISATSRDLARDAAEGRFREDLFFRLNVFAITLPPLRERLEDIPLLVNHFLHKYGESFGRSGMVVSPEAMKLLAAYGWPGNVRELENCIERAFILSDGEILDAGSLPDVVRGDSAASAAGFHLPEDTLSIKRAEECLEREFIRRALAKTGGNRTHAARLLEISHRALLYKLKEFGID

SEQ ID NO: 43945 - DNA, 1395 bp, Geobacter sulfurreducens PCA
  CDS (1)..(1395)
atggaaaagattctcatcatagacgacgaggcgttcatccgcgaaaacgtggagcggatcctcaccgacgacggctatcaggttctctgcgccgcctccggcacggaggcccgcgagatcgttgccgacgaggacgttgacctggtcctgctggacctgaacctgggcaccgaggacggcatcgaggtcctcaaggagctgaaactcctggacccggagctcctcgtcatcatcataaccggcttcggctcggtggagagcgccgtggacgccctgaagctgggcgcgttccactacatgaagaaacccttcaaggcggacgccctgcgggtcatcgtgaaactggcgctccagacccagaccctgcggcgcgaggtccgcaatctccgcaagggggatctgaccctgttcgaaaatgtccccctggtgggggccggcgaggggctgaaggagatcatccgccaggtcaaggaggtggcccgctttcccctctccacggtcctcatcaccggcgagtcgggcaccggcaaggaactggtggcgcgcaccattcaccacctttcggaccggcgcgaggcccccttcgtcgccatcaactgcgcctccatgccggtttcgctgctggaaagcgaactcttcggccacgagaagggggcgttcaccgatgccagccagcgcaagccgggcctttttgaagaagcccacaaggggaccatctttctggacgagatcggcgagatggatgtctccatccaggccaagctgctgcgggtgctggaagaccggaagatcaggcgggtcggcggaacgcggaacatcgacatcgacgtgcgggtgatcgccgccaccaaccgcaacctgcgcgacgccatccgcgaagggaacttcagggaagacctctactatcgtctcaacgtgttccccatccacatcccgccgctgcgggagcggaaagaggatatcccggtcctggcgaaattctacctggaccgttacggccgcaccttcaaccgcagcttccagatcatctcggccgaggccctgcggctgctggaaacgcacccctggcccggcaacatccgcgagatgaaaaacgtcatcgagcggatctgcatcatgcacgacggcccggaactgaccccgaaccaccttccgcccgaaatcaagcagaccgaggggagcgttgccccgccggccacggatgtaagcgcggatctggcccaggggctcgaagcggccaccgaccgctacgaaaagcagctcatcgctgcggccctggccatgaccggcaacaacgtgctgcaggcggcccagattctcaagattccgcgcggaacgctacgctacaagatgacacggcacggattgcacgggggggggagcgacgggggatag

SEQ ID NO: 43946 - protein, 464 aa, Geobacter sulfurreducens PCA
MEKILIIDDEAFIRENVERILTDDGYQVLCAASGTEAREIVADEDVDLVLLDLNLGTEDGIEVLKELKLLDPELLVIIITGFGSVESAVDALKLGAFHYMKKPFKADALRVIVKLALQTQTLRREVRNLRKGDLTLFENVPLVGAGEGLKEIIRQVKEVARFPLSTVLITGESGTGKELVARTIHHLSDRREAPFVAINCASMPVSLLESELFGHEKGAFTDASQRKPGLFEEAHKGTIFLDEIGEMDVSIQAKLLRVLEDRKIRRVGGTRNIDIDVRVIAATNRNLRDAIREGNFREDLYYRLNVFPIHIPPLRERKEDIPVLAKFYLDRYGRTFNRSFQIISAEALRLLETHPWPGNIREMKNVIERICIMHDGPELTPNHLPPEIKQTEGSVAPPATDVSADLAQGLEAATDRYEKQLIAAALAMTGNNVLQAAQILKIPRGTLRYKMTRHGLHGGGSDGG

SEQ ID NO: 43947 - DNA, 1371 bp, Geobacter sulfurreducens PCA
  CDS (1)..(1371)
atgaccgctccgaagattcttgccgtcgacgatgacgagctttctctcttgatgctggagaacctgctggccgatgcgggattcgcccccctgaccgcggtcagcggcgcacaggcgctggcgctgttggagcgggagcatgtggacctgctcatctccgacctgatcatggaggggatgaacggtctggaactcctggatcgggtcagggagcgctacccgaacgtgccggtcatcgtggtcacggcccgggggagcgtggagagcgccgtggaggccatgcggcggggcgcctacgactacctggcaaagcccttcaaccccgaggtgctgaggatcacgctccagcgggccctggactatcaccacgtggtccgcgagaacgagcagatcacggggctgttgcgcgagcggttcaccttccagagcatcgttacggtgaatccggccatgaagaagctgctggagctggccgccagggtggctgcggcgcggcagaccacggtggccatctacggcgaaagcggctcgggcaaggaggtgctggcgcgggccatccactttgccggcaaagggctgcccgccggattcgtggcggtcaactgcgcggccgtgcccgagcacttgctggagagcgagctgttcggccacgtgcggggggccttcaccggggccgaccgggatcgggagggaaagttcagtctggcccgcggcggcacgcttctgctggacgagatcggcgacatgcccctgccgctccaggccaagttgctgagagtcctccaggagcgcgtgttcgaaaagatcggcagcaatacccccatctcgacggattgccgcgttatcgtggccaccaaccgcaacctggccgacatggtggcggccggccgcttccgcgaagacctctatcaccggatcaacgtgtttcccttggtcattccgcctctgcgggagcgcaccgacgacatcccgctcctgtgcgagcacgtcctcgaccagctgcggcagcacctgggcaagccgctgcccggcatctcccagaaggccatggacgccatgctggcccacggctggccgggcaatgtgcgggagttgcgcaactgcctggagcgcgccgcgatcctgaccgacggcgagctgatccggcccgagcacctggggttcggcgcggccggagcccctgcccgggaaacatctgccggaccggcgcccgacacggtgcagtacgccctggcgctgcccgttgaccagttgtcgctccatgccctcaccgagcggatcatggccatcaccctggagcgctgcggcggcaacaagtccagggcggcccagctcctcaggatcgaccgcaaggcattctaccggggctga

SEQ ID NO: 43948 - protein, 456 aa, Geobacter sulfurreducens PCA
MTAPKILAVDDDELSLLMLENLLADAGFAPLTAVSGAQALALLEREHVDLLISDLIMEGMNGLELLDRVRERYPNVPVIVVTARGSVESAVEAMRRGAYDYLAKPFNPEVLRITLQRALDYHHVVRENEQITGLLRERFTFQSIVTVNPAMKKLLELAARVAAARQTTVAIYGESGSGKEVLARAIHFAGKGLPAGFVAVNCAAVPEHLLESELFGHVRGAFTGADRDREGKFSLARGGTLLLDEIGDMPLPLQAKLLRVLQERVFEKIGSNTPISTDCRVIVATNRNLADMVAAGRFREDLYHRINVFPLVIPPLRERTDDIPLLCEHVLDQLRQHLGKPLPGISQKAMDAMLAHGWPGNVRELRNCLERAAILTDGELIRPEHLGFGAAGAPARETSAGPAPDTVQYALALPVDQLSLHALTERIMAITLERCGGNKSRAAQLLRIDRKAFYRG

SEQ ID NO: 43949 - DNA, 1374 bp, Geobacter sulfurreducens PCA
  CDS (1)..(1374)
gtgagaaagacaaagatactggtggtggatgacgaacatctcatccgttggtccctcgagcagaacctgaagaagcaggggtatgacgtggtttccgccggtaacggcgaggatgccctgcggatcgtccgcgaggagcagcccgacttggtgctgctcgatatccagctgccgggaataagcggcctggaggctctggaaaagatcaaagaatacgatgaggaaatcctcgtcatcatggtgaccgctcacggcgccctggaaacagcggttcatgccatgaggctcggcgcctacgattacatcaacaagccgttcaatctggacgaaatgtccatcgtcatccgcaaggccctggaaacctccgatctgcgtcgggaggtccagcggctccgcagcgaacagtcgcgcaagttcggccccccagacatcatcggtgccagccggcacatgaaaaacgtcctggaaatgatggaaaaggttgccaagagtgatgcctccacggtcctgatccagggggaatccggcaccggcaaggaactggtggccaagtggatccattaccagtctgcccgcgcggaaaagccgtttgtggccatcaactgcgcggcagtacctgccacgcttctggaaagcgagcttttcggccatgagaaaggcgcctttactgacgccaaggtgatgaaaaaagggctcttcgagttggccgacgggggtaccgttttcctcgacgaaatcggcgacatggagatgggaatgcaggcgaagctcctgcgcttcctggaggaaaggaccttccgccggatcggcggcaccaaagcctttgccgttgatgtccggatcatctccgccaccaaccgcgacctgctgaaggccattgaggagaagaatttccgcaacgatctctactaccggctccaggtgattcccatttacctgcccccgctccgggagcgcaaggaagacatcctgcaactggtcaaccacttcatcgaggtgttcaaccgcgaattcaacaagcacgtgaccggcatctcgaagatggccgagaagctgctcctggaataccactggcccggcaatatccgtgagctcaagaacgtgatcgagcgggccatcatcctcggcaacgaagatacgctgctgctggagcacctgcccctggagatcgttgccaaggcatcgaaccagaccacgggcttggcgaccttcaagctgccgcctgacggggtcgatattgaagaggttgaaaaggagctgatccgccagtccctggagatgagtgagtggaaccagtccaaggctgccaagaagctgaacctgggaatcgatgcgttccgttaccggatgaagaagttcggcttccttaaataa

SEQ ID NO: 43950 - protein, 457 aa, Geobacter sulfurreducens PCA
MRKTKILVVDDEHLIRWSLEQNLKKQGYDVVSAGNGEDALRIVREEQPDLVLLDIQLPGISGLEALEKIKEYDEEILVIMVTAHGALETAVHAMRLGAYDYINKPFNLDEMSIVIRKALETSDLRREVQRLRSEQSRKFGPPDIIGASRHMKNVLEMMEKVAKSDASTVLIQGESGTGKELVAKWIHYQSARAEKPFVAINCAAVPATLLESELFGHEKGAFTDAKVMKKGLFELADGGTVFLDEIGDMEMGMQAKLLRFLEERTFRRIGGTKAFAVDVRIISATNRDLLKAIEEKNFRNDLYYRLQVIPIYLPPLRERKEDILQLVNHFIEVFNREFNKHVTGISKMAEKLLLEYHWPGNIRELKNVIERAIILGNEDTLLLEHLPLEIVAKASNQTTGLATFKLPPDGVDIEEVEKELIRQSLEMSEWNQSKAAKKLNLGIDAFRYRMKKFGFLK

SEQ ID NO: 43951 - DNA, 1413 bp, Bdellovibrio bacteriovorus HD100
  CDS (1)..(1413)
atgaccaataagctccacacactgattgttgatgacgaggccgaactgcgccgctcggtgatttccatcctgaaatccaccatgcccgaaattgaattcaccatcgaagaagcggccacaggcaaagaagccctggacaaagtgaaacaacagcagtgggatctggtactgatggatgtcaagatgccggagatgaacggccttgaagccctgacagccatcaaagaacacgatccacgcaccttcgtggttttgatgacggctcactccaaccttcatgacgctgttgtggcgatcaaagaaggcgcttacgactacgtcgaaaagccagtgcagccgcaacaactggccgaaatcgtgcgtaaaagtcttgaggcccgtgatctgatctcctctttggcgatgtccaatccggtttttgatgacgacatcgaatccgagatcgtgggtggttcttccaaaatgaaagaggtcttcaacctgatctaccgtctgtgcaaagtcgacacgacggttctggtgcgtggtgaaaacgggacaggcaaagagctggtggcccgcgcgattcatttcaactcccctcgaaaatccggcgcctttgttgccatcaactgtggtgctattccggaaaacctgatggaaagtgaattgtttggtcacgaaaaaggtgctttcaccggcgcggtggaacgcaagatcggcaaattccagctggccaacaacggcactttgttcctggatgaaattggcgagcttcgcccggacatgcaggtgaaacttctgcgcgttttgcaagagcgcaagttcaccccggtgggcagcaatcgcgaagtcaaaaccacgacgcgtattattgccgccaccaaccgcaacctggaaaagatgatggaagaaggcgaattccgcgaagacttgttctatcgcctgaacgtgatgccgatcttcctgccgcctttgcgtgagcgcgctgacgacatcgaagcactggctggaaactttattaagaaattctcaaagcaacacggccgccagatcacagcgatcactcccgaagctttggatatgctgaagtcctaccgctggccggggaatatccgcgagcttgaaaacatcattgaacgttctttcatcgtggaaaacagccaccagatcacggtggattccttaccggactctatcaaactgacgccgaaagatggcgctgataaaacggcaagtgttggttattccggcccgctggatttcgacgccttcaaagaagagatggaaaaggaatttatcgtcagtgccctgaaggccaacaacggccgtatcaatcagaccgtggcgcaggcgaatattccgaagaacaccctgctgcgcaagatccgcaagtacggcatcaatgtgaaggaatacactaacgaagaataa

SEQ ID NO: 43952 - protein, 470 aa, Bdellovibrio bacteriovorus HD100
MTNKLHTLIVDDEAELRRSVISILKSTMPEIEFTIEEAATGKEALDKVKQQQWDLVLMDVKMPEMNGLEALTAIKEHDPRTFVVLMTAHSNLHDAVVAIKEGAYDYVEKPVQPQQLAEIVRKSLEARDLISSLAMSNPVFDDDIESEIVGGSSKMKEVFNLIYRLCKVDTTVLVRGENGTGKELVARAIHFNSPRKSGAFVAINCGAIPENLMESELFGHEKGAFTGAVERKIGKFQLANNGTLFLDEIGELRPDMQVKLLRVLQERKFTPVGSNREVKTTTRIIAATNRNLEKMMEEGEFREDLFYRLNVMPIFLPPLRERADDIEALAGNFIKKFSKQHGRQITAITPEALDMLKSYRWPGNIRELENIIERSFIVENSHQITVDSLPDSIKLTPKDGADKTASVGYSGPLDFDAFKEEMEKEFIVSALKANNGRINQTVAQANIPKNTLLRKIRKYGINVKEYTNEE

SEQ ID NO: 43953 - DNA, 1407 bp, Bdellovibrio bacteriovorus HD100
  CDS (1)..(1407)
atgaagtcgagaattcttgttgtcgatgacgaagaatcaatacgcgagtttttagagatcatgctgaaaaaagaagggtatgaaatcactttggctgaagacggccaaaaggcgaaagaccttcttgcgaaaaaaacatttgatatgatcatctcagacttgcagatgccccatgtgacggggatcgagcttctgaagcacgtcaaagaatcctatccggatacagtcttcatgctgatcacagcgttcggtacaaccgaaactgccgtggaagcgatgaagatgggtgcttatgattatctgacaaaaccattcaaaattgatgaagtccgtctgaacatccagaacgcacttcgttcccgcaacttggaagtggaaaacagatccttgaaaaaggaactggtaaaagaatactccttccagaacatggtggggaattccccggtcatgcatgcgatctacgatatggtcaagcgtgtctcccagacgccaaccaacgttttgatcacaggggaatccggtacgggtaaagaggttgtggccaaggcgattcactataacggtccgttgaaagaccgtccatttgtaacagtgaactgcggtgccatccctgagaacctgatggaatccgaaatgttcggtcacaaaaaaggctctttcaccggtgcggtggctgataaagcgggtctttttgaagtggctgacggcggaacgctgttcctggatgaggtcggtgaattgccattgacgattcaggtaaagcttcttcgtgcgattcaagagcgtgtgatccgccgcgtgggtgcgacggaagacatgaaggtggatgtgcgtatcatcgccgcgaccaaccgtaatttggaagagatggttcaaaagggcggtttccgtcaggatttgttctatcgtctgaatgttatcaatatcaaaacgccgggtcttcgtgagcgtcgtgatgatatcccgcttttggcaaatcacttcctgaaaaagtacaacgaacgtctgaacaaaaacatcggtgcgatcagcgcggatgcgatggaaatcctgaaaaagtacgactatccagggaacgtgcgtgagcttgaaaacatgatcgagcgcaccgtggctttggaaggcggggcgacgattcttccggaatctttgccaccgatggtgaacacctcttccggtcgcaagatggcttcctccaatgaaatcgaaatcggtgacgatggggttgatttggacaaggtgatgggtcagatcgaaaaagaacttctgatcaaagccatccactctgccggcggcgtgaaaaagagagctgcaaagctgcttcatatctccttcagatccatgcgatatcgcattgaaaagtataatctaggcgtagtcggcgacgacgagctcgacgacgaataa

SEQ ID NO: 43954 - protein, 468 aa, Bdellovibrio bacteriovorus HD100
MKSRILVVDDEESIREFLEIMLKKEGYEITLAEDGQKAKDLLAKKTFDMIISDLQMPHVTGIELLKHVKESYPDTVFMLITAFGTTETAVEAMKMGAYDYLTKPFKIDEVRLNIQNALRSRNLEVENRSLKKELVKEYSFQNMVGNSPVMHAIYDMVKRVSQTPTNVLITGESGTGKEVVAKAIHYNGPLKDRPFVTVNCGAIPENLMESEMFGHKKGSFTGAVADKAGLFEVADGGTLFLDEVGELPLTIQVKLLRAIQERVIRRVGATEDMKVDVRIIAATNRNLEEMVQKGGFRQDLFYRLNVINIKTPGLRERRDDIPLLANHFLKKYNERLNKNIGAISADAMEILKKYDYPGNVRELENMIERTVALEGGATILPESLPPMVNTSSGRKMASSNEIEIGDDGVDLDKVMGQIEKELLIKAIHSAGGVKKRAAKLLHISFRSMRYRIEKYNLGVVGDDELDDE

SEQ ID NO: 43955 - DNA, 1512 bp, Bdellovibrio bacteriovorus HD100
  CDS (1)..(1512)
ttggttgtagacgatgatcagggcttaagactttcggtaaagtccgcacttgcggttactcagcgcttcgaagttgatgaagctttcgatggcgtgaatgccatggagaaagtgaaaaacggcgacaagaagtacgaccttgttctgcttgatgtcgacatgcctcgcatgaacggccttgaagcccttcgccagatcaaagaattcgatccaggcatcatcgtgatcatcatgaccgcccacgcgacctttgagtctgccattcaggcagtcaaagacggcgcttacaactatctgcagaaaccagtggcgggtgatgatctgctggctttgatcgacaaagccgtgaacgcccacaatcttatttccaatatcgcagcctctgcccccgtgatggtggaagaaggccgcaagatcatcggccacacatcccagatgcagaaggtgttcaacatcatccaccgtctggcgaaagtggaaaccccggttctaatccgtggtgcttccggtacgggtaaagaactggtggcgaaagccatccacttcaactcggcccgcaaagacgaaaagttcgtggcgatcaactgctctgccatcccggaaaatctgtttgaatcagaattgttcggtcacgaaaaaggctctttcaccggcgctgaccagcgcaagattggtaaattccaattcgctgaaggcggcactttgttcctggatgaagtgggcgacatgcctcagctgatgcaggtgaaaatcctgcgtgtccttcaggaaaaactgttcacgccagtgggttccaaccgtgaattcccaacgaacgtgcgtatcatcgctgcgaccaaccgtcctttggaggacatgatcaaggccggcacctttcgtgaggatctattctatcgcctgaatgtcgtacctatattcctgccggctttggctgaacgcaaagacgacatggaacatatggtgaacatctttatccgcaagttcaaccaggcccatggcaaacgcatcaacggcattgcaccggacgccatggcggttttgaaaaaacacagctggccaggaaacatccgtgaactggaaaacgtgatcgaacacgctttcgttctggaaatgtccaacatcatcacgattgcttctttgccggaagctttgttgatcgcgactggcacaaacctgatcgacgttcctccggttcaggaaaccgctcagaacgtggcgtctgcgggcatcagctctgcagctcaggcacacgcttctttgggtgatgacgaggacagcgatgttggcggcatggacctggacgaagaagacggtgaaatgatcgcttactctggtgaaaatctggatttcaacgcccagaaagaagctttcgagaaagaatttattatcaaggctctgaaaaccttccgcggacgcatcaatcagacagcattgcatgcgaacattccaaagaagactcttctcagaaaaatcgaaaagtacggcatcatcgccaaagactattcaaactag

SEQ ID NO: 43956 - protein, 503 aa, Bdellovibrio bacteriovorus HD100
MVVDDDQGLRLSVKSALAVTQRFEVDEAFDGVNAMEKVKNGDKKYDLVLLDVDMPRMNGLEALRQIKEFDPGIIVIIMTAHATFESAIQAVKDGAYNYLQKPVAGDDLLALIDKAVNAHNLISNIAASAPVMVEEGRKIIGHTSQMQKVFNIIHRLAKVETPVLIRGASGTGKELVAKAIHFNSARKDEKFVAINCSAIPENLFESELFGHEKGSFTGADQRKIGKFQFAEGGTLFLDEVGDMPQLMQVKILRVLQEKLFTPVGSNREFPTNVRIIAATNRPLEDMIKAGTFREDLFYRLNVVPIFLPALAERKDDMEHMVNIFIRKFNQAHGKRINGIAPDAMAVLKKHSWPGNIRELENVIEHAFVLEMSNIITIASLPEALLIATGTNLIDVPPVQETAQNVASAGISSAAQAHASLGDDEDSDVGGMDLDEEDGEMIAYSGENLDFNAQKEAFEKEFIIKALKTFRGRINQTALHANIPKKTLLRKIEKYGIIAKDYSN

SEQ ID NO: 43957 - DNA, 1404 bp, Bdellovibrio bacteriovorus HD100
  CDS (1)..(1404)
atgcgtagccaacgtgtcctgatattagatgatgaatcctcactccgcaccgctctgttccgggtgctggatcgcaaaggcctgaacgtcatcactgccaacaaaatcgaagaagccaaagtactgtgccagggtgacagcccggtggatctggccattgtcgatttgaaccttccggatggcgatggcatcgagttcatgacttatcttaaagcgctgacaccagcgaccgaagtgatcatcctgacgggtcatgccactattgagtccgcgattcgtgcgactcaaaaaggggccttccactttgtgaccaaacccttcaatcttgaagagctgatgagtctgattgaaaaagccctgacgcacaaaaaactgcagcaggaaaatcagcaactgcgctctgaactgaacaagaaatacaaattcgaccagatcatcggcaccagcgaccagattcagaatgttctgcgcatgattgaacgcgtggcagattctgactcgacagttctggtgaccggggaatccgggaccggtaaagagctgattgcccgcgcgattcactataattccccacgcgcacaagggccatttgtaccgatcaactgcggtgcgatcccttctgagcttctggaaagcgaactgttcggtcatatgaaaggggccttcaccggcgccattgccaaccgtgtgggccgttttgaaatggctgacgggggcacgatcttcctggatgaaatcggtgatcttgaaccatccctgcaggtgaaacttctgcgtgctttgcaggaaagaagtttcgagccggtgggatccaccaaaactgtcagcgtgaatgtaagagtgatcgcagcgacaaacctgaatctggaagacgctgtcgaaaacggccgcttccgtgaagatcttttctatcgcctgaatgtgattccaatcaccgtgccggctttgcgcgagcgcaaaaccgatatccctctgctgctgaatcatttcatggatatcttcaacaaaaccaagggccgcggtctgacgggcatcacttctgatgctttggactgtctggtgaattacccttggccgggcaacatccgtgaacttgaaaacctggtggagcgtatgacgatcctgaaaggccagggtcaggtggatatttctgatctgcctttgaaatacaaatccggcaagacggcctcgactgaaatcggcggtctggagatcccggatatgggcatggactttaattcggcggtggacgcttacgaaaacgccctgattctgaaagccctggaaaaaaccggctggaatcgcaatcaggcagcggcgttgctaagactgaaccgcacgacactggtggagaagatcaaaaagaaaggtctgaccccgcccaacgaaatcaccccgatttaa

SEQ ID NO: 43958 - protein, 467 aa, Bdellovibrio bacteriovorus HD100
MRSQRVLILDDESSLRTALFRVLDRKGLNVITANKIEEAKVLCQGDSPVDLAIVDLNLPDGDGIEFMTYLKALTPATEVIILTGHATIESAIRATQKGAFHFVTKPFNLEELMSLIEKALTHKKLQQENQQLRSELNKKYKFDQIIGTSDQIQNVLRMIERVADSDSTVLVTGESGTGKELIARAIHYNSPRAQGPFVPINCGAIPSELLESELFGHMKGAFTGAIANRVGRFEMADGGTIFLDEIGDLEPSLQVKLLRALQERSFEPVGSTKTVSVNVRVIAATNLNLEDAVENGRFREDLFYRLNVIPITVPALRERKTDIPLLLNHFMDIFNKTKGRGLTGITSDALDCLVNYPWPGNIRELENLVERMTILKGQGQVDISDLPLKYKSGKTASTEIGGLEIPDMGMDFNSAVDAYENALILKALEKTGWNRNQAAALLRLNRTTLVEKIKKKGLTPPNEITPI

SEQ ID NO: 43959 - DNA, 1422 bp, Treponema denticola ATCC 35405
  CDS (1)..(1422)
atgaaattcagtattttggttattgatgacgaaaaaaatattcgtgaaggccttgcgatggccttggaagatgaaggctatgaagtaattactgccgataacggaaaaacaggtttggatattgccttaaaagacgaagtcgatcttgtaattaccgatctaaaaatgcctgaaataagcggtgaagaggtcttacgcgaagttatttcaaaaactccgggggttcccgtaattgttttaaccggacacgggacggtagaaacggctgttgaagccatgaggatgggggcctatgattttttaaccaagcccttggatttggaacgcctttttcttttagtaaaaagagccttacaaaacagggcccttgttctgcaaaatagggcactcttacatgacattgaaaccaaacaaagttttgaaaatattataggcaagagccctcttatggaaaaggtttttgagaatataaaaaaagttgcgccgacaaaggccagcgtcttaattaccggagaaaccggagtcggaaaagaattgatagctcgagccattcataatctttcaaaccgtaaagataagccctttgttcaagtccactgtgcgtcctttgccgaaagtcttttggagtccgagcttttcggtcatgaaaaaggagcctttacaggggccgtacaacgcagccgaggccgctttgaaattgcaaacggcggttctctttttttggacgaaataggcgaagtcaatcaaatgatacaggtaaaacttttgcgggttcttcaagaaaaaaagtttgagagggtaggaggttctgaaactattagcgtagatacaaggataatcgccgcaacaaacagggatttggtagaagaaataaaaaaaggaaattttagggaagatctttattttagattgaatgtagttcatattcacgtgcctcccttgcgtgaacgcaaggaggacattcctcttttggttgctgcctttatcaaagactttgcagaggagaacggtaaaaaaatagattctatggaacctcgtgcaagagctgcaatttataattatgagtggccgggaaatataaggcagcttcaaaactgtattcaaagtgccgttgtaatgagctccgataatgtaattcactttgacgacttaccggaaacattgcgcgaaaaggccgaggcttcttcaatccgtataccgatgggagtaaatatggccgaagccgaaaagcaaattattttgcagactcttgcaaaccaaaataataataaatccaagacagccgatattttaggaataggccgaagaaccctccatcgaaaacttgatgaatatgatgcggagattaaagatgatacttcgcgaatgttggaaggaaaagaaaatcaatccaaaaaggaaaaagtaaatggcaaaaaataa

SEQ ID NO: 43960 - protein, 473 aa, Treponema denticola ATCC 35405
MKFSILVIDDEKNIREGLAMALEDEGYEVITADNGKTGLDIALKDEVDLVITDLKMPEISGEEVLREVISKTPGVPVIVLTGHGTVETAVEAMRMGAYDFLTKPLDLERLFLLVKRALQNRALVLQNRALLHDIETKQSFENIIGKSPLMEKVFENIKKVAPTKASVLITGETGVGKELIARAIHNLSNRKDKPFVQVHCASFAESLLESELFGHEKGAFTGAVQRSRGRFEIANGGSLFLDEIGEVNQMIQVKLLRVLQEKKFERVGGSETISVDTRIIAATNRDLVEEIKKGNFREDLYFRLNVVHIHVPPLRERKEDIPLLVAAFIKDFAEENGKKIDSMEPRARAAIYNYEWPGNIRQLQNCIQSAVVMSSDNVIHFDDLPETLREKAEASSIRIPMGVNMAEAEKQIILQTLANQNNNKSKTADILGIGRRTLHRKLDEYDAEIKDDTSRMLEGKENQSKKEKVNGKK

SEQ ID NO: 43961 - DNA, 1293 bp, Yersinia pestis biovar Medievalis str. 91001
  CDS (1)..(1293)
atgaaaggctggggttatcaaaccacgccagcccacaatggattagaggccatcgaactggctaaagagatccctttcgatttaattctgactgatgtgcgaatgtctgaaatggatggtattgaggcattaaaggcaattaaagcctataacccggcaatccctattttaattatgacggcttattccaacgttgaatctgcggttgaggcaattaaagccggggcatacgattatcttaccaaaccgcttgatttcgacatgttacaactcacccttgagcgggcactggaacatacgcatctcaagaatgagaataaaacacttaaacagcagatcatcagtaaccaaaatattattggtcgcagcccacaaatgcgctatctgatggatatggttggcatgattgcgccttctgaagcgacggtgttgatatgtggagaatcgggtacgggcaaagaaattattgcccgctcagttcatgctaacagcgcccgtaaagatcaaccgttggtgattgttaactgcgcggcactcagtgagtcattgctggagtccgagctattcggccatgaaaaaggggcgtttactggcgcagataaacgtcgggaagggcgctttatggaggcacataaggcaacgttatttttggatgagattggtgaaatctcagggttgatgcaggcaaaactcctgcgtgctatccaagaacgggagatccagcgcgttggcagtaatcagacattagatattgatgtcaggttgattgccgccactaaccgcaatcttaaagccgatgttgatagtggaaagtttcgccaggatctctactatcgattaaatgtggtcacgatagataccccggcgttgagagagcgaagcgaagatattccgccgttgtcgatgcatttcttggaaaagtttgcgctcaagaaccgtaaatcaatcaaaggattcacaccgcaagcgatgaatatgctgttgaaatacaactggcctggtaacgtgcgtgaattggaaaatacggtggagcgtgcggtgattttactgaccggtgatttcatcagcgagaaggagttgccgttaaatattaatcattatattcaggagaatgccggtagtgagaatataggttatgaggatgcagaaaaacctatccagtctctcgaatgggtcgaaatagacgctattttgactgcgttggaaaagacgggaggcaataaaacagaggcagcaaaacatttaggcatcacgcgcaaaacattgcaggcaaaattacaaaaaagaacttag

SEQ ID NO: 43962 - protein, 430 aa, Yersinia pestis biovar Medievalis str. 91001
MKGWGYQTTPAHNGLEAIELAKEIPFDLILTDVRMSEMDGIEALKAIKAYNPAIPILIMTAYSNVESAVEAIKAGAYDYLTKPLDFDMLQLTLERALEHTHLKNENKTLKQQIISNQNIIGRSPQMRYLMDMVGMIAPSEATVLICGESGTGKEIIARSVHANSARKDQPLVIVNCAALSESLLESELFGHEKGAFTGADKRREGRFMEAHKATLFLDEIGEISGLMQAKLLRAIQEREIQRVGSNQTLDIDVRLIAATNRNLKADVDSGKFRQDLYYRLNVVTIDTPALRERSEDIPPLSMHFLEKFALKNRKSIKGFTPQAMNMLLKYNWPGNVRELENTVERAVILLTGDFISEKELPLNINHYIQENAGSENIGYEDAEKPIQSLEWVEIDAILTALEKTGGNKTEAAKHLGITRKTLQAKLQKRT

SEQ ID NO: 43963 - DNA, 1326 bp, Parachlamydia sp. UWE25
  CDS (1)..(1326)
atgaccattgaaaaaattttaattgttgatgatgaattgattatgcgaaactttcttacagaagctctgaaacgaaaaggaattgaagccattgccgcagaaaatggggaaaaggctattaaaattgtccaagagcaatcttttgatatggttatcacagatatgaaaatgcctggattgaatggtattgatgttcttcaaaaaattaaagaactatctccccaaacactggttattgtgatgacagcttttggaacaattgaaaatgctgtagatgcgatgaaattaggagcttttcattacatcattaaaccgttctccttagaaagtttaatggctaatattgaaaaggccaatcaacacgtggtattagtcgaagagaatcaatacctgcggcaacaaattggggtgagctcttctcgtcatgtaattgctgaaagccctgcaatgcagcaagttttaaaagatattgaaagaattgctaaaagtaatgccagtgtctttattaatggggaaaccggaactggaaaagaggtgattgcgcatctcgttcattatagttctccaagagctaatcaaccatttattaaagttaactgtgcggcagtgcctgataccttagtagaatcagaattttttgggcatgaaaaaggagcttttacaggagcagctaataaaaggctgggtcgctttgagttagcaaatggaggaacgcttctcttggacgaagtgactgaaattcctcttgttttgcaatcaaagcttcttcgtgtaacgcaagaacaagaatttgaaagagttgggggagcaaagcctattaaagtcgatgtccgtttggtttctacttccaatcgtgatgtgaaagaagctattgcaaacaaatatttacgagaagatctttactaccgtttaaatgttgttccactttatcttccaccattaagagaaagaaaagaagatattattccattagctgagcattttatcgagaaaatttgccaagaaaatcataccgagaagaaaaaattaagtgagagcgcacaaaaaaaattactcctttatcgttggcctggaaatgttagagaacttgctaatgtcgttgaacgatcggttgtcatggatccgggcaaaattattcaaggcgatcatctttatttagagggacctggggtgaatgtcatggcaggaaaaactattcaagaactagaaaaacagttaattgtagaaacgttgcaaatgcatcaaaatagaacaaaagtagcagaaacactaggaattagcgttaaagtattacgagataaacttgaagaatacaaacttgtctag

SEQ ID NO: 43964 - protein, 441 aa, Parachlamydia sp. UWE25
MTIEKILIVDDELIMRNFLTEALKRKGIEAIAAENGEKAIKIVQEQSFDMVITDMKMPGLNGIDVLQKIKELSPQTLVIVMTAFGTIENAVDAMKLGAFHYIIKPFSLESLMANIEKANQHVVLVEENQYLRQQIGVSSSRHVIAESPAMQQVLKDIERIAKSNASVFINGETGTGKEVIAHLVHYSSPRANQPFIKVNCAAVPDTLVESEFFGHEKGAFTGAANKRLGRFELANGGTLLLDEVTEIPLVLQSKLLRVTQEQEFERVGGAKPIKVDVRLVSTSNRDVKEAIANKYLREDLYYRLNVVPLYLPPLRERKEDIIPLAEHFIEKICQENHTEKKKLSESAQKKLLLYRWPGNVRELANVVERSVVMDPGKIIQGDHLYLEGPGVNVMAGKTIQELEKQLIVETLQMHQNRTKVAETLGISVKVLRDKLEEYKLV

SEQ ID NO: 43965 - DNA, 1431 bp, Desulfovibrio vulgaris subsp. vulgaris str. Hildenborough
  CDS (1)..(1431)
atggctaagatcctgatcgtcgacgacgatcaccagttgaggcagagcttccagcgtttgctggcggtggaggggcacgatgtgcgtggcgcatcatcgggcgagcagggcctacgcatggtgcgcgaggaactgcccgagtgcgtgatcatggacgtgcgcatgccgggcatgaacggccttgatgcgctgaaggccctgcgggagatcgacgcccgtctcccggtcatcatcatgacggcctatgccaccaccgagacggccatcgaagccaccaagttcggtgcgttcgactacatcctgaagcccttcgacatccccgacatcctcgcgctcatcgacaaggcggtggaggcgggccgccggatgcgcggacgggtggccatgacgcccgagcccggtgacggcggtgacgccgaggcactggtgggcacgagccgcgccatgcacgaggtctacaaggccatcggccgtgccgcgcccacggacgcgctggtgctggtacgcggcgagtcgggcacgggcaaggaactggtggcccgtgccatctaccagcacagcctgcgggccgaacgcccctacctcgtgatcaactgcgtcgccataccggacacccttctcgagagcgaactgttcggctacgagaagggggccttcaccggcgccacccatcgcagggtgggcaagatagagcaggcgagcggcggcaccgtgttcctcgacgagataggcgacatgcccctcggcatccaggcgaagctgctccggctgttgcaggagaggcagatcgaaagactcggcggacgcgagaccatccccgtggacgtgcgcatcatcgccgccacgaacaccgacctcgaagccgccgtggcggacgggcgctttcgcgaagacctctactacaggctcaaggtcgtcaccctgtggctgcccccgttgcgcgagcgccgcgaagacatccccccgcttgcccgcttcttcctctcccgtttcgcacgtgagatggacacccccgaccccggcatctcgaccgaggccctcgcctacatggaggcccatccatggccggggaacgtccgcgaactcggcaatgccatccagaaggcgctggtgttcaaccgtggcgcccccttgctgccagaggacatccggcaggcgctcgaaggcgtgcgcggcagcacctccacccgcgaaggcgacgaaggggcaggcgacgacctgctgcaactggtgcgacgtaccctctccgggggtgacgacaacgccttcgagaccatcatggaccatgtggggcgcatcgtcgtgcgcgaggccctgcaatataccggcggcaaccgcacacgtgcggcgcgccttctcggcatgtcgcgtccgacattgctggcccgcatggaacgctacggcctcaaggtcgagcagcaggtctcctag

SEQ ID NO: 43966 - protein, 476 aa, Desulfovibrio vulgaris subsp. vulgaris str. Hildenborough
MAKILIVDDDHQLRQSFQRLLAVEGHDVRGASSGEQGLRMVREELPECVIMDVRMPGMNGLDALKALREIDARLPVIIMTAYATTETAIEATKFGAFDYILKPFDIPDILALIDKAVEAGRRMRGRVAMTPEPGDGGDAEALVGTSRAMHEVYKAIGRAAPTDALVLVRGESGTGKELVARAIYQHSLRAERPYLVINCVAIPDTLLESELFGYEKGAFTGATHRRVGKIEQASGGTVFLDEIGDMPLGIQAKLLRLLQERQIERLGGRETIPVDVRIIAATNTDLEAAVADGRFREDLYYRLKVVTLWLPPLRERREDIPPLARFFLSRFAREMDTPDPGISTEALAYMEAHPWPGNVRELGNAIQKALVFNRGAPLLPEDIRQALEGVRGSTSTREGDEGAGDDLLQLVRRTLSGGDDNAFETIMDHVGRIVVREALQYTGGNRTRAARLLGMSRPTLLARMERYGLKVEQQVS

SEQ ID NO: 43967 - DNA, 1365 bp, Desulfovibrio vulgaris subsp. vulgaris str. Hildenborough
  CDS (1)..(1365)
atgaccccccactccatacttctcgtcgaagatgaactctccatgcgcctcggcatgcagcacgcgctctcgcgcgcaggctacgaggtcgccgcggcggacaccgccgaggcggcacgccacgccctgcaccgacgacccttcgacctcgtcatcaccgacctgcgcctgcccggcatgagcggcatggaactgctcgacagcatccgcgagatgcatccgggcacgggcgtcatcctcatcactgccttccccgaagtggaactggccgtacaggccatcaaggccggggccttcgacttcctgtgcaagcccttccagagtgacgggctgctcatcgccgtcgaacggttcttccgctttctcgacctcaagcgcgagaacgacagactgcgcggagaacgtgaagaaggcgagttcatcggcgaaagcccggccatgctcaaggtcttcgaccgcatccgcgccctcgccgacgcctgtgtgccggtactcgtgctcggccccagcgggtcgggcaaggaactggtggcgggtgcgctgcatcgccgcagcaagcgccgcgacaggccgttcatcaagatcaactgcgcggcactgccggaacagttgctcgaatcggagttgttcgggcacgagaagggagccttcaccggtgcccagcaggcgcgcatcggcaagttcgaggctgccgacggcggtacgctgttcttcgacgaggtgggcgagatgcccctgccccttcaggcgaagctgctgcgtgtgctggaagaccaggaggtgacccccgtggggggcaacaccccgcgcaaggtcaacgtgcgcacggtgttcgccacggcacggaacctcgaggaggccatagccgacggcagattccgcgaagacctctactaccgcatcaacgtcgtgcccgtgacgctgccgcccctgcgcgaacgtggcagcgacgtggcccttctcaccgaacgcttcctgcggcgattctgcgccttgcacgaacgtcaggccacgctctcggaacaggcccgccttgccctgctggcctacgactaccccggcaacgtgcgtgaactgcgcaacgccgtggaacatgccgtactgctctgcaccgaaggggagattcacgtggggcacctgcctgaacgcatccgcgcagccacgcagtccatgccacccgcctgcgacgatgacgcgggcgacaccccggcgtcccttgccgaaggggtggcacgcttcgagagacgtcgcatcatggaggcgctggaacgcacggggggccgcaagatacaggctgccgacctgctcggtatcagccgcaagcagttgtggctcaagctcaaagagctttccatcgacatctag

SEQ ID NO: 43968 - protein, 454 aa, Desulfovibrio vulgaris subsp. vulgaris str. Hildenborough
MTPHSILLVEDELSMRLGMQHALSRAGYEVAAADTAEAARHALHRRPFDLVITDLRLPGMSGMELLDSIREMHPGTGVILITAFPEVELAVQAIKAGAFDFLCKPFQSDGLLIAVERFFRFLDLKRENDRLRGEREEGEFIGESPAMLKVFDRIRALADACVPVLVLGPSGSGKELVAGALHRRSKRRDRPFIKINCAALPEQLLESELFGHEKGAFTGAQQARIGKFEAADGGTLFFDEVGEMPLPLQAKLLRVLEDQEVTPVGGNTPRKVNVRTVFATARNLEEAIADGRFREDLYYRINVVPVTLPPLRERGSDVALLTERFLRRFCALHERQATLSEQARLALLAYDYPGNVRELRNAVEHAVLLCTEGEIHVGHLPERIRAATQSMPPACDDDAGDTPASLAEGVARFERRRIMEALERTGGRKIQAADLLGISRKQLWLKLKELSIDI

SEQ ID NO: 43969 - DNA, 1404 bp, Desulfovibrio vulgaris subsp. vulgaris str. Hildenborough
  CDS (1)..(1404)
atgccaacgacatgtgacgaacacatcctcatcgtcgatgacgaacccgacttcgcgcacggactggcaagactggtgagcagggactttccggcagccagtgtctctgtggcgctttccggcgctgaggcgctgcacatcatccagggcagcggggtcgccctgctgctcaccgacctgcggatgcccgacatggatggaatggaactcatgcagcaggccatgaccgtggaccccacgacttcggtcatcctgctcacggcgcacggttccatagagacggcggtcgccgccctcaagaacggcgcatacgacttcctcaccaagcccgtccgccgcgaagaactgcaaaggaccctcaacaaggcgctggagcggatacgcatcctcaaagagaacaaacggttgcgtcaaatgatgcaacaaggctgcatcgaacgccagatgataggcgaatctccggtcatgcaacgcctcaaggagactatcgcggccatcgcagccacggactactctgtgctcatcaggggagaatcagggacaggcaaggaactcgtcgccgacatgctgcaccgcctcggcagcaggagggagcgcccactagtcaaagtgaactgcccctccatccccgaccagcttctggaaagtgaactgttcggacacgtcaaaggggcattcacgggggcagacaggactcggcgcgggctcttcatgtctgcgcaacggggaacgctcctgctggatgaaatcggggacatcggtgaggcactccagaccaagctgctccgggtcttgcaagagcgcgagattcgccctgtggggtcaagcgcgagcaccctcgtggatgtgcgtatcatcgccagcaccaacagggccctcgaagagcgcatcaagcagggactcttccgggaagacctcttctacaggctcaacgtgctgaccatccacacgccccccctccgagaacggcgcgacgacatcccactgctggcagaccacttcgtcgcggcgacttgccgggagctctccagccctgtgaaacgcatctcacccggcgcacttgcctgtcttgccggaagggagtggcccggcaatgtcagggaactacagaactacatccgcaggctcgtcgtcttctgcccgggagacaccatcgacaccgcccaccttcgtcttgtggacggcacgacctgcccgacgactgcggagacgccatcccttgttccctacaaagaggcgaagggggctgtcgtggaggatttcacccgccgttacgtcgaaggcctcttgcgccagacgggaggcaacatatccgaggcggcgcgactttcaggcatcgaacgcgtgtcactccagaagatcctgcgtcgtctgggcacttccggagacacgttcaaaggatag

SEQ ID NO: 43970 - protein, 467 aa, Desulfovibrio vulgaris subsp. vulgaris str. Hildenborough
MPTTCDEHILIVDDEPDFAHGLARLVSRDFPAASVSVALSGAEALHIIQGSGVALLLTDLRMPDMDGMELMQQAMTVDPTTSVILLTAHGSIETAVAALKNGAYDFLTKPVRREELQRTLNKALERIRILKENKRLRQMMQQGCIERQMIGESPVMQRLKETIAAIAATDYSVLIRGESGTGKELVADMLHRLGSRRERPLVKVNCPSIPDQLLESELFGHVKGAFTGADRTRRGLFMSAQRGTLLLDEIGDIGEALQTKLLRVLQEREIRPVGSSASTLVDVRIIASTNRALEERIKQGLFREDLFYRLNVLTIHTPPLRERRDDIPLLADHFVAATCRELSSPVKRISPGALACLAGREWPGNVRELQNYIRRLVVFCPGDTIDTAHLRLVDGTTCPTTAETPSLVPYKEAKGAVVEDFTRRYVEGLLRQTGGNISEAARLSGIERVSLQKILRRLGTSGDTFKG

SEQ ID NO: 43971 - DNA, 1431 bp, Desulfovibrio vulgaris subsp. vulgaris str. Hildenborough
  CDS (1)..(1431)
atggcaaacaggcagagggtgcttctcgtcgatgacgagcaggatttcgccaacgggctggctcgcctcatagcccgtctttttccagacgtgcacgtggatgtcgccttctccggtcaggacgcgctggagcatatccgcaagcagcgcgtccacgtcatggtgaccgacctgcgtatgccgggtatgggcggcatggaactgctcaggcgggtcatggagacggaacccgatgtgagcgtcgtggtgctcaccgcccacggcaccatcgagaccgcggtggaagcgttgcaggccggggcctacgatttcgtgaccaagcccgtcgagcctgaacaggtggcgcgcgtccttcgcaagggacttgagagggcacgcctgctcgacgagaacaggcgcttgcgcgacctcgtggcactggtgggcgaatccggtgaactggtgggcgagagccccgccatgcagtctgtacgccgcaccgtcgccacggttgccccttccgactacaccgtgctcattcgtggcgagtcgggtaccggcaaggagatggtcgcgcggatggtacatcgtttaagtccgcgtgttgacgaaccctttcttgccctcaattgtccggccattcccgaacatctgcttgagagcgagctcttcggtcacgtccggggagcattcacaggcgcggaaagggatcgcaagggcctgttctccattgccgacggtggcactgtcctgcttgatgaaatcggtgacatctcatcgaacatccagacaaaactgctgcgcttcctgcaagagggagaggtgcgccccgtggggtcgccccgcaatgagcacgtggacgtccgcatcatcgcctccaccaatcaggaccttgaagcccgcatggcgtcgcgcgactttcgcgaagacctcttctaccgcctcaatgtcgtcaccatctgggttccgccgttgcgtgaacggctttcagacatccctctgcttgcggcgacgttcctcgcccgtgcaagtcgggaactcggtgtaccgcagcgtgacttcgatgaaggcgtcctcgaccatctcatgcggcgcgaatggccgggcaacgtgcgtgaattgcagaactacgtgcgcaggctcgccctgttcagccggggggatggcatcacgcttgatgccgtgcaacaggccgaacagagcgagagcggagcccctgccgccctctgtgtgccgtctcccgtggcggagggagaggtgatgccctacaaggatgccaaggcatcgctggtcgagtcgttcagtgagaggtacctgcgcgaccttctggagagtacggggggcaatgtcaccgaggctgccagactttcggggctgtcgcgcgtgtccatccagaagatggtcgcccgttacggtatcgatgccgcagccatgcgtgccaacggcagttga

SEQ ID NO: 43972 - protein, 476 aa, Desulfovibrio vulgaris subsp. vulgaris str. Hildenborough
MANRQRVLLVDDEQDFANGLARLIARLFPDVHVDVAFSGQDALEHIRKQRVHVMVTDLRMPGMGGMELLRRVMETEPDVSVVVLTAHGTIETAVEALQAGAYDFVTKPVEPEQVARVLRKGLERARLLDENRRLRDLVALVGESGELVGESPAMQSVRRTVATVAPSDYTVLIRGESGTGKEMVARMVHRLSPRVDEPFLALNCPAIPEHLLESELFGHVRGAFTGAERDRKGLFSIADGGTVLLDEIGDISSNIQTKLLRFLQEGEVRPVGSPRNEHVDVRIIASTNQDLEARMASRDFREDLFYRLNVVTIWVPPLRERLSDIPLLAATFLARASRELGVPQRDFDEGVLDHLMRREWPGNVRELQNYVRRLALFSRGDGITLDAVQQAEQSESGAPAALCVPSPVAEGEVMPYKDAKASLVESFSERYLRDLLESTGGNVTEAARLSGLSRVSIQKMVARYGIDAAAMRANGS

SEQ ID NO: 43973 - DNA, 1380 bp, Desulfovibrio vulgaris subsp. vulgaris str. Hildenborough
  CDS (1)..(1380)
gtgaagcatcttctggtgattgatgatgaacccggtcacaggctcatggtgcgtgccgtcatggaggatgtgggctggcatgtggtcgaggccggtagcggcgaagaagggcttgaactcctcgtccatgagcaggttcatgtcgtgctgctcgatatgcgcatgcctggtatggacgggcaggagacgcttgcccgcatcctcgagatacagcccggacttccagtggtgatgctcaccgcctatggcaccgtggggtcggccgtagaagccatgaagtgcggagcgttcgactacctcaccaaacccgccgacaatgaggaactggtggccgtgcttgagaaggcatgggaacatcgcaggctcgtggtcgagaacgaagagttgcgaaagcggtacgtcgagaacgacccgaccgccccgttggtgggggcgagtcaggtcatgcaccgcatgcgtgacttcatcagacaggcggggccgagtgaggcgacggtgctcatcatgggcgagtcgggcacaggcaaggagcttatcgcacaggcacttcatgatgccagcacgcgcgcccgacagccactggtcaaggtcaattgcgcggcactgccgggacatctgcttgaaagcgagttgttcggctatgtcagaggggccttcacaggtgccgtgaaagacaagccgggacgttttcagcttgcccggggaggaacgctgttccttgacgaaatcggcgaacttccgctcgagttgcaggccaagctgttacgcgtactgcaggaacgcgtggtcgaacctctgggcggtgtgcgccccgtttcggtggatgtgcgcatcattgccgcgaccaaccgcgacctgcgccgcgaagtggcgaagggaacgttcagagaggacttgtatttcaggctcaacgtccttgaagtcgtctcgccacccttgcgcaagcgcatggaggatttgccgcaacttgtcgaagaattgttggggaagctttgcagaaagaacaggaaaagcatacgctgtatcagtgccgactttttcgaggccctgtcgcggcatagttggccgggcaatgtccgtgaacttgagaacgtccttgagcgggccctcatcctgagcaggacagactcgttgtctgcggatgccttgcctccgcaactgttcggagatgaaccgcaggtggcggacatgcagcaggaacggcctgtggtcgatgatgattcgcgaccctgctcgctggatgaggctgaaaagggtgagttgcttcgtgcactagatgtgcacggagggcatcgggagaagacggcggatgctctgggcataagccgcaggacgcttcaatacaagctcaagaaattcgggctgacacgacgagcctag

SEQ ID NO: 43974 - protein, 459 aa, Desulfovibrio vulgaris subsp. vulgaris str. Hildenborough
MKHLLVIDDEPGHRLMVRAVMEDVGWHVVEAGSGEEGLELLVHEQVHVVLLDMRMPGMDGQETLARILEIQPGLPVVMLTAYGTVGSAVEAMKCGAFDYLTKPADNEELVAVLEKAWEHRRLVVENEELRKRYVENDPTAPLVGASQVMHRMRDFIRQAGPSEATVLIMGESGTGKELIAQALHDASTRARQPLVKVNCAALPGHLLESELFGYVRGAFTGAVKDKPGRFQLARGGTLFLDEIGELPLELQAKLLRVLQERVVEPLGGVRPVSVDVRIIAATNRDLRREVAKGTFREDLYFRLNVLEVVSPPLRKRMEDLPQLVEELLGKLCRKNRKSIRCISADFFEALSRHSWPGNVRELENVLERALILSRTDSLSADALPPQLFGDEPQVADMQQERPVVDDDSRPCSLDEAEKGELLRALDVHGGHREKTADALGISRRTLQYKLKKFGLTRRA

SEQ ID NO: 43975 - DNA, 1389 bp, Desulfovibrio vulgaris subsp. vulgaris str. Hildenborough
  CDS (1)..(1389)
atgaaagggcatatcctgcttatcgaagacgacacagcctttcagggtatgctccgtgaagccctcgaagaacgcggctaccgcgtcaccgccgtcaaccgcgccgaagacggggtgcgcatcgtgcgtagcggagacttcgaccttgtgctcaccgacgtgatgctgcccggcatatcgggtgtcgaggccatcccccgcctgcgtgaagccgcccccgggacggacatcgtcgtgatgaccgcgttctccacacgtgaactcgcgctggaggcggtcaagctgggggcctacgacttcttctcgaagcctttcagtctcaaggaactggacatcgtcatacgccgcgccatggagaagcggcgtatgcagggtgaaatcgtggcgcttcgagagacactgcgccgcgacacgcccaccagtcgcatcgtgggcgaaagccgcgccatgcgcgacgtgaaggcgcttctcgaacgcatcgccccgctggagagcaccgttctcatcatgggagaatcgggtaccggaaaggaactcatcgccgataccatccgcgccctctcgccccgcgccgccaatcctttcgtcaaggtcaactgcgccgccatccctgaacacctgttcgagaacgaacttttcggccacgagaagggggcgttcacgggggctgccactgccatgccgggcaaattcgagcaggcgcagggcggcatgatcatgctcgacgaaatcggcgacatgcccctcgccatccagccgaagcttctgcgcgtcgtcgagcagaaacaggtcgaacgcctcggcggacgcgcccctgtgccgctcgacgtgcgcatcatcgccgccaccaaccagaatcttgctgaacgggtacgcgagaaggccttccgcgaagacctgtactaccgcctcagcgtagctgtggttctcattcccccgctacgcgaccgcaaggacgacatcccgctgctggcccagtatttcgtgaacaagctggaaggtacgctgggccttccggtgcatggactctctcccgacgccatcgccgtactcatggaccatgactggccgggcaacgtccgccagcttgccaacgtactcgaacgcgcagccatcgcagccgacgggctcatctgcgcccgcgatgtcatggcggccattggcacggcgcgcggttcgaacgtcgacaaggcgacactgtccggcatggacctcaagacgacccttcgcatggtcgaacgcaacctgattctcgacgcgttgcgccgctgccacgggcggcagaccgaagccgccgtgctgcttgggctgacccccaagaacctgtgggccaaactccgcaagcacggcatccgtgcgggcacggaagacctgctccaacaaacgtag

SEQ ID NO: 43976 - protein, 462 aa, Desulfovibrio vulgaris subsp. vulgaris str. Hildenborough
MKGHILLIEDDTAFQGMLREALEERGYRVTAVNRAEDGVRIVRSGDFDLVLTDVMLPGISGVEAIPRLREAAPGTDIVVMTAFSTRELALEAVKLGAYDFFSKPFSLKELDIVIRRAMEKRRMQGEIVALRETLRRDTPTSRIVGESRAMRDVKALLERIAPLESTVLIMGESGTGKELIADTIRALSPRAANPFVKVNCAAIPEHLFENELFGHEKGAFTGAATAMPGKFEQAQGGMIMLDEIGDMPLAIQPKLLRVVEQKQVERLGGRAPVPLDVRIIAATNQNLAERVREKAFREDLYYRLSVAVVLIPPLRDRKDDIPLLAQYFVNKLEGTLGLPVHGLSPDAIAVLMDHDWPGNVRQLANVLERAAIAADGLICARDVMAAIGTARGSNVDKATLSGMDLKTTLRMVERNLILDALRRCHGRQTEAAVLLGLTPKNLWAKLRKHGIRAGTEDLLQQT

SEQ ID NO: 43977 - DNA, 1392 bp, Desulfovibrio vulgaris subsp. vulgaris str. Hildenborough
  CDS (1)..(1392)
gtgcgtaccagttattccgtgctggcagtggatgacgaaccatccatcggcaagttgctggaaaaggaactgtcgacgccagcgcgcgccgtgcatgtggccggtagtgcccggcaggcgcgtgaacggttgcggcgcgccacctacgaggtggtggtgctggacatccggctgcccgacgccgacggcatcgagttcatggtggaattgcgccagcgctatcccgacatggaggtcatcctcatcaccgggcacggcaacatcgacaatgctgtggaagccatgaaactgggtgcctacgactacatcaccaagccgttcaacctgaccgagctcgaagtggtggtcgagcgtgcctatcaaagggcttttttgcgcaatgagaacagagcgttgcgtcatgcgcacgaccgtgggcgaccgggtgtgacgcttatcggcaactcacaggtgatcaaggaggtgcgctacctcatcgaaaaggtggcaccgaccgatgtgcctgtcctcatcaccggtgaaagcggcgcaggcaaagaggtggcggcccatgccatccagtcgctgggcactcgcgcagacaagccgttcatcatcaagaactgcgccacgttgcagaaggagttggcccgtagcgaactgttcggccatgtccgcggttcgttcacgggggcactggaaagccgcgacgggctcatggccttcgccaacaagggaacgctgttcctcgacgagataggcgaattgcccatggaggtgcaggcttcgctgttgcgggtgctggagaacaagacctaccgccgagtgggagagaaggaccaccgcagttgcgacatcaggctcatcttcgccaccaaccgcaccctcgccggagaggtcgaggctggacgcttccacgaggccctgtaccatcgcatcaacgtgttcaatatcgagatgccccccctgcgtgagcgcaaggaggacattcccctgctggcggagttctttctcgcccgtctcggcaacgggcgcgacgacctgcgcatatccgacagggccatgtcgtgcctgatgcagtacgcatggcccggcaacgtgcgtgaattgcgcaacgtgcttgaacgcagcatcatcctcgccgagaacaacctcatcaccgaacatgcgttaccgcgtgacctcgcgggatttgcgggtggcggtggcgggcagtccggtgtttcaggtgtacccggtgcgtccggtgccatgggcgaggcgcagggaccgttgtcgcttgaagccatggaacgcgagcacatcgcccgtatcctcgaattctacgataacaaccgttcgctggctgccacagcactgggcatcagccgcaagacgctgtaccgcaagatgcgggaatacgacatcggctag

SEQ ID NO: 43978 - protein, 463 aa, Desulfovibrio vulgaris subsp. vulgaris str. Hildenborough
MRTSYSVLAVDDEPSIGKLLEKELSTPARAVHVAGSARQARERLRRATYEVVVLDIRLPDADGIEFMVELRQRYPDMEVILITGHGNIDNAVEAMKLGAYDYITKPFNLTELEVVVERAYQRAFLRNENRALRHAHDRGRPGVTLIGNSQVIKEVRYLIEKVAPTDVPVLITGESGAGKEVAAHAIQSLGTRADKPFIIKNCATLQKELARSELFGHVRGSFTGALESRDGLMAFANKGTLFLDEIGELPMEVQASLLRVLENKTYRRVGEKDHRSCDIRLIFATNRTLAGEVEAGRFHEALYHRINVFNIEMPPLRERKEDIPLLAEFFLARLGNGRDDLRISDRAMSCLMQYAWPGNVRELRNVLERSIILAENNLITEHALPRDLAGFAGGGGGQSGVSGVPGASGAMGEAQGPLSLEAMEREHIARILEFYDNNRSLAATALGISRKTLYRKMREYDIG

SEQ ID NO: 43979 - DNA, 1419 bp, Desulfovibrio vulgaris subsp. vulgaris str. Hildenborough
  CDS (1)..(1419)
atgcccgcccgcatcctcatcatcgacgacgaagacgacatccgcttctccctgcgcggcatcctcgaagacgaggggcacgaggtgacggaagcccccgacggagaggccggactgcgcaccctcgcctccgacacccccgacgtggtcttcctcgacatctggatgcccggcatggacggcctcaccgtgctggagcacatacatgccgcggccccttcgcttccggtcatcatgatatcagggcacggaaccatcgaaaccgccgtcgccgccatcaagaagggtgcgcacgacttcatcgagaaacccctctcactggagaaggtggtcatcgccgccgaacgcgccctcgaaatgcgcgagttgcggcgcgagaatcaggcactgcgcagttcactgggcgcaggcagcaaggcggacgaactcatcggcgaatcggcccccatgcgacgcatccgcgaacagattgcccgcgtcgcccccacggatgcgtgggtgctcatcaccggtgagaacggcacaggcaaggaacttgccgcccgcgccgtacacgccggcagtcaacgcgccacgagaccgctggtggcggtgaattgcgccgccattcccgaagaactcatcgagagtgaactgttcggccatgagaaaggggccttcaccggtgcggaaagcgcccgcaccggcaaattcgagatggcccacaggggaacgctgttcctcgacgaaatcggcgacatgagcctcaagacacaggccaagattctgcgcatcctgcaggaacagagcttcgagaaggtcgggggcacgcgcaccatccgtgtcgatgtccgggtcgtggcagccaccaacaagaatctcgaagagcagatagcgcagggtacgttccgcgaagacctctactaccgcctgcgtgtctttccactttcgctgcccgccctccgcgaacggggcgacgacatcctccggcttctggacgccttcatgcttcgcctgtgccgtgaccacgccttcgcccccctgaccttcacggacgatgcgcaggacgtgctgctacgataccgctggcccggcaacgtgcgcgaactgcgcaatttcgtggagcggatgctcatcctgcacgccggggaatcggtggatgtggaagacctgccccccgaatgcctgcgcgacctgtcaccctcgtcagacagcgcgacgggcacggcagcgcaatcggctaccgcgacctgcggcacgggtgtcgacggcatcctcgacttcaaggccgcccgcaacgccttcgagacacgcttccttgccgagcagttacaggagtgcggcggtaacgtgagccgccttgccgaacgcatcggcttggaacgcagccacctccaccgcaagctcaagggatacggcatcatagccggcgaccagtag

SEQ ID NO: 43980 - protein, 472 aa, Desulfovibrio vulgaris subsp. vulgaris str. Hildenborough
MPARILIIDDEDDIRFSLRGILEDEGHEVTEAPDGEAGLRTLASDTPDVVFLDIWMPGMDGLTVLEHIHAAAPSLPVIMISGHGTIETAVAAIKKGAHDFIEKPLSLEKVVIAAERALEMRELRRENQALRSSLGAGSKADELIGESAPMRRIREQIARVAPTDAWVLITGENGTGKELAARAVHAGSQRATRPLVAVNCAAIPEELIESELFGHEKGAFTGAESARTGKFEMAHRGTLFLDEIGDMSLKTQAKILRILQEQSFEKVGGTRTIRVDVRVVAATNKNLEEQIAQGTFREDLYYRLRVFPLSLPALRERGDDILRLLDAFMLRLCRDHAFAPLTFTDDAQDVLLRYRWPGNVRELRNFVERMLILHAGESVDVEDLPPECLRDLSPSSDSATGTAAQSATATCGTGVDGILDFKAARNAFETRFLAEQLQECGGNVSRLAERIGLERSHLHRKLKGYGIIAGDQ

SEQ ID NO: 43981 - DNA, 1380 bp, Desulfovibrio vulgaris subsp. vulgaris str. Hildenborough
  CDS (1)..(1380)
atgagcgaaacgacgcacatcctcgtcatagacgacgagaagaactacctgctggtgctcgaagccctgcttacggacgcgggctacgctgtcacggccctcaacgaccccgagacggccctcgcctttcttgaggagagcgaggtcgacgttgtcatcaccgacatgaagatgccgcgtgtgaccgggcgcgaggtgctcgaacgggtcaagaagacgtggccgcacatccccgtgtgcatcatgaccgcgttcggttccatcgaaggggccgtcgacgtgatgaagtacggggccttcgactacatcaccaaaccgttctccaacgacgaactgctgctctcggtgcagaacgccgccgaactctcgcgggtacaccgccagtaccgcgccctgcgcgccaacctcgaagagcgctacggcacgcatcagatcatcggtcgtagcaaggccatccgcgaagtgctcgacatggtcgacagggccgcccccagccgttcgacggtgctcatcaccggagagtcgggcaccggcaaggaactggtggcccgggccatccatttctcgtcgccccgcaacagcgggcccttcgtcagcgtcaactgcatggcgctgaatccgggcgtactcgaaagcgagctgttcgggcatgagaaaggctcgttcaccggggccatggccatgcgccgcgggcggttcgaacaggccgacggcgggacgctcttcctcgacgaaatcggtgagctgacccccgagttgcaggtgaaactgctgcgggtgcttcaggagcgccgcttcgaacgcgtgggcggcggcgacgagatagaggtcgacatccgcgtggtggccgccaccaacaaggaccttcagaaggaagtggagaacggaacgttccgcgaagacctctactaccgtctgaacgtcgtccatgttgccctgccgcccctgcgcgaacgccgcgaggacattcccctgctggtgggtcatttcgtcgagaaactcgcccgtgacaacggcatgaagcccaagaccttcacccccgaggcccacgactatctcacggggtacgaatggcccggcaacatccgccaactgcagaacgtggttgagcggtgcctcgtgctggtggccagcgacaccgtgggggtcgacgacctgccgccggagatacgtgacgaggagtcgcagctgaagagcgccgtggacctcttgccggtgcgtctcgaccttgccgacacgctggagaagatcgaagcggcactcatccgcagggctctcgtgcgcgccgaattcgtgcaggtgaaagcggcagagcttctcggcatctccaagagcctgctccagtacaagctgaaaaaatacggcataaccggccactag

SEQ ID NO: 43982 - protein, 459 aa, Desulfovibrio vulgaris subsp. vulgaris str. Hildenborough
MSETTHILVIDDEKNYLLVLEALLTDAGYAVTALNDPETALAFLEESEVDVVITDMKMPRVTGREVLERVKKTWPHIPVCIMTAFGSIEGAVDVMKYGAFDYITKPFSNDELLLSVQNAAELSRVHRQYRALRANLEERYGTHQIIGRSKAIREVLDMVDRAAPSRSTVLITGESGTGKELVARAIHFSSPRNSGPFVSVNCMALNPGVLESELFGHEKGSFTGAMAMRRGRFEQADGGTLFLDEIGELTPELQVKLLRVLQERRFERVGGGDEIEVDIRVVAATNKDLQKEVENGTFREDLYYRLNVVHVALPPLRERREDIPLLVGHFVEKLARDNGMKPKTFTPEAHDYLTGYEWPGNIRQLQNVVERCLVLVASDTVGVDDLPPEIRDEESQLKSAVDLLPVRLDLADTLEKIEAALIRRALVRAEFVQVKAAELLGISKSLLQYKLKKYGITGH

SEQ ID NO: 43983 - DNA, 1356 bp, Desulfovibrio vulgaris subsp. vulgaris str. Hildenborough
  CDS (1)..(1356)
atgacgcaccgcatccttgtggtcgacgacgaggccatcgcccgcgacaacctcgctatcctccttcgcaagcgcaagtacgaggtcgacaccgcagccaacggcgaagaggccatgcgcgccctcgccggggccgactacgacctcgtgctcaccgacctcatgatggacgacatggacggcatggccctgctgcggcacatcaggcagcaccacgccgacaccgaggtcatcatgatcaccggatacgccacggtggagacggctgtccttgccatgcaggagggagcctatcactacctcgccaagccctaccgcatcgaagaggcgcgggcactggtccagaaggcgctggagaagcgggcgctgaatcaggaggtgcatcgcctgcgagagcaattgcgcgaacgctcgctcccggtgcccattctcggcagcgcaccgtgcatcgtcgaactcaagcggctcatcgccaaggtggcccctgcagaggcgtcggtgctcatcctcggcgagaccggtacaggcaaggagcttgccgcgaggatggtgcacctcttcagccgtcgttccgacaggcgctttctggccatcaactgcggggcgttcaatgacgcgctgctcgaaagcgaactcttcggccacgagcaaggagccttctcgggggcggcgcgcctcaagaaagggctgttcgaggcggcggagggcggaaccctctttctcgacgaagtgggcgagatgtcactcgccatgcaggtgaagctgctgcgcacgctgcaggagaggagcatccgacgggtggggggcactgtggacattccggtggacgtgcgccttgtggcggccaccaaccgcgacctcaagcgcgaggccgaggcgggcaccttccgggccgacctcttctaccgcctgaacgtcgtctcactgcgtatgccgccgctttcggaacgccgtgcggacatccccctgctggcgcggtacttcaccgagaagagcgcccgggacatgcaggtcgccccccccgccatcggacaggatgccctcgacgcgctggcccgctacccgtttcccggcaacgtcagggagttgcagaacatcatggagcgggccgtggtgctgtgcagcgacggcgtcatcaaggcggggcatctgccgcccgacctgttcgaagcccccgaccacgtgatgcgcggggacgaacgcaaggcactgacccttgatgacaacgagagggaccacatcatgtggatgctcgaacatgcggggggcaaccgcacgctggcggcacggcttctgggcatcgaccgggcctcgttgtggcggaagctcaaacggttcggcgtggaggcggggtag

SEQ ID NO: 43984 - protein, 451 aa, Desulfovibrio vulgaris subsp. vulgaris str. Hildenborough
MTHRILVVDDEAIARDNLAILLRKRKYEVDTAANGEEAMRALAGADYDLVLTDLMMDDMDGMALLRHIRQHHADTEVIMITGYATVETAVLAMQEGAYHYLAKPYRIEEARALVQKALEKRALNQEVHRLREQLRERSLPVPILGSAPCIVELKRLIAKVAPAEASVLILGETGTGKELAARMVHLFSRRSDRRFLAINCGAFNDALLESELFGHEQGAFSGAARLKKGLFEAAEGGTLFLDEVGEMSLAMQVKLLRTLQERSIRRVGGTVDIPVDVRLVAATNRDLKREAEAGTFRADLFYRLNVVSLRMPPLSERRADIPLLARYFTEKSARDMQVAPPAIGQDALDALARYPFPGNVRELQNIMERAVVLCSDGVIKAGHLPPDLFEAPDHVMRGDERKALTLDDNERDHIMWMLEHAGGNRTLAARLLGIDRASLWRKLKRFGVEAG

SEQ ID NO: 43985 - DNA, 1380 bp, Desulfovibrio vulgaris subsp. vulgaris str. Hildenborough
  CDS (1)..(1380)
atgagcgacgtgaccgttctcatcgtggatgacgatgtggctcaccgcaccatgctgcgtaccatgctgcgcggctggggctatgccactgacgaggccgacgacggcgagaccgccgtcgagaaggtgcgcgaaaaggcccgcgatgcggtgctcatggatgtgcgcatggcccgcatgggcggtatcgaggcgttgcggcgcatcgtggagtacaaccccgccgtgcccgttctcatcatgacggcatactcctctgtggagacggccgtggaggctctgcggctcggggcctacgactacctgaccaagccgctggacttcgatgtgctgcgccataccctcgagcgcgccctcgaccatacccgcctcgtgtccgagaaccgtgagctgaagagccgcctcgacgacgcggcacgggcaccgggcatcatcgggcgcagtgcacccatgcgtgagctggccgaactcgtcgccaccgtcgcgccgtccgaggccacggtgctcatcaccggagagtcgggaacaggcaaggaactggtggcaaggtcgcttcacgagggcagccgtcgcagcgcaaagcaactggtgacggtgaactgcgcagcactctccgagtcgctcctcgagtcggagttgttcgggcatgagcggggagccttcaccggggccgacaagcgccgtgacgggcgattcgtgcaggccgacggaggtacactcttcctcgacgagataggcgaactgccgctgctgttgcaggccaaactgctgcgggcgctgcaacagggagagatacagcgcgtgggcagcgacgttccgctgacggtggacgtgcggcttcttgccgccaccaaccgcgacctgcgcgaagaggtggccgccgggcgctttcgcgaagacctgttctatcgcctcaatgtcatcggcatccatatgcccgcgctgcgtgaacggcccgatgacatccccctgctggcggcgcatttcctcgaccgttacgcggaacgcaaccgcaagcacctcaagggtttcaccccgcaggccatggacatgctgctcaagcacccgtggccgggtaacgtgcgtgaactcgagaacgccgtggagagggctgtcatcatggccacgggtgactgggtcggcgaacgtgaactgcccatgtccctgcgcggggcggggggcgccgacccagccgtcgccgatgccgcactgcccaccggtcaggacccctacgccggtctctcactggaagacctcgagcgtcgcgccatcgtcgccaccctgcgcgagacgggtgacaacaagagtgaagccgcaaggcgtctcggcatcacccgtgccacactgcacaacaaactcaagaagtacgacctcgaatga

SEQ ID NO: 43986 - protein, 459 aa, Desulfovibrio vulgaris subsp. vulgaris str. Hildenborough
MSDVTVLIVDDDVAHRTMLRTMLRGWGYATDEADDGETAVEKVREKARDAVLMDVRMARMGGIEALRRIVEYNPAVPVLIMTAYSSVETAVEALRLGAYDYLTKPLDFDVLRHTLERALDHTRLVSENRELKSRLDDAARAPGIIGRSAPMRELAELVATVAPSEATVLITGESGTGKELVARSLHEGSRRSAKQLVTVNCAALSESLLESELFGHERGAFTGADKRRDGRFVQADGGTLFLDEIGELPLLLQAKLLRALQQGEIQRVGSDVPLTVDVRLLAATNRDLREEVAAGRFREDLFYRLNVIGIHMPALRERPDDIPLLAAHFLDRYAERNRKHLKGFTPQAMDMLLKHPWPGNVRELENAVERAVIMATGDWVGERELPMSLRGAGGADPAVADAALPTGQDPYAGLSLEDLERRAIVATLRETGDNKSEAARRLGITRATLHNKLKKYDLE

SEQ ID NO: 43987 - DNA, 1416 bp, Acinetobacter sp. ADP1
  CDS (1)..(1416)
atgaccgaacaacaaccacgtgttttactcattgatgatgaagaagacctttgtacattgatgcaaatcagtctttcacgtctcggcgtccagacagattgtgcctacaacctacaacgtgccaaacaattgttacaacaacaacattatgatgcctgcctaaccgatctcaacctacccgatggacatggacttgattttgttcagtacgttacagaacgctttccttacttacccattgccgtgattacggcgtatggcaatatgggcattgcaattgcagcgttaaaagccggtgcttttgactttgtgagcaaacccatcaatcaacagcatcttagtcaactgattcaaactgcactgcatagtagccaaacggcaccagacaatgaacaagacacgcttgagcatcgtttattgattggtcaatctgcacccattgaacaactacgtatagcacttagaaaaattgcacgttcgcaggcacccgtatttattacaggtgagtctggaacaggtaaggaagtggttgccaatctggtacatcgcttaagcaatcgcaatgaagggccgtttattgcactaaactgtggtgcaattccgtcagaactcatggagagtgagttatttggccataagaaaggcagcttcacaggtgccacacaagataaacagggattacttttatcggcacatggaggaagtctatttctggatgaaattgcagaacttcctctcacgatgcaagttaaattactacgcgctgttcaagaaaagaaaatccgtccaattggttcagatcgtgaaattgatgtcgattttcgtgtgatcagtgccagccatcagaatctggaacttttagtccagcaaggcaaatttcgtcaggatttattctttcgaattcatgtcatggatattcagcttcctccactacgtgagcgtggacaagatattttactgttagccaagcattttattcagcatgtttgtcatgaatgggacctgcctttaaagcatttgagccctgcggctgaacattatctactacattatgactttccaggaaatgttcgggaattacgcaatatgatggaacgtgccattaccttaagtgatggagcatcaatagaccttcagcaattaaacagctctctactacgccaaaccactatcccagaattagatttaacaccgatttcgaatacagtatcaatagcaccaacatctcagcaaaatttagaatttccacatgaaggacttgaacaatatttagaaaaagttgaaaaagatatgctgcttaatgcgttaaatagtacacactggaatcgtactttagccgcaaaaaaattaggaatgagttttcgctctcttcgctatcgtctgaaaaaatttgggcttgatactgatgatggctaa

SEQ ID NO: 43988 - protein, 471 aa, Acinetobacter sp. ADP1
MTEQQPRVLLIDDEEDLCTLMQISLSRLGVQTDCAYNLQRAKQLLQQQHYDACLTDLNLPDGHGLDFVQYVTERFPYLPIAVITAYGNMGIAIAALKAGAFDFVSKPINQQHLSQLIQTALHSSQTAPDNEQDTLEHRLLIGQSAPIEQLRIALRKIARSQAPVFITGESGTGKEVVANLVHRLSNRNEGPFIALNCGAIPSELMESELFGHKKGSFTGATQDKQGLLLSAHGGSLFLDEIAELPLTMQVKLLRAVQEKKIRPIGSDREIDVDFRVISASHQNLELLVQQGKFRQDLFFRIHVMDIQLPPLRERGQDILLLAKHFIQHVCHEWDLPLKHLSPAAEHYLLHYDFPGNVRELRNMMERAITLSDGASIDLQQLNSSLLRQTTIPELDLTPISNTVSIAPTSQQNLEFPHEGLEQYLEKVEKDMLLNALNSTHWNRTLAAKKLGMSFRSLRYRLKKFGLDTDDG

SEQ ID NO: 43989 - DNA, 1476 bp, Acinetobacter sp. ADP1
  CDS (1)..(1476)
atgtcgcgaaataaaatatgggtaattgatgatgatcgcgccatgcgctgggtcttggaaaaaacctttaaagaagaaggctttgatgttacaagtttcgaagaggcacaatccgcgcttgatcagcttttggacgatgcaccagacgtaatcttaactgatattcgtatgccaggtatcgatggtttaacttttctaggaaaagttaaaaataactatcctgatttgcctgtcatcatcatgactgctcactcagatcttgaatccgcggtctctagctatcagacaggtgcttttgagtatttacctaaaccatttgacattgatgaagcgctggctttagttaatcgtgcgatcctgcatattaataaacttcaacagcaagaagccaccaaagcagcttctgcggcacaatcaactgaaattattggtgaatctcctgccatgcaggaagtattcagagcgattgggcgtttatcacaatctcatatcaccgtacttattaatggtgaatcaggtacaggtaaagaactggttgcgcatgccttacataagcattctccgcgcagcagtaagccgtttatcgcgctcaacatggcagcaattccaaaagacctgattgaaactgaactgttcggtcacgagaaaggtgcttttactggtgcaaatactcaacgtcagggtcgttttgagcaagccaatggcggcacattatttttagatgaaattggcgatatgccttttgaaacacaaacacgtttattacgtgtattggcagatggtgagttttatcgtgtaggtggacatattcctgttaaggttgatgttcgaattgtggctgcaacgcatcaagatctcgaaaaactggtgaatgaaggccgattccgtgaagacttgtaccatcgtctaaacgtgatccgaatccatattccgaagctcgctcaccgtagcgaagacatcccaatgctagcacaacactttctagcacgcgcgggcaaagaactgggtgtaagtcctaaaattttgcggacagaaaccactgattatatgcaacagctcccttggccagggaatgtacgccaactagaaaatacatgtcgatggctaacggtaatgattacgggacgagaagtctatcctgaagatctcccttcagaactcaaacagattccaattcagaaatctgtggatcagacaggtacaccgccaagctttgatcgtatttcattgcatcattgggatgagctacttggacaatgggctattcaaaaacttaaaaatggtgaaatgaaaattttggatatcgccactcctatgtttgagcgtactttgatcaatgctgcgcttcaacaaacgcgtggacgcaaacgtcatgcagccgaacttctcggttggggacgcaatacacttactcggaaattaaaagaacttggtatcagcgcagaagatgatactgaagaagaaagtgaaatttaa

SEQ ID NO: 43990 - protein, 491 aa, Acinetobacter sp. ADP1
MSRNKIWVIDDDRAMRWVLEKTFKEEGFDVTSFEEAQSALDQLLDDAPDVILTDIRMPGIDGLTFLGKVKNNYPDLPVIIMTAHSDLESAVSSYQTGAFEYLPKPFDIDEALALVNRAILHINKLQQQEATKAASAAQSTEIIGESPAMQEVFRAIGRLSQSHITVLINGESGTGKELVAHALHKHSPRSSKPFIALNMAAIPKDLIETELFGHEKGAFTGANTQRQGRFEQANGGTLFLDEIGDMPFETQTRLLRVLADGEFYRVGGHIPVKVDVRIVAATHQDLEKLVNEGRFREDLYHRLNVIRIHIPKLAHRSEDIPMLAQHFLARAGKELGVSPKILRTETTDYMQQLPWPGNVRQLENTCRWLTVMITGREVYPEDLPSELKQIPIQKSVDQTGTPPSFDRISLHHWDELLGQWAIQKLKNGEMKILDIATPMFERTLINAALQQTRGRKRHAAELLGWGRNTLTRKLKELGISAEDDTEEESEI

SEQ ID NO: 43991 - DNA, 1413 bp, Erwinia carotovora subsp. atroseptica SCRI1043
  CDS (1)..(1413)
atgcaacgagggatagtctggattgtcgatgacgatagctccatccgttgggtgcttgagcgcgcgcttgctggtgcgggtttaacctgcgcaacgtttgagaacggaaatcaggtactgcatgcgctggcgacacaaacgcctgacgttctgctgtccgacatccgcatgccagggatggatggattggcgctcttacagcaaatcaaacagcgccacccgatgctcccggtcatcattatgacggcacattccgatctggatgccgccgtcagtgcttatcaacagggcgcgttcgactatttaccgaaaccgtttgatattgatgaagctgtcgcgctggctgagcgcgcgatcagccattatctggaacagcaacagccggtacgcaaccagccgatcaatggcccgacaacggacattatcggcgaagcacctgcgatgcaggatgtctttcgcatcattggccgcctgtctcgctcatcgatcagcgtactaattaacggcgaatcgggaacgggtaaagaactggtggcgcatgccctgcatcgtcacagtccgcgcaccaaagccccttttatcgccctgaatatggcagcaattcctaaagacctgatcgaatcggaattgtttggtcatgagaaaggcgcatttacgggcgcaaaccaaattcgtcagggccgctttgaacaggccgatggcggtacgctgtttctggatgaaatcggcgacatgccgctagacgtgcaaacacgtctgttgcgcgtattggccgacgggcagttttatcgcgttggcggctatgccgcggtgaaggtcgatgtccgcattatcgcggcaacacaccaaaaccttgaacagcgcgtgcaggaaggcaaattccgtgatgacctgtttcaccgcctgaacgtgatccgcgttcatctgccgccgctgcgtgagcgtcgggaagatatcccccgtctggcgcgttatttcttgcaggccacggccaaagagctgggtgtcgaaccgaagaatttgcatccagaagcggaaacagcactaacccgtttaccgtggcctggcaacgttcgccaattggagaacacctgccgctggttgacggtcatggccgcgggtcaggaggtgctgattcaggatctgccgcctgagctgttcgagaccactgcgcccgattctaccgtgcatattttgccagacagttgggcaacgctattagcacaatgggccgatcgtgcgctgcgttccggtcatcaaaacctgctggcggaagcacaaccagaaatggaaagaacgctgcttacgacagcattacgacatacgcagggacataaacaggaagccgcaaggttactgggatggggtagaaatactctgacgcgtaaactaaaagagctgggaatggagtag

SEQ ID NO: 43992 - protein, 470 aa, Erwinia carotovora subsp. atroseptica SCRI1043
MQRGIVWIVDDDSSIRWVLERALAGAGLTCATFENGNQVLHALATQTPDVLLSDIRMPGMDGLALLQQIKQRHPMLPVIIMTAHSDLDAAVSAYQQGAFDYLPKPFDIDEAVALAERAISHYLEQQQPVRNQPINGPTTDIIGEAPAMQDVFRIIGRLSRSSISVLINGESGTGKELVAHALHRHSPRTKAPFIALNMAAIPKDLIESELFGHEKGAFTGANQIRQGRFEQADGGTLFLDEIGDMPLDVQTRLLRVLADGQFYRVGGYAAVKVDVRIIAATHQNLEQRVQEGKFRDDLFHRLNVIRVHLPPLRERREDIPRLARYFLQATAKELGVEPKNLHPEAETALTRLPWPGNVRQLENTCRWLTVMAAGQEVLIQDLPPELFETTAPDSTVHILPDSWATLLAQWADRALRSGHQNLLAEAQPEMERTLLTTALRHTQGHKQEAARLLGWGRNTLTRKLKELGME

SEQ ID NO: 43993 - DNA, 1332 bp, Desulfotalea psychrophila LSv54
  CDS (1)..(1332)
atgaaaaaaatacttctggtagacgatgacaaggggcatagaaccatgctcaaggtaaacctcggtgaactcggctatcaggtaattacggcaggagatggcgatgaggttctagccaaacttactaaaaacaagattgatctcatcctccttgatatgaagatgcctcgcatcgatggcctcgccaccctctccctgctctcccagcagaacaacaggattcccgttattgtcattaccgccttttcatccatggaaaatgccattgaggccatgaagaagggtgcctttgactatgtcaccaaaccggttgatatagataacttgcatattgcaatatcaaaggccctgcatcaaaagatatctcctcctctctctcccggcacagagcctcaggccgacagcaagttccctgagatcatcggggagagtgctcccatgcaggaacttttttcccagatatccctcattgcccccagcgatgcaaccatccttctctcaggagaatcaggcacgggcaaggaactggtggcaacggcaatacataggcacagcaagagaaaagagggggcactgatccggattaactgtgctgccctgcatgaaaatttacttgaaagcgagctctttggtcacgagctgggggccttcaccggagcagcaaaacaaaaaaaaggccttttcgaacgggcggacaagggcaccctctttctcgatgaaattggagatatgagcctgacaactcaggtaaagatactccgggttttacaggagggcgagtttgaacgggtaggcggaaatgactccatcaaggtcaatgtgagaattatcgccgccagccataggaatttagaaaaattgatagaagaaggcaccttccgccaggacctcttttttcgcctctccgttgtccctctccacctacctgccctacgagagagactggtcgacatccccatcctggcaaacttcttcctctctctctacaacaagaaaaacagaaaggatatcaaaggattcagccaggaagcattggatttactgatggaatatccctggcccggcaatatcagagaattagaaaacagcattgaacgtggtgtcatcctctgtctcggtgaacagataacggcccacgaactcccgccccagtttttccgcaatcgcagcccgggcgagctgagcagtcgagacaccctgcgagacgtcgagaagagggctatccaacaggccttggcacgatccggcttcaataagagcgccacggcaaagcaactcggcattgcccggcaaaccttgctcaacaagataagagactacgggctggaatag

SEQ ID NO: 43994 - protein, 443 aa, Desulfotalea psychrophila LSv54
MKKILLVDDDKGHRTMLKVNLGELGYQVITAGDGDEVLAKLTKNKIDLILLDMKMPRIDGLATLSLLSQQNNRIPVIVITAFSSMENAIEAMKKGAFDYVTKPVDIDNLHIAISKALHQKISPPLSPGTEPQADSKFPEIIGESAPMQELFSQISLIAPSDATILLSGESGTGKELVATAIHRHSKRKEGALIRINCAALHENLLESELFGHELGAFTGAAKQKKGLFERADKGTLFLDEIGDMSLTTQVKILRVLQEGEFERVGGNDSIKVNVRIIAASHRNLEKLIEEGTFRQDLFFRLSVVPLHLPALRERLVDIPILANFFLSLYNKKNRKDIKGFSQEALDLLMEYPWPGNIRELENSIERGVILCLGEQITAHELPPQFFRNRSPGELSSRDTLRDVEKRAIQQALARSGFNKSATAKQLGIARQTLLNKIRDYGLE

SEQ ID NO: 43995 - DNA, 1365 bp, Desulfotalea psychrophila LSv54
  CDS (1)..(1365)
atgaaatctaatatcctcatcatagaagatgatcaggatatgtgtgatatgctggcgatgggtttgcgtcggcgtggttttgccgtctccacctatatttcagggcaggaggggctggctgccatcaatcctgaaacaacagacgtggttctgtcagatatcaatctccccgatgccaatggtcttgatatttgtaaagaggttgtggccaatacgccggatataccggttattataatgaccgccttcggtagtatggatacggctatatcagccattcgttcaggtgcctatgactttgtaaccaaaccccttgatattgatatcctggccctgagtcttgagcgagctgtacagtatcgcgaactcaaggtccgggtcaaaaagctcagtgatcaaatcgggcaaccacagcattttgacaacctcatgggcgaaagccctgttatggaaaaactcttttctcagcttgcccgcattgcagattcagaggcatcacttcttattagcggggaaagtggttcaggcaaagaacttactgccaaggctgtgcatacgcatagtcgtcgcagagacaatcccctgatcaccatcaactgtgccgctatgcccggccagcttcttgaaagtgaactctttggacataaaaaaggtgcctttaccgatgcccaaaaccataattcaggcctctttatggcagcaaacggtggcaccctttttctcgacgaggtgggtgaaattccgttgaagcttcagcctaaacttttacgggcccttgaggagcggtgcgtgcggcccgtaggtgggcaaagagagcttccctttgatgtacgaatcattgccgctaccaatcgtgatcttgagtcggctgtggaggatggcctttttcgagaagacctttactaccgtctcaatgttatcaagattgaactcccccccctgcgctcacgaggagcggatattttgctcctggccaagaagttcatggatgcctttgccactcggcaagagaagaaggttatagggttttccgatactgtggccgggaaactcctgcgctacgcctggccgggtaatgttcgagaactgcgcaatgccatcgagcacgcagtagcgctcactgcttttgacacacttatgccagaagatcttcctgaaaagattcggcatttccggggcgactgcatccttctgggagaccaggaccccatggaacttgtctccatggaagagatggagagacgctatattacccatgtattaaaagtttcagataataacagaaccctggccgcgcgaattcttcagcttgaccgaaaaaccctctaccgtaagttgcaacgctatgaagaaagccagggatag

SEQ ID NO: 43996 - protein, 454 aa, Desulfotalea psychrophila LSv54
MKSNILIIEDDQDMCDMLAMGLRRRGFAVSTYISGQEGLAAINPETTDVVLSDINLPDANGLDICKEVVANTPDIPVIIMTAFGSMDTAISAIRSGAYDFVTKPLDIDILALSLERAVQYRELKVRVKKLSDQIGQPQHFDNLMGESPVMEKLFSQLARIADSEASLLISGESGSGKELTAKAVHTHSRRRDNPLITINCAAMPGQLLESELFGHKKGAFTDAQNHNSGLFMAANGGTLFLDEVGEIPLKLQPKLLRALEERCVRPVGGQRELPFDVRIIAATNRDLESAVEDGLFREDLYYRLNVIKIELPPLRSRGADILLLAKKFMDAFATRQEKKVIGFSDTVAGKLLRYAWPGNVRELRNAIEHAVALTAFDTLMPEDLPEKIRHFRGDCILLGDQDPMELVSMEEMERRYITHVLKVSDNNRTLAARILQLDRKTLYRKLQRYEESQG

SEQ ID NO: 43997 - DNA, 1437 bp, Desulfotalea psychrophila LSv54
  CDS (1)..(1437)
atgagaacaaaatataataatattcaatccaaacagggaattataatgtgtagctactctatactggtagtagacgatgagcctaattatctgatcgttctctcagaactattacgtgatgaagatctggaggtttttactgctggaagtggtaaggcaggacttgatatatgccgtgaggtagaccttgatctggttattaccgatatgcagatggacggtatggacggtatggcccttttggagcagataaaagaacttaatccggatttgccggtgctcatcatgacagcccacgccgaggtggaaaaggcagttaaggctatgcaggcaggcgcttttggttatctggctaaaccgtttgccaacgatgagctcttggtgaatatttacagggctgcccgccattactctcttatccgagaaaataagagattacgtcatcaactgcagagtgaggattgctttagtggtattgttggtaagagtcccagtatgcagagagtgtacaaacttatccgtaaggttgccccaactcctgcctcggttcttataacaggagaaagcggtacgggtaaagagcttgtcgctcaagccgttcactccaccagtccccggcgggatgaggcctttattgccgtgaactgtgctgccctttcggcaaacctgcttgaaagtgaactctttggccatgaaaaaggtgcctttactggagccgcatccatgcgtaaggggcgttttgagcttgctgcaggtggaactatttttcttgatgagatcagtgagatcccgctagaactgcaatcgaagttgcttcgtatcttgcaggaaaagagttttgagagggtgggtggggcaaagacccttcatgttgatgtgcgggtgataagtgcctctaataaagatcttaaggaagaggtagcagccggtcattttcgggaagaccttttttatcgcctgaacgttattcacctgaatctgccccctcttcgggagcgcctagacgatttgccccttttagtggccttttttatagaaaagtatagaaaaattttgcagttggagaatctcgtggtcggcgaagaggcaatgaaacttcttctaaggcttccttgggatggtaatgtgcgtgagcttgagaataccattgagagagccgccattctctgtgatgcaggcaatattatggtggaagatgtacagccggagacggtctataataaggaggatcattggcaaccaggcggggatctcagcaattttatcccggaatcggtggggcttaacgaggttctctatgctgttgaggagagaatgcttattaaggccttggatgaatccaatcaggtgcaggcaagggccgcgtcccagcttggtattaccaagagtttattgcagtataagctgaaaaaatatggtttaaaaaagaagaaatag

SEQ ID NO: 43998 - protein, 478 aa, Desulfotalea psychrophila LSv54
MRTKYNNIQSKQGIIMCSYSILVVDDEPNYLIVLSELLRDEDLEVFTAGSGKAGLDICREVDLDLVITDMQMDGMDGMALLEQIKELNPDLPVLIMTAHAEVEKAVKAMQAGAFGYLAKPFANDELLVNIYRAARHYSLIRENKRLRHQLQSEDCFSGIVGKSPSMQRVYKLIRKVAPTPASVLITGESGTGKELVAQAVHSTSPRRDEAFIAVNCAALSANLLESELFGHEKGAFTGAASMRKGRFELAAGGTIFLDEISEIPLELQSKLLRILQEKSFERVGGAKTLHVDVRVISASNKDLKEEVAAGHFREDLFYRLNVIHLNLPPLRERLDDLPLLVAFFIEKYRKILQLENLVVGEEAMKLLLRLPWDGNVRELENTIERAAILCDAGNIMVEDVQPETVYNKEDHWQPGGDLSNFIPESVGLNEVLYAVEERMLIKALDESNQVQARAASQLGITKSLLQYKLKKYGLKKKK

SEQ ID NO: 43999 - DNA, 1383 bp, Desulfotalea psychrophila LSv54
  CDS (1)..(1383)
atggcaaacatactggtagtcgatgatgaacggagcatgcgtgaatttttcaagatactcctccataaagagggatataaagcctataccacagctaatattaacgaggcaagggagatcttttcccaagagccaatcgatctgatcatcactgatatccgcatgcccagcggcagtggttttgatctacttgaaaacatccgggaagaaaaccctcacattcccattattctcattaccgccttcaccgaacccaatgatgccctccgggccatgaagaatggtgcctttgactatattagcaaaccatttaatattgaagaaattaagtctgtagtaaaatctgctctacaaaaaagcaactgttctgccccccgaatggtcaccagtcactttccagaaattattggtgaaagtcgggaaatgcagaaaattttcgatataataagccgagttgcccccactccggcaaacatacttatccatggagaatccgggacgggcaaagagctcgttgcccgagctatccagcaaaaaagtctggttgcccaaaaggcctttatccccatcacctgtagtgcaatccccgaagagctgatggagagcgaactctttggccatgtcaagggagcctttaccggtgcgattaccgccaagacaggcctctttgccgaggccaatggtggcaccgtatttcttgatgaaataggagaactcccccttcacatccaaatcaaattgctccgggttttacaagagagagagataaagccagtgggaggcaatcagattcagagcatccaggtccggatcattgccgccaccaacagagttcttgaagaggagataagggccggccgcttccgggaagatctcttctaccgtctggccgttgttcctatccgagtaccacctcttagagaacgtaagagtgatattccccttctagctcaacacttccttaaaaaatactcacgccttctgggaaagaaggtccaggaaatatcatcctatggcctggaggttttaatgaagtatgagttccccggcaatgtccgggaattagaaaatatcatagagagggccgttgccctggaatcatccaatattatcctcccggaaaatcttaatttttctgcccccaatatcctgcgggaagagagagcaagagataatagcagaggtttccaagccctctcctgcgaagaggagctctttgaccttggtcttgaaaatatcatgacccgtctggaaaaaaatcttctccaacataccctgaagaagaccaataactctaagataagggcggcagaactcctgcagataagctttcgttccctgagatataaaattaaaaaatataaaatagaaccagctgaatag

SEQ ID NO: 44000 - protein, 460 aa, Desulfotalea psychrophila LSv54
MANILVVDDERSMREFFKILLHKEGYKAYTTANINEAREIFSQEPIDLIITDIRMPSGSGFDLLENIREENPHIPIILITAFTEPNDALRAMKNGAFDYISKPFNIEEIKSVVKSALQKSNCSAPRMVTSHFPEIIGESREMQKIFDIISRVAPTPANILIHGESGTGKELVARAIQQKSLVAQKAFIPITCSAIPEELMESELFGHVKGAFTGAITAKTGLFAEANGGTVFLDEIGELPLHIQIKLLRVLQEREIKPVGGNQIQSIQVRIIAATNRVLEEEIRAGRFREDLFYRLAVVPIRVPPLRERKSDIPLLAQHFLKKYSRLLGKKVQEISSYGLEVLMKYEFPGNVRELENIIERAVALESSNIILPENLNFSAPNILREERARDNSRGFQALSCEEELFDLGLENIMTRLEKNLLQHTLKKTNNSKIRAAELLQISFRSLRYKIKKYKIEPAE

SEQ ID NO: 44001 - DNA, 1365 bp, Desulfotalea psychrophila LSv54
  CDS (1)..(1365)
atggcaaagcgcgtacttattattgatgacgaggcaagtattcgtataacacttcagggtattcttgaagatgaaggctttcaaactctcgcctgcgcatcggctgaagagggaattgaactccttgaaaaagagatcattgacattgtcctactcgatatctggttgggtgataacatggatggactcaccgcccttgaaataatccacgagcgcttctctcttcccgttatcatgatttccggccacggcaatgtagaaacagccgtacaagccaccaaaaagggggcctttgattttatagaaaagcccctttcctacgaaaaaattctggtcgccatcacaaacggccttcgttttgctaacctcgaaaaggaaaatattcttcttcgggaaaatcgccacaaacagacaaacctcacaggaaaatctgccgcaattcaaattgtcaaaaagcagattgcaacggtcgcaccaacagaggcatgggttcttattcgcggagaacatggcaccggcaaggagctggttgcccaatctatccatagcctctcgcgtgccagcaatcagcccatggtagaaatcaactgtgccgctattccggaagagttaattgaatccgaactatttggccatgaaaaaggttcttttaccggtgcccataacagtaaaagaggcaaattcgatcaggccaatggcggcatactctttctcgatgaaattggcgacatgagtatgaccacccagtcaaaaattttacgcatcctccaggagcagaaatttgagcgggtgggcggaaataagacgatcaaggtcaatgtacgcgttctcgctgccactaacaaaaatctcgaagaggagatagaggcgggcaatttcagagcagatcttttctggcgactgaacgtggtacctattcatgtccccccactcaaggagagaatggaggacattcctctcctcgttgaaaacctgctcgaacagcttatccataagggtttacaaaaaaagacctttggcgaagacgcctaccgggccctgcaaagccacgattggcccggaaacgtcagagagcttcgtaattttatagaaagagttgttattatgacaccgggagaggtcatctccggcagtgataccgagctctttctcatgggagggtctagcaaactgcccacaggtaagacggatctgcccagctggttttcccaggactataaaaccgccaaaaaaatctttgagaaaaagtatctcaaagaacggttggaacaaaacgatggtaacgtctcccgcaccgcagagcaggtagggcttgagcgtagccatcttcacaaaaagctgaagtctcttgaaataatagactag

SEQ ID NO: 44002 - protein, 454 aa, Desulfotalea psychrophila LSv54
MAKRVLIIDDEASIRITLQGILEDEGFQTLACASAEEGIELLEKEIIDIVLLDIWLGDNMDGLTALEIIHERFSLPVIMISGHGNVETAVQATKKGAFDFIEKPLSYEKILVAITNGLRFANLEKENILLRENRHKQTNLTGKSAAIQIVKKQIATVAPTEAWVLIRGEHGTGKELVAQSIHSLSRASNQPMVEINCAAIPEELIESELFGHEKGSFTGAHNSKRGKFDQANGGILFLDEIGDMSMTTQSKILRILQEQKFERVGGNKTIKVNVRVLAATNKNLEEEIEAGNFRADLFWRLNVVPIHVPPLKERMEDIPLLVENLLEQLIHKGLQKKTFGEDAYRALQSHDWPGNVRELRNFIERVVIMTPGEVISGSDTELFLMGGSSKLPTGKTDLPSWFSQDYKTAKKIFEKKYLKERLEQNDGNVSRTAEQVGLERSHLHKKLKSLEIID

SEQ ID NO: 44003 - DNA, 1413 bp, Yersinia pseudotuberculosis IP 32953
  CDS (1)..(1413)
atgcaacgagggatagtctggatcgtcgatgacgatagttccatccgctgggtgcttgagcgcgcactgactggagcgggtctaaactgtgtcgcattcgatagcggcaatcaggtattggatgcactggctacgcgaactccagatgtgttgttatcagatatccgtatgccaggaatggatggcttggcattactcaaacaaattaagcaacgccatccgatgctcccggtcatcataatgacggcccattcagatttagatgccgccgtcagtgcgtatcagcaaggggcctttgactatttgcccaaaccgtttgatatcgacgaggccgtggctctggttgaacgggctattagccattatcaggagcaacaacaacccgcccgtagccaaccagtcagtgggccgacagccgatattatcggcgaagcaccggcgatgcaggatgtttttcgtatcattggccgcttgtcacgctcctcaattagcgtactgattaatggtgaatccggtaccggtaaagagctggtcgcacacgcattacatcgccacagcccacgggctaaagccccctttatcgcactgaacatggcggctatcccgaaagatttaattgagtcggaactgttcggtcacgaaaaaggggcatttaccggggccaatcaggtacggcaggggcgctttgaacaagctgacaccggcacactttttttagatgaaattggtgatatgccactggatgtgcaaacccgcctgttacgggtattggctgatggccagttctatcgggtcgggggctatgcacccgttaaagtcgatgtgcggatcattgcggcaactcaccagaatctggagttgcgtgttcaagaaggaaaattccgtgaggatctattccatcgtctgaatgtgatccgagtacatttacctccactacgtgaacgcagtgaggatattccgcgtttggctcgctactttttacacgtagcggctaaagagttgggcgtggaaagcaaaaatctgcatccagagaccgaagcggcgctaacccgcttaccttggcctgggaacgtgcgccaactggagaatacctgtcgttggctgaccgtcatggccgctgggcaggaagtcctcgttcaggatctgccgtctgaattatttgaaactcatatgcccgatgcatccggccaacgagcccccgacagttggtcaacgctgttagcgcaatgggcggatcgtgcgttgcgttctggtcatcaggatttactgtctgaagcacaaccagaaatggagcgcacgctgttaaccaccgcattacgccatacccaaggccataagcaggaagcagcacgcctgctgggctggggccgtaatacattaacgcggaagttgaaagagttggggatggagtag

SEQ ID NO: 44004 - protein, 470 aa, Yersinia pseudotuberculosis IP 32953
MQRGIVWIVDDDSSIRWVLERALTGAGLNCVAFDSGNQVLDALATRTPDVLLSDIRMPGMDGLALLKQIKQRHPMLPVIIMTAHSDLDAAVSAYQQGAFDYLPKPFDIDEAVALVERAISHYQEQQQPARSQPVSGPTADIIGEAPAMQDVFRIIGRLSRSSISVLINGESGTGKELVAHALHRHSPRAKAPFIALNMAAIPKDLIESELFGHEKGAFTGANQVRQGRFEQADTGTLFLDEIGDMPLDVQTRLLRVLADGQFYRVGGYAPVKVDVRIIAATHQNLELRVQEGKFREDLFHRLNVIRVHLPPLRERSEDIPRLARYFLHVAAKELGVESKNLHPETEAALTRLPWPGNVRQLENTCRWLTVMAAGQEVLVQDLPSELFETHMPDASGQRAPDSWSTLLAQWADRALRSGHQDLLSEAQPEMERTLLTTALRHTQGHKQEAARLLGWGRNTLTRKLKELGME

SEQ ID NO: 44005 - DNA, 1365 bp, Yersinia pseudotuberculosis IP 32953
  CDS (1)..(1365)
atgacaacacataaagcgcatattttggtcgttgatgatgacctgagccactgcacaattatccaggctttaatgaaaggctggggttatcaaaccacgccagcccacaatggattagaggccatcgaactggctaaagagatccctttcgatttaattctgactgatgtgcgaatgtctgaaatggatggtattgaggcattaaaggcaattaaagcctataacccggcaattcctattttaattatgacggcttattccaacgttgaatctgcggttgaggcaattaaagccggggcatacgattatcttaccaaaccgcttgatttcgacatgttacaactcacccttgagcgggcactggaacatacgcatctcaagaatgagaataaaacacttaaacagcagctcatcagtaaccaaaatattattggtcgcagcccacaaatgcgctatctgatggatatggttggcatgattgcgccttctgaagcgacggtgttgatatgtggagaatcgggtacgggcaaagaaattattgcccgctcagttcatgctaacagcccccgtaaagatcaaccgttggtgattgttaactgcgcggcactcagtgagtcattgctggagtccgagctattcggccatgaaaaaggggcgtttactggcgcagataaacgtcgggaagggcgctttatggaggcacataaggcaacgttatttttggatgagattggtgaaatctcagggttgatgcaggcaaaactcctgcgtgctatccaagaacgggagatccagcgcgttggcagtaatcagacattagctattgatgtcaggttgattgccgccactaaccgcaatcttaaagccgatgttgatagtggaaagtttcgccaggatctctactatcgattaaatgtggtcacgatagataccccggcgttgagagagcgaagcgaagatattccgccgttgtcgatgcatttcttggaaaagtttgcgctcaagaaccgtaaatcaatcaaaggattcaccccgcaagcgatgaatatgctgttgaaatacaactggcctggtaacgtgcgtgaattggaaaatacggtggagcgtgcggtgattttactgaccggtgatttcatcagcgagaaggagttgccgttaaatattaatcattatattcaggagaatgccggtagtgagaatataggttatgaggatgcagaaaaacctatccagtctctcgaatgggtcgaaatagacgctattttgactgcgttggaaaagacgggaggcaataaaacagaggcagcaaaacatttaggcatcacgcgcaaaacattgcaggcaaaattacaaaaaagaaattag

SEQ ID NO: 44006 - protein, 454 aa, Yersinia pseudotuberculosis IP 32953
MTTHKAHILVVDDDLSHCTIIQALMKGWGYQTTPAHNGLEAIELAKEIPFDLILTDVRMSEMDGIEALKAIKAYNPAIPILIMTAYSNVESAVEAIKAGAYDYLTKPLDFDMLQLTLERALEHTHLKNENKTLKQQLISNQNIIGRSPQMRYLMDMVGMIAPSEATVLICGESGTGKEIIARSVHANSPRKDQPLVIVNCAALSESLLESELFGHEKGAFTGADKRREGRFMEAHKATLFLDEIGEISGLMQAKLLRAIQEREIQRVGSNQTLAIDVRLIAATNRNLKADVDSGKFRQDLYYRLNVVTIDTPALRERSEDIPPLSMHFLEKFALKNRKSIKGFTPQAMNMLLKYNWPGNVRELENTVERAVILLTGDFISEKELPLNINHYIQENAGSENIGYEDAEKPIQSLEWVEIDAILTALEKTGGNKTEAAKHLGITRKTLQAKLQKRN

SEQ ID NO: 44007 - DNA, 1359 bp, Borrelia garinii PBi
  CDS (1)..(1359)
atgagcaaaatacttgtagctgatgatgaaaagaatattagagaaggaattgctacctatcttgaggatgaaggatattttgttttcacggctagcgacggagaggaagctcttgaaacaattgaaaatgaaaatcttgatgtaataatatctgaccttagaatgcctcagatatcaggagaaaaattgctcaaaatagttaaagaaaaaaacttaaaaataccttttattattttaacggctcacggaacagttgattctgctgtagacgccatgagagaaggcgcttacgatttcttaacaaaacccttagaccttgaaagactcttgctaataataaaaagatcattaaataaaaaagaaaataacaatgaagaaaatgtcaatttagaaaatattctaataagaaaagatttaaaatactatgaaaaaatcatgggaaaatcgctgttaatgcaaaagatttttgaacttgtaataaaaatagcaaaatcaaacgcatctgttcttataacgggcgaaagcggcgttggaaaagagataatagccgatgctatttttgatctttcaaatagaaatgacaaaccatttataaaagtaaattgcgctgcactttctgaaagcatccttgaaagcgagctttttgggcatgaaaaaggagcattcactggcgcaatttccaaaaaaaagggcagatttgaacttgctaacaagggtacaatttttcttgatgagatagcagaaatttcacctgaaattcaagtgaaacttttaagagtactgcaaaacaaaacctttgaacgcgttgggggcgaaactacaattaaagttgacattaggcttctggctgcaacaaacaagaaccttgaagaagaaattaaaaaaggaaaatttagagaagatttattttatagattaaatatcattaatataaacataccgcctttaagagagagaaaagatgatatatctaatttaacaagcatactaataagagacgtcgcaaaggaaaataatagacaagaaaaaactctttctaatgatgcaattaaagctctttattattacgattggccaggaaatattagagaattaaaaaatgtacttgaaagcgcattaatattatcaaaaggaaagcaaatcactaaagaagatttacccgcaaaaatcaaaaataatgaaaatcttatatttaaaatcacactaccaataggaattagcctaaaagaagctgaaaaagaaataataaaacaaacgctttttcattccaaaaacaataaaagtaaatgcgccgaaatattaaaaataggaagaaaaactttacataataaaataatcgaatatcaaattgatcaataa

SEQ ID NO: 44008 - protein, 452 aa, Borrelia garinii PBi
MSKILVADDEKNIREGIATYLEDEGYFVFTASDGEEALETIENENLDVIISDLRMPQISGEKLLKIVKEKNLKIPFIILTAHGTVDSAVDAMREGAYDFLTKPLDLERLLLIIKRSLNKKENNNEENVNLENILIRKDLKYYEKIMGKSLLMQKIFELVIKIAKSNASVLITGESGVGKEIIADAIFDLSNRNDKPFIKVNCAALSESILESELFGHEKGAFTGAISKKKGRFELANKGTIFLDEIAEISPEIQVKLLRVLQNKTFERVGGETTIKVDIRLLAATNKNLEEEIKKGKFREDLFYRLNIININIPPLRERKDDISNLTSILIRDVAKENNRQEKTLSNDAIKALYYYDWPGNIRELKNVLESALILSKGKQITKEDLPAKIKNNENLIFKITLPIGISLKEAEKEIIKQTLFHSKNNKSKCAEILKIGRKTLHNKIIEYQIDQ

SEQ ID NO: 44009 - DNA, 1395 bp, Symbiobacterium thermophilum IAM 14863
  CDS (1)..(1395)
gtgcgcacctacgccctgctgatcgccgacgatgaggcctcgtttcgcgaactcctgcagcggcgactgggccgcaagggttacctggtgaaggccgtggggtcgggaacggaggcgctggaagccctggcggaggaggagttcgacgccgccatcttcgacatgaagatgccggggctggatggcatcgcaacgctccggcgggcgcgggagatccagccttcccttcccgtgctgatcctcaccggacacggttccatcgagacggcggtggaggcgatccgggccggcgcttacgactacctgaccaagccgtgcaacctggccgagctggaggccgtcctggagaaggcgctggagcggcgtgttctggaggtggagaaccaggggctgcgggaggcgctgcggcgcctgggcgacgaggtcgagatcgtgggccgcagcgagccgatccggcggctgttggagctgacccggcgggtggcccaggggtccatgccggtgctcatcgagggcgagagcggcacgggcaaggagctgatcgcaagggcggtccacctgtggagtccccgggcctcgggtccgtttattcccgtaaacgccggggcgctgccggccccgctcctggagagcgagctgttcggccacgcgcgcggcgccttcaccggtgcggtggcggccaaaccgggtttggtggagctcgccgagggtgggacgctgttcctcgacgagatcggggagatgcccctggaggtgcaggccaagctgctccgttttctggagagccatgaggtgcgccgggtaggcgaaacgcgcatccggcgggtggacgtgcgcatcgtcgccgccaccaaccggtgcctgaccgatgaggtgaacgcggggcggttccgggaggacctgtactaccgcctgaacgtggtcaccctccacgtgcctcccctgcgggagcggcgcgaggatatcccgctgctggtcgaacacttcctggcccggctggggtcggcgaaggagatgacgccggacgccatggagatcctcatgcagcaggagttccgtgggaatgtgcgagaattgttcaacgtggtgcagcgcggtgtgatcctgagtcccgaccggtttatcgcgccggaagacctggggcttgccgtgcgtcgcgcacgttccgggcaggccggcgccggcttggaagccgggccaaccgggcggctggatggttccgccagcgagaccggtgaacctttccccacgctggacgaagtggaacgggcgcacatcgcccgggcgctggagcgcacgggctggaaccgggcgcaggccgcacagttgctcggggtcagcgtacgcacgctgtatcggaagatcgagagctacggactcaggtccgggatgtag

SEQ ID NO: 44010 - protein, 464 aa, Symbiobacterium thermophilum IAM 14863
MRTYALLIADDEASFRELLQRRLGRKGYLVKAVGSGTEALEALAEEEFDAAIFDMKMPGLDGIATLRRAREIQPSLPVLILTGHGSIETAVEAIRAGAYDYLTKPCNLAELEAVLEKALERRVLEVENQGLREALRRLGDEVEIVGRSEPIRRLLELTRRVAQGSMPVLIEGESGTGKELIARAVHLWSPRASGPFIPVNAGALPAPLLESELFGHARGAFTGAVAAKPGLVELAEGGTLFLDEIGEMPLEVQAKLLRFLESHEVRRVGETRIRRVDVRIVAATNRCLTDEVNAGRFREDLYYRLNVVTLHVPPLRERREDIPLLVEHFLARLGSAKEMTPDAMEILMQQEFRGNVRELFNVVQRGVILSPDRFIAPEDLGLAVRRARSGQAGAGLEAGPTGRLDGSASETGEPFPTLDEVERAHIARALERTGWNRAQAAQLLGVSVRTLYRKIESYGLRSGM

SEQ ID NO: 44011 - DNA, 1329 bp, Legionella pneumophila subsp. pneumophila str. Philadelphia 1
  CDS (1)..(1329)
atgatcaaaagtaaagtgcttgttatagatgacgaaccagacattagagagttattaactcttactttatcacgcatgggtttaatttgtgatgcggtgtctgattttaagcagggcatagaacatataaaacaaaattattattctttggttttaaccgatatgcgtttgcctgacggagatggtatagaaattgttaaattcattcagaaatacaaaccacagttgccagtcgctgtcattactgcttatggaaatgtagaaggtgcggtcaatactttaaaggctggtgcatttgattatgtatccaagcctgttgacttaaagatgctcagagaactcgttaagacggcattatccatgcaaaatccgtctaccgagagtcctgatgaaggtctattggttggtgagagcctgataatgcaacaactgcgtgagagcattcataaattagctcgtagtcaggcaccggttttcattcaaggtgattcgggtgttgggaaagaacttgttgctcagctgatccatgctaatggtcccagaaaagataagccatttattcctgtaaattgtggtgccatacctggtgagttgatggagtcagagttttttggccataaaaaaggaagttttacaggagcgatttcggataaaacaggattatttgttgcagctcatggcggcactttgtttcttgatgaaatcgccgaacttcctctcgccatgcaggttaaattactacgcgcaattcaggagaaggcaattaaaccaataggtgagttatatgaaattccggtcgatgttcgcattctaagtgcgagtcataaaaatttgattgaggaaatcaatgcagggaggtttcgtcaagatttgtattatcgaattaatgtgattgagctgcgtgttccaactttaatggaaaggctttctgatatcccttgcctgacagaggcgatattaaaaaaattatctaaaaatcaaaacagaaatttggttaaaataaatccctcttgttttgaaatattgagccgttatcatttcccgggaaatgtcagagagttggaaaatatccttgagcgtgccatggctatgtgtgaaggagaggtcatagagccaagcgatttacatttgcccagaacaacaataaccccagctgttgccgtaccctccacgtcaactaacttaaatggttaccttcaggatcaggaaaaagagttaattcttgatgcgcttgagaaaacaaaatggaacagaaccgctgcggcacaactactgggggtcagcttccgaactctccgttatcgattaaaaaaactgggacttgattag

SEQ ID NO: 44012 - protein, 442 aa, Legionella pneumophila subsp. pneumophila str. Philadelphia 1
MIKSKVLVIDDEPDIRELLTLTLSRMGLICDAVSDFKQGIEHIKQNYYSLVLTDMRLPDGDGIEIVKFIQKYKPQLPVAVITAYGNVEGAVNTLKAGAFDYVSKPVDLKMLRELVKTALSMQNPSTESPDEGLLVGESLIMQQLRESIHKLARSQAPVFIQGDSGVGKELVAQLIHANGPRKDKPFIPVNCGAIPGELMESEFFGHKKGSFTGAISDKTGLFVAAHGGTLFLDEIAELPLAMQVKLLRAIQEKAIKPIGELYEIPVDVRILSASHKNLIEEINAGRFRQDLYYRINVIELRVPTLMERLSDIPCLTEAILKKLSKNQNRNLVKINPSCFEILSRYHFPGNVRELENILERAMAMCEGEVIEPSDLHLPRTTITPAVAVPSTSTNLNGYLQDQEKELILDALEKTKWNRTAAAQLLGVSFRTLRYRLKKLGLD

SEQ ID NO: 44013 - DNA, 1362 bp, Legionella pneumophila subsp. pneumophila str. Philadelphia 1
  CDS (1)..(1362)
ttgcctgaacagaaacgtagggtaactttatcaaacaaaggattttctatgagtcatgttttaatagttgaagatgattcagtattaagagaagcgttggctgagactatgacgatctcaggccatacctatatcactgctaaagacggtaaagaggcattagcacttcttgaattacataatccaagtgtcgtactcactgacataagaatggataaattagatggaaatcagttattaaatgaaatacaaaaaaagaggcctggtttgccggttattctaatgacagcttatggttctgtagaggatgcggttacagcgattcgcaatggcgctgttgattatttgcaaaagcccttcagcgcgcaagtcttaattgaaaaaataaagcagtatataaaaactgatctgagtgaagaggataatgatcctattgcacgggatcctaaaagccaagccttactgacaatggctttgagagtcgcacaatccgatgtgggagtaatgatcagtggagaaagcggtactggaaaggaagtgctcgcacattttatccatgatcattcttatcgaagcaaacaaccttttattgcaattaattgtgctgcaattcctgaacaaatgctggaagcaaccctgtttggttatgaaaaaggtgcttttaccggagcatacaaatcaacccctggcaagtttgagcaagcccagggcggaactttacttttagatgaagtaagtgaaatgtccttaggtttgcaggcaaaattacttagagttttacaggaaaaagaagtagaaaggattggttcaaacaaaataataaaccttgatgtgcgcattattgcgacgacaaacaggcaattaaaggaagaggttcaggcagggcgttttagagaggacctttactatcgattgaatgtttttcctctgcaatggcacccactaagagagagaacaagtgatattattccattagcgaattatttaatccgtaaacattgtcagcataaacaaccaatagttccagtcattagcccggatgcgcaaaaggcaatgttgtcctattcatggccagggaatgcgagagagctggataatgttatacaaagagctctggtgttacagactcaaggtatcatcgaagaagagcatttgcagattacgaattcaactaccatgccttcggaagagaagacaaagggtacgagtaaaaatttacagatacatgagtatgaattaatagaaaaaacattattagaaaatgaaggaaacagacaaaaagttgctgcgttattgggggttagcgaaaggactttgcgctataaactcgcaaaaatgcgtgaagaagggtatgtggtttaa

SEQ ID NO: 44014 - protein, 453 aa, Legionella pneumophila subsp. pneumophila str. Philadelphia 1
MPEQKRRVTLSNKGFSMSHVLIVEDDSVLREALAETMTISGHTYITAKDGKEALALLELHNPSVVLTDIRMDKLDGNQLLNEIQKKRPGLPVILMTAYGSVEDAVTAIRNGAVDYLQKPFSAQVLIEKIKQYIKTDLSEEDNDPIARDPKSQALLTMALRVAQSDVGVMISGESGTGKEVLAHFIHDHSYRSKQPFIAINCAAIPEQMLEATLFGYEKGAFTGAYKSTPGKFEQAQGGTLLLDEVSEMSLGLQAKLLRVLQEKEVERIGSNKIINLDVRIIATTNRQLKEEVQAGRFREDLYYRLNVFPLQWHPLRERTSDIIPLANYLIRKHCQHKQPIVPVISPDAQKAMLSYSWPGNARELDNVIQRALVLQTQGIIEEEHLQITNSTTMPSEEKTKGTSKNLQIHEYELIEKTLLENEGNRQKVAALLGVSERTLRYKLAKMREEGYVV

SEQ ID NO: 44015 - DNA, 1350 bp, Bacteroides fragilis YCH46
  CDS (1)..(1350)
atgcttttaattatagatgatgatagcggggtccgctcttccctgagttttatgctgaaacgcgccggttatcaggtaattgcagtgaccggcccgcgtgaggcgatggaagtagttcgttcggaagctccttctctgatcctgatggatatgaattttacactttccacttccggtgaagaaggattgacgcttttaaaacaagtaaaggtttttcgtcccgatgtcccggtcattctgatgactgcctggggcagtatacagttggctgtacaagggatgcaggccggtgcattcgactttatcacgaaaccctggaataacgctgctctgttgcagcgcatcgagacggcactcgaactgactgccactcccaaagacactccacaggagcaaagcggaacactcaaccggagccatatcataggcaaaagccgtgggttgatggaggtattgaatacggtagcacgtattgctcctaccaatgctcccgtattaatcacgggtgaaagcggaacgggtaaagaactgatagccgaagccatccatatcaatagccaacgtgtccgccagccttttgtaaaagtcaatctgggaggaatttcgcagagccttttcgaaagtgaaatgttcggtcataaaaaaggtgcgtttacagatgccactgccgaccgtatggggcgttttgaaatggcgaacaaaggaactatttttttggatgaaatcggggacctcgatccgtcgtgccaggtaaagctgctgcgggtattgcaggaccagacctttgaggtgttgggagacagtcgcccgcgtaagacggatatccgggtggtttcggctacgaatgccgacctgagtaagatggtgagcgaacacacttttcgtgaagacctgttctatcgtatcaatctgataaccgtaaaactgcctgcactgagagaacgcagagaagatataccattgcttgccagacactttgccgaccgtcaggcggagattaacaatctgccccgtacagaattctcgtcggatgcgttgaacttcctgagccgtttaccttttccgggcaatatccgtgaattgaagaacctggtagaacgtacgattctggtcagcgggaaggaagtgttggatgcaatcgatttcgagaaccaataccaacgtcatgacgaaagtgtggcaacttcttcttcatttgcgggaatgaccttggatgaaattgaaaagcaaacgattcttcaggcactggaacgctataaaggaaatctcagccaggtggctaccgcattgggaatcagtcgtgcagcattgtatcgccgtttggagaaatatgatatcggtgataagtaa

SEQ ID NO: 44016 - protein, 449 aa, Bacteroides fragilis YCH46
MLLIIDDDSGVRSSLSFMLKRAGYQVIAVTGPREAMEVVRSEAPSLILMDMNFTLSTSGEEGLTLLKQVKVFRPDVPVILMTAWGSIQLAVQGMQAGAFDFITKPWNNAALLQRIETALELTATPKDTPQEQSGTLNRSHIIGKSRGLMEVLNTVARIAPTNAPVLITGESGTGKELIAEAIHINSQRVRQPFVKVNLGGISQSLFESEMFGHKKGAFTDATADRMGRFEMANKGTIFLDEIGDLDPSCQVKLLRVLQDQTFEVLGDSRPRKTDIRVVSATNADLSKMVSEHTFREDLFYRINLITVKLPALRERREDIPLLARHFADRQAEINNLPRTEFSSDALNFLSRLPFPGNIRELKNLVERTILVSGKEVLDAIDFENQYQRHDESVATSSSFAGMTLDEIEKQTILQALERYKGNLSQVATALGISRAALYRRLEKYDIGDK

SEQ ID NO: 44017 - DNA, 1338 bp, Bacteroides fragilis YCH46
  CDS (1)..(1338)
atgaacacaggaaccattctgattgtagacgataacaaaggagtattggcctcactcgaacttctgctcgaaaactatttcagcaagatactgacagcttcgaatccaaatcagatcaccaccctgctgacaacgcgccgcatcgatgtagtcatcctggacatgaacttctcggcgggtatcaacaatggcaacgagggactttactggttggggcacatccggcagatggctcccactctacccgtagtgatgctgaccgcttacggagatgtggaacttgccgttaaagcacttaaaaacggtgcagccgacttcctgctgaaaccatgggacaaccagaccctgatcgacaaggtgacggaagcctaccatagccgcaaagctccggaacgtactgcaaaagttgacagggctgagggattcgaaatgctggtggggcgttcgcctgccatgttgcaactgatgaaagtggtatcgaaagtggcacgcacggacgccaacatcctgataacgggagaaaacggaacaggcaaagaaatactggcacgggagatacaccgcctctcacctcgtggcgcacgtccgatgctgaacgtagatatgggggccatcagcgagtcgctgttcgaaagtgaactgttcggacacgaacggggagctttcaccgatgcccacgaaagccgtcccggaaagtttgaagcggccaacggcagttcactgttcatggacgaactgggcaacctccctctcccactccaaaccaagctcctcaccgtattgcaaagccggaatgtgactcgtctgggcagtaacaaagtgattccggtcgatatccgcctgatttcggcaacgaacaaagatataccggaaatggtgaagcagggcatgtttcgcgaagacctgttctaccgcatcaacaccattcatctggaactgcctcccctacgtgaacggggagatgatatcctactctttatcgactgcttcttacgtaaattcacctctaaatatcaacggcaggaaatacggatacacgagcagactgtcgaaaaattacgcagttatcattggccgggcaatataagggagttgcagcacaccatcgaaaaagcggtcatcttgtgtgaaggcagcgtaatccgccccaaagatatcctggtgaaacagacctggcaaccgcaggcaaccgccactgtccccaatctggaagaggtggagcggagggccatcgaaactgccatcctgcaaaacaacggtaacctgactgccgcagccgaacaattgggagtgagccggcaaacattatacaataaactcaaacgattcaaactctga

SEQ ID NO: 44018 - protein, 445 aa, Bacteroides fragilis YCH46
MNTGTILIVDDNKGVLASLELLLENYFSKILTASNPNQITTLLTTRRIDVVILDMNFSAGINNGNEGLYWLGHIRQMAPTLPVVMLTAYGDVELAVKALKNGAADFLLKPWDNQTLIDKVTEAYHSRKAPERTAKVDRAEGFEMLVGRSPAMLQLMKVVSKVARTDANILITGENGTGKEILAREIHRLSPRGARPMLNVDMGAISESLFESELFGHERGAFTDAHESRPGKFEAANGSSLFMDELGNLPLPLQTKLLTVLQSRNVTRLGSNKVIPVDIRLISATNKDIPEMVKQGMFREDLFYRINTIHLELPPLRERGDDILLFIDCFLRKFTSKYQRQEIRIHEQTVEKLRSYHWPGNIRELQHTIEKAVILCEGSVIRPKDILVKQTWQPQATATVPNLEEVERRAIETAILQNNGNLTAAAEQLGVSRQTLYNKLKRFKL

SEQ ID NO: 44019 - DNA, 1332 bp, Bacteroides fragilis YCH46
  CDS (1)..(1332)
atgggaactatcatcattgttgacgataacaaaggagtgctgacagccgtacaattactattgaaaaatcatttttcgaaagtcattaccttatcctctcctgtcagtctgtccacagtgcttagagaagaaaacccggaagttgtcttattggacatgaatttcacttccggaatcaataatggtaacgaaggtctgttttggttacatgaaatcaaacggcaatacagagaccttccggtagtactattcacagcttatgctgatattgatcttgccgtacggggtataaaagagggagcatctgattttgtagtgaaaccatgggataatcaaaagctgttggaaactcttttaaatgccgcttcacaagcaaaagacggaaagaaaaagaatcgcaaaaaggaatcatctccggtttctgccatgtattggggtgaaagcagtgctatgcagcagctccgcacgttgattgagaaagtagcaacgaccaatgcgaatatactgataacaggtgaaaacggaacgggaaaggaaatgctcgcacgtgagattcatgctttatcaccacgctctgccgagagcatgatatccgttgatatgggtgctatcaccgaatccttgtttgagagtgaactgttcggacatgtgaaaggttcttttactgacgcccatgccgaccgtacaggtaagtttgaagcagcagaccgaagttccctgtttcttgacgaaataggaaaccttccctttcatttgcaggctaagctactgacagccattcagcagagaagcatagttcgtgtaggtagtaaccaatctatccccgtagacattcgcctaatctgcgcaactaaccgaaacttgcaggagatggtagacaaaggcttattccgtgaagatttattataccgtatcaacaccattcatgtagaaattcctccacttcgcaaacgtaaagaagatattgttccgctagctgagcgttttatagcccgcttttgcaaacagtatgacaaagcctctatcagcctgagtccggccgcttgcgagaaactgaccgcacatgcctggtatggcaatatccgcgaattggaacattccattgagaaagcagtcattattagcgatggtgaaaccatccccgctgaaatgttccaattagtgcagaaaacggagaacccggaaacagagacctctactcttgaagatatggagaaagccatgattcgcaaggctctcgacaaatgtggaggcaacctttcggctgtagccgctcaattaggcattacccgccaaacattatataataagatgaaaaagtttggtttatga

SEQ ID NO: 44020 - protein, 443 aa, Bacteroides fragilis YCH46
MGTIIIVDDNKGVLTAVQLLLKNHFSKVITLSSPVSLSTVLREENPEVVLLDMNFTSGINNGNEGLFWLHEIKRQYRDLPVVLFTAYADIDLAVRGIKEGASDFVVKPWDNQKLLETLLNAASQAKDGKKKNRKKESSPVSAMYWGESSAMQQLRTLIEKVATTNANILITGENGTGKEMLAREIHALSPRSAESMISVDMGAITESLFESELFGHVKGSFTDAHADRTGKFEAADRSSLFLDEIGNLPFHLQAKLLTAIQQRSIVRVGSNQSIPVDIRLICATNRNLQEMVDKGLFREDLLYRINTIHVEIPPLRKRKEDIVPLAERFIARFCKQYDKASISLSPAACEKLTAHAWYGNIRELEHSIEKAVIISDGETIPAEMFQLVQKTENPETETSTLEDMEKAMIRKALDKCGGNLSAVAAQLGITRQTLYNKMKKFGL

SEQ ID NO: 44021 - DNA, 1344 bp, Bacteroides fragilis YCH46
  CDS (1)..(1344)
atgagatccatactgatagttgaagatgatattacgttcgggatgatgctaaaaacctggttaggcaagaaagggtttaatgtatcatcagtgagtaacattgcacgtgcgcaaaagcacatcgatgcacaaccggtagacctgattctttccgacttgcgacttcccgaccacgatggtattcacctgttgaaatggatgggtgagaaagagctccatatcccattgattatcatgacaggatatgcagatatccaatcagccgtacaagcaatgaaactgggtgcacaagactatattgccaaacccgttaatcccgaagagctgcttaagaaaatgagcgaagcacttcaaaagaaagaagctcctcttcccaaaactcccctcacggagaaaagccctaaaaccaaacaagaatctcattcctatctggaaggagaaagtgatgctgccaaacaactctataattatgtcagcctggtagctcccaccaacatgtcagtcctgatcaacggtgccagtggaaccggaaaagagtatgtagcccatcgtattcaccaattaagcaaacgtagcgacaaaccgtttattgccatcgactgtggctccatccccaaagagttggccgcttctgagttcttcggtcacatcaaaggctccttcaccggtgctctctctgataaaaccggtgcttttgtagcagcgaacgggggtaccatctttcttgatgaaatcggtaacctgagttacgaaatacaaattcaacttcttcgtgcactgcaggaacgtaaaatacgccctgttggttcaaactcagaaattactgtcgatatccgtctggtgtctgcaaccaacgagaacctggaacaggccatcgaaaaaggtacattccgcgaagacctctaccaccgaatcaatgaatttactttgcgcatgcctactctgaaagaacgtggcggagacatccttctttttgccaacttcttcctcgaccaggctaataaagagcttgacaagcaactgatcggcttcgatgccaatgcttcaaaggcattactcgaatatcactggcccggcaacctaaggcagatgaagaatatcatcaaacgcgccacattgcttgctcaaggcagtttcataggccttgcagaactgggtagtgaaattctggaaacacaactatcaactcccaaaatgacattacgggatgaagatgccgaaaaggaacatatactggaagcactccgacaaacaggaaacaacaaaagccgtgctgcacaattactcgatattgaccgcaaaacattatacaataaactgaaactatacggaatcgacctctaa

SEQ ID NO: 44022 - protein, 447 aa, Bacteroides fragilis YCH46
MRSILIVEDDITFGMMLKTWLGKKGFNVSSVSNIARAQKHIDAQPVDLILSDLRLPDHDGIHLLKWMGEKELHIPLIIMTGYADIQSAVQAMKLGAQDYIAKPVNPEELLKKMSEALQKKEAPLPKTPLTEKSPKTKQESHSYLEGESDAAKQLYNYVSLVAPTNMSVLINGASGTGKEYVAHRIHQLSKRSDKPFIAIDCGSIPKELAASEFFGHIKGSFTGALSDKTGAFVAANGGTIFLDEIGNLSYEIQIQLLRALQERKIRPVGSNSEITVDIRLVSATNENLEQAIEKGTFREDLYHRINEFTLRMPTLKERGGDILLFANFFLDQANKELDKQLIGFDANASKALLEYHWPGNLRQMKNIIKRATLLAQGSFIGLAELGSEILETQLSTPKMTLRDEDAEKEHILEALRQTGNNKSRAAQLLDIDRKTLYNKLKLYGIDL

SEQ ID NO: 44023 - DNA, 1383 bp, Methylococcus capsulatus str. Bath
  CDS (1)..(1383)
atgagtgaagcgcgcaagcgagtgttgctggtggacgacgatcccgacctgttgcgtctgatcgggctgcgcctgaccgcggcggggttcgatgtggcgaaagcggcgaacggccagtcggcactgtcgcaggtagtggtcttccggccccatgtcgtcgtcaccgatctgaggatggacggtatggacggcatggcattgttcgacgccttgaacgaacgccatcccaccttgccagtgatcatcatgacggcacacggtaccatcaacgacgcagtcgcggcgacccggcggggcgtattcggattcgtcaccaagccggtggacaagaacgaactgattgagcacatctccgaagcgatccgcatcaacggaaacacgaccgtcattcccgacaaggaggagtggcgcgcccggatcgtcacccagagccctttgatggaagaggtcctggggcaggcccagcgtgtggcccagaaccgggccagcgtgttcatcggtggtgaaagcggtaccggcaaggaactgctggctcgggccattcacgacctcagtcctcgtgccaaggggccgttcgtggcggtcaattgcagcgccatcccggaaaatctgctcgagtccgagctgttcggttaccgcaagggggcgttcaccggggcgacgcgggaccaccagggcctgttcaaagcggccgacggtggcacgctgttcctggatgaagtcggtgacatgccacgatcctttcaggtgaaactgttgcgcgcccttcaggagatgaaggtgcgtcccgtcggagcgacccatgacgagccggtcgacgtccgggtgatctcggccacccatgtcgaccttgaacaggcgatggcggaggggaacttccgcgaggatctgtattaccgcctcaacgtcgtgaccctgctgttgccgcccctggtcaaacgtcccgaggacattcccttgctggccatgcattttcttcgggagctggtgagttcgtacggcgaccaggtcaagggcttctctccggaggcgatggaggcgctggtgaattttcagtggcccggcaacgtccggcaactgcgcaacgtggtggaacagtgcgtggcgctgtcgaccacgccactgatccccgtgaccctggtgcaacgtgctttgcgggaggcgccgtcgtctttcccttcgttgcaggaagccagggaccagttcgaactcaactacctcatccgcctattgcagatgacccgagggaacgtgacccaggccgcccgtctggctaagcgcaaccgtaccgagttttaccggctcctgagccggcatggcatgaatccggcgatgttcaagggaggcggagatgccgccggcgatgcgcagccgccttcgtga

SEQ ID NO: 44024 - protein, 460 aa, Methylococcus capsulatus str. Bath
MSEARKRVLLVDDDPDLLRLIGLRLTAAGFDVAKAANGQSALSQVVVFRPHVVVTDLRMDGMDGMALFDALNERHPTLPVIIMTAHGTINDAVAATRRGVFGFVTKPVDKNELIEHISEAIRINGNTTVIPDKEEWRARIVTQSPLMEEVLGQAQRVAQNRASVFIGGESGTGKELLARAIHDLSPRAKGPFVAVNCSAIPENLLESELFGYRKGAFTGATRDHQGLFKAADGGTLFLDEVGDMPRSFQVKLLRALQEMKVRPVGATHDEPVDVRVISATHVDLEQAMAEGNFREDLYYRLNVVTLLLPPLVKRPEDIPLLAMHFLRELVSSYGDQVKGFSPEAMEALVNFQWPGNVRQLRNVVEQCVALSTTPLIPVTLVQRALREAPSSFPSLQEARDQFELNYLIRLLQMTRGNVTQAARLAKRNRTEFYRLLSRHGMNPAMFKGGGDAAGDAQPPS

SEQ ID NO: 44025 - DNA, 1413 bp, Methylococcus capsulatus str. Bath
  CDS (1)..(1413)
atgaagcgagcgttccaggtttgggtggtcgatgacgaccgatcgatccgctgggtcttggaaaaagcgctgcaaaaagcgtcgattcagacccgtgccttctccaccgccaacagcatgatggaagccctgaatcgggaccggccggatgcggtgctgaccgacatccgtatgcccggtctggatggcatcgagctgctgaagcagttgcaggccaaatatcccgatctgccggtcgtgatcatgaccgcgcattccgatctggagagtgcggtgtccgcattcagcggcggggcgttcgagtatctgccgaagccgttcgacgtggacgaggcggtggatctggtcgcaaaggcctgtgcccacagccagcgggcggcgaccggggaagcggccgacaagggcctgccggagaagaccccggaaatcatcggcgaggcgccggcgatgcaggaggtgttccgcgccatcgcccggcttgcgcgttcgaacatcacggtgctgatcaacggcgagtcggggaccggtaaggaattggtcgcccgcgccctgcaccgccacagtccccgcgccgacaagccgttcatcgcgctcaacatggccgccataccgcgcgatttgttggagtccgagttgttcggccacgagcgcggcgctttcaccggtgcgcaggcccgccgggcggggcggttcgagcaggccgacggtggcacgctgttcctggacgagatcggcgacatgccggcggaactgcagacccgtctgctgcgcgtgctggccgagggcgagttttttccggtcggcgcccatgccccggtcaaggtggacgtgaggatcatcgccgcgacccaccagaacctggaacaactggtggcggaaggccgcttccgtgaggatctgtttcaccgcctgaatgtcatccgtatccacatcccaccgctcagggagcggcgccaggacatcgtcctgctgctcaagcatttcctgaaggaggccagccaggaactcaacgtcgagaccaagaccctgctgcccgaagtcgagacttacctgtgccggctggattggccgggcaatgtccggcagttggagaatacctgccgctggatcacggtcatggcggccggcaaggacgtacacctcgacgatctgccgccggagctgctgaaggcccggccggagccggtcgccgtctccagcgaatggcaggacagtttcactcagtggatcgacgcgcgtctgcggcgtggcgaccgcaatgtcgcgaaggaagccatcgattcggccgaaggcatcctcatcagcaccgccttgcaattcacccggggtcgccggcaggaggcagccaagctgctgggttacggcaggaacaccctgacccgtaaaataagcgagctgaacattgacgtctga

SEQ ID NO: 44026 - protein, 470 aa, Methylococcus capsulatus str. Bath
MKRAFQVWVVDDDRSIRWVLEKALQKASIQTRAFSTANSMMEALNRDRPDAVLTDIRMPGLDGIELLKQLQAKYPDLPVVIMTAHSDLESAVSAFSGGAFEYLPKPFDVDEAVDLVAKACAHSQRAATGEAADKGLPEKTPEIIGEAPAMQEVFRAIARLARSNITVLINGESGTGKELVARALHRHSPRADKPFIALNMAAIPRDLLESELFGHERGAFTGAQARRAGRFEQADGGTLFLDEIGDMPAELQTRLLRVLAEGEFFPVGAHAPVKVDVRIIAATHQNLEQLVAEGRFREDLFHRLNVIRIHIPPLRERRQDIVLLLKHFLKEASQELNVETKTLLPEVETYLCRLDWPGNVRQLENTCRWITVMAAGKDVHLDDLPPELLKARPEPVAVSSEWQDSFTQWIDARLRRGDRNVAKEAIDSAEGILISTALQFTRGRRQEAAKLLGYGRNTLTRKISELNIDV

SEQ ID NO: 44027 - DNA, 1314 bp, Legionella pneumophila str. Paris
  CDS (1)..(1314)
atgagtcatgttttaatagttgaagatgattcagtattaagagaagcgttggctgagactatgacgatctcaggccatacctatatcactgctaaagacggtaaagaggcattagcacttcttgaattacataatccaagtgtcgtactcactgacataagaatggataaattagatggaaatcagttattaaatgaaatacaaaaaaagaggcctggtttgccggttattctaatgacagcttatggttctgtagaggatgcggttacagcgattcgcaatggcgctgttgattatttgcaaaagcccttcagcgcgcaagtcttaattgaaaaaataaagcagtatataaaaactgatctgagtgaagaggataatgatcctattgcacgggatcctaaaagccaagccttactgacaatggctttgagagttgcacaatccgatgtgggagtaatgatcagtggagaaagcggtactggaaaggaagtgctcgcacattttatccatgatcattcttatcgaagcaaacaaccttttattgcaattaattgtgctgcaattcctgaacaaatgctggaagcaaccctgtttggttatgaaaaaggtgcttttaccggagcatacaaatcaacccctggcaagtttgagcaagcccagggtggaactttacttttagatgaagtgagtgaaatgtccttaggtttgcaggcaaaattacttagagttttacaggaaaaagaagtagaaaggattggttcaaacaaaataataaaccttgatgtgcgcattattgcgacgacaaacaggcaattaaaggaagaggttctggcagggcgttttagagaggacctttactatcgattgaatgtttttcctctgcaatggcacccactaagagagagaacaagtgatattattccattagcgaattatttaatccgtaaacattgtcagcataaacaaccaatagttccagtcattagcccggatgcacaaaaggcaatgttgtcctattcatggccagggaatgcgagagagctggataatgttatacaaagagctctggtgttacaaactcaaggtatcatcgaagaagagcatttgcagattacgaattcaactaccatgccttcggaagcgaagacaaagggtacgagtaaaaatttacagatacatgaatatgaattaatagaaaaaacattattagaaaatgaaggaaacagacaaaaagtcgctgcgttattgggggttagcgaaaggactttacgctataaactcgcaaaaatgcgtgaagaaggatatgtcgtttaa

SEQ ID NO: 44028 - protein, 437 aa, Legionella pneumophila str. Paris
MSHVLIVEDDSVLREALAETMTISGHTYITAKDGKEALALLELHNPSVVLTDIRMDKLDGNQLLNEIQKKRPGLPVILMTAYGSVEDAVTAIRNGAVDYLQKPFSAQVLIEKIKQYIKTDLSEEDNDPIARDPKSQALLTMALRVAQSDVGVMISGESGTGKEVLAHFIHDHSYRSKQPFIAINCAAIPEQMLEATLFGYEKGAFTGAYKSTPGKFEQAQGGTLLLDEVSEMSLGLQAKLLRVLQEKEVERIGSNKIINLDVRIIATTNRQLKEEVLAGRFREDLYYRLNVFPLQWHPLRERTSDIIPLANYLIRKHCQHKQPIVPVISPDAQKAMLSYSWPGNARELDNVIQRALVLQTQGIIEEEHLQITNSTTMPSEAKTKGTSKNLQIHEYELIEKTLLENEGNRQKVAALLGVSERTLRYKLAKMREEGYVV

SEQ ID NO: 44029 - DNA, 1329 bp, Legionella pneumophila str. Lens
  CDS (1)..(1329)
atgaccaaaagtaaagtgcttgttatagatgatgaaccagatataagagagttattaactcttactttatcacgcatgggtttaacttgcgatgcagtgtctgactttaagcaaggcatagaacatataaaacaaaattattattctttggttttaaccgatatgcgtttacctgatggagatggtatcgaaattgttaaattcattcagaaatacaaaccgcagatgccagttgccgtcattactgcctatggaaatgtcgagggtgcggtcaacactttaaaggcgggtgcatttgattacgtatcaaaacctatagacttaaaaatgcttagagatctcgttaagacggcattatccatgcaaaacccgcctaccgagaagcctgatgaagatctactggttggtgaaagtttggtaatgcaacaacttcgtgaaaacattcataaattagctcgcagtcaggcaccagtttttattcaaggagcttcgggtgttggaaaagaattggtcgctcagttgatccatgttaatggtcccagaaaggataagccatttattcctgtaaactgtggtgctatacctggtgagttgatggaatcagagttttttggccataaaaaagggagctttacaggagcgatttctgataaaacagggttgtttgttgcggctcatggtggcaccttgtttcttgatgaaatcgccgaacttcctctcgctatgcaggttaaattgctacgtgcgattcaggagaaggcaattaagccgataggtgagttatatgaagttcctgtggatgttcgtatcctaagtgcaagtcataaaaatttgattgaggaagttaatgcaggggcatttcgtcaagatttgtattatcgaattaatgtgattgaattgcgtgtcccaactttaatggaaaggctttcagatattccttgcctgacagaggcgatattaagaaagttatctaaaaatcaaaacagaaacctggtgaaaataaatccatcctgttttgaaatattgagtcgttatcattttccaggaaatgtcagagaactggagaatatccttgagcgtgccatggctatgtgtgaaggagaggttatagaaccatccgatttacatttaccaagaacaacaataaccccagctgttgccgtaccctcgacgtcaactaacttaaatggttaccttcaggatcaggaaaaagagttaattcttgatgcgcttgagaaaacaaaatggaacagaaccgctgctgcacaactactgggggtcagctttcgaactctccgttatcgattaaaaaaactgggccttgattag

SEQ ID NO: 44030 - protein, 442 aa, Legionella pneumophila str. Lens
MTKSKVLVIDDEPDIRELLTLTLSRMGLTCDAVSDFKQGIEHIKQNYYSLVLTDMRLPDGDGIEIVKFIQKYKPQMPVAVITAYGNVEGAVNTLKAGAFDYVSKPIDLKMLRDLVKTALSMQNPPTEKPDEDLLVGESLVMQQLRENIHKLARSQAPVFIQGASGVGKELVAQLIHVNGPRKDKPFIPVNCGAIPGELMESEFFGHKKGSFTGAISDKTGLFVAAHGGTLFLDEIAELPLAMQVKLLRAIQEKAIKPIGELYEVPVDVRILSASHKNLIEEVNAGAFRQDLYYRINVIELRVPTLMERLSDIPCLTEAILRKLSKNQNRNLVKINPSCFEILSRYHFPGNVRELENILERAMAMCEGEVIEPSDLHLPRTTITPAVAVPSTSTNLNGYLQDQEKELILDALEKTKWNRTAAAQLLGVSFRTLRYRLKKLGLD

SEQ ID NO: 44031 - DNA, 1458 bp, Photobacterium profundum SS9
  CDS (1)..(1458)
gtggcaatggaaagcggaataaaacaaagacaagtcctaatggtcgaagatacggcatcggtagcggcattgtataaatcttatctaaacccattaggattaaatgtcacgattgtcggaacaggaagggatgcactgaacttcatgaaagagacagtgcctgaacttatcctactagatcttcgtttacctgatatgacaggtatggaagtacttgaatctgtacgccttaaccataagaatttacctgttgttattatgaccgctcacggctctattgatgttgcggtagatgcgatgagacacggtgcccaagattttctgatcaaaccctgcgaagctgatcgtttacgcattacggtgaataatgcattaaaagataatagtaaaagtcagcaatcatctaaatctaaacaaggtggagcgcaatatcaggggttcatcggtaacagtatacctatgcaagccgtatatcgtgttattgaatctgcagcgtcgagtaaggcgacggtttttgttacgggtgaaagtggtacgggtaaagaagtgtgtgctgaagcgattcatgctgctagtccgcgtaatgataaaccgtttgtcgcattaaattgtgctgctattcctaaagatctcattgaaagtgagttatttggtcatgttaaaggtgcatttacaggtgcatcgacagaacggcaaggtgctgttgaaatggctcataaaggtacattgtttcttgatgaactttgtgaaatggatttggatttgcaaagcaagttgctacgttttattcaaacaggaacatatcaaaaagtaggctcttctaaaacgagtactgttgatgtacgctttgtatgtgctacaaatcgtaatccgtggattgaagttcaagaagggcgcttccgagaagatctctattatcgcctacatgttattcctattgccttgcccccactgcgtgatcgtagtgacgatatgattgaaatagcacatgctttattggcattaatgtctgtggaagaaggaaaaaactttagtcgtttttcttcagatgttattgatttgtttaagttacatacttggccgggcaatgttcgtgaattacaaaacgttattcgtaatattgttgttttaaattctggcgaagaagtgactcttcaaatggttccaccgccagttagtgagatatctggcgctgaaattgcatcctctctaagaattgcctctggagtacaaaaaagtacgattgtacagaaagacatcttacataccgaacccattgaacggactgcaattgagccgctttggattgttgaaaaacgcgcaatacaagctgctattgatgcgtgtgatggtaatgttcctcgtgctgcaggtttgctagaagttagcccatcaacaatttatagaaaattacaagcttggcaagatgctgtaggtagtaatagggagatcgattaa

SEQ ID NO: 44032 - protein, 485 aa, Photobacterium profundum SS9
MAMESGIKQRQVLMVEDTASVAALYKSYLNPLGLNVTIVGTGRDALNFMKETVPELILLDLRLPDMTGMEVLESVRLNHKNLPVVIMTAHGSIDVAVDAMRHGAQDFLIKPCEADRLRITVNNALKDNSKSQQSSKSKQGGAQYQGFIGNSIPMQAVYRVIESAASSKATVFVTGESGTGKEVCAEAIHAASPRNDKPFVALNCAAIPKDLIESELFGHVKGAFTGASTERQGAVEMAHKGTLFLDELCEMDLDLQSKLLRFIQTGTYQKVGSSKTSTVDVRFVCATNRNPWIEVQEGRFREDLYYRLHVIPIALPPLRDRSDDMIEIAHALLALMSVEEGKNFSRFSSDVIDLFKLHTWPGNVRELQNVIRNIVVLNSGEEVTLQMVPPPVSEISGAEIASSLRIASGVQKSTIVQKDILHTEPIERTAIEPLWIVEKRAIQAAIDACDGNVPRAAGLLEVSPSTIYRKLQAWQDAVGSNREID

SEQ ID NO: 44033 - DNA, 1416 bp, Photobacterium profundum SS9
  CDS (1)..(1416)
atgagcaaaggattgatatgggttgttgatgatgacagctcaattcgttgggtattagaacgcacactcaatgcagccggattacaatgcgaaacctttgccagtgccgataatgtcattgaagcattagagcgtaatgttccagatgtattggtttcagatctccggatgcctggcactgatggattaacactgcttcgttcattgcaaaaagatttccctgcattgcccgttatcatcatgacggcacactctgaccttgatgccgcagttaacgcctatcaagaaggagcattcgaatacctacctaagccttttgatatcgatgaagccgtcaatcttgttgagcgagctgtgactcatagccaagagcaaaaacgccaacagcagccagaaagtgacactaaagcagtaccggaaattatcggcgaagccccggcaatgcaggaagtattccgtgcaatcggtcgtttatctcgctcatcgatttcagtattaattaacggtgaatcaggcacaggtaaagaattagtcgcccacgccctgcaccgtcatagcccacgtagcaagcaagcttttattgctttgaatatggccgcaatacctaaagatttaattgaatctgaattattcggccatgagaaaggagcatttaccggcgccaacagcgtacgacaagggcgatttgaacaagcgaatggtggcacactgtttctcgatgaaatcggcgatatgccattagatattcaaacccgattattacgtgtattggctgacggacaattttatcgtgttggcgggcactctgcggttaatgtcgatgttcgcattatcgcggcaacgcaccaaaaccttgaaaaactggttgccgatggcggattccgagaagatttattccaccgtttaaatgttattcgggtgcatatcccttcattaaaagatcgtcgccaagacataccacaattaacacgacactttttacaacgggcgtcagatgaactcgcagttgaagtgaaaacattgcatccagatactgttgatgtgatcacgaatctcaattggccgggtaatgttaggcaattagaaaatacctgtcgttggttaacagtgatggcaagtggtaatgaaatactgccttccgatctccctcccgagctactagaagcccctacgctcatcaatggtgaaccaacgaattcacactggcatcattctttgcaatgctgggcaagaacagcacttcaacaaggaaacgacaatttacttggcgaagcgttaccagaatttgaaaaaatcttgctcgaaacggcactggaacacacccatggccataaacaagaagccgccaagctacttggctggggcagaaacaccttaacccgtaaactcaaagagctgaatatatcatcagattaa

SEQ ID NO: 44034 - protein, 471 aa, Photobacterium profundum SS9
MSKGLIWVVDDDSSIRWVLERTLNAAGLQCETFASADNVIEALERNVPDVLVSDLRMPGTDGLTLLRSLQKDFPALPVIIMTAHSDLDAAVNAYQEGAFEYLPKPFDIDEAVNLVERAVTHSQEQKRQQQPESDTKAVPEIIGEAPAMQEVFRAIGRLSRSSISVLINGESGTGKELVAHALHRHSPRSKQAFIALNMAAIPKDLIESELFGHEKGAFTGANSVRQGRFEQANGGTLFLDEIGDMPLDIQTRLLRVLADGQFYRVGGHSAVNVDVRIIAATHQNLEKLVADGGFREDLFHRLNVIRVHIPSLKDRRQDIPQLTRHFLQRASDELAVEVKTLHPDTVDVITNLNWPGNVRQLENTCRWLTVMASGNEILPSDLPPELLEAPTLINGEPTNSHWHHSLQCWARTALQQGNDNLLGEALPEFEKILLETALEHTHGHKQEAAKLLGWGRNTLTRKLKELNISSD

SEQ ID NO: 44035 - DNA, 1410 bp, Salmonella enterica subsp. enterica serovar Paratypi A str. ATCC
  CDS (1)..(1410)
atgcaacgaggaatagtctgggtcgtcgatgatgatagttccatccgttgggtgcttgagcgtgctctcgccggggcagggttgacctgtaccacctttgagaatggtaatgaagtactggctgcgctggccagtaaaacgccggacgtcttgctgtcggatatccgaatgccgggaatggacgggctggcgctattaaagcagattaaacagcgtcacccgatgcttccggtcatcattatgaccgcgcattccgatttagatgccgccgtgagcgcctatcagcagggggcgtttgattatctacctaaaccgtttgatattgatgaagccgtcgctctggtcgagcgcgcgattagccactatcaggagcagcagcagccgcgtaatatcgaggttaacggcccgacaacagacatgataggcgaagcgcccgccatgcaggatgtgtttcgcattattggtcggctgtcgcgttcttcgattagcgtgctgattaacggcgaatcagggaccggtaaagaactggtcgcccatgcgcttcaccgccatagcccacgcgccaaagcgccgtttatcgcgctcaatatggcggccatcccgaaagatttgattgaatccgaactgtttggccatgagaaaggcgcttttaccggggcgaataccatccggcagggccgtttcgagcaggctgacggcggcacgctgtttctggacgaaattggcgatatgccgctggatgtccagactcgtctgttacgcgtgctggctgacggacagttctaccgtgtgggcgggtacgcgccggtaaaagtggatgtgcgcattattgccgccacccaccagaacctcgaacgacgcgttcaggaagggaaattccgtgaagacctgttccaccgcctgaacgtgattcgtatccatctcccgccgttgcgcgagcgccgtgaggatattccgcgcctggcgcgccattttttgcaggtcgccgcccgtgaattaggcgtggaagccaaattattacatccggaaaccgaaacggcgttaacgcgcctggcatggcctggtaacgtgcgtcagttagaaaatacctgccgctggctcaccgtcatggccgccggacaggaggtattgacccaggatttaccgggcgaactgtttgaagcctcgacgccggatagcccgtcccacctgccgccggatagctgggccacattactggcgcaatgggcggaccgtgccttgagatccggtcatcaaaacctgctttctgaagcgcagccagaactggaaagaacgctactgaccacggcgttacgccatacgcagggtcataaacaggaagccgccaggctgctcggttgggggcgaaacaccctaacgcggaagttgaaagagctgggaatggagtaa

SEQ ID NO: 44036 - protein, 469 aa, Salmonella enterica subsp. enterica serovar Paratypi A str. ATCC
MQRGIVWVVDDDSSIRWVLERALAGAGLTCTTFENGNEVLAALASKTPDVLLSDIRMPGMDGLALLKQIKQRHPMLPVIIMTAHSDLDAAVSAYQQGAFDYLPKPFDIDEAVALVERAISHYQEQQQPRNIEVNGPTTDMIGEAPAMQDVFRIIGRLSRSSISVLINGESGTGKELVAHALHRHSPRAKAPFIALNMAAIPKDLIESELFGHEKGAFTGANTIRQGRFEQADGGTLFLDEIGDMPLDVQTRLLRVLADGQFYRVGGYAPVKVDVRIIAATHQNLERRVQEGKFREDLFHRLNVIRIHLPPLRERREDIPRLARHFLQVAARELGVEAKLLHPETETALTRLAWPGNVRQLENTCRWLTVMAAGQEVLTQDLPGELFEASTPDSPSHLPPDSWATLLAQWADRALRSGHQNLLSEAQPELERTLLTTALRHTQGHKQEAARLLGWGRNTLTRKLKELGME

SEQ ID NO: 44037 - DNA, 1407 bp, Idiomarina loihiensis L2TR
  CDS (1)..(1407)
atgaccactaatgctcagttatggataattgatgatgacgactctattcgctgggtactggaaaaagcctttgctgatagccgttatcacgtgcgcagttttgccaatggcgaagactttttcatggctctaaagagcgataaaccaaccgttgtgctcaccgatatccgtatgccgggagaaaacggcctggctgtactggagcggctgcatcagaccgaggcgcatttgcctgttgtggttatgaccgcgcattccgatctcgagacaacggtaaaagcgtttcagggcggcgcatttgagtatctggcaaagccctttgacattgatgaagctattaccgccgttgaccgtgctctgcagcatgccagacaaagtgaaaatgcgcccgcgcaaatagacgcaaattcagttcccgagcttattggtgaagccacgcctatgcaggatgtgtttcgtgctatcggtcgcttgtcgggctcaagcgttagtgtgctgcttaccggagaaaccggtactggcaaagaagttgtcgcgcgagctctgcataaacacagcccacgggcggataaaccttttattgcgcttaacatggcagcaatacccgccgatttaattgagtcggagctgttcgggcacgaacgcggggcctttaccggagccgaccgtaaacgcgtcgggcgttttcagcaagctgacggtggtactttgtttctggatgaaattggcgatatgcctttaccagttcagacacggctgttgagagttctggccgaaggacagttttacccggtgggagcgttgcaaccggtaaaagtggatgtgcgcgttattgccgccacccaccgggaactagaacacttggttaaccagggcacattcagggatgacctttatcatcgtcttaacgttatccgtttgcggctgccgcctctgcgtgagcgggcggaagatatcgatactctggcaagacactttcttaaaaagtcggccgaagagttgaatgtcacaccaaaaacattgttaaatgaaacgcttagcacattaaagagttacaattggccaggtaacgtccgacaactggaaaatacctgtcgctggctaaccgttatggcgcccgggcagcaaataagtccccgggacttgcctgaagacattctggtgacttcagagccaggttcgacagagccaggcggtgagcttacctggttacactttttgcaaactgagctggaacagcagccgttaaactcgcaggatgttctgcaaagttatcagcagcagctggagcaggttgcgttacagactgctttaaaacgtttttccggacataaacaaaaagcagccgcatggctgggctggggaaggaataccttaacccgaaagttgaaaactctgctaaagtaa

SEQ ID NO: 44038 - protein, 468 aa, Idiomarina loihiensis L2TR
MTTNAQLWIIDDDDSIRWVLEKAFADSRYHVRSFANGEDFFMALKSDKPTVVLTDIRMPGENGLAVLERLHQTEAHLPVVVMTAHSDLETTVKAFQGGAFEYLAKPFDIDEAITAVDRALQHARQSENAPAQIDANSVPELIGEATPMQDVFRAIGRLSGSSVSVLLTGETGTGKEVVARALHKHSPRADKPFIALNMAAIPADLIESELFGHERGAFTGADRKRVGRFQQADGGTLFLDEIGDMPLPVQTRLLRVLAEGQFYPVGALQPVKVDVRVIAATHRELEHLVNQGTFRDDLYHRLNVIRLRLPPLRERAEDIDTLARHFLKKSAEELNVTPKTLLNETLSTLKSYNWPGNVRQLENTCRWLTVMAPGQQISPRDLPEDILVTSEPGSTEPGGELTWLHFLQTELEQQPLNSQDVLQSYQQQLEQVALQTALKRFSGHKQKAAAWLGWGRNTLTRKLKTLLK

SEQ ID NO: 44039 - DNA, 1341 bp, Idiomarina loihiensis L2TR
  CDS (1)..(1341)
atgaccgcagcaaaagccatgataggcgttattgaggatgatccggctctgcaggagttgctggttgaagagctggaggccgagggctataaagtcaccgcgtggggaagtattgaagcctttaaaaaatcggtaacgccattggatttggttatcagcgatattcgcttaccgggattgtcaggcttgtctttactggaaagtttaaaaaatgaagagaactcccctgcgctgttattgattaccgcatttggtacggttgatcaggcggttgatgctttaaaacaaggagccgatgactttctaaccaagccgctggatgttgaacacctattgcttagcgtaaaacggatattagaacatcggtcactgcagcgtgagcttaaacggtatcgtcagcaacaaaagggccccgggggcttagtcggccaaagcccgtcaatgcgtaaactgtatgaccagatagagcgcatagctccggcagacggcagcgtcttaattaccggtgaaagcggtacgggtaaagagttggtggcaaaggcactgcatcagttaagtgaccgcgctgagcagagcttccaggcggtgaactgtgcgggcattccagccgagttaatggaaagcgaattctttggtcacacagctggcgcatttaccggtgctcagaaaaagcgtcagggcctgcttaagcaggccgacggcggtactttgttgctggacgaaattggtgaaatgccaatggcgttacaggctaaactgctacgtgtattgcaggaaggcacgattcgcgccgtgggcagcgacgaagaagaaacggtgaatgtccggatcctggctgcaacccaccagaacttagagcaacaggtagaagatgggcgcttccggcaggatttattttaccgtctggaaacctttagtttacgagtaccaccgctgcgggaacggggagaagatattgagcgtttagctaattttttcctacagcagctgcagaaaaacagtgataaaccggttcgcagcatttctccggctgcactggagcagctttattgctatcgctttccgggcaacgtacgtgaattacagaatgctattgaacgtgcctttactttctccagagacgataaaatagcggttgaagatttaccgcaaagaattttggatagtgagcatgaacccgacgtggattatggcaccgagtggccgactctggatgaatatcagaatcagtacattcgtaaggtattgacgcatgccgaagggaataaatctaaagcggcagaaattctcggagtcacaaggcgcactctataccgttggctggaacagcatggcgagtga

SEQ ID NO: 44040 - protein, 446 aa, Idiomarina loihiensis L2TR
MTAAKAMIGVIEDDPALQELLVEELEAEGYKVTAWGSIEAFKKSVTPLDLVISDIRLPGLSGLSLLESLKNEENSPALLLITAFGTVDQAVDALKQGADDFLTKPLDVEHLLLSVKRILEHRSLQRELKRYRQQQKGPGGLVGQSPSMRKLYDQIERIAPADGSVLITGESGTGKELVAKALHQLSDRAEQSFQAVNCAGIPAELMESEFFGHTAGAFTGAQKKRQGLLKQADGGTLLLDEIGEMPMALQAKLLRVLQEGTIRAVGSDEEETVNVRILAATHQNLEQQVEDGRFRQDLFYRLETFSLRVPPLRERGEDIERLANFFLQQLQKNSDKPVRSISPAALEQLYCYRFPGNVRELQNAIERAFTFSRDDKIAVEDLPQRILDSEHEPDVDYGTEWPTLDEYQNQYIRKVLTHAEGNKSKAAEILGVTRRTLYRWLEQHGE

SEQ ID NO: 44041 - DNA, 1404 bp, Azoarcus sp. EbN1
  CDS (1)..(1404)
atgaaagccactcacagtcccgcccccactgccggcgcccacctgctgctcgtcgatgacgacaccgacctgctcaagctgctgtcgctgcgcctgcacgcgagcggttatcgcgtcagcaccgccgagacggcggaggctgcgctcggacgcatcgcagtcgaacgcttcagcctggtcgtcagcgacgtgcgcctcccggaccgcgacggactcgcgctgttcgaggaaatccggcgtacctgccctgtgctgccggtgatcctgctcaccgcgcacggcagcattcccgacgccgtcgaggcgacttcccgcggcgtcttcggctatctgacaaaacctttcgacagtcaggcgctgcttgaaaagatctcccaggcgttgcaggtaggcggcccgatacacgtcgggaacgacgccgacgacggggactggcgtgatgaaatcatcagccacagcaaccgcatggcgaccgtcctcgacgaagcccgtctcgtcgccgcgtcggacgcgagcattctcatccgcggcgacagcggcaccggcaaggaattgctcgcgcgcgcaatccaccgcatcagcagccgcgcgaacgcgccgttcgtcgcgatcaactgtggcgcaattccggaacagttgctcgaatcggaactcttcggccacgtgaaaggcgctttcaccggcgcggcgacggccaacaccgggcttttccttaccgcccatcgcggcacggtgtttctcgacgagatcggcgacatgccgctcgcgctgcaggtgaagctgctgcgcgtgctgcaggagcgcgccgtgcgccccgtcggggcgagtcgcgccgagccgatcgacgtgcggatcatctccgcgacgcaccgcgacctggaactcgcgcttgccgaggggcagttccgcgaggatctgttctaccgcctcaacgtcgtcagcctgaccttgccgacgctcgaccagcgccgcgaagacatcccgctgctcgccaaccatttcctcgaggttatcgggcgcaaataccacaaacggctgcgcggtttcgcccccgaagcgatggaagcactcgcgacggcggcttggccggggaatatccgccagctgcagaacgtcgtcgaacaggcctgcgcgctcgcgacgacgtcactgatcccgctcgcgttggtcgaacgggcgctgcgggtgccgagcatcgaagccctgagttacgccgaagcaaagcaacgcttcgaacgcaactacctcatccagctgctcaaactcaccgacggcaatgtttcggacgcagcgcgcctcgcggaccgcaaccgtacggagttctatcgcctgctgcaacggcatgcgctgactcccagtctgttccgcgacggttcggttgtcgctcgcgaacgacagcaataa

SEQ ID NO: 44042 - protein, 467 aa, Azoarcus sp. EbN1
MKATHSPAPTAGAHLLLVDDDTDLLKLLSLRLHASGYRVSTAETAEAALGRIAVERFSLVVSDVRLPDRDGLALFEEIRRTCPVLPVILLTAHGSIPDAVEATSRGVFGYLTKPFDSQALLEKISQALQVGGPIHVGNDADDGDWRDEIISHSNRMATVLDEARLVAASDASILIRGDSGTGKELLARAIHRISSRANAPFVAINCGAIPEQLLESELFGHVKGAFTGAATANTGLFLTAHRGTVFLDEIGDMPLALQVKLLRVLQERAVRPVGASRAEPIDVRIISATHRDLELALAEGQFREDLFYRLNVVSLTLPTLDQRREDIPLLANHFLEVIGRKYHKRLRGFAPEAMEALATAAWPGNIRQLQNVVEQACALATTSLIPLALVERALRVPSIEALSYAEAKQRFERNYLIQLLKLTDGNVSDAARLADRNRTEFYRLLQRHALTPSLFRDGSVVARERQQ

SEQ ID NO: 44043 - DNA, 1392 bp, Azoarcus sp. EbN1
  CDS (1)..(1392)
atgcagcgcgaccacgccgagccggcgctcgaaccggcgagagccgcggaattcaactggcaggcccattcgatcctcgtcgtcgatgacgaggaggacacgcgcagcttcctcgaacgggcgctgcgtccgcgctgcgggctcgtggagatcgcgcgcgacgccgagcaggcggcgcgcctgatggcgcggctgcatttcgacctgctgatcctcgacatcgcgctgccgggcaaatcgggcctcgcgtggctgcacgaattgcgcgaacacggcttcagcggcgacgcgatcctcgtcgccgctgaagccgacctcgataccgcgatcgccgcgctgcgcggcggcgcttcggatttcatcctcaaaccgttccgcgtcgaccagatcctcaattcggtcaggaactgctttcagcgcgctcacctcgcccgcgagaacttcgtgctgcgacgcgagcttgccggcctgggcggcgaagtcagcaacggcctggtgggtcgttcggatgcgatgcagcagctgcgtgaagtgctgcaccgcgtcgcgcagacctcgagcacggtgctgctgctcggcgaatccggcaccggcaaggaagtggcggcacgcgcgctgcacgagatgagcccgcgcgcgcgacggccattcgtgcccgtgaattgcgccgcgatcgcgtcggagctgatcgagagcgagcttttcggccacatccggggagcttttaccggcgcgaccgagagccgcaacggcctgttccattatgcccacggcggcacgctgttcctcgacgagatcggcgagctgccgctggcgctgcagacgcggctgctgcgcgtgctcgaggagcgccgcctgcggccggtcgggtcggagcgggaggtgccggtcgatgtgcgcatcatcgccgcgtccaaccgcgacctcgccaccgaggtcgctgcgggccgcttccgcgaggacctgtatttccgtctcgcggtcgtcgacatcctgatcccgccgctgcgcgaacgcgccgaagacattccggacctgctgcatcacttcatgaacctgctgacgatgcagctcgcggtacccgcgctcgcaatccccgaggccctgctcgcgcggctggcgcattaccgttggccgggcaacgtgcgcgaattgcgcaacttcgtcgaacgttcgctgatcctcggcgcatttccgccggaggcgccgaacctgcgcggcgatgcgttgctggtcggtactgagctgtcgctcggcgaagtcgagaagcgccatatcctgcacatgctcgaagcgtgcggcggcaacaagtccgaagcggcgcgccggctcggcgtttcgcgcaagacgctggaacgcaagtgcgccgaatgggacgaatcgctgacctga

SEQ ID NO: 44044 - protein, 463 aa, Azoarcus sp. EbN1
MQRDHAEPALEPARAAEFNWQAHSILVVDDEEDTRSFLERALRPRCGLVEIARDAEQAARLMARLHFDLLILDIALPGKSGLAWLHELREHGFSGDAILVAAEADLDTAIAALRGGASDFILKPFRVDQILNSVRNCFQRAHLARENFVLRRELAGLGGEVSNGLVGRSDAMQQLREVLHRVAQTSSTVLLLGESGTGKEVAARALHEMSPRARRPFVPVNCAAIASELIESELFGHIRGAFTGATESRNGLFHYAHGGTLFLDEIGELPLALQTRLLRVLEERRLRPVGSEREVPVDVRIIAASNRDLATEVAAGRFREDLYFRLAVVDILIPPLRERAEDIPDLLHHFMNLLTMQLAVPALAIPEALLARLAHYRWPGNVRELRNFVERSLILGAFPPEAPNLRGDALLVGTELSLGEVEKRHILHMLEACGGNKSEAARRLGVSRKTLERKCAEWDESLT

SEQ ID NO: 44045 - DNA, 1371 bp, Azoarcus sp. EbN1
  CDS (1)..(1371)
atgaaccaccccgaacgacgccaacgcccccgcatcgacgtcctcgtcgtcgacgacgaggaagacatccgcgaagtgctcgagctgtcgctgatgcgcatgggcctcggatgcgacactgtcggcacgatcgccgatgcgtgccggctgctcggcgaccgggcttatcggctgtgcctcacggacatgcgcctgcccgatggcgacggcatcgagctcgttgcccacatccagacccagcagccaggcctgccggtcgcggtcgtcaccgcctacggcagcatcgaaaccgcgatccgcgcgctcaaggccggcgctttcgacttcgtcacgaagcctgttgagctgaaggcgctgcgcgaactcgtcagtcacgctctccggcttgcgcagccggccagggtcgcccctgccgtcgcgagcggccgcagcctgatcgggtgctccgcggcgctcgcgcagttgcgcgtgcaggtcgaaaagctcgcgcgcaaccaggcgccggtgtttatccacggggaatccggcactggcaaggaagtcaccgcgcgcctgatccacgagctcggcccgcgcgccgccggcccgttcgtgccggtcaactgcggcgcgatctcgccggagctgatggaaagcgagttcttcggccaccgcaaaggcagcttcaccggcgcggtgtcggacaaggatggcctgttccaggcggcgcgcggcggcacgctgtttctcgacgaagtagccgacctgccgctggcgatgcaggtgaagctgctgcgcgcgatccaggaacgcgcagtgcgcccggtcggcgcgcacgccgaggagtcggtcgatgtgcgcatcctgtcggcgtcgcaccgcgacctcgcgcagctcgtcgctgcaggcaagtttcgccaggacctgtacttccgcatcaacgtcatcacgctgcgtgtgccgccgctgcgcgaacgccccgaagacatcccggagcttgccgcgcacatcctcgcccggctcgccgagcgcgaaggcggtgcgcctcgtcgcctgagcgcaggcgccgcagccgaactccagcagcacgcttttccgggcaacgtgcgcgagctcgaaaatcttctcgaacgcgcgtgcgcgctgtgcgacggcgacgagatcggcgtcgacgacgtcaggctgtacccgacgacaggcatcggcgagccgctgcgcttcgacttcggcgatcactccgacgacgagcgcgacggcgacggcgacgacgagcgcctgcgcgtgctgcgcatgctcgacgacacccgttggaaccgttctgaagccgcgcgccggctcggcatgacgctgcgccagctgcgctaccggctgcagaagtgggggatggagtaa

SEQ ID NO: 44046 - protein, 456 aa, Azoarcus sp. EbN1
MNHPERRQRPRIDVLVVDDEEDIREVLELSLMRMGLGCDTVGTIADACRLLGDRAYRLCLTDMRLPDGDGIELVAHIQTQQPGLPVAVVTAYGSIETAIRALKAGAFDFVTKPVELKALRELVSHALRLAQPARVAPAVASGRSLIGCSAALAQLRVQVEKLARNQAPVFIHGESGTGKEVTARLIHELGPRAAGPFVPVNCGAISPELMESEFFGHRKGSFTGAVSDKDGLFQAARGGTLFLDEVADLPLAMQVKLLRAIQERAVRPVGAHAEESVDVRILSASHRDLAQLVAAGKFRQDLYFRINVITLRVPPLRERPEDIPELAAHILARLAEREGGAPRRLSAGAAAELQQHAFPGNVRELENLLERACALCDGDEIGVDDVRLYPTTGIGEPLRFDFGDHSDDERDGDGDDERLRVLRMLDDTRWNRSEAARRLGMTLRQLRYRLQKWGME

SEQ ID NO: 44047 - DNA, 1428 bp, Azoarcus sp. EbN1
  CDS (1)..(1428)
atgaacaccgtctggatcgtcgatgatgaccgctccatccgctgggtgatcgaaaaagccctcagccgcgaaaacatttcgcaccgcagctttgcctcggcgggcgaagcgctcacggcgctggaaaccgcgccccaccccccgaaagtgctggtttcggatatccgcatgcccggcgaatcaggcctcgggctgctgcagcgcgtgaaaaccctgcacccgcacctgccggtcatcatcatgaccgcttactccgacctcgaaagcgcggtctcggcattccagggcggagcattcgaatatctgcccaagcccttcgacgtcgaccaggcggtggccctcgtgcagcgtgcgatcgcccagaacgcgcaccagcagggcgcaccggaggaggcgaccgtcgcgcccgaaatcctcggccaggcaccttcgatgcaggaagtgtttcgcgcgatcggccgcctcgcacagtcgcacgcgacggtgctgatcaacggcgaatcgggcaccggcaaggaactggtcgcgcgcgcgctgcatcgccacagtccccgccgtgacgccccgttcatcgcgatcaacactgcagcgatcccgcgcgacctgctcgaatcggaacttttcggccatgagcgcggcgccttcaccggcgcggctgcgcaacgccgcgggcgtttcgaacaggccgatggcggcacgctgttcctcgacgagatcggcgacatgcccgccgaactgcagacccgcctgctgcgagtgctgtcggacaatcatttctaccgcgtcggcggccaccagccggttcgcgccaacgtgcgcgtcatcgccgcgacgcaccagcacctcgaagaccgcgtgcggcaggggctgtttcgcgaggacctgttccaccgcctcaacgtcatccgcctgcgcctgccgccgatgcgcgagcgccgcgaggacatccccatcctggtgcggcatttcctgcagaaaagtgcgcaggatctcggcgtcgagcccaagcgcgtttccgaaccggcgctgaagtacctgcaggctctacctttccccggcaacgtccggcagctcgagaacctgtgccactggctgacggtgatggcgccgggacagaccatcgaggtcgccgacctgccgcccgaaatgcgcgaccggcccgagcgcgagatgcccgtcgcctgggtcgatggactcgccgtcgaggcggaccgcctgatcgcgacttcccccggcgaggtcttcgaccgcctgacgcgcgaattcgaacgcacgctgatccgccgcgccctgacggccactggcggacggcgcatcgacgcggcgctgctgctcggcatcggccggaacacgatcacgcgcaagatccaggaactcgggatggaggaccatcggcatccgccggcgagcgaaaacgcttccagctaa

SEQ ID NO: 44048 - protein, 475 aa, Azoarcus sp. EbN1
MNTVWIVDDDRSIRWVIEKALSRENISHRSFASAGEALTALETAPHPPKVLVSDIRMPGESGLGLLQRVKTLHPHLPVIIMTAYSDLESAVSAFQGGAFEYLPKPFDVDQAVALVQRAIAQNAHQQGAPEEATVAPEILGQAPSMQEVFRAIGRLAQSHATVLINGESGTGKELVARALHRHSPRRDAPFIAINTAAIPRDLLESELFGHERGAFTGAAAQRRGRFEQADGGTLFLDEIGDMPAELQTRLLRVLSDNHFYRVGGHQPVRANVRVIAATHQHLEDRVRQGLFREDLFHRLNVIRLRLPPMRERREDIPILVRHFLQKSAQDLGVEPKRVSEPALKYLQALPFPGNVRQLENLCHWLTVMAPGQTIEVADLPPEMRDRPEREMPVAWVDGLAVEADRLIATSPGEVFDRLTREFERTLIRRALTATGGRRIDAALLLGIGRNTITRKIQELGMEDHRHPPASENASS

SEQ ID NO: 44049 - DNA, 1395 bp, Azoarcus sp. EbN1
  CDS (1)..(1395)
atgaaccgacacatcctgatcgtcgacgacgaggcgctgtaccgccagctgctcaccagccggctcggccgcgccggctaccgcctcagcgaagccgcggacggcgaggctgcgctcgaatgtgcgcaacacggcggaatcgacctcgcgctcgtcgacatcaagatgccgggcatcgacggcatcgaggtgttgaagcggctcaaggagctcgatccgctgatcgaagtcgtgatcctgacggggcacggcaacgtcgacaccgcgatctcggcaatgaagctcggcgccttcgactacctgtcgaaaccttacaagctgaccgagctcgacatcgtcgtcgagcgcgcgctcgaaaagcgcgcgatggcacagcgctgcgcggcgctgagtgccgaggtcgccgcgctgcgcagcacggacgacggcgcggtgatcggcgcgagcgccgcgtggaagcgcatgctcgcgctcgtgcgccgcgccgcaccgctcgacctgccggtgctgatcaccggcgagagcggtgccggcaaggaggtcgtcgcgagcgcgctgcaccgctggagcaaccgcgcgaaggaatcctacgtgccgctgaactgcggcctgctcgacgacgacctcgtcgagagcgaacttttcggccacaagcgcggcgcgttttcaggcgcgacggccgacaaggaaggcctgttccaggtcgcgagcgccgggactctgttcctcgacgagatcggcgaactccccctcgggtgccaggcgaagctgctgcgcgtgctcgacagcggcgaattccgccagctcggcgcgaccgcgctgcggcacacccatgcgcgcgtcgtcgccgcgacgcaccgcgacctcgataagctcgtcgctgaaggcaaattccgccacgacctgctgtaccgactcaacgtcgtacatatccacgtgcccccgctgcgcgaacggacggaggacatcccgctgctcgtcgaacacctgctccgtcgcaggacgccccaatcagggccggtgccgcaactcgcgccgaccgcgctcgcacacctcgtcgcctaccgctggcccggcaacgtccgcgagctccgcaacgtcgtcgagcgacttatcgccttccgcgaaggcgacacgatcggggaggcggaagtgtgtgcggtgctcgggattgccccggcgcccgcgccgggctgcgcgcggggaggggcggcggccgcttcggatggcatcgtgcccctcgacgatttccagcgcgactacgtgctgcgcgtgctcgacaagctcgacggcaacgtcagcgcagcggcacaggcgctgggcgtgtcgcgctcgaccgtctatcgcttcctgcgagaaatgcctgttacggatgacgcccaacgtttgacatga

SEQ ID NO: 44050 - protein, 464 aa, Azoarcus sp. EbN1
MNRHILIVDDEALYRQLLTSRLGRAGYRLSEAADGEAALECAQHGGIDLALVDIKMPGIDGIEVLKRLKELDPLIEVVILTGHGNVDTAISAMKLGAFDYLSKPYKLTELDIVVERALEKRAMAQRCAALSAEVAALRSTDDGAVIGASAAWKRMLALVRRAAPLDLPVLITGESGAGKEVVASALHRWSNRAKESYVPLNCGLLDDDLVESELFGHKRGAFSGATADKEGLFQVASAGTLFLDEIGELPLGCQAKLLRVLDSGEFRQLGATALRHTHARVVAATHRDLDKLVAEGKFRHDLLYRLNVVHIHVPPLRERTEDIPLLVEHLLRRRTPQSGPVPQLAPTALAHLVAYRWPGNVRELRNVVERLIAFREGDTIGEAEVCAVLGIAPAPAPGCARGGAAAASDGIVPLDDFQRDYVLRVLDKLDGNVSAAAQALGVSRSTVYRFLREMPVTDDAQRLT

SEQ ID NO: 44051 - DNA, 1428 bp, Xylella fastidiosa Ann-1
  CDS (1)..(1428)
atggttgagattgatgcgacttccccacgcatctgggtggttgacgacgatcgctcggtacgcttcgtgttatctactgcactgcgtgatgcaggctatatcgtggaaggtttcgagagtacttgcgcagcgttgcaagccctagcagcctccccaatcccagacttattgttcaccgacgtacgcatgcctggtgatgatggtttgattttgctggacaagctcaaagcacgccatccgcaccttccagtaattgttatgtctgcctacaccgatgtggctagcactgccggtgcatttcgcagtggtgcacatgaattcttgtccaagccatttgatctagacgatgcggttgagttggcagctcgtgtgttgccacatacagaaggatctcatgggagaccacccatattgcctgctgccaacagtaatcccgtcttgatcggcagcactccggtgatgcgtgctttgttccgtgcaatcggacggttggcgcaggcaccactctcggtgctgattaacggtgaaacaggcactggcaaagagctcgttgcacgtgcgttacacaacgaatctccgcgtgcgcaggcgccgttcgttgcgctgaatgctgcggcgattccaaccgagcttttggagagcgagttgttcggtcacgaggccggcgcgtttacaggagcgaccaaacgtcatattggccgctttgagcaagccgatggcggcactttatttttggatgaaatcggcgatatgccgttgtctttgcagacgagactgttacgtgtactggctgaaaatgaattcttccgggtcgggggccgtgaactgatccgtgtcaatgtccgtgtgattactgcgacccatcaggatcttgatatgttggtccagcaggggcgttttcgttccgatctcttgcaccgtttagatgtggtgcgcttgcaactgccatcgttacgtgagcggcgtgatgacgtggcacagttggccgagaattttttggcgatggctgggcacaagctggatatctcagttaaacgtttgtctgccgatgcgctagagatactgcgtcgctacgattggccaggtaatgtccgtgagctcgaaaatatttgctggcgattagctgctttggtgaacactgagacaattgatgccaatgatgttgaagctgtgttaacacatggcaagcgcaagcgttgtaacactgaaagtgattgggatatccatttagccaaatgggcggaagaccgcttagctgcaggcgcaactgctgtgcatgccgaggctcgcaaatgtttggaccgaacactactggatgtggcattgcgtttgacgcagggccgtcgtgccgaagcagctgcacgtcttggtctgggtcgtaacacgttgacccgcaagcttggctcaagtcaacgtcgtaggaggtaa

SEQ ID NO: 44052 - protein, 475 aa, Xylella fastidiosa Ann-1
MVEIDATSPRIWVVDDDRSVRFVLSTALRDAGYIVEGFESTCAALQALAASPIPDLLFTDVRMPGDDGLILLDKLKARHPHLPVIVMSAYTDVASTAGAFRSGAHEFLSKPFDLDDAVELAARVLPHTEGSHGRPPILPAANSNPVLIGSTPVMRALFRAIGRLAQAPLSVLINGETGTGKELVARALHNESPRAQAPFVALNAAAIPTELLESELFGHEAGAFTGATKRHIGRFEQADGGTLFLDEIGDMPLSLQTRLLRVLAENEFFRVGGRELIRVNVRVITATHQDLDMLVQQGRFRSDLLHRLDVVRLQLPSLRERRDDVAQLAENFLAMAGHKLDISVKRLSADALEILRRYDWPGNVRELENICWRLAALVNTETIDANDVEAVLTHGKRKRCNTESDWDIHLAKWAEDRLAAGATAVHAEARKCLDRTLLDVALRLTQGRRAEAAARLGLGRNTLTRKLGSSQRRRR

SEQ ID NO: 44053 - DNA, 1413 bp, Xylella fastidiosa Ann-1
  CDS (1)..(1413)
atgaatgaatcccgcagtgctctgattgtcgatgacgagcgcgacatccgtgaacttttggtccttacgctaggacgtatggggctgcgtatcagaacggcagctaatctggcacaagcatacgcgttacttgagtctgactcgttcaatctttgtatcaccgacatgcgtttacctgatggcagtggcattgagctggtgaaaaagattgtgcgtcattatccacgcaccccggtggccatgatcactgcttttggcagtatcgaactggcggtagaggcgctcaaggaaggtgcttttgactttgtcagcaaacctgttgatctgaacgtcctgcgaggcatggtccgtcatgctttggaattgaacaatcgtgaacgctctgttgtgtcaagtcagccacaaagccccagccaacgtctccttggtgaatcatcaccgatggctcagcttcgggccactatcgctaaagtggcgcgtagtcaagccccggtttatatccttggtgaatcaggagttggtaaagaactggttgcacgtacgatccacgaacagagtgtgcgtgctgctggggcgttcgtgccggtcaactgtggtgcgatccctgtggatcttatggaaagcgaatttttcggtcacaagaaagggagtttcaccggtgcgcatactgataagccaggtttattccaaagtgctggcggcggtactttattcctggatgaagttgccgaattacccttgcacatgcaagttaaattgctgcgtgcgattcaggagaaatcgatacggccaatcggtgcaaccgttgaggtaccagtagatgtgcgtattttatcggcgactcaccaagatctgagtgacctgattgccaatggccgcttccgtcacgatttgtactaccgcattaatgtaatcgagatacgtgttccaccgctacgtgagcgtgctggcgatttgctgcatcttgctgcagccattgtggctcgcttggcacacacgcatgggcgggcggtcccgttgctttcaccctccgccttggaggcgttagaacattattcgttcccgggtaatgtgcgtgaactggagaacattctggagcgtgctctagcactgactgaagataatcatatcggtgctgcggatctgcacctgccccagggcagtttgcatggacagggattgccgctcccgttagtgcccacagctctcccgattgtgcctgtggacgcatcagcatcggtggagggtgagaatacgccggctgccttgccgtcgtacatggagcagctggaacgtgctgccattcaaaaggcgttggaagagaatcgctggaataaaacaaagacagctgcaaaacttggcatcactttccgtgcattgcgttacaaactaaagaagctgggcatggagtga

SEQ ID NO: 44054 - protein, 470 aa, Xylella fastidiosa Ann-1
MNESRSALIVDDERDIRELLVLTLGRMGLRIRTAANLAQAYALLESDSFNLCITDMRLPDGSGIELVKKIVRHYPRTPVAMITAFGSIELAVEALKEGAFDFVSKPVDLNVLRGMVRHALELNNRERSVVSSQPQSPSQRLLGESSPMAQLRATIAKVARSQAPVYILGESGVGKELVARTIHEQSVRAAGAFVPVNCGAIPVDLMESEFFGHKKGSFTGAHTDKPGLFQSAGGGTLFLDEVAELPLHMQVKLLRAIQEKSIRPIGATVEVPVDVRILSATHQDLSDLIANGRFRHDLYYRINVIEIRVPPLRERAGDLLHLAAAIVARLAHTHGRAVPLLSPSALEALEHYSFPGNVRELENILERALALTEDNHIGAADLHLPQGSLHGQGLPLPLVPTALPIVPVDASASVEGENTPAALPSYMEQLERAAIQKALEENRWNKTKTAAKLGITFRALRYKLKKLGME

SEQ ID NO: 44055 - DNA, 1464 bp, Magnetospirillum magnetotacticum MS-1
  CDS (1)..(1464)
atgagcaccatgacaaccaccaccacggccacaattctggtggccgatgacgatcggggcatccgcacggtactgtcccaggctttgggccgggcgggctacgaggtgcggaccaccggcaatgcctcgaccctgtggcgctgggtgtcggaaggcgagggcgatctggtgatcaccgatgtggtgatgcccgacgaaagcgggctggacctgctgccgcgcatgaagaagatccgcccggaactgcgcatcatcgtcatgagcgcccagaacacgctgctgaccgcggtgaaggctacccagcgcggcgctttcgaatacttgcccaagcccttcgacctcaaggaactggtcaatgtggtcgggcgcgccttgtccacgccgcgggcctctcccaccgaggccgccgccgatgacgacgatgaaaagctgccgctgatcggccgatcgcctgccatgcaggagatctaccggaccctggcgcggctgatgagtaccgatctgtcggtgatgatcacgggcgaatcgggcacgggcaaggaactggtggcccgcgcgctgcacgattacggcaagcgccgcaacggtcccttcgtggccatcaacatggcggccattccgcgcgagctgatcgaaagcgagttgttcggccacgaaaagggcgcctttaccggcgccacccagcgggctgccggacgtttcgaacaggccgagggcggaaccttgttcctggacgagatcggcgacatgccgcccgaggcccagacccgtctgctgcgtgttctgcaagaaggcgagtataccacggtgggcgggcgcacccccatccgcgccaatgtgcgcatcgtggccgcgacccaccgcgatcttacccaactgatccgccaaggcctgttccgcgaggatctgttctaccgcctgaacgtggtgcccatccgcctgccgcccttgcgcgagcggtccgaggacattccggagctgatccgtcatttcctggcccaggcgggagcggagggattgccgtccaagaccatcgacggcctggccatggaccggctgcgcaagcaccgctggccgggcaatgtgcgcgaactggagaatctggttcgccgtctggcggcgctgtattcccaagaagtgatcggcattgaggttatcgagcaggaactggtgggcggtacgccccatgccgacgccatttccggcggggtggagggcgaggggctgtccgctacggtggagcggcatctgcgcgaatatttcggcaatcacggcgacggactgccgcctgccggagtctacgaccgggtgctgcgcgaagtggaacgtcccctggttaccatcgccttggaagcgacgcgcggcaatcagatcaaggcggcccatctgctgggcgtcaaccgcaatacgcttcgcaagaagatcaaggacctggacatccagatcgcccgcggcctcaaataa

SEQ ID NO: 44056 - protein, 487 aa, Magnetospirillum magnetotacticum MS-1
MSTMTTTTTATILVADDDRGIRTVLSQALGRAGYEVRTTGNASTLWRWVSEGEGDLVITDVVMPDESGLDLLPRMKKIRPELRIIVMSAQNTLLTAVKATQRGAFEYLPKPFDLKELVNVVGRALSTPRASPTEAAADDDDEKLPLIGRSPAMQEIYRTLARLMSTDLSVMITGESGTGKELVARALHDYGKRRNGPFVAINMAAIPRELIESELFGHEKGAFTGATQRAAGRFEQAEGGTLFLDEIGDMPPEAQTRLLRVLQEGEYTTVGGRTPIRANVRIVAATHRDLTQLIRQGLFREDLFYRLNVVPIRLPPLRERSEDIPELIRHFLAQAGAEGLPSKTIDGLAMDRLRKHRWPGNVRELENLVRRLAALYSQEVIGIEVIEQELVGGTPHADAISGGVEGEGLSATVERHLREYFGNHGDGLPPAGVYDRVLREVERPLVTIALEATRGNQIKAAHLLGVNRNTLRKKIKDLDIQIARGLK

SEQ ID NO: 44057 - DNA, 1374 bp, Magnetospirillum magnetotacticum MS-1
  CDS (1)..(1374)
atgccgcatatcctgcttgtcgatgacgaccgcgccatttgccggacgctcaatctgcatttccagcaaaacaacatggacgtcaccgtcgcccattcggccgaggacggcatcaacaaagcagaaaatcctgagatcgacgccgtgatctccgatgtcaggctgcccggggctgacggcatgagcctgctatcgtccatcaaggccattcggcccaccctgccggtgatcatgatcaccgccttccacgacttcgagaccacggtcgccgccatgcagggcggtgccatcgattatgtgccaaagcccatcgatctggacgaactggacgcggcggtggaacgcgccctgtcccagggacgctccggcgaggggctggtgatcggtggcacctctggcggcagcggcacccagattgtgggccagtccttcgccatgaaggaggtcttcaagagcatcggcctcgtggcgcaaagccggatcacagccttgatcctgggcgagtccggcaccggtaaggaattggccgcccgcgctgtgcacaatgccagcgccgaacgtcacctgcccttcgtagcggtcaattgcgccgcactggtggagaccttgctggaaagcgagatgtttggccacgagcgcggggctttcactggcgcggtcagcgcccacaagggcaaggtggagcaagtcggcgaaggcaccttgttcctggacgaaatcgcggaattgtccatgcccatgcagagcaagctgctgcgcatcctggaagagagggaatacacgccggttggcggaacccaggtcaagaagagcagcgcccgcttcattaccgcgaccaatgtcgatctgcgcgagcgggtcgcaaatgggttgttccgcgaagacctttattaccggcttaacgtggcgaccatcaccctgccgccgcttcgcgaccgtccgagcgacattcggctgctggtcgagttcctgctgcggaaaatcaataaggatctccgcaagacgatccgccgggtttccgccgacgccttgacttgcctcgaagcctatggctggcccggcaatgtgcgcgagttggaaaacgtactcatgaaggcggctgtccttcaacgcggcgatctgctgactcccgactgcctgccgccggaactgcggcgtgaaccggttcaggcggcggcggacggggcttgcgcaggcgtcctgtgctcattgcgcgatcttgagcgcgatcatatccgtcgggtcttggccgagactcattggcacaaggggaaggcttgcgacattctcggaatttcgcgtccgcggctagaacgccgcatcaaggaattcggcatggtctcgcccaggagcagatccgacgatgaggattga

SEQ ID NO: 44058 - protein, 457 aa, Magnetospirillum magnetotacticum MS-1
MPHILLVDDDRAICRTLNLHFQQNNMDVTVAHSAEDGINKAENPEIDAVISDVRLPGADGMSLLSSIKAIRPTLPVIMITAFHDFETTVAAMQGGAIDYVPKPIDLDELDAAVERALSQGRSGEGLVIGGTSGGSGTQIVGQSFAMKEVFKSIGLVAQSRITALILGESGTGKELAARAVHNASAERHLPFVAVNCAALVETLLESEMFGHERGAFTGAVSAHKGKVEQVGEGTLFLDEIAELSMPMQSKLLRILEEREYTPVGGTQVKKSSARFITATNVDLRERVANGLFREDLYYRLNVATITLPPLRDRPSDIRLLVEFLLRKINKDLRKTIRRVSADALTCLEAYGWPGNVRELENVLMKAAVLQRGDLLTPDCLPPELRREPVQAAADGACAGVLCSLRDLERDHIRRVLAETHWHKGKACDILGISRPRLERRIKEFGMVSPRSRSDDED

SEQ ID NO: 44059 - DNA, 1437 bp, Azotobacter vinelandii
  CDS (1)..(1437)
atgagccgaagcgaaaccgtgtggatcgtcgacgacgaccgctccatccgttgggtcctggaaaaggccctgcaacaggaaggcatgaccacccagagcttcgacagcgcggacggcgtgctcagccgcctgtcccgccagcggcccgacgtgatcatctccgacatccgcatgcccggtgccagcggcctcgagctgctggcgcagatccgcgagcattacccgcgcctgccggtgatcatcatgaccgcgcactccgacctggacagcgcggtggcctcctaccagggcggtgccttcgaatacctgcccaagccgttcgacgtcgacgaggcggtgtcgctgatcaagcgtgccaacctgcacgcccaagagcagcaggggctggaggtgccaaccatccaggccaacactccggaaatcatcggcgaggcgccggcgatgcaggaggtattccgtgccatcggccgcctctcccactccaacatcaccgtgctgatcaacggcgagtccggtaccggcaaggaactggtcgcccatgccctgcaccgtcacagcccgcgtgccaaggcccccttcatcgcgctgaacatggcggcgatcccgaaggaactgatggagtccgagctgttcggccatgagaagggtgccttcaccggcgccgccagcctgcgccgcggacgcttcgagcaggccgacggcggcaccctgttcctcgacgagatcggcgacatgccggccgacacccagacacgcctgttgcgcgtgctggccgacggcgagttctatcgggtcggcggtcacacgccggtcaaggtcgacgtacgaatcatcgccgccacccatcagaacctggaaaacctggtgcaggctggcaagtttcgcgaggatctgttccatcgcctgaacgtcatccgcatccacatcccgcgcctctccgaccgtcgcgccgacatccccgcactgacccggcatttcctcaaccgcgccgccgtggaactggcggtcgagcccaagacgctcaagccggaaaccgaggagtacctgagcaatctgccctggcccggcaacgtgcgccaactggagaacacctgccgctggatcaccgtgatggcctcgggccgcgaggtgcacatcgacgacctgccgccggaactgctcagccatgcccaggagaacgcgccggccagcaactgggaacaggccctgcgtcagtggaccgatcaggccctggcccgcggtcagtcgaacctgctggacatcgtcgtgccggccttcgagcgggtgatgatcgagagcgtactcaagcacaccgccggacgccgtcgcgatgcggccctgctgctcggctggggacgcaacaccctgacgcgcaagatcaaggaactcggcatgaacgtaggcggcagcgacgaggaagacggcgacgagggctga

SEQ ID NO: 44060 - protein, 478 aa, Azotobacter vinelandii
MSRSETVWIVDDDRSIRWVLEKALQQEGMTTQSFDSADGVLSRLSRQRPDVIISDIRMPGASGLELLAQIREHYPRLPVIIMTAHSDLDSAVASYQGGAFEYLPKPFDVDEAVSLIKRANLHAQEQQGLEVPTIQANTPEIIGEAPAMQEVFRAIGRLSHSNITVLINGESGTGKELVAHALHRHSPRAKAPFIALNMAAIPKELMESELFGHEKGAFTGAASLRRGRFEQADGGTLFLDEIGDMPADTQTRLLRVLADGEFYRVGGHTPVKVDVRIIAATHQNLENLVQAGKFREDLFHRLNVIRIHIPRLSDRRADIPALTRHFLNRAAVELAVEPKTLKPETEEYLSNLPWPGNVRQLENTCRWITVMASGREVHIDDLPPELLSHAQENAPASNWEQALRQWTDQALARGQSNLLDIVVPAFERVMIESVLKHTAGRRRDAALLLGWGRNTLTRKIKELGMNVGGSDEEDGDEG

SEQ ID NO: 44061 - DNA, 1401 bp, Azotobacter vinelandii
  CDS (1)..(1401)
atgccacatattctgatcgtcgaagacgaaaccatcatccgctccgccctgcgccgcctgctggaacgcaaccactatcaggtcagcgaggccggctcggtgcaggaagcccgggagcgccacagcctgcccggcttcgacctgatcatcagcgacctgcgcctgcccggcgcgcccggcaccgaactgatacgcctggccgagggtaccccggtactgatcatgaccagctatgccagcctgcgctcggcggtggactcgatgaagatgggcgcgatggactacatcgccaagcccttcgaccacgacgagatgttgcagacggtggcgcgcatcctcagcgagcgccgccaggcgccggccgccctggccgaaccggcggccgcccaggcccccgccccggccagcggcgagatcggcatcatcggctcctgtcccgccatgcgcgatctgttcggcaagatccgcaaggtcgccccgaccgactccacggtgctgatccagggcgaatccggcaccggcaaggaactggtcgcccgcgccctgcacgacctgtcgaaacgcgccaaggccccgctgatctcggtgaactgcgcagcgatcccggaaaccctgatcgaatccgaactcttcggccacgagaaaggcgcctttaccggcgccgtcgccggacgcaccggcctggtcgaagccgccgacggcggcaccctgttcctcgacgagatcggcgaactgcccctggaggcccaggcgcgcctgctgcgcgtgctgcaggagggcgagatccgccgggtcggctcggtgcagtcgcagaaggtcgatgtccgcctgatcgccgccacccaccgcgatctcaagggactgtccaagaccggccagttccgtgaggacctgttctaccggctcaatgtcatctcgctgaagctgccggccctgcgcgagcgcgacggtgacgtcctggagatcgcccaggccttcctcaggcgccagagcgagcgcatggagcgcggcgagctgtgcttctcccccgaggccgagcggaccatctgccagtacgcctggccgggcaacgtgcgcgaactggagaatgccatcgagcgcgcggtgatcctctgcgaaagccagaccataccggccgacctgctgggcgtcgatgtcgaactggaagacctggaggacgatgatttcgccgaattacccgatcccgaggtcgacggcagccacgagcccaccgaggatctctcgctggaagactacttccagcacttcgtcctggagcatcaggaccacatgaccgagaccgaactggcccgcaagctcggcatcagccgcaagtgcctgtgggaacgtcgccagcgtctcggcattccgcgccgcaagtcgagcgctcccagttcctga

SEQ ID NO: 44062 - protein, 466 aa, Azotobacter vinelandii
MPHILIVEDETIIRSALRRLLERNHYQVSEAGSVQEARERHSLPGFDLIISDLRLPGAPGTELIRLAEGTPVLIMTSYASLRSAVDSMKMGAMDYIAKPFDHDEMLQTVARILSERRQAPAALAEPAAAQAPAPASGEIGIIGSCPAMRDLFGKIRKVAPTDSTVLIQGESGTGKELVARALHDLSKRAKAPLISVNCAAIPETLIESELFGHEKGAFTGAVAGRTGLVEAADGGTLFLDEIGELPLEAQARLLRVLQEGEIRRVGSVQSQKVDVRLIAATHRDLKGLSKTGQFREDLFYRLNVISLKLPALRERDGDVLEIAQAFLRRQSERMERGELCFSPEAERTICQYAWPGNVRELENAIERAVILCESQTIPADLLGVDVELEDLEDDDFAELPDPEVDGSHEPTEDLSLEDYFQHFVLEHQDHMTETELARKLGISRKCLWERRQRLGIPRRKSSAPSS

SEQ ID NO: 44063 - DNA, 1341 bp, Azotobacter vinelandii
  CDS (1)..(1341)
atgcagcagattctcttcatcgacgacgaagcaccgatccgcgaagcggtgcagcagtggctggagctgtccgggctcgcggtgcgtacctgcgcccacgccgaggaggcgctggcgctgctcgacgccgacttccccggggtggtggtcagcgatgtgcgcatgcccggcatggacggcctggcgctgctcgaacgcctcaaggcgctggatgccgaattgccggtgatcatggtcaccgggcatggcgacgtgcccatggcggtgaccgcgatgcagcagggcgcctacgacttcatcgagaagcccttcagccccgagcgcctgctcggcagcctgcggcgcgccctggagatgcgccggctggtctgcgagaaccgcgcgctgcgccgccaggtggcgcggcgcgagcacatcgagggccgtctgctcggcgtgtcgccggcgatggaggaactgcgccggcagatcctcgaactggcgccgaccacggtcaacgtgctggtccgcggcgagaccggcagcggcaaggaatgcgtggcgcgctgcctgcacgccttcggcccgcgcgccggcaaggctttcgtcgcgctcaactgcgcggcgattcccgagcagttgttcgagagcgagctgttcggccacgagagcggcgccttcaccggcgcccagggcaagcgcatcggccgtatcgagcacgccgacggcggcaccctgttcctcgacgagatcgagagcctgccgctggcgcagcaggccaagctgttgcgcgtgctgcaggagaagacgctggagcggctcggctccaaccgcagcatcgccgtcgacctgcgggtgatcggcgcggtcaagccggacctggtcgccgaagtgcgcgccgggcgttttcgcgaggatctcctgtaccggctcaatgtcgccgagttgcgcgtcccgccgctgcgcgagcggcgcgaggacattccgctgctgttcgagtatttcgccctcgccgcggccgagcgtcacgaccgcgaaccgcgcccgctggcggccgccgaactggcgcggctcatggctcacgactggccgggcaacgtgcgcgagctggtcaacgccgccgagcgtcacgtactcggcctgggcgggcggaccggcgaggcgctggcggcgccgcggtcgctggcggcgcagctggaggccttcgaggcgcagtgcctgcgccaggccctgcagcagtgccgcggcaacatcgccgaggtcatggccctgctgcaactgccccggcggacgctcaacgagaagatgcaacgccacggcctgaaccgcatcgatttcctgcccgccggggaccaggactga

SEQ ID NO: 44064 - protein, 446 aa, Azotobacter vinelandii
MQQILFIDDEAPIREAVQQWLELSGLAVRTCAHAEEALALLDADFPGVVVSDVRMPGMDGLALLERLKALDAELPVIMVTGHGDVPMAVTAMQQGAYDFIEKPFSPERLLGSLRRALEMRRLVCENRALRRQVARREHIEGRLLGVSPAMEELRRQILELAPTTVNVLVRGETGSGKECVARCLHAFGPRAGKAFVALNCAAIPEQLFESELFGHESGAFTGAQGKRIGRIEHADGGTLFLDEIESLPLAQQAKLLRVLQEKTLERLGSNRSIAVDLRVIGAVKPDLVAEVRAGRFREDLLYRLNVAELRVPPLRERREDIPLLFEYFALAAAERHDREPRPLAAAELARLMAHDWPGNVRELVNAAERHVLGLGGRTGEALAAPRSLAAQLEAFEAQCLRQALQQCRGNIAEVMALLQLPRRTLNEKMQRHGLNRIDFLPAGDQD

SEQ ID NO: 44065 - DNA, 1386 bp, Desulfitobacterium hafniense DCB-2
  CDS (1)..(1386)
atgagtgaggatcgacatatcgttatcatcgacgatgaaccggatatgctggaaacctgtgccagggttatccatcggatgggctataaatgtacgacctatgaagatagctgcgaggctttggaggagatttacaggctgcagcctgacctgatcataaccgatatcaaaatgcctcaatgcgatggctttgaagtcctggaaaaagctaaagtatgtactcccaaggccagagtcattgtgatcacagggtatgcttcggtggactcagctgtacaggccatgaaagaaggggcctacgattatctctccaagcccttccccatcgaacagctgcagctgaccatcaataaggcccttcaacatatcgccttaacagaggaaaatcaactgctgcgggctcagctacaggaaggtttgaacactgataatattattggcgcacggggaggactgcaggatgtctttgagacgattggcaagatttccaatagcgatgcgtccatccttatcctgggagaaagcggtacagggaaagaagttatcgcccgggctattcacaaaaacagccggcgttctacagggccctttattcccgtggattgtgcgtccttaccggaaaatttattagagagtgaattatttggttatgaaagaggagcctttacaggggcgaacacgaccaagcagggtttgttggaaatggcccatgggggaactctctttctggatgaattgggagaactgaccccggccatgcaggccaagcttttaagaacattggaagaacgggcgatccgaagagttggaggcaatcgcttgatcaatatcgatattcgggttttggccgctaccaatcgtgatttggaaaaagcaatccgggccaaagaattcagagaagatctctattatcgaatcaacgtcattaccctcaagctccctgtcttgcatgaacggcagcaggacattcccttgctggtcaatcatttctgtaagaagttttcccaggatatgaataagaaggtaagcggcttcactcccgaggccatgcaggccatgaaaagctatgcctggccggggaacatccgcgaactgcgtaatgttgtggaaagggccatctccctatcgggatcagagatggttgaaatttccgatctgccggaaaaagtcattggcggacaaaaaaagattctccctgagcaggagaatctgggagccttttcttttcacgaggctaaggatatttgcttgaagagatttgagatggaataccttaaggaacttttggacaaacatcatggcaatattactcaagcggccaaatcagccgggatggatcgcaaaacaatccataggctgatcaataagtatgatttgcagaggtag

SEQ ID NO: 44066 - protein, 461 aa, Desulfitobacterium hafniense DCB-2
MSEDRHIVIIDDEPDMLETCARVIHRMGYKCTTYEDSCEALEEIYRLQPDLIITDIKMPQCDGFEVLEKAKVCTPKARVIVITGYASVDSAVQAMKEGAYDYLSKPFPIEQLQLTINKALQHIALTEENQLLRAQLQEGLNTDNIIGARGGLQDVFETIGKISNSDASILILGESGTGKEVIARAIHKNSRRSTGPFIPVDCASLPENLLESELFGYERGAFTGANTTKQGLLEMAHGGTLFLDELGELTPAMQAKLLRTLEERAIRRVGGNRLINIDIRVLAATNRDLEKAIRAKEFREDLYYRINVITLKLPVLHERQQDIPLLVNHFCKKFSQDMNKKVSGFTPEAMQAMKSYAWPGNIRELRNVVERAISLSGSEMVEISDLPEKVIGGQKKILPEQENLGAFSFHEAKDICLKRFEMEYLKELLDKHHGNITQAAKSAGMDRKTIHRLINKYDLQR

SEQ ID NO: 44067 - DNA, 1338 bp, Pseudomonas syringae pv. syringae B728a
  CDS (1)..(1338)
atgagccaacggcaaaaaatcctgatagtcgatgatgagccggatattcgcgaactcctggagatcacgctgggacgcatgaaactcgacacccgtagtgcgcgtaacgttgccgaagcccacgactggctggcccgcgaaccgttcgacatgtgcctgaccgacatgcgtctgccggacggcaatggccttgagctggtgcaacacatacagcacggctacccccacgtgccggtggcgatgatcactgcccacggcaacctggacaccgcgatccacgcgctgaaggccggagctttcgactttgtgaccaagccggtcgacctgggcaggttgcgcgagctggtcaatagcgcgctgagcctgcccggcgcgcaacccacgcgcagcatcgacaaccgcctgctgggcgactcgctggcaatgcgtaccttgcgcagtcagatcggcaagctggcccgcagccaggcgccgatctacatcagcggcgaatcaggcagtggcaaggagctcgtagcgcgtctgatccacgagcagggcccgcgcatcgacaaacctttcataccggtgaattgcggcgccattccttccgaactcatggaaagcgaattcttcggtcatcgcaaaggcagctttagcggtgcccacgaagacaagccaggtctgtttcaggcggcgcataccgggacgctgtttctcgatgaggtcgccgacctgccgctggccatgcaggtcaaactgctgcgcgccattcaggaaaaatccatccgcagcgtcggcggccaacaagagcagatcgtcgacgtgcgcattctgtgcgccacccacaagaacctgaatgcagaggtcgcggccggtcggttccgtcaggatctgtattaccgattgaacgtgatcgaagtgcgcgtgccctcgttgcgcgagcggcgtgaggatatcgaccaactggcagccagcgtgctcaagcgccttgccgggaacggcgcacaacccgtcgcgcgcctgaacgcgcaggcgctggaaacgctgaagagctaccgcttccccggtaacgtgcgcgaactggaaaacatgctggagcgcgcttacacgctgtgcgagaacgacgaaatccacgccagcgacctgcgcctgacagagtctgccagccctcaggagaacgacggcccgagcctggccgatatcgacaaccttgaagactacctggaaagcgtcgaacgccagctcattctgcaggcgctggaagaaacccgctggaaccgcaccgctgcggcagaaaggctcagtttgtcgttcaggtcactgcgctatcgcctgaagaagctgggcctggattga

SEQ ID NO: 44068 - protein, 445 aa, Pseudomonas syringae pv. syringae B728a
MSQRQKILIVDDEPDIRELLEITLGRMKLDTRSARNVAEAHDWLAREPFDMCLTDMRLPDGNGLELVQHIQHGYPHVPVAMITAHGNLDTAIHALKAGAFDFVTKPVDLGRLRELVNSALSLPGAQPTRSIDNRLLGDSLAMRTLRSQIGKLARSQAPIYISGESGSGKELVARLIHEQGPRIDKPFIPVNCGAIPSELMESEFFGHRKGSFSGAHEDKPGLFQAAHTGTLFLDEVADLPLAMQVKLLRAIQEKSIRSVGGQQEQIVDVRILCATHKNLNAEVAAGRFRQDLYYRLNVIEVRVPSLRERREDIDQLAASVLKRLAGNGAQPVARLNAQALETLKSYRFPGNVRELENMLERAYTLCENDEIHASDLRLTESASPQENDGPSLADIDNLEDYLESVERQLILQALEETRWNRTAAAERLSLSFRSLRYRLKKLGLD

SEQ ID NO: 44069 - DNA, 1401 bp, Desulfovibrio desulfuricans G20
  CDS (1)..(1401)
atgacaaacgctcctaccatattgatagtggatgatgatcaggcgcacagaaccatgctgcgcaccatgctgcgcggctggcagtactcggcggaagaagccgacgacggttccgtggccgtgagcaaggtgcaggagcgcgcatatgacgccatcctgatggatatccgcatggcccgcatgagcggcatagaagccctgcggcatatcatggcccacaatccggccattcccgtgcttatcatgacggcatattcttcggtgaatacagcggtggaagccctgaaaataggtgcttatgactacctgacaaagccgcttgatttcgacgagctgaaactgacgctggagcgcgcgcttgatcacacgcggctggcctcggaaaacagagagctgcgcagctctctgtccgcggggcaggctgcctcgcgcattatcggccgcagcgaggccgtgcgccggcttaccgagctggtggccacagtggcgcccagcgacgccacggtactcatcaccggagaatcgggcacaggcaaagaactggtggccagagccatacacgaaggaagcagcagacgtgacagaccgctggtaaccgtcaactgcgccgcccttacggaatcgctgctggaatcagaactgttcggccacgaaaaaggtgcttttaccggtgcggacaaaaaacgcgacgggcggtttgttcaggcggacggcggtacgttgtttctggatgaactgggcgaaatgtctctggcactgcaggcaaagctgctgcgtgcgctgcagcagggtgaaatccagagggtgggcagcgacaacccgctgagagtcgatgtacgcgtcatcgccgcaaccaaccgcaatctgaccgcagaggtgaccgcaggcaggttccgcgaagacctgttttaccggctcaacgtcatcggcatagcggtaccggcactgcgggaacggcgcgacgacatccccctgctggccggacactttctgacccgctatgccgaacgtaaccgcaagatgctcaaaggattcaccccgcaggccatgaactgtctggtcaactatgactggccgggcaatgtgcgtgaactggaaaacgccgtggagcgcgccgttatcatgagcatgggcgaatatgtcaccggacgcgaactgccgccggacattgcagcggctgacggcgaaacggatatcaccgcagcagtgcccgatacggacacaccgctgcccgacaccgtccatgacccctatgcggggctctcgctggaaaatctggaacgccgcgccattgaggcaacgctgcgcgaatgtgccgacaataaaagcgaagccgcccgccggctgggcatcacccgcgcaacactgcacaacaagctgaaaaaatacggcatggaataa

SEQ ID NO: 44070 - protein, 466 aa, Desulfovibrio desulfuricans G20
MTNAPTILIVDDDQAHRTMLRTMLRGWQYSAEEADDGSVAVSKVQERAYDAILMDIRMARMSGIEALRHIMAHNPAIPVLIMTAYSSVNTAVEALKIGAYDYLTKPLDFDELKLTLERALDHTRLASENRELRSSLSAGQAASRIIGRSEAVRRLTELVATVAPSDATVLITGESGTGKELVARAIHEGSSRRDRPLVTVNCAALTESLLESELFGHEKGAFTGADKKRDGRFVQADGGTLFLDELGEMSLALQAKLLRALQQGEIQRVGSDNPLRVDVRVIAATNRNLTAEVTAGRFREDLFYRLNVIGIAVPALRERRDDIPLLAGHFLTRYAERNRKMLKGFTPQAMNCLVNYDWPGNVRELENAVERAVIMSMGEYVTGRELPPDIAAADGETDITAAVPDTDTPLPDTVHDPYAGLSLENLERRAIEATLRECADNKSEAARRLGITRATLHNKLKKYGME

SEQ ID NO: 44071 - DNA, 1380 bp, Desulfovibrio desulfuricans G20
  CDS (1)..(1380)
atgaccaacgacacgcatattctgcttcttgacgacgaaaaaaactatcttctggtgctggaagcgctgctgaccgacgccggatacaaggtcacagccatcaacgaccctgaaaccggtctggcgtttctggatgaatcggatgtcgatgtcatcgtcaccgacatgaaaatgcccaaaatcaccggccagaacgtgcttgaccatgtaaaaaaacggtttgcgcacattccggtgctcatcatgactgccttcggctccatagagggcgcggtggaagtgatgaagacaggggccttcgactacatcaccaaacccttttccaacgatgaactgctgctttctgtgcagaacgcagcagaactcgccctggcgcaccgccgctaccgcctgctggctgaagccatggagcaacgctttggcccgcgccagatagtgggcaacagccgcgccatacgcgacgtgctgaccatggtggaaagagccgcgcccagcaagtcaacggtgctcatcaccggagaatccggcaccggcaaagaactggtggcccgtgccatacattattcatcaccgcgcaaggacggccccttcatcagcgtcaactgcatggcgctgaacgccggcgtgctggaaagcgaactgttcggccacgaaaaaggctcgttcaccggcgccacggccatgaaacgcggccgctttgaaatggcgcacggaggaacgctttttctggatgaaataggcgagctttcgcacgacatgcaggtaaagctgctgcgcgtgctgcaggagcgcacatttgagcgggtgggcggcagcgcccccatagaagtggacatacgcgtggtggccgccaccaacaaaaacctgcttgaagaggtgggcaaaggcagcttccgcgaagacctgtactacaggctcaacgtggtgcaggtggaactgccgccgctgcgcgaacgccgcgaagacattccgctgctggccgcgcatttcgtgcacaaatatgccgaggacaacgaactgccgcagaagaacttttctcctgaagcgctggactacctgaccggctatgaatggcccggcaacatcaggcagctggaaaacatcgtggaacgctgcatggtgcttacgccttcggccaccatcggcgtggaagacctgccccatgaaatacgcgacgaggaaacccagctgaaaagcgccgtggacctgcttcccgtcaagctggatcttgccgacacactggacaagctggaagcggcactcatccgccgcgcgctggtgcggtccgaattcgtgcaggtcaaggctgcggaactgctgggcatttctaaaagtctgctgcaatacaaactgaaaaaatacggcatcacaggccattga

SEQ ID NO: 44072 - protein, 459 aa, Desulfovibrio desulfuricans G20
MTNDTHILLLDDEKNYLLVLEALLTDAGYKVTAINDPETGLAFLDESDVDVIVTDMKMPKITGQNVLDHVKKRFAHIPVLIMTAFGSIEGAVEVMKTGAFDYITKPFSNDELLLSVQNAAELALAHRRYRLLAEAMEQRFGPRQIVGNSRAIRDVLTMVERAAPSKSTVLITGESGTGKELVARAIHYSSPRKDGPFISVNCMALNAGVLESELFGHEKGSFTGATAMKRGRFEMAHGGTLFLDEIGELSHDMQVKLLRVLQERTFERVGGSAPIEVDIRVVAATNKNLLEEVGKGSFREDLYYRLNVVQVELPPLRERREDIPLLAAHFVHKYAEDNELPQKNFSPEALDYLTGYEWPGNIRQLENIVERCMVLTPSATIGVEDLPHEIRDEETQLKSAVDLLPVKLDLADTLDKLEAALIRRALVRSEFVQVKAAELLGISKSLLQYKLKKYGITGH

SEQ ID NO: 44073 - DNA, 1344 bp, Desulfovibrio desulfuricans G20
  CDS (1)..(1344)
atgtctgacatctacagcattctggtcattgatgacgaagaatccatactgcgactgctcgaacgcgaactgaccacacaggaccgcattgtccacaccgcccagaacggacgcgaaggccgtgaaaaactgagccgccagcgttatgacgttgtcatttccgacatccgcctgcccgacgccgacgggctggacctcatggtcgagctgaaaggcatatatcccgacgtggaattcattcttatcaccggacacggcaacatagacaacgccgtggaagccatgcgtctgggcgcctacgactatgtgaccaaaccttttcatctggacagggtggaactggtggtcgaacgggcctaccagcgggtatgcctgcagcgcgaaaaccgcagcttccgccactcgcacagcagcgctccgccttcaaagatggtcggtaattcagcagaaataaaacagatacgctatctggtcggcaaagtcgctcccaccgacgttcctgtgcttatcaccggcgaaagcggcgtgggcaaagatgttgtggcccattccattcaggcgctcagcacccgaagcggcaagccttttctggtgaaaaactgcgccaccctgcaaaaagaactgatgcgcagcgaacttttcggccataccaaaggctcgttcaccggcgccaccgacaaccgcgaagggctgcttgcctttgcagacaccggcacactgtttctggacgaaatcggcgaactgccgccggaagtgcagggcgcactgctgcgggtactggaggccaaacgataccgccgcgtgggcgagaaaagcgagaggcaggtggatatccgctttcttttcgccaccagccgcaacctgctggaagaagtggaggcaggccggttcaatgacgccctttttcaccgcatcaacgtattcaacatctgcgtggcaccgctgcgcgaccgcaaagaagacatccccctgcttgtggagcattttctgggcagactgggcaatgccatgggtcacaacgaactgaccgtcagtgacaaagccatgcagtgcctgcagcactacgactggcccggcaacgtgcgcgagctgcgcaacgtgctggagcgcagtataattctttcagaaaacggcatcatttcagaacgttcactgccgcgcgatcttgtggaacgggctgaacagagcgggctggaaagcagcatcttttcgctggaacacatggagcgtgaacatatcacccgcgctctggccttttttaacgggaacagacagcaggcatccaaggcgctgggcataggacgcaaaaccttgtaccgcaagctggagcgttacaatttgtaa

SEQ ID NO: 44074 - protein, 447 aa, Desulfovibrio desulfuricans G20
MSDIYSILVIDDEESILRLLERELTTQDRIVHTAQNGREGREKLSRQRYDVVISDIRLPDADGLDLMVELKGIYPDVEFILITGHGNIDNAVEAMRLGAYDYVTKPFHLDRVELVVERAYQRVCLQRENRSFRHSHSSAPPSKMVGNSAEIKQIRYLVGKVAPTDVPVLITGESGVGKDVVAHSIQALSTRSGKPFLVKNCATLQKELMRSELFGHTKGSFTGATDNREGLLAFADTGTLFLDEIGELPPEVQGALLRVLEAKRYRRVGEKSERQVDIRFLFATSRNLLEEVEAGRFNDALFHRINVFNICVAPLRDRKEDIPLLVEHFLGRLGNAMGHNELTVSDKAMQCLQHYDWPGNVRELRNVLERSIILSENGIISERSLPRDLVERAEQSGLESSIFSLEHMEREHITRALAFFNGNRQQASKALGIGRKTLYRKLERYNL

SEQ ID NO: 44075 - DNA, 1398 bp, Desulfovibrio desulfuricans G20
  CDS (1)..(1398)
atgaacgcgcgcgttcttattgtggatgacgaagacggcatccgcttttccctgcggggtattctggaagatgaaggctatgaggtagcggaggcggaaaccggtgaagaaggcctgaaactggccacggaaacgccccccgaccttatatttctggatatatggctgccgggcatggacggactggaagtgctggacaatctgcgtacggccgatgcctctttgccggtgatcatgatttccggtcacggcaacatcgaaaccgcggtcaacgccataaaaaaaggcgcctacgacttcatcgaaaaacccctctcgctggaaaaagtcgtcatttcggccaacaaggcgctggagtattaccgcctgcgcagagagaatcaggccctgcgctcgcggctcacccagtcgaccaccgtggaaatgaccggaaactccgcttccattgtggaactgcgcggccagataggccgggtggcccccacggacgcatgggtgctcatcacgggagaaaacggcacgggcaaggaaatagcggcacgctccattcacgcaagctcgcgcagaaaagataaaccgctggtggcggtcaactgcgccgccatacccgaagagcttatcgaaagcgaactcttcggacacgaaaaaggcgccttcaccggtgccgaaactgccaagaccggcaaatttgaaatggctcatcagggcacgctgtttctggacgaaattgcagacatgagcctgaaaacgcaggcaaagattctgcgtattctgcaggagcagagctttgagcgggtgggcggccataaaacggtaaaggtcgatgtgcgcgttatcgcggcaaccaataaaagtctggaagatgaaatagccgcaggccggttccgcgaagacctgtattaccgcctgcgggtcatcccccttgtggtgccgccgctgcgccagcgcggcgatgacgttatgctgctcatcggtgaattcatgaacagaatgaccgcggaacacggtttccgccctgtcacgtttgcaccggatgcgtgttccgccctgctgtgctaccactggccgggcaacgtgcgtgaactgaaaaattttgtggaacgcatgctcatcatgcactccggccagacggtgaccgccgccatgctgccgcccgaataccgctgcgccggtgcgggcataatgcctcagccctgtaccgcaggcccgtcggatggtatgatccccgaaggtgtcatggatttcaaggcggcgcgcactgccttcgaggcccgctttctggaggcgaaactgcaggagttcggcggcaacataacccgcctggccgaagccatcggccttgaacgcagctacctgtaccgcaaactgaaatcatacaacattcagactccggagtag

SEQ ID NO: 44076 - protein, 465 aa, Desulfovibrio desulfuricans G20
MNARVLIVDDEDGIRFSLRGILEDEGYEVAEAETGEEGLKLATETPPDLIFLDIWLPGMDGLEVLDNLRTADASLPVIMISGHGNIETAVNAIKKGAYDFIEKPLSLEKVVISANKALEYYRLRRENQALRSRLTQSTTVEMTGNSASIVELRGQIGRVAPTDAWVLITGENGTGKEIAARSIHASSRRKDKPLVAVNCAAIPEELIESELFGHEKGAFTGAETAKTGKFEMAHQGTLFLDEIADMSLKTQAKILRILQEQSFERVGGHKTVKVDVRVIAATNKSLEDEIAAGRFREDLYYRLRVIPLVVPPLRQRGDDVMLLIGEFMNRMTAEHGFRPVTFAPDACSALLCYHWPGNVRELKNFVERMLIMHSGQTVTAAMLPPEYRCAGAGIMPQPCTAGPSDGMIPEGVMDFKAARTAFEARFLEAKLQEFGGNITRLAEAIGLERSYLYRKLKSYNIQTPE

SEQ ID NO: 44077 - DNA, 1398 bp, Desulfovibrio desulfuricans G20
  CDS (1)..(1398)
atgagcgaacacatcctgcttatcgaagatgacaacgcctttcaggagatgctttccgaggcgttacgaagccgcgggtacgccgtgagctcggcctccagagcggaggaaggcatcagcatggcgcgtcagcatgatttcgatcttatcctgaccgatgtcatgctgcccggcatgtcgggtgtggaggccattcctcagctgcgtgaagccgcccccggttccgatatcatcgtcatgaccgcctactccaccagagaactggcgcttgaagccatccgtctgggagcctacgattttttttcaaaaccattcagcctgaaagaactggatatcgtggtgcgcagggcgctggaaaaacgccgtctgcaaaaagaggtgaccactctgcgcgaaacgctgcgccatgacagcccggtacaacgcatcatcggcgacagcgcccccatgcgcgccgtaaaaacgctggtcgaaaaagtagccccgctcgattcgacagtgcttatcaccggcgaatccggcaccggcaaagaactggtctccgacaccctgcgcgcgctttccggccgggcaggagcaccttttgtcaaggtaaactgcgccgccattcctgaacatctgtttgaaaacgaactgttcggtcacgagaaaggtgcctttaccggtgccacatctgcacagcccggcaaatttgaactggcgcacggcggcaccctgctgctggacgaaatcggcgacatgcccgcagccattcagcccaaactgctgcgggccgtggaagaaaaacagatcgaacggctgggcgggcgcagaccggttgcagtcaacgtacgcattatcgccgccaccaaccagaacctgcgtgaacttgtggcccgcaaagcgtttcgcgaagacctgtattacaggctgggcgtagccgtaatcatgctgcctcccctgcgcgaccgcaaagaagacataccccggctggcggagcatattctccgcaaactggggctgacgctgggcataccggtgcacggcatcactgccgcagccgtacaggcgcttatgaaccaccactggcccggcaatgtccggcagctggccaacctgctggaaagagcggccatcagcgcacagggacgcattacagcccaagacatagccgctgcacttgccgtgcagaacggtacatcgccgcagccctgcaccgcacagtctccgcatgacgcccccgcggcagaagactgcctgcgtatgcccctgcgcgaaaccctgcaccagatggaacgcaacctgctgctggaagcgctgcgcagggcggaaggcagccagaaaaacgctgcggccctgctgggtcttactcccaaaaacatgtgggcaaaactgcagaagcatcagatacgcatctga

SEQ ID NO: 44078 - protein, 465 aa, Desulfovibrio desulfuricans G20
MSEHILLIEDDNAFQEMLSEALRSRGYAVSSASRAEEGISMARQHDFDLILTDVMLPGMSGVEAIPQLREAAPGSDIIVMTAYSTRELALEAIRLGAYDFFSKPFSLKELDIVVRRALEKRRLQKEVTTLRETLRHDSPVQRIIGDSAPMRAVKTLVEKVAPLDSTVLITGESGTGKELVSDTLRALSGRAGAPFVKVNCAAIPEHLFENELFGHEKGAFTGATSAQPGKFELAHGGTLLLDEIGDMPAAIQPKLLRAVEEKQIERLGGRRPVAVNVRIIAATNQNLRELVARKAFREDLYYRLGVAVIMLPPLRDRKEDIPRLAEHILRKLGLTLGIPVHGITAAAVQALMNHHWPGNVRQLANLLERAAISAQGRITAQDIAAALAVQNGTSPQPCTAQSPHDAPAAEDCLRMPLRETLHQMERNLLLEALRRAEGSQKNAAALLGLTPKNMWAKLQKHQIRI

SEQ ID NO: 44079 - DNA, 1374 bp, Desulfovibrio desulfuricans G20
  CDS (1)..(1374)
atgatcaagcgattgctggttattgacgacgagcccggccaccgcctgatggtccgtgcggttatggaagacaacggatggcaggtttttgaagccgcaagcggagaagacgggctatcttttctcggaaccgattctgtgcatgtggttctgctggatatgcgcatgccgggtatggacggcaaagagacgctggcccgtattctggatatcaatccgcaattgccggtggtgatgcttacagcatacggcactgtcggatctgctgttgaagccatgaaaaaaggagcttttgactacctgagcaagcccgcggacaatgacgagctggcagcagtgcttgaaaaagcatgggagtattcgttgctgctggcagaaaatcagaatctgcgccagaagctggggcagggagaccctgttcagaaaattgtgggttcaagccccgccatgctgcgggtgctggattttatcagacaggccggtcccagcgaggctactgtgcttgttatgggtgaatccggaacaggcaaggaactgattgccgaagccctgcacgatgcaagcctgcgccgcgaaaaaacactggtgaaagtcaactgcgcagcgttgccgggcaacctgctggaaagcgaattgttcggctatgtcaagggcgcttttaccggtgccgtaaaggataagcccggccgttttcagctggcacgcggtggcactctctttctggatgaaataggtgaaatgcctgttgaactgcaggcaaaactgctgcgtgcgctgcaggaacgggttatcgaaccgctgggttccgtccggcccgttgatgtggatgtgcgcattgtggcagccacaaaccgcgacctgcgtaaagctatcgaacagggggatttccgcgaagacctgtttttccgcctgaacgtgcttgaggtggtttccccgccactgcgtgaacgcattgatgatattccgctgcttgtaagccggcttgtagataaactgagccgcaaaaaccgcaaggaagtacgcagcgtcagtccggagtttctggatgcacttatggcgtaccactggccgggtaatgtgcgtgaactggaaaacgtgcttgaacgtgctcttattctgagcaggtctgatattctggggcccgagtcgttgcccgcccagttgctgcaggtcgaagaacgcagagaccccttaccgcagcgcatggtttccacagctcttgtgccgtcttttgacgatgccgagcgcgaaacattgctcaaggcgctggaagcgcataacggacatcgcgaaaaaacagccgatgcgctaggtataagccgcaggacactgcaatataagcttaagaagttcggtctgacacggcgcagctga

SEQ ID NO: 44080 - protein, 457 aa, Desulfovibrio desulfuricans G20
MIKRLLVIDDEPGHRLMVRAVMEDNGWQVFEAASGEDGLSFLGTDSVHVVLLDMRMPGMDGKETLARILDINPQLPVVMLTAYGTVGSAVEAMKKGAFDYLSKPADNDELAAVLEKAWEYSLLLAENQNLRQKLGQGDPVQKIVGSSPAMLRVLDFIRQAGPSEATVLVMGESGTGKELIAEALHDASLRREKTLVKVNCAALPGNLLESELFGYVKGAFTGAVKDKPGRFQLARGGTLFLDEIGEMPVELQAKLLRALQERVIEPLGSVRPVDVDVRIVAATNRDLRKAIEQGDFREDLFFRLNVLEVVSPPLRERIDDIPLLVSRLVDKLSRKNRKEVRSVSPEFLDALMAYHWPGNVRELENVLERALILSRSDILGPESLPAQLLQVEERRDPLPQRMVSTALVPSFDDAERETLLKALEAHNGHREKTADALGISRRTLQYKLKKFGLTRRS

SEQ ID NO: 44081 - DNA, 1350 bp, Pseudomonas aeruginosa UCBPP-PA14
  CDS (1)..(1350)
atggaaaccacttccgaaaaacaggggcgcatcctgctggtcgatgacgagtcggcgatcctgcgcactttccgttattgcctcgaagacgaaggctacagcgtggccaccgccagcagcgcgccgcaggcggaggccctgttgcagcgccaggtattcgacctgtgcttcctcgacctgcgcctgggcgaagacaacgggctcgacgttctcgcccagatgcgcgtccaggcgccatggatgcgcgtggtgatcgtcaccgcgcattcggcggtggataccgcggtcgacgccatgcaggccggcgcggtggattacctggtcaagccctgcagcccggaccaactgcgcctagccgccgccaagcaactggaggtgcgccaactgaccgcgcgcctggaggccctggaggacgaagtgcgccgccagggcgacggcctggaatcgcacagcccggccatggccgcggtactggagaccgcgcgccaggtcgcggcgaccgacgccaacatcctcatcctcggcgaatccggctccggcaagggcgaactggcacgcgccatccacacctggagcaaacgcgcgaagaagccccaggtcaccatcaactgcccgtcgctgaccgccgaactgatggaaagcgaactgttcgggcacagtcgcggcgccttcaccggtgccaccgaaagcaccctgggcagggtcagccaggctgacggcggcaccctgttcctcgacgagatcggcgacttcccgctgaccttgcaacccaagctgctgcgcttcatccaggacaaggaatacgaacgcgtcggcgatccggtgacccgccgcgccgatgtgcgcatccttgccgcgaccaaccgcgacctgggcgcgatggtcgcccagggccagttccgcgaggacctgctctaccgcctcaacgtgatcgtgctcaacctgcctcccctgcgcgaacgcgccgaggatatcctcggcctggccgaacgtttcctcgcccgcttcgtcaaggactacggccgccccgcccgcggcttcagcgaagccgcccgcgaggccatgcggcaatacccctggccgggcaacgtacgcgagctacgcaacgtgatcgagcgcgccagcatcatctgcaaccaggaacgggtggatgtcgaccacctcggtttcagcgctgcgcaatctgccagcagcgcgccgcggatcggcgaatcgctgagcctggaagacctggagaaagcccatatcacggcggtgatggcctccagcgcgaccctcgaccaggccgccaagaccctcggtatcgatgcctcgaccctgtaccggaagcgcaagcagtacggcctatga

SEQ ID NO: 44082 - protein, 449 aa, Pseudomonas aeruginosa UCBPP-PA14
METTSEKQGRILLVDDESAILRTFRYCLEDEGYSVATASSAPQAEALLQRQVFDLCFLDLRLGEDNGLDVLAQMRVQAPWMRVVIVTAHSAVDTAVDAMQAGAVDYLVKPCSPDQLRLAAAKQLEVRQLTARLEALEDEVRRQGDGLESHSPAMAAVLETARQVAATDANILILGESGSGKGELARAIHTWSKRAKKPQVTINCPSLTAELMESELFGHSRGAFTGATESTLGRVSQADGGTLFLDEIGDFPLTLQPKLLRFIQDKEYERVGDPVTRRADVRILAATNRDLGAMVAQGQFREDLLYRLNVIVLNLPPLRERAEDILGLAERFLARFVKDYGRPARGFSEAAREAMRQYPWPGNVRELRNVIERASIICNQERVDVDHLGFSAAQSASSAPRIGESLSLEDLEKAHITAVMASSATLDQAAKTLGIDASTLYRKRKQYGL

SEQ ID NO: 44083 - DNA, 1389 bp, Pseudomonas aeruginosa UCBPP-PA14
  CDS (1)..(1389)
ttgcgacgcctgctggagcgcaaccagtaccaggtcagcgaagccggctcggtgcaggaagcccaggagcgctacaccatcccctccttcgacatggtggtcagcgacctgcgcctgccgggcgcccccggcaccgaactgatcaagctcgccgaaggcattccggtgctgatcatgaccagctacgccagcctgcgttcggcggtggattcgatgaagatgggcgcggtggactacatcgccaagcctttcgaccacgacgaaatgctccaggccgtggcgcgcatcctcaaggaccgccaggagaaccgcagcgcggccccggtctccgccaacggcggcaaggccggcggcgaacgcggcgccagcccggcggcagccgacggcgagataggcatcatcggctcctgtgcgccgatgcaagagctgtacagcaagattcgcaaggtcgcgccgaccgactccacggtactgatccagggcgagtccggcaccggcaaggaactggtcgcccgcgccctgcacaacctgtcgaagcgcgccaaggcgccgctgatctcggtgaactgtgcggcgattccggaaaccctgatcgaatccgagctgttcggccatgaaaaaggcgccttcaccggtgccagcgccgggcgcgccgggctggtcgaagcagctgacggcggcaccctgttcctcgacgagatcggcgaactgccgctggaggcccaggcccgcctgctgcgcgtattgcaggaaggcgagatccgccgggtcggctcggtgcaatcgcagaaggtcgacgtgcgcctgatcgccgccacccaccgcgacctgaagaccctggccaagaccgggcaattccgcgaagacctctattaccgcctgcatgtgatctcgctgaagctgcccgccctgcgcgagcgtggcaacgacgtgatggagatcgcccgcgcctttctggctcgccagtgcacccggatggggcgcgcgccgctcagcttcgcccacgacgccgaacaggcgatccgccattacccatggccgggcaacgtgcgcgagctggaaaacgccatcgagcgggcggtgatcctcagcgagagccaggaaatccacgccgacctgctgggtatcgacattgagctggacgacctcgaggacgacttcgccgccgacctcggcctcggcccggcgggcgccgcggccagcaaccacgagcccaccgaggacctttcgctggaagactacttccagcacttcgtcctcgagcaccaggaccacatgaccgagaccgagctggcccgcaagctgggcatcagccgcaaatgcctgtgggaacgccgccagcgcctgggcattccgcgacgcaaatcaggggcctcggccgactcgtaa

SEQ ID NO: 44084 - protein, 462 aa, Pseudomonas aeruginosa UCBPP-PA14
MRRLLERNQYQVSEAGSVQEAQERYTIPSFDMVVSDLRLPGAPGTELIKLAEGIPVLIMTSYASLRSAVDSMKMGAVDYIAKPFDHDEMLQAVARILKDRQENRSAAPVSANGGKAGGERGASPAAADGEIGIIGSCAPMQELYSKIRKVAPTDSTVLIQGESGTGKELVARALHNLSKRAKAPLISVNCAAIPETLIESELFGHEKGAFTGASAGRAGLVEAADGGTLFLDEIGELPLEAQARLLRVLQEGEIRRVGSVQSQKVDVRLIAATHRDLKTLAKTGQFREDLYYRLHVISLKLPALRERGNDVMEIARAFLARQCTRMGRAPLSFAHDAEQAIRHYPWPGNVRELENAIERAVILSESQEIHADLLGIDIELDDLEDDFAADLGLGPAGAAASNHEPTEDLSLEDYFQHFVLEHQDHMTETELARKLGISRKCLWERRQRLGIPRRKSGASADS

SEQ ID NO: 44085 - DNA, 1353 bp, Dechloromonas aromatica RCB
  CDS (1)..(1353)
atgtctgagacaggaatcctggttgtcgatgacgaagaaattgcccgccagaatcttgtgcatgttttgaagcgcgagggctggcacgtagatgccgctgccgatggcgagcaggcaacggcctgtctgggcaagcaaacttatcaactggtgctgacggatattcgcatgccgggtatggatggtctggcgttgctcaggcagatcaaggcgcaggcagctgataccgaggtgatcgtgatcaccgcgcatgctagcgcggggtctgccgtcgaggcgatgcgagccggcgcattcttctatgtggaaaagccttttcgcattgccgaggtacgaaagattgtccacgaagccctggagaaggtccgtctaaaaagcgaagttctggcgctcaagcaggagctggccaaaaccaacatgtctcgccggatcatcgcgagttccgaggcgatgaagcgcctgctcgatacagcaaggcgtgtcgcaccaactgactgcacggtgctgatccacggcgagacggggaccgggaaagagttgatcgcccgttatttgcacgattgcagcgatcgatccgcatccccttttgtcgcaatcaactgcggtgtgttgtccgaggaattgttggccaatgaactgttcggccatgagcggggtgcctttaccggagccgctggtgtgaaaaccggactactggaggcggctgagggcgggaccttgtttctcgatgaagtcacggaaatgccgcctgccattcaggtcaagcttttgcgagtcttgcaggagcgagaattcttccgcttgggcagtacgcaagcaataaaaataaatctccggatcttggcggcaaccaatcgtaatccggaagagtcggtcgctgcgggcatcctgcgttcggacctttactttcgcctgaatgtggtggcattgagtattccaccccttcgcgaacgaaaggaagacatccctgtgcttgcctctcacctgatcgcaactcacgcccagagaatgggcaaggctttgcccagcctttcgccgcaggcgctgtccgtgctaatggcttatgactatcccggcaatattcgcgaactggaaaatatcattgagcgggcgatcgctttatgttccacgcagctcattgagcaggatcttttgccggcaaacctgctcgagcaagcgtctccgagtccgatcgattcggcgagtggcggttttcagactttggagcagcttgaaaaagagcacatccagaaagcgctattgcactgcaacggcaacaagtttcaggcagcaaagatgctgggtatcgacagggtgtcgctctggagaaaactcaagtcgtttggcgagtag

SEQ ID NO: 44086 - protein, 450 aa, Dechloromonas aromatica RCB
MSETGILVVDDEEIARQNLVHVLKREGWHVDAAADGEQATACLGKQTYQLVLTDIRMPGMDGLALLRQIKAQAADTEVIVITAHASAGSAVEAMRAGAFFYVEKPFRIAEVRKIVHEALEKVRLKSEVLALKQELAKTNMSRRIIASSEAMKRLLDTARRVAPTDCTVLIHGETGTGKELIARYLHDCSDRSASPFVAINCGVLSEELLANELFGHERGAFTGAAGVKTGLLEAAEGGTLFLDEVTEMPPAIQVKLLRVLQEREFFRLGSTQAIKINLRILAATNRNPEESVAAGILRSDLYFRLNVVALSIPPLRERKEDIPVLASHLIATHAQRMGKALPSLSPQALSVLMAYDYPGNIRELENIIERAIALCSTQLIEQDLLPANLLEQASPSPIDSASGGFQTLEQLEKEHIQKALLHCNGNKFQAAKMLGIDRVSLWRKLKSFGE

SEQ ID NO: 44087 - DNA, 1413 bp, Dechloromonas aromatica RCB
  CDS (1)..(1413)
atgaaaccggtctggatcgtagacgacgatcgctccatccgctgggtgctcgagaagaccctgtcccgcgagggcatcccattcaagagctatgcctcggccagcgaggcgatctcccagctcgaacagggcatcgagccaccacaggtgctgatgtccgacatccgcatgccaggccagtccgggctggaattgctgcaggaggtgaagacccgcttcccgtcggtaccggtcatcatcatgacggcctattccgatctggaaagtgcggttgctgctttccagggtggggccttcgaatacctgcccaaaccattcgatgtcgaccaggcggtcgaactgattcggcgtgcgattgacgaatcaatgcaccagagtggtgcaatggaggaggaagggctggtgccggagattctcggccaggcacctgccatgcaggaagtcttccgggccatcggccgacttgccctctcgcacgccactgtgctgatcaccggtgaatccggttccggcaaggagttggttgcccgagccttgcaccggcacagtccgcgcgccgataaacctttcatcgcaatcaacacggctgcgatcccgaaggatttattggagtccgagctgtttggtcacgagcgtggcgcctttaccggcgcccaggctcagcggcgcggtcgtttcgaacaggccgaggcgggcaccctgtttctcgatgaaatcggcgacatgccctcggagttgcagacccgcctcttgcgggtgctgtcggatggccatttttaccgggtcgggggccattctccgatcaaggccaacgtgcgcgtcatcgcagcgacacaccagaacctcgaaacccgtgtcaaggatggcctgttccgcgaggatttgttccatcgcctgaacgtcattcgcattcgcctgcccgccctgcgtgagcggcacgaagatattccgctgctggcccgccattttctgcagaaaagtgcgcgcgaattgggcgtggaaaccaagcgtttgaccgatgcggcattgaagtatctgtcaggcctggagtttcagggcaacgtgcggcaactggagaatctctgtcactggctgaccgtgatggcgccagggcagcaagtggatgtcggcgatttgccggccgagttgcgcgaggcatcttcaacggtgttggcaaccgattgggaaagtgcgctggaaggcgaagtcgatcgcatgctggcgcgcggcgtgccggatgtgcatggcgttctggcccagaccttcgaacgcatcctgatttcccgggcgttggcccataccggcgggcggcggatcgaggcagcgcaagcgctggggattggtcgcaacacgatcacccgcaagattgccgaactcggtatcgatggcggcaaggagcacgcagcggagtaa

SEQ ID NO: 44088 - protein, 470 aa, Dechloromonas aromatica RCB
MKPVWIVDDDRSIRWVLEKTLSREGIPFKSYASASEAISQLEQGIEPPQVLMSDIRMPGQSGLELLQEVKTRFPSVPVIIMTAYSDLESAVAAFQGGAFEYLPKPFDVDQAVELIRRAIDESMHQSGAMEEEGLVPEILGQAPAMQEVFRAIGRLALSHATVLITGESGSGKELVARALHRHSPRADKPFIAINTAAIPKDLLESELFGHERGAFTGAQAQRRGRFEQAEAGTLFLDEIGDMPSELQTRLLRVLSDGHFYRVGGHSPIKANVRVIAATHQNLETRVKDGLFREDLFHRLNVIRIRLPALRERHEDIPLLARHFLQKSARELGVETKRLTDAALKYLSGLEFQGNVRQLENLCHWLTVMAPGQQVDVGDLPAELREASSTVLATDWESALEGEVDRMLARGVPDVHGVLAQTFERILISRALAHTGGRRIEAAQALGIGRNTITRKIAELGIDGGKEHAAE

SEQ ID NO: 44089 - DNA, 1410 bp, Dechloromonas aromatica RCB
  CDS (1)..(1410)
atgatggcggcgccatccaaggcggtcggtgcgcatgtgctggtagtcgatgacgatgaggatattctgcgcctgctgaccatgcgcttgcgggcgagggggttccgggtgtctgccgttggttcggccgagcaggcgctggcccagatcgccgttgatccgccccggctcgtcgtcagcgatgttcgtctgcccggcctggatggcctgtcgctgttcgaagagatccgccgcacgcggccgaccttgccggtcattctgcttacggcccacggcaatattcccgatgccgtcgatgccacctcccgcggcgtctttggctacctgaccaagccgttcgatagccagatcctgctcgaaaagattgatcgcgccctgcaactctcggcaccgacgccccatgttggcgaactgccacccgtcactgccgagggtgacgatgcctggatggccggtgttattttccgtagcagccgcatggccgagttgatggccgaagcccgcatgattgccgcctctgatgccagcgtgctgatccgtggcgaaagcggctccggcaaggaggttctggcgcgagccatccaccgggccagtccgcgtgccaaggggccgtttatcgccatcaactgcggcgccattcctgaacagctgctcgagtcggaattgtttggccacgccaagggggccttcaccggcgccgcaaccaatcgcgttggtctgtttcaggcggccaatggcggcacgctcttcctcgacgaaatcggcgacatgccgctggccttgcaggtcaagctgctgcgcgtgttgcaggaacgtgttgtccggccggtgggtacgaccaaggccgagccggtggatgtccgcctgctgtcggccacccatcgcgatctcgatgccgccatggcgcaaggccagttccgcgaggacctctattaccgcctcgatgtcgtttccctgaccctgccgcgtctcgatgaacgacgagaagacattccgctgctcgcttcgcattttgtccaattgctcgccggcaaatacggcaagcaggtcaacggcttcgctcccgaggcgctggaggccttggcgaccgcggcctggccgggcaatgtccgacaactgttcaacgtcgtcgaacaaagctgtgcgctgacttcgacgccattgatcccgctaacgctagtccagcgcgccctgcgggtgccagccatggatgccttgacctacgctgacgccaagcagcgcttcgagcgcaattacctcgttcagctgctcaagctgaccgatggcaacgttgccgatgcggcgcgcattgccgaacgcaaccgcactgagttctaccgcctgctgcaaaaacatgacctgactccggccatgttccgcagcgatagcgaagtggccgccgaacgctga

SEQ ID NO: 44090 - protein, 469 aa, Dechloromonas aromatica RCB
MMAAPSKAVGAHVLVVDDDEDILRLLTMRLRARGFRVSAVGSAEQALAQIAVDPPRLVVSDVRLPGLDGLSLFEEIRRTRPTLPVILLTAHGNIPDAVDATSRGVFGYLTKPFDSQILLEKIDRALQLSAPTPHVGELPPVTAEGDDAWMAGVIFRSSRMAELMAEARMIAASDASVLIRGESGSGKEVLARAIHRASPRAKGPFIAINCGAIPEQLLESELFGHAKGAFTGAATNRVGLFQAANGGTLFLDEIGDMPLALQVKLLRVLQERVVRPVGTTKAEPVDVRLLSATHRDLDAAMAQGQFREDLYYRLDVVSLTLPRLDERREDIPLLASHFVQLLAGKYGKQVNGFAPEALEALATAAWPGNVRQLFNVVEQSCALTSTPLIPLTLVQRALRVPAMDALTYADAKQRFERNYLVQLLKLTDGNVADAARIAERNRTEFYRLLQKHDLTPAMFRSDSEVAAER

SEQ ID NO: 44091 - DNA, 1359 bp, Dechloromonas aromatica RCB
  CDS (1)..(1359)
atggaagaaagcttggtcggcgaacgcgaggcgccttggcggcagtattcggtactgattgttgatgatgaaccggggatgctcagtttcctgcagcgggccttgagttcgcgctgtggcctggttgattgcgccgacgcggtcgaagccgcgcggcccatgttgagtcgcaaccgttacgacctgatcgtgctcgacattgctttgcacggttgttccggcatcgactggctacacgagctgcgccaggatggttacgccggtgacgtcgtgttgatgaccgcttatgccgatctcgatacggcgatcgacgccctgcgggccggtgccgccgatctgctgcaaaaacccttctcgctggcgctggccctgaatgccatccagcgttgcttcgaacgctcgtcgctggcgcgcgaaaattttgtgctgcgccgtgaagtcagcacgcatgcggtcgatatcgaaggggtggtcgggcagtccgacctgatgatcaaggtctgcgagcgcctgaagcgcattgcgccgacgccggcgaccgttttgctcagcggcgaatccggtacgggcaaggaagtggctgcccgtgccttgcaccgcatgagccagcgggctgccggaccttttgtgcctgtcaattgtgccgccatttccgccgagttgatcgagtccgagctattcggtcacatcaaaggtgcttataccggggcgcagcaaaaccgcgaaggcctgttctattacgcccggggcggcacgctcttcctggacgaaatttccgaattaccatccgccgcccaggccaagctgctgcgcgtgctggaagagcgccggatcaggccggtcggctcggagcaggaagtggcggtcgatgtcagggtgatcgcggccaccaaccgcgatctgaaaaccgaggtggccgcccagcgctttcgacaggatctatactaccgactgcaggtgctggaggtcacgctgccgccgttacgcgagcggccagaggatattccgctgctggtcgagcatttcatggcccagctcacgcccaaccttggtgtgccgccgctcggcctcgatccacgcacgctggcgcgaatggccgattacgactggccgggcaatgtccgtgaattacgcaatctggtcgagcgttcgctgattctcggctggttcgacatcgggccggaaccggaaatgggcatcaacgttacagtgggaagcgacgaaacgctggaggccgttgaaaaacgccacattcttgccgtgctggcggcctgtgaaggcaataagtcggaagccagccggcgcctcggcatttcccgcaagacgatggaccgcaagtgccaggcctggggtctctga

SEQ ID NO: 44092 - protein, 452 aa, Dechloromonas aromatica RCB
MEESLVGEREAPWRQYSVLIVDDEPGMLSFLQRALSSRCGLVDCADAVEAARPMLSRNRYDLIVLDIALHGCSGIDWLHELRQDGYAGDVVLMTAYADLDTAIDALRAGAADLLQKPFSLALALNAIQRCFERSSLARENFVLRREVSTHAVDIEGVVGQSDLMIKVCERLKRIAPTPATVLLSGESGTGKEVAARALHRMSQRAAGPFVPVNCAAISAELIESELFGHIKGAYTGAQQNREGLFYYARGGTLFLDEISELPSAAQAKLLRVLEERRIRPVGSEQEVAVDVRVIAATNRDLKTEVAAQRFRQDLYYRLQVLEVTLPPLRERPEDIPLLVEHFMAQLTPNLGVPPLGLDPRTLARMADYDWPGNVRELRNLVERSLILGWFDIGPEPEMGINVTVGSDETLEAVEKRHILAVLAACEGNKSEASRRLGISRKTMDRKCQAWGL

SEQ ID NO: 44093 - DNA, 1320 bp, Ralstonia eutropha JMP134
  CDS (1)..(1320)
atgccggctgaactgactgtactgatcgtcgaagacgacgccgacgtgcgtctgggctgcgagcaggcactgcggctcgaaggcatcgccacgcaaggcgtggcaagtgccgaggcggccctgcgcgagatcacgccgggctggcccggcatcgtagtcagcgacatccgcctgccgggcatcgatggcatggccttgcaggcggaactgcgcgggcgggatccgtcgctcccggtgatcatgatcaccggccacggcgatgtgagcctggccgtgcaggccatgaagcaaggcgcctacgatttcctcgaaaagccgttctcgcccgagcagctcgtcgacaccacgcgccgcgcgctcgagcagcgccgtctgacgcttgaagtcgaggaactgcgcgagcgcctggccggccgcgacaagctcgcggcgcagctgatcggccgctcgccggcgatcgaacgcctgcgccggctgattgccgatctggccgacacggccgccaacgtgctgatccatggcgagaccggtaccggcaaggaactggtcgcacgctgcctgcacgatgccagccggcgccatgcgcgcaatttcgtcgccatcaactgcggcggcctccccgaacagctgttcgagagcgagatcttcggccatgaggcgggctcattcaccggcgccgcgcgccgccgcatcggcaaggtcgagcacgccgaaggcggcacgctgttcctcgacgaaatcgagagcatgccgatgccgctgcagatcaagctgctgcgggtcctgcaggaacgcgtggtggaacgcctggggtcgaacgagcccgtgcccgtggacacgcgtgtggtcgcggccaccaaggccgacctgcgcgcgttgtccgacgcagggcagtttcgctcggacctttattaccgcctcaacgtcatcacgctggaactgccggcgctacgcgaccggcgcgaagacgtgccgctgctgtttgagcatttcgtggcgcaggccgcgctgcgcttcgggcgcgacgccgtgccggccacgcccgccgaactggccacgctggtcgcctatccctggcccggcaatgtgcgggaactgcgcaacctggccgaacgccacgtgctcggtctcggctgcgatccgggccacggcacctccgcgccggaagcactgccactggcgcaggcggtcgagcaattcgagcgcgcgctgattgccgacgcgctgcgccggcacgacggcaacctcagccgcgccagcgaggcgctgggcgtggccaagactacgctgttcgacaagacccgcaagtacggcctgtag

SEQ ID NO: 44094 - protein, 439 aa, Ralstonia eutropha JMP134
MPAELTVLIVEDDADVRLGCEQALRLEGIATQGVASAEAALREITPGWPGIVVSDIRLPGIDGMALQAELRGRDPSLPVIMITGHGDVSLAVQAMKQGAYDFLEKPFSPEQLVDTTRRALEQRRLTLEVEELRERLAGRDKLAAQLIGRSPAIERLRRLIADLADTAANVLIHGETGTGKELVARCLHDASRRHARNFVAINCGGLPEQLFESEIFGHEAGSFTGAARRRIGKVEHAEGGTLFLDEIESMPMPLQIKLLRVLQERVVERLGSNEPVPVDTRVVAATKADLRALSDAGQFRSDLYYRLNVITLELPALRDRREDVPLLFEHFVAQAALRFGRDAVPATPAELATLVAYPWPGNVRELRNLAERHVLGLGCDPGHGTSAPEALPLAQAVEQFERALIADALRRHDGNLSRASEALGVAKTTLFDKTRKYGL

SEQ ID NO: 44095 - DNA, 1404 bp, Ralstonia eutropha JMP134
  CDS (1)..(1404)
atgtctcacatcctgattgtcgacgacgacgagaatgcctgcgccgcgctggccgagatcgtggcactggaagggttcaccgcctcgaccgcgggcagcctgcgtgaagcccgcctgcagatcggctggcgcatgccggacgtgatcctggctgacctgcgcctgccggacggcaacggcctggagctgtttgccgaagtggcatcttcgggcgtggaaattatcctcaccaccggttacgcgagcgtagacagtgccgtggaagccctgcgctcgggcgccaccgattacctcgtcaagcccatcaacgtggcgcgtctgcagaccgtgctgaagcggctcgccaataccggagcgctgcgcgcggaaatccattcgctgcgcggcgaattgcgccgctatggccggtttggccggttgctgggcagttccgacgtcatgcaggcggtctacgaccagctcgcgcgggtggcgccgacagaggccactgtgctgctgatcggcgagagcggcaccggcaaggaactggcgatgcagacggtgcatgagttgtccgcgcggcggcggcagccgttcctggcggtcaactgcggcgccatctcgccgacgctgatcgaaaccgagatgttcggccacgagcggggcagcttcacgggcgccgaccgccagcacaagggctatttcgagcgcgccgacggcggcacgctgttccttgacgaaatcaccgagatgcctgccgagctgcaggtcaagctgctgcgcgtgctcgaaaccggcagcttcatgcgggtcggtaccaaccgcgagcagcacgccgatgtgcgggtgctcgcggcgaccaaccgcaatcctgaagaggccgtcgccgagggcaagctgcgcgcggacctgttccaccgcctcaatgtgtttccggtagaactgccgccgctgcgcgcacgtggcgacgacgtgatccagattgccaatacgatgctggagcagctcaatgccgagcagggcactgcgcggcgcttcgcacccaacgtgctcgacagcctgcgccagcacatgtggccaggcaatgtgcgcgagttgcgcaattttgtgcagcgcgcctacatcatggccgatgacgacctgatcaccgaagtacaggtgccgctgcaggctgcggcggcgcaggcgccggccgccgcgatggtatcggtgccggtgggcatgtcgctggccgatgccgaccggcagctcatcttcgcgacactggaacaatgtgccggggtgaaaaagcacgctgcggaaattcttggcatcagcctcaagaccctgtacaaccggctggaagattatgcagcgcgaggcgagctgcccgagtggctgcgtgccgcgcgcaccagccagggcggcatcccagccagcggctga

SEQ ID NO: 44096 - protein, 467 aa, Ralstonia eutropha JMP134
MSHILIVDDDENACAALAEIVALEGFTASTAGSLREARLQIGWRMPDVILADLRLPDGNGLELFAEVASSGVEIILTTGYASVDSAVEALRSGATDYLVKPINVARLQTVLKRLANTGALRAEIHSLRGELRRYGRFGRLLGSSDVMQAVYDQLARVAPTEATVLLIGESGTGKELAMQTVHELSARRRQPFLAVNCGAISPTLIETEMFGHERGSFTGADRQHKGYFERADGGTLFLDEITEMPAELQVKLLRVLETGSFMRVGTNREQHADVRVLAATNRNPEEAVAEGKLRADLFHRLNVFPVELPPLRARGDDVIQIANTMLEQLNAEQGTARRFAPNVLDSLRQHMWPGNVRELRNFVQRAYIMADDDLITEVQVPLQAAAAQAPAAAMVSVPVGMSLADADRQLIFATLEQCAGVKKHAAEILGISLKTLYNRLEDYAARGELPEWLRAARTSQGGIPASG

SEQ ID NO: 44097 - DNA, 1518 bp, Mesorhizobium sp. BNC1
  CDS (1)..(1518)
atgcctgatacggtgctgattgtagacgacgacccggtgcagctccgccttctcgacgcggctgtgcgcaggctcggctatgcgccggttctggccgatggcggcgaagcagcgttgcgtatcctggcggaagtgcgaccggaagagttgcgcgctgtcattctcgacctgatgatgcccggcatgaacggcatcgaggtgatggagacgatgcgcaagcgcggcatcgacatgccggtcattgtgcagacggcgacaggtggcgtggagaccgctgtagcggcaatgcgcgccggcgctttcgattttgtcgtaaagccggtctcgcccgagcggcttgccgccgcgctgaagaacgcattgaaggtggaggcgctggaaggccagcaacggcgcaagcgggagaaagcgcccgacaaattctccttccgccatatcgtcacccgcagccctgccatggaaaaggttctgcgtcttgcacaaagagccgctgcctccgacattccgattctcatcgagggtgaatcgggtgtcggcaaggaactgatcgcccgagccgtccgcaatgaaagcgcccgccgaggaaagcccttcgtcaccgtcaattgcggagcgattcccgataatctcgtggaaagcatccttttcgggcatgagaagggtgccttcaccggcgccaccgagaagcactcgggcaaattcgtcgaggcgaacggcggaacgctctttctcgacgagatcggggaactgccgttggacgtgcaggtgaagctgctgcgcgccgtgcaggagggcgaggtcgacccggtgggcaggcggggaacggtgaaggtcgatatccgcctgatctcggccacgaaccgcgatttgctgcagcgcgtgcgggaaggccgcttccgcgaagacctttattatcgcttgggcgtttttccgataacggtcccgccgctgcgtgagcgcagggacgatattcccctcctggtgcagtatttcatcgcgcagttcggagatgcgacaaccggccggaatatttcagggatatcgtcggatgcgatcaagctgctctcggcatatgattggccaggcaatgtccggcagctcgaaaatgccgtcttccgggccatggtcctgtgcgatggaacggtgctcaccgccgccgaattcccacagatacgggcacaggttgaaggaatcgacgaaaagcttctcgcggatgaaataaagccggcgcatcaggaaagcgcgccaccaccgcaacccgacaaagcgtcgcaacaggagatgcagccgctgcatcccgctttgctgcccgttatcggagaagacggcaatgtccgcccgctggaggagatggagcgggagatgatccagtttgcgatcgaacattatgacggcaggatgagcgaagttgcgcgaaggctgggaattggccgctccacgctttaccgcaagctgaaagagatggggatcgagcctccggagggcggcgggaaaaagactgaatcccctggcggatga

SEQ ID NO: 44098 - protein, 505 aa, Mesorhizobium sp. BNC1
MPDTVLIVDDDPVQLRLLDAAVRRLGYAPVLADGGEAALRILAEVRPEELRAVILDLMMPGMNGIEVMETMRKRGIDMPVIVQTATGGVETAVAAMRAGAFDFVVKPVSPERLAAALKNALKVEALEGQQRRKREKAPDKFSFRHIVTRSPAMEKVLRLAQRAAASDIPILIEGESGVGKELIARAVRNESARRGKPFVTVNCGAIPDNLVESILFGHEKGAFTGATEKHSGKFVEANGGTLFLDEIGELPLDVQVKLLRAVQEGEVDPVGRRGTVKVDIRLISATNRDLLQRVREGRFREDLYYRLGVFPITVPPLRERRDDIPLLVQYFIAQFGDATTGRNISGISSDAIKLLSAYDWPGNVRQLENAVFRAMVLCDGTVLTAAEFPQIRAQVEGIDEKLLADEIKPAHQESAPPPQPDKASQQEMQPLHPALLPVIGEDGNVRPLEEMEREMIQFAIEHYDGRMSEVARRLGIGRSTLYRKLKEMGIEPPEGGGKKTESPGG

SEQ ID NO: 44099 - DNA, 1461 bp, Mesorhizobium sp. BNC1
  CDS (1)..(1461)
atgagcgcacaaggcaacattctggtggccgatgacgacgcggccattcgcacggtcctcaatcaggcgctgtcgcgcgtggggcaccaggtccgcgtgacgtcgaatgccgcgacgctttggcgctgggttgccgcgggcgagggggatctagtcattaccgatgtggtgatgccggacgaaaatgccttcgacatgcttccgcgcatccgaaaagcgaggccggacctgccggtcatcgtcatgagcgcacagaacaccttcatgactgcgattcgtgcgtcggaggcaggcgcttacgaatacctgcccaagcccttcgatttgacggagcttctgggcatagtcggtcgggctctggcagagccgcgcagcaaggcagtcgagacgcggacgaacgatacgccggaagcgatgccgctcatcggccgctcgccggccatgcaggatatctaccgcatgcttgcccgcatgatgcagacggatctcaccgtcatgatcaccggcgaatcggggactggcaaggaactcgtcgcgcgggctctacatgaattcggccgccgccgtaacggccccttcgtcgctatcaacatggcggccataccccgggacctgatcgagtcggaactcttcggccacgagaaaggggctttcacgggcgcgcagcagcgctcttccggtcgcttcgagcaagctgaaggtggcacgcttttcctcgatgaaatcggcgatatgcccatggaggcccaaacgcggctcctgcgagtgctccagcagggcgaatacaccacggtgggcggacgcacgccgatcaagaccgatgtgcgaatcgttgctgccacgaacaaggatttgcgcgcgcttatcaatcaggggctttttcgtgaagatctcttctaccgcctgaatgtcgtcccgctgcggctgccgccgttgcgcgaaaggtcggaggatatacccgatctggtgcgtcatttctttgcacaagcggaacgggaaggactccagcccaagcgcatcgccacgggcggggtcgacgccatgatgaaatatccatggcccggcaatgtgcgcgaactggaaaacctagtgcgccggttggccgcgctatacccccaggacgagatctccgaggaaatcatactgggcgagcttcatggtgggatgccggccgccaattcgcctttgaatgatggagcggggcaggacctgccacttgggcaatccgtggaacaatatctgcagcgctatttccgaggcttcggttcagcgcttccgccgccgggcctctaccaccgcattctggccgaggtggagtatccactgatccttgcggctctcgctgccacccatggcaatcagatccgggcggccgaactgcttggggtcaaccgcaacacactgcgcaagaagatccgcgatcttagcgtcgatatctatcggacggccaaaaacccctga

SEQ ID NO: 44100 - protein, 486 aa, Mesorhizobium sp. BNC1
MSAQGNILVADDDAAIRTVLNQALSRVGHQVRVTSNAATLWRWVAAGEGDLVITDVVMPDENAFDMLPRIRKARPDLPVIVMSAQNTFMTAIRASEAGAYEYLPKPFDLTELLGIVGRALAEPRSKAVETRTNDTPEAMPLIGRSPAMQDIYRMLARMMQTDLTVMITGESGTGKELVARALHEFGRRRNGPFVAINMAAIPRDLIESELFGHEKGAFTGAQQRSSGRFEQAEGGTLFLDEIGDMPMEAQTRLLRVLQQGEYTTVGGRTPIKTDVRIVAATNKDLRALINQGLFREDLFYRLNVVPLRLPPLRERSEDIPDLVRHFFAQAEREGLQPKRIATGGVDAMMKYPWPGNVRELENLVRRLAALYPQDEISEEIILGELHGGMPAANSPLNDGAGQDLPLGQSVEQYLQRYFRGFGSALPPPGLYHRILAEVEYPLILAALAATHGNQIRAAELLGVNRNTLRKKIRDLSVDIYRTAKNP

SEQ ID NO: 44101 - DNA, 1488 bp, Dechloromonas aromatica RCB
  CDS (1)..(1488)
atgagtcacccggcttccaaccgcagcctgcgcaaactaccggccatccttgtcgtcgatgacgaagtgcggtcgcaggaagccttgcgccgcacgctggaagaggatttcgatgtgctgtgtgcgtccagtgccgacgagggcatggaaatcctcgagcgagagcaggcctccgccgccatccgcatcgtgctttgcgaccagcgcatgccgggaacgaccggcgtccagttcctgcgcgaagtgcggacccgctggccggatatcgtacgcatcatcctgtccggctataccgacgccgaggacatcattaccggcgtcaatgaggcgggtatctggcaatacctgttgaagccctggcagcccgagcaactgctgctgaccatgcagcgcgccgccgaagtctggcgtctgcaacaggaaaaccagcggctgtcgcttgatctgcgcacggccgagccggtgctgaaaaggcacgtcgacagcaagcaggagaaggtcaaaagcagtttcggcctggctggcttcatccgggcgccgggcagcccgatcaatgccgtctgcgacatggtcgggcgcgttgcgccttttgacctgtcggtgatggtcaccggcgaatcgggcaccggcaaggaaatgatcgcccgcgccatccactacgaaagccgccgggcgagcaaacccttcatcaccgaaaactgcggcgccctgcccgatacgctgcttgagtccgagttgttcggctacaagcgcggcgcctttacgggcgcggtggaagatcgtgtcggcctgttccagcaggccgatggcggcacgctgttcctcgacgaaatcggcgaaaccagcccggccttccaggtcaagctgctgcgcgtgctgcaggaaggcgagtttcgcccgctgggcagcaaccgcccggttcatgtcgatgtccgggtcattgccgcgaccaatcgcgacctggaagaagacgtgcgcaccggacgttttcgtgaggatctctactaccggctggcgaccatttcattgcatgtgccgccgttgagagagcggccaatggatctgccgctactggcgcgtcgtctgctcgacagcagttgccaggcgcttggaaaatcggttgagggcttcaccaacgaagcgcttgcctgcattgctgcttaccgctggccaggcaatgtgcgcgaactgcaaaacgaaattctgcgcatggtcgccttgtccaccgcgccgctgcttggtgccgacctgctgtcgccacgggtgttgcgcacaccggtgggcgaaactcaggaaaatgatctggcctgggcttccggcttgagcggtggcctcaaggagcgcatggatcagctggaaatgcacgtcctcaaggaggcgatgatccgccaccgctggaacaaatcgcgggcagcccgggagttggggctgtcgcgtgtcggcctgcgggccaagctggttcgccacgggctggagcaggccgaatga

SEQ ID NO: 44102 - protein, 495 aa, Dechloromonas aromatica RCB
MSHPASNRSLRKLPAILVVDDEVRSQEALRRTLEEDFDVLCASSADEGMEILEREQASAAIRIVLCDQRMPGTTGVQFLREVRTRWPDIVRIILSGYTDAEDIITGVNEAGIWQYLLKPWQPEQLLLTMQRAAEVWRLQQENQRLSLDLRTAEPVLKRHVDSKQEKVKSSFGLAGFIRAPGSPINAVCDMVGRVAPFDLSVMVTGESGTGKEMIARAIHYESRRASKPFITENCGALPDTLLESELFGYKRGAFTGAVEDRVGLFQQADGGTLFLDEIGETSPAFQVKLLRVLQEGEFRPLGSNRPVHVDVRVIAATNRDLEEDVRTGRFREDLYYRLATISLHVPPLRERPMDLPLLARRLLDSSCQALGKSVEGFTNEALACIAAYRWPGNVRELQNEILRMVALSTAPLLGADLLSPRVLRTPVGETQENDLAWASGLSGGLKERMDQLEMHVLKEAMIRHRWNKSRAARELGLSRVGLRAKLVRHGLEQAE

SEQ ID NO: 44103 - DNA, 1383 bp, Rubrivivax gelatinosus PM1
  CDS (1)..(1383)
atgcccgccagccccgccctgcccgctcccgcccccggactcgacgcctggccgcgcgcctcggtgctgctggtcgacgacgagcagggcatgcgcaacttcctcgagaagacgctggcaccgcgctgcggcaacgtgcagagcgctgccagcgccgaggaggccgacgcgctggtgcgccggcaccgtttcgacctggtgatcctcgacatctcgctgcccgggaagagcggcctcgcctggcttcgcgagctgcgcgagcagggctacagcggcgaggtggtgctgatcaccgcctatgccgatctcgacaccgcgatcgaggcgctgcgcgcgggcgcctccgacctggttctcaagccgtttcgcgtgacgcagatcctcaacgcggtgaagcacggcctcgaccgcacgctgctgaagcgcgagaactgggtgctcaagcacatgatctcgcagcgcggcgagggcttcgacggcctggtgggcagctcgccggcgatgcaggacctcaggcgcgcgctgcagcgcgccgcgccggtggccagcaccgtgctgctgtcgggcgaatcgggcaccggcaaggagctggcggcgatcgcgctgcatcgccacagcccgcgcgcaccggaacccttcgtgccggtcaactgcgcgagcctcgcgcccgagcgcatcgagagcgagctgttcggccatgcccagggtgccttcaccggcgcgacgcacggccgcgacgggctgttctattacgcccagggcggcacgctgttcctcgacgagatcgccgaactgccgctggcccagcaggctgcactgctgcgcgtgctggaggaccaccgcatccgtccggtcggcagcgagcagcagatcccggtcgacgtgcgcatcgtcgccgccaccaaccggcggctggccgacgaggtggccgccgggcgcttccgcaaggacctgtactaccggctgcaggtggtcgagatcggcctgccgccgctgcgcgagcacaaggacgacatcgccgagctggtggcgcatttcatcgccacgctggcgccgcatctcggcgtcgagccgatcgccgtcagcccggccgagatggcctacctgcagcagtacgactggcccggcaacgtgcgcgagctgcgcaacctggtggagcgctcgatgatcctgggcgcgctcaacgtgtcagcgctctaccccggcggtactacgtcgcgcaccggcgcgagcgccggcccgaccgacctgcagacgctggagaagcagcacatcctcgcggtgctggaatcggtgcagggcgacaagacgcgcgcggctgagttgctgggcatctcgcgccgcacgctggagcggcgctgcgccgaatggctagtcgcttga

SEQ ID NO: 44104 - protein, 460 aa, Rubrivivax gelatinosus PM1
MPASPALPAPAPGLDAWPRASVLLVDDEQGMRNFLEKTLAPRCGNVQSAASAEEADALVRRHRFDLVILDISLPGKSGLAWLRELREQGYSGEVVLITAYADLDTAIEALRAGASDLVLKPFRVTQILNAVKHGLDRTLLKRENWVLKHMISQRGEGFDGLVGSSPAMQDLRRALQRAAPVASTVLLSGESGTGKELAAIALHRHSPRAPEPFVPVNCASLAPERIESELFGHAQGAFTGATHGRDGLFYYAQGGTLFLDEIAELPLAQQAALLRVLEDHRIRPVGSEQQIPVDVRIVAATNRRLADEVAAGRFRKDLYYRLQVVEIGLPPLREHKDDIAELVAHFIATLAPHLGVEPIAVSPAEMAYLQQYDWPGNVRELRNLVERSMILGALNVSALYPGGTTSRTGASAGPTDLQTLEKQHILAVLESVQGDKTRAAELLGISRRTLERRCAEWLVA

SEQ ID NO: 44105 - DNA, 1449 bp, Rubrivivax gelatinosus PM1
  CDS (1)..(1449)
atgagcagccagccccgcagggaagcaccggccgaggcacggcggccgtcggaacaggtgctcgtgatcgacgacgaccacggcatcggcgactgcgtcgagatgctgctgcagcgcgccggctacacctgcgtgatcacgcgcaccggcggcgagggcctggcgcagctccgcagccgcgagttcgacatggtcatcaccgacctgcgcctgcccgacgccagcgggctggacatcgtggcggccagcaaggcggccaaccccgagacgcaggtgatcctgatgaccagcttctcgtcggtcgagagcgcgatcgaggcgctgcgcctgggcgccaacgactacgtgatcaagcccttcgacaacgatgacttcctgttctcggtggagcgggcgctcggcgagcgccgcacccgcatggagaacgtggccctcaagcgcagcctgcgcaaggcctattcccagaacgccatcatcggcgagagcgacggcgtcaagcgcctgctgggcatgatccagcgcgtggccgccaccgaggccaacgtgctgatccagggcgagagcggcaccggcaaggaactggtggcccaggccatccacttcggcggcaatcgggcgcaccggccgttcgtcgcggtgaactgcggggccattccggccgagctgatcgagtccgagctgttcggccacgtcaagggcgcctacacgggcgcggcctcggccagcgagggcctgatccgcgaagccagcggcgggacgctgttcctcgacgagatctcggagatgccgctcaacgtgcaggtgaagctgctgcgggtgctgcaggagcgccaggtgcgaccgctcggttcgggacagagctacatcaccgacacgcgcttcctcgcggcgagcaaccgcaacctgaaggagagcgccgagagcggcagcttccgcgccgacctctactaccgcctgaacgtcatcacgatccacgtgccgccactgcgcgagcgcggggccgacatcgagctgctcgcgcgccacttcatgcagttgttcagccgcaagttcggcagccgggtcagcggcatggaccgggacttcatcgacttcctgcaccgccactcctggcccggcaacgtgcgcgagctccagaacgtgatcgagcgcgcggtgatcctggccgatgccgacatcctgagcgccgccgacctggaggaaacgctcgcgctgccggccaaggagactcacctgccgctgggcagcgggttgcccctgtcggtggaggagtacatcaaggaagtcgtgctgctctaccaggaccggcacggcgaggccgagcttgcggcgatgctcggcatcggccgcaaggcgctctggatgcggcgccgcaactggggcctgcaccggcagcgcgagcgcgcaccggccggcgacgagctagaccacctccaccgcgttcagtga

SEQ ID NO: 44106 - protein, 482 aa, Rubrivivax gelatinosus PM1
MSSQPRREAPAEARRPSEQVLVIDDDHGIGDCVEMLLQRAGYTCVITRTGGEGLAQLRSREFDMVITDLRLPDASGLDIVAASKAANPETQVILMTSFSSVESAIEALRLGANDYVIKPFDNDDFLFSVERALGERRTRMENVALKRSLRKAYSQNAIIGESDGVKRLLGMIQRVAATEANVLIQGESGTGKELVAQAIHFGGNRAHRPFVAVNCGAIPAELIESELFGHVKGAYTGAASASEGLIREASGGTLFLDEISEMPLNVQVKLLRVLQERQVRPLGSGQSYITDTRFLAASNRNLKESAESGSFRADLYYRLNVITIHVPPLRERGADIELLARHFMQLFSRKFGSRVSGMDRDFIDFLHRHSWPGNVRELQNVIERAVILADADILSAADLEETLALPAKETHLPLGSGLPLSVEEYIKEVVLLYQDRHGEAELAAMLGIGRKALWMRRRNWGLHRQRERAPAGDELDHLHRVQ

SEQ ID NO: 44107 - DNA, 1437 bp, Pseudomonas fluorescens PfO-1
  CDS (1)..(1437)
atgccgcacattttgatcgtcgaagacgaaaccattatccgctccgccttgcgccgcctgctggaacgcaaccagtaccaggtcagcgaagccggttcagtgcaggaagcacaagaacgcttcagtattcccacattcgatctgatcgtcagcgacctgcgtctgccgggtgctccgggcaccgagctgatcaagctcggccagggcacgccggtgctgatcatgaccagctacgccagcctgcgctcggcggtcgactcgatgaagatgggcgcggtggattacatcgccaagcctttcgaccacgatgaaatgcttcaggctgtcgcgcggatcctgcgcgatcgccagtcggcgcctgctgccggcgaagcagctcccgcgaaatcggccaatggcagcggcaaatccgccatcgacaacagcaatggcgagatcggcatcatcggttcgtgtccgccgatgcaggatctttacggcaagatccgtaaagtcgcgccgaccgattccaacgtattgatccagggtgagtccggtaccggtaaagagctggtggcccgtgccctgcacaacctgtcgaaacgcgccaaggcaccgatgatctcggtgaactgcgccgccattccggaaagcctgatcgagtccgaactgttcggccacgagaaaggcgcgttcaccggtgccagcgccggtcgcgccggtctggtggaagcggcggacggcggcacgctgttcctcgacgaaattggcgagttgccactggaagctcaggctcgtttgctgcgtgtcttgcaggaaggcgaaattcgccgggttggctcggttcagtcgcagaaagtcgatgtccggttgatcgccgcgacccaccgcgacctcaagagcctggcgaaaatcggccagttccgtgaagacttgtactaccgcctccatgtgatcgcgttgaaactgccggccctgcgcgagcgaggcgccgacgtcaacgaaatcgccaatgcgttccttgctcgccagagcgcacgcatcaaccgcaccgacctgaaatttgccgccgatgccgaacaggcgatccggcactattcctggccgggtaacgtacgggagctggaaaacgccgtcgagcgcgccgtgattctgagcgaaagcccggaaatctctgccgacctgctgggcatcgacatcgagctgggtgatctggaggacgacgaattcatcggcctgccggcgcaaccggccggtaacgccagcaacagcagccacgagccgaccgaagacctatcactggaagactacttccagcatttcgtgctcgagcatcaggatcacatgaccgagaccgaactggcgcgcaaactgggcgtcagccgcaaatgcctgtgggagcgtcgtcagcgtctgggcattccacggcgcaagaccggggtcgccagcgagagctga

SEQ ID NO: 44108 - protein, 478 aa, Pseudomonas fluorescens PfO-1
MPHILIVEDETIIRSALRRLLERNQYQVSEAGSVQEAQERFSIPTFDLIVSDLRLPGAPGTELIKLGQGTPVLIMTSYASLRSAVDSMKMGAVDYIAKPFDHDEMLQAVARILRDRQSAPAAGEAAPAKSANGSGKSAIDNSNGEIGIIGSCPPMQDLYGKIRKVAPTDSNVLIQGESGTGKELVARALHNLSKRAKAPMISVNCAAIPESLIESELFGHEKGAFTGASAGRAGLVEAADGGTLFLDEIGELPLEAQARLLRVLQEGEIRRVGSVQSQKVDVRLIAATHRDLKSLAKIGQFREDLYYRLHVIALKLPALRERGADVNEIANAFLARQSARINRTDLKFAADAEQAIRHYSWPGNVRELENAVERAVILSESPEISADLLGIDIELGDLEDDEFIGLPAQPAGNASNSSHEPTEDLSLEDYFQHFVLEHQDHMTETELARKLGVSRKCLWERRQRLGIPRRKTGVASES

SEQ ID NO: 44109 - DNA, 1392 bp, Pseudomonas fluorescens PfO-1
  CDS (1)..(1392)
atgggcatcaaggttctgctggtcgaggatgaccgctcgttgcgcgaagcgctggccgatacgctgctgctggccggtcacgactatcacgcggtgggttcggccgaagaggcgctgaacgcggtcgagcgcgaagcgttcagtctggtggtcagtgacgtcaacatgccgggcatggacggccatcaattgctcggcctgctgcgcgcacggcaaccgcaattgccggtgctgctgatgaccgcccatggcgcggtcgagcgcgcggtcgatgccatgcgccagggcgcggcggattatctggtcaagccgttcgagcccaaggctctgctggatctggtagcgcgtcacgccttgggcagccttgtcgccagcgacgccgaagggccggtcgcggtcgagccggccagtgctcaattgctggatctggcggcgcgggtcgcacgcagtgattccaccgtgctgatttccggcgagtccggcaccggcaaggaagtgctggcgcgctacatccaccagcaatcccatcgtgccagtcagccgttcattgcgatcaactgcgcggcgatccccgacaacatgctcgaagccaccctgttcggtcatgaaaaaggctcgttcactggcgccatcgcggcccaggctggcaagttcgaacaggcggacggcggcaccattctgctcgatgaaatttccgaaatgcccctgggtctgcaagccaagctgttgcgggtgttgcaggagcgggaagtggaacgggtcggcgcacgcaagccgatcaccctcgatattcgcgtggtggcgaccaccaaccgcgatctggccggtgaagtggcggcggggcgattccgtgaagacctctattatcgtctgtcggtatttccgctggcctggcgtccgttgcgcgagcgcaccgccgatatcctgccgctggccgagcgtctgttggccaaacacgtcaataaaatgaagcacgcgatggcgaagttctcgtccgaggcgcaagcgtgcctgatcggttatccgtggccgggcaacgtgcgcgagctggataatgcggtccagcgggccttgattctccagcagggcgggttgatccagccgcaggatttctgtctctccgggcctgcgctgtttgcgccattgccagcggtggtgccggttgcgccggtcattcgtgaagtcgaaatcgaggtggattcggccggtgcgctgggcgatgacctgcgtcgccgggagttccagatgatcatcgacaccctgcgtaccgagcgcggccgacgcaaggaagccgccgaaaaactcggcatcagcccgcgcaccctgcggtacaaactggcgcaaatgcgcgatgcgggcatggatgtcgaaggctacctgttcgccacctga

SEQ ID NO: 44110 - protein, 463 aa, Pseudomonas fluorescens PfO-1
MGIKVLLVEDDRSLREALADTLLLAGHDYHAVGSAEEALNAVEREAFSLVVSDVNMPGMDGHQLLGLLRARQPQLPVLLMTAHGAVERAVDAMRQGAADYLVKPFEPKALLDLVARHALGSLVASDAEGPVAVEPASAQLLDLAARVARSDSTVLISGESGTGKEVLARYIHQQSHRASQPFIAINCAAIPDNMLEATLFGHEKGSFTGAIAAQAGKFEQADGGTILLDEISEMPLGLQAKLLRVLQEREVERVGARKPITLDIRVVATTNRDLAGEVAAGRFREDLYYRLSVFPLAWRPLRERTADILPLAERLLAKHVNKMKHAMAKFSSEAQACLIGYPWPGNVRELDNAVQRALILQQGGLIQPQDFCLSGPALFAPLPAVVPVAPVIREVEIEVDSAGALGDDLRRREFQMIIDTLRTERGRRKEAAEKLGISPRTLRYKLAQMRDAGMDVEGYLFAT

SEQ ID NO: 44111 - DNA, 1329 bp, Pseudomonas fluorescens PfO-1
  CDS (1)..(1329)
atgaacaacgacctcagtgtattgatcgtcgaagacgacccccatgtcctgctcggctgccagcaggcgctgaccctcgaagacatcccctgcatcggcgtcggcagtggcgaagaagcgctggagcaggtcggcgacaacttcgccgggatcgtcatcagcgacattcgcctgccgggcatcgacggcctggaactgctgacccggctcaagcaacgcgaccgcagcctgccggtggtgctgatcaccggccacggcgacatctccatggccgtcggcgcgatgcagaaaggcgcctacgacttcatggaaaaaccgttctcccctgaacgactggtggacgtggcccgtcgtgcgctggagcaacgcagcctcaatcgcgaagtttcgtccctgcgccggcaactggccgaacgcgattcccttgaagggcggatcatcgggcgttcgccggccatgcagaacctgcgcgaactgatcgccaacgtcgccgacacctcggccaacgtattgatcgaaggcgagaccggcaccggcaaggaactggtcgcccgctgcctgcacgatttcagccgacgccacaccaaacagttcgtcgcgctgaactgcggcggtctgccggaaaacctgttcgaaagcgaaatcttcggtcacgaagccaacgccttcaccggcgccggcaaacggcggatcggcaagatcgagcacgccgacggcggcacgctgttcctcgacgaagtggaaagcatgccgctgccgttgcagatcaaactgctgcgggtgttgcaggagcgcaccctcgaacgcctcggctcgaaccagagcgtggcggtggattgccgggtgattgcggccaccaagtccgacctcgacgagtcgagcaaggccggggaatttcgcagtgacttgtactaccgcctcaacgtggtgacgctggaactgccgcccctgcgcgaacgccgcgaagacatcctgcaactgttcgaacacttcacccagcaatcggccctgcgtttcgaccgggcgctgccggagctggacaaccagacgttgtcgagcctgatgagccacgactggccgggcaacgtgcgcgaactgcgcaacgtcgccgagcgttttgccctcggtttgccggcgttcaagaaaaccggcgcgggcagcgcaggtcagggcctggcgttcgccgaagcggtggaagcgttcgaacgcaacctgctcagcgacgccctgcaacgcagcggcggcaacctgacccaggccagcctggaactgggcatggccaagaccacgctgttcgacaaagtgaaaaaatacggcctgagccattaa

SEQ ID NO: 44112 - protein, 442 aa, Pseudomonas fluorescens PfO-1
MNNDLSVLIVEDDPHVLLGCQQALTLEDIPCIGVGSGEEALEQVGDNFAGIVISDIRLPGIDGLELLTRLKQRDRSLPVVLITGHGDISMAVGAMQKGAYDFMEKPFSPERLVDVARRALEQRSLNREVSSLRRQLAERDSLEGRIIGRSPAMQNLRELIANVADTSANVLIEGETGTGKELVARCLHDFSRRHTKQFVALNCGGLPENLFESEIFGHEANAFTGAGKRRIGKIEHADGGTLFLDEVESMPLPLQIKLLRVLQERTLERLGSNQSVAVDCRVIAATKSDLDESSKAGEFRSDLYYRLNVVTLELPPLRERREDILQLFEHFTQQSALRFDRALPELDNQTLSSLMSHDWPGNVRELRNVAERFALGLPAFKKTGAGSAGQGLAFAEAVEAFERNLLSDALQRSGGNLTQASLELGMAKTTLFDKVKKYGLSH

SEQ ID NO: 44113 - DNA, 1347 bp, Pseudomonas fluorescens PfO-1
  CDS (1)..(1347)
atggaatcagccactgagcaccaaggccgcattctgctggtggacgatgaatccgccatcctgcgaacctttcgttattgcctcgaagacgaaggttataccgtcgccaccgccaacagtgcggctcaggctgacgcgctgctgcaacgccaggtgttcgacctgtgcttccttgatttacgcctgggtgaagacaacggcctcgatgtactcgcgcagatgcgcattcaggcgccgtggatgcgggtggtcatcgttaccgcccattcggccgtcgataccgcggtagacgcgattcaggccggcgctgccgattatctggtcaaaccgtgcagcccggatcaattgcgcctggcgaccgccaagcagcttgaagtgcgccagctgtcggcgcgtctggaagccctcgaaggcgagatccgcaaacccaaggacggcctcgattcccacagcccggcgatgaaagtcgtactggaaaccgcgcggcaagtggcgggcaccgacgccaacatcctgatcctcggcgagtccggcaccggtaaaggtgagctggcccgggcgattcacggctggagcaagcgcgagaagaaatcctgtgtgaccatcaattgcccgtcactgaccgccgaattaatggagagcgagctgtttggtcacagtcgtggcgccttcaccggggccagcgaaagcacgctcggtcgggtcaatcaggccgatggcggtacgctgtttctcgacgagatcggcgattttccgctgacattgcaacccaagttgctgcggttcattcaggacaaggaatatgagcgggtaggggatccggtcacccgccgcgccgatgtgcgcatcctcgccgccaccaacctcaatcttgaggacatggtgcgcgacggccgtttccgtgaagacctgctctatcgcctgaacgtcatcaccctgcatttgccgccgctgcgcgagcgggccgaagacatcctgaccctggccgaccgtttcctcgcccgtttcgtgaaggagtatgcgcgtccggcacggggcttcagcgacgaggctcgcgaagcactgctgggctaccgttggcccggcaacatccgtgagctgcgcaacgtggtcgagcgggcgagcatcatctgcccgcaggagcgcgtggaaatcagccacctcggcatggccgagcaaccggccaacaacgcgccacgggtcggcgccgcgctgagcctcgacgagctggaaaaggctcacatcggcgcagtactggcgaccgccgggaccctcgatcaggctgccaagactctggggatcgacgcctcgaccctgtatcgcaagcgcaagcagtacaacctgtga

SEQ ID NO: 44114 - protein, 448 aa, Pseudomonas fluorescens PfO-1
MESATEHQGRILLVDDESAILRTFRYCLEDEGYTVATANSAAQADALLQRQVFDLCFLDLRLGEDNGLDVLAQMRIQAPWMRVVIVTAHSAVDTAVDAIQAGAADYLVKPCSPDQLRLATAKQLEVRQLSARLEALEGEIRKPKDGLDSHSPAMKVVLETARQVAGTDANILILGESGTGKGELARAIHGWSKREKKSCVTINCPSLTAELMESELFGHSRGAFTGASESTLGRVNQADGGTLFLDEIGDFPLTLQPKLLRFIQDKEYERVGDPVTRRADVRILAATNLNLEDMVRDGRFREDLLYRLNVITLHLPPLRERAEDILTLADRFLARFVKEYARPARGFSDEAREALLGYRWPGNIRELRNVVERASIICPQERVEISHLGMAEQPANNAPRVGAALSLDELEKAHIGAVLATAGTLDQAAKTLGIDASTLYRKRKQYNL

SEQ ID NO: 44115 - DNA, 1383 bp, Rhodospirillum rubrum
  CDS (1)..(1383)
atgttagcccccgcccagaccgttctgatcgtcgatgacgacgaggccatccgccagatgctgtcggccttcttgtccaaggaaggcctgagggtggtgacggcgcgcgacggcctggaggcgatcgaggttttccgccttcagcgtaccgatgtggttttgctcgatatccgcatgccacgcatgaacggccttgaggcggccaaggcgatcttggagatggaccggggcacggcggtgatcttgatgaccgccttcgccgaggtttgcaccgcggttcaggcgatcaaggatggcgccttcgactatgtgatcaagccctttgatcttgaggagatccgcctgctcgtccgccgggcgctggagatccgctcgatgcgcgccgatatcgtttcattgcggcgcgaattatccgagcgttacggcgccgaaggtatcttgaccgacaatcccaagatgatggatctgcgccagaccatcgccaaagtggcgcgcagccaagccaccgtgctgatccagggcgaaagcggcaccggcaaggaactggtggcggcctcggtccattacggcagcccgcgcgccaccggtcccttcatccgcgtcaattgcgcggccattcccgaaggcttgctggaaagcgagttcttcggccacgagaagggggccttcaccggggcggccacccgtcggcgcgggcgttttgaacaggccgagcatggcacgctgtttctcgacgagatcggcgagatttccccggcccttcaggtcaagctgctgcgggttctgcaggaacgcgaatacgagcgcgttggcggttcggagccgatcccggccgatgtgcgcatcgtcgcggcgaccaaccgcgatctcgaggcgatgatccgcgagggaaccttccgtcaggatctgttcttccgcctgaatgtcgtcgccttgaagaccatccccttgcgcgatcgtcccgaggatatccgcctgctcgccgatcattttcttgggcgcttcgccgccgataacaacgtggtgatccggggcttcgatccggcggccttggactgcatgctggcctatccctggcccggcaatgtccgcgaattggtcaacgccgtggagcgcgccgtggtgatgagcacgggcaacgtgattttgcgcgacgatctgcccgaaaacatcatttgcggcgagcgcgccgctttcgtttccgaactgctgcccgatggcgaggcgatcaggcccttgcgcgaaatggccagcgagttcgaaacccgcgtcatccgcctcgccctggcgcgcaacggcggcaaccgggcgcgcacggcgattcaactggggatcagccgtcgcgccctgctttataagctgcaggaatacgccatcacctga

SEQ ID NO: 44116 - protein, 460 aa, Rhodospirillum rubrum
MLAPAQTVLIVDDDEAIRQMLSAFLSKEGLRVVTARDGLEAIEVFRLQRTDVVLLDIRMPRMNGLEAAKAILEMDRGTAVILMTAFAEVCTAVQAIKDGAFDYVIKPFDLEEIRLLVRRALEIRSMRADIVSLRRELSERYGAEGILTDNPKMMDLRQTIAKVARSQATVLIQGESGTGKELVAASVHYGSPRATGPFIRVNCAAIPEGLLESEFFGHEKGAFTGAATRRRGRFEQAEHGTLFLDEIGEISPALQVKLLRVLQEREYERVGGSEPIPADVRIVAATNRDLEAMIREGTFRQDLFFRLNVVALKTIPLRDRPEDIRLLADHFLGRFAADNNVVIRGFDPAALDCMLAYPWPGNVRELVNAVERAVVMSTGNVILRDDLPENIICGERAAFVSELLPDGEAIRPLREMASEFETRVIRLALARNGGNRARTAIQLGISRRALLYKLQEYAIT

SEQ ID NO: 44117 - DNA, 1377 bp, Ralstonia metallidurans CH34
  CDS (1)..(1377)
atgtcggctaacccgatcgaagcgcccctggacgccgaggcaacaagccccgtgctgaccgtgctcatcgtcgaggacgacgccgacgtgcggctcggctgcgaacaggcgctgcgcctcgaaggcattgccacacgcgcggtcggcagcgccgaagctgcgctgcgtgaggtcgatgcgggctacgcgggcatcgtcgtcagcgatatcaatctgccgggatcggacggcatggcgctgctgcgcgaactcgcgtcgcgcgatgctgcactgcccgtcatcatgatcaccggccacggcgatatcacgctggccgtgcaagccatgaaacagggcgcctacgatttcatcgagaagccgttctcgccagaacggctcgtggccacctgccggcgcgcgctggagaagcgtcgcctggcgctcgaggtggcagacctgcgagcccggctggcggggcaggaatcgctctccgcgcgcctgatcggtcattcgcccgccatcgagcgcctgcgccagatgatcaccggcctcggcaacacgaccgcgagcgtgctgattcatggcgagaccggcaccggcaaggaacttgtggcacgctgcctgcacgaagccagcgcgcgccgggcgcggcatttcgtgccgatcaattgcggcgggctgcccgagcaactgttcgaatccgagatcttcggccatgaggccggcgcgttcacgggtgcggccaaacgccgcatcggcaagatcgaacacgctgaaggcggcacactgtttctcgacgaaatcgagagcatgccgatgcagatgcagatcaagctgctacgcgtgttgcaggagcgcgtggtggagcggctgggctcgaatcaggcggtgcaggtcaacgcgcgcgtggtggcggccaccaaggccgatctgcgcgcggcggccgatgtgggccagttccgcgccgatctctattaccgtctcaatgtcgtcacgctggagcttccgccgttgcgagagcgccgggaggacatcccgctgctgttcgagcacttcgtcgcgcaggccgcgctgcgattcgaacgcgaggcgattccgcccacgccagccgagatggccggattgatggcctacccgtggcccggcaacgtgcgcgagttgcgcaacctcgccgagcgccatgtactggggctgggatgccggccaggcgaaggcggacacgatatggcgccacctgcggccttgccgctggcgcaggcggtagaacagttcgaacgtgcactgatagcagacgcactgcgccgccatgatggcaatctgacacgcgccggcgagtcgctcggtattgccaagaccactcttttcgacaaggtccgcaagtacggactttcgtcatga

SEQ ID NO: 44118 - protein, 458 aa, Ralstonia metallidurans CH34
MSANPIEAPLDAEATSPVLTVLIVEDDADVRLGCEQALRLEGIATRAVGSAEAALREVDAGYAGIVVSDINLPGSDGMALLRELASRDAALPVIMITGHGDITLAVQAMKQGAYDFIEKPFSPERLVATCRRALEKRRLALEVADLRARLAGQESLSARLIGHSPAIERLRQMITGLGNTTASVLIHGETGTGKELVARCLHEASARRARHFVPINCGGLPEQLFESEIFGHEAGAFTGAAKRRIGKIEHAEGGTLFLDEIESMPMQMQIKLLRVLQERVVERLGSNQAVQVNARVVAATKADLRAAADVGQFRADLYYRLNVVTLELPPLRERREDIPLLFEHFVAQAALRFEREAIPPTPAEMAGLMAYPWPGNVRELRNLAERHVLGLGCRPGEGGHDMAPPAALPLAQAVEQFERALIADALRRHDGNLTRAGESLGIAKTTLFDKVRKYGLSS

SEQ ID NO: 44119 - DNA, 1410 bp, Magnetococcus sp. MC-1
  CDS (1)..(1410)
atgaaagcgcgtgatctacatagcctgctgttggttgaagatagcccctctatggcgatggtctatcaagagtacatcaaaggggagccacagtggcaggtgagccactgtaaagagggtcatgccgcgctggtctatctgcaccagcatacgcctgatctggttttattggatctgcaactgcccgacatgcatggtttagagattctcaaggcgatccatgagcagcagctacctacgcaagtggtgatcatcaccgcccatggcagcgtggacaccgccgtggaagctacccgtttgggtgcttttgattatctagaaaaacccttctcagccaaccgcttgctggtcaccatgggcaatgccctgcgccagaaaaatttatccctggaggtacaagcctaccgggatagttttgaccgggaccactaccacggttttattggggcatcccctaccatgcaagcgctctatcaaaccatcgagagtgcggcacccagctcggccaccatctttattaccggagagtccggtaccggcaaggaggtgtgcgccgaggccattcacaaggcctcgacccgccgcaaccgtccctttattcccgtcaactgcgccgccatacccaaagatttgatggaaagcgagctgtttggccatgtcaaaggctcctttaccggggcactctcggaccgacagggtgccgcccaacgcgcccaccatggcacactatttttagatgagatcggtgaactgcccctggatctacaaagtaagctgttgcggtttttacagaccggtcaggtgcaaaaggtcggtgcgcaaaagggtgaggtggtggatgtgcgcattctatgtgccaccaatcgagacccctgggaagaggttcaggaggggcgttttcgcgaggacctctactaccgccttaatgtgatccccctccacctacccccgctacgcaagcgggatcaggatgtgctattactggcccatcatctgttgcaacagtacagccgtgaggagaaaaagggctttacccgctttagtggtgaggctgaacaactcatcttagggcaccgttggccgggcaatgtgcgggagctgcaaaatgtcattcgccatgcggtggtgctcaatgatggcacactgctcgaagcggctatgctgccgccaccggtcgggggcagcatggggaggcacatgacggtgcccccccaaaacaagatgctcctgcaagagggcgctaccgatgatgagatcctgcccttgtgggtcgaggagaaacgcatcatcgagcgggccttaaaacagtgtggggataatattccccaggccgccgcccgcttgcagattaatccttctaccatctaccgcaaaaagcagttatggaaaagccgtgaggaggaagcgtag

SEQ ID NO: 44120 - protein, 469 aa, Magnetococcus sp. MC-1
MKARDLHSLLLVEDSPSMAMVYQEYIKGEPQWQVSHCKEGHAALVYLHQHTPDLVLLDLQLPDMHGLEILKAIHEQQLPTQVVIITAHGSVDTAVEATRLGAFDYLEKPFSANRLLVTMGNALRQKNLSLEVQAYRDSFDRDHYHGFIGASPTMQALYQTIESAAPSSATIFITGESGTGKEVCAEAIHKASTRRNRPFIPVNCAAIPKDLMESELFGHVKGSFTGALSDRQGAAQRAHHGTLFLDEIGELPLDLQSKLLRFLQTGQVQKVGAQKGEVVDVRILCATNRDPWEEVQEGRFREDLYYRLNVIPLHLPPLRKRDQDVLLLAHHLLQQYSREEKKGFTRFSGEAEQLILGHRWPGNVRELQNVIRHAVVLNDGTLLEAAMLPPPVGGSMGRHMTVPPQNKMLLQEGATDDEILPLWVEEKRIIERALKQCGDNIPQAAARLQINPSTIYRKKQLWKSREEEA

SEQ ID NO: 44121 - DNA, 1515 bp, Magnetococcus sp. MC-1
  CDS (1)..(1515)
atgcagcaggaggccgaacagaccattttggtcgcggatgatgatcaagccgtgcgctttgtgctggaacaggcgttgagccgggccggctacaaggtacacgcttttggcaatacccaacccttggtcaaccattttaaccaatatgggggggatcttatcatcaccgatgtggtgatgcccggcggctcgggactggatatggtgcaaagcttaaaagccacttatcctgacctgcccattattgtgatgacggcccaatccactctccgcaatgcggtacaagcctttgagcggggggcttttgagtatctggccaagccctttgacatcaatcggctggtggatttaacccgacgtgccctgcaaaaacaggaagaacgcgtccgcaatcaaccccaaaccaaaaccaaacagcaggccgccgccgaggatatggatcgccagttggaggagcgctttggcggtatcattggttcatcccgggcgatgcaggcgctgtttcacaccattggccgtctttcgaattcggagatgacggtgctcattcatggtgaatcgggcaccggtaaagagctggtagcccgtgccgtgcatgcctacagcccccgccgccgtggcccttttactgccattaacatggccgctatcccccgggatttgattgagtcggaactgtttggtcacgaaaagggggcctttaccggtgcggtctcccgtcgtcctggacattttcaaaaggccgagggcggtaccctgtttctggatgagattggggatatgcccatggaggcccaaacccggctgttgcgggttctgcaagagggcacctttaccttggtgggcagcaccgacattttgcgcagtgatgtccgtattattgccgccacccatcaggatctgcccaccgccatttccgaaggtcgctttcgcgaggatcttttctaccggcttaatgtgatccccctgcatgtgcccaccctgcgttcccgtaaagaggatattccggttctttcgcaatattttttggcgaaaacctcgaaagagctgaaggttgccaccaaacgcctcacccaatctgccatggaaaagttggtggcctatgactggcccggcaacgtccgggagctggaaaacctgattcgccgccttacggtgttgattccagaggatgagattcgccctgaaaagatcgaactctatgagcgcaccatgcccaagttggccagaaatgatctatctggccatgaaccccaagaggagcgctccaccgagagcaacaccagccatagctacgaagcgattttattacaggatctggatacattctttgccaccatgggaggattggagaccagcggtgtgtatgatatggttttacgcaagatggaggcggtattgatcccccgggtgttgcggcaaacccgtggcaaccgggtcaaggcggcgcaaattctaggcataaaccgtaacaccttacgaaaaaaaatgcgggatttggggatggatgattaa

SEQ ID NO: 44122 - protein, 504 aa, Magnetococcus sp. MC-1
MQQEAEQTILVADDDQAVRFVLEQALSRAGYKVHAFGNTQPLVNHFNQYGGDLIITDVVMPGGSGLDMVQSLKATYPDLPIIVMTAQSTLRNAVQAFERGAFEYLAKPFDINRLVDLTRRALQKQEERVRNQPQTKTKQQAAAEDMDRQLEERFGGIIGSSRAMQALFHTIGRLSNSEMTVLIHGESGTGKELVARAVHAYSPRRRGPFTAINMAAIPRDLIESELFGHEKGAFTGAVSRRPGHFQKAEGGTLFLDEIGDMPMEAQTRLLRVLQEGTFTLVGSTDILRSDVRIIAATHQDLPTAISEGRFREDLFYRLNVIPLHVPTLRSRKEDIPVLSQYFLAKTSKELKVATKRLTQSAMEKLVAYDWPGNVRELENLIRRLTVLIPEDEIRPEKIELYERTMPKLARNDLSGHEPQEERSTESNTSHSYEAILLQDLDTFFATMGGLETSGVYDMVLRKMEAVLIPRVLRQTRGNRVKAAQILGINRNTLRKKMRDLGMDD

SEQ ID NO: 44123 - DNA, 1527 bp, Geobacter metallireducens GS-15
  CDS (1)..(1527)
atgtcacagatcaaggtattgattatcgatgacgaggcggatgtctgcacctttttccgccgcctgctgaccagaaaagggtatgacgtcgtcacggcgtcaaaggagcctgaggcgatgcgggccatcgaagagcaccgcttcaccgtggccatggtggatctgaagctgccggataccgacggcctgaccctccttcaggcgatcaaggcccggcagcccgcctgcgaagtcatcatcatgaccggctacagcaccatcaagacggcagtcgcggccatgcagctgggggcctacgagtacctggaaaagcccttcgacgacatcgacgaaatcgaggccctgatcgagaaggccgccagccacgggttcaacctccagcaggggagcgccgccgccgaggagtgggccgaggtggcccgggccgtcggtttccaggtgggggcatccttgggcatgaggcggctcgtatccgtggcccacaagatcgccggcaagaatgtcaccgtgctgatccaggggagcaccggcaccgggaaagaggtcctggcccgctttatccattccgcatcgggacgggcggatcaggcgttcatcccggtcaactgcggcgccctgccggagaacctcctggaaagcgagctcttcggccacgagaaaggggccttcaccggcgcggcccagccccgtcgcggcatcttcgaactggccaaccgcggcaccctgttcctcgatgaaatcggcgatgccagcccgcaaatccaggtgaaactgctgcgggtgctggaaaccggcgaattcatgcgggtagggggtgaaaaacccatcaagaccgacgtgagggtgatcgccgccaccaacgtggacctggagcaggccatccgggagaagacgttccgcgaggacctctactaccggctcaacgtggtccggctcgaaatcccgccgctccgctcccgttccgaggacatcccccagctggcggagcactttgtccgtcagctcaacgcagcgctgcggatttcacccccggcgctgcgccttctgcaggggtacggatggccgggcaatatccgccagcttgccaacgtcatccggcgcgccgtggtcatgtgcagcggtgacaccatcctccccgagcatctcgaaagcacccttctgaacagcgcagccttggccggcgacaccttttcccccgtgtcctcgcaggccggggagggggctgtctccctctccccggagcggctctggcgaaccgacgtcagcgtagaggagttgcggaagctgggtgccgatgagctgaagcggatgctcgattccctgcgggcactggaggggaggctgatcacagccatgggagaagggggcggggctgcgcggcggtgtctcaaggataccgaggaggaaaccatcaggcaggcactggaacagtaccggtggaacatcaccgagacggcgaaggtcctgggcatcggcaggaacaccctctaccgcaagatcaagcagtacgggctggggagttcctga

SEQ ID NO: 44124 - protein, 508 aa, Geobacter metallireducens GS-15
MSQIKVLIIDDEADVCTFFRRLLTRKGYDVVTASKEPEAMRAIEEHRFTVAMVDLKLPDTDGLTLLQAIKARQPACEVIIMTGYSTIKTAVAAMQLGAYEYLEKPFDDIDEIEALIEKAASHGFNLQQGSAAAEEWAEVARAVGFQVGASLGMRRLVSVAHKIAGKNVTVLIQGSTGTGKEVLARFIHSASGRADQAFIPVNCGALPENLLESELFGHEKGAFTGAAQPRRGIFELANRGTLFLDEIGDASPQIQVKLLRVLETGEFMRVGGEKPIKTDVRVIAATNVDLEQAIREKTFREDLYYRLNVVRLEIPPLRSRSEDIPQLAEHFVRQLNAALRISPPALRLLQGYGWPGNIRQLANVIRRAVVMCSGDTILPEHLESTLLNSAALAGDTFSPVSSQAGEGAVSLSPERLWRTDVSVEELRKLGADELKRMLDSLRALEGRLITAMGEGGGAARRCLKDTEEETIRQALEQYRWNITETAKVLGIGRNTLYRKIKQYGLGSS

SEQ ID NO: 44125 - DNA, 1389 bp, Geobacter metallireducens GS-15
  CDS (1)..(1389)
atgaaagcacgcattctcatttgcgacgacgaggaagggatcaggcgctacctccagaagatgttcctggccaaggagtacgatgtggaaacctttgccgacggaacgagccttctggcacgtattgaggggggaacggagggtgatgccgacatcctccttcaggacgtgcggatgccggacatggacgggatcgaggtgctgaagcgggtgaagaagctccggccggccatgccggtggtggtgatgaccgccttcggcaccatcgacgcggccgtggaggcgatcaagctgggggcctacgactacgtcaccaagccgttccccaaggagaagatcctcggcctcatggagaacgccctccaactggacctcctcatgaaggagaaccgggtgctgaaggaggagctctcccgccccgacatccccgacaacatcgtcttcaccagcgcgaagttccgggaggtctacgacctcacggtccaggtggccggcagcgacgccaacatcctggtcctcggcgaatcgggtaccggcaaggagcttatcgcgggcgcgatccacgtgaacagccagcgcaaggggcggcgctttctctccatcaactgtgcggccctgtctgacacgctcctggagagccagctcttcggccacgtgcgcggtgccttcaccggcgccatcaccacccagaaggggctcctggaggaggccgacggcggcaccctcttcctggacgagatcggcgatgtctccgccgcggttcaggcgaagctgctgcgggtcatccaggagcgggagttcatccccgtgggggccaccaagcccaagagcgtcgacatccgcttcgtggccgccaccaacaaggatctggccaaggaggtcgcggccggacgattccgggaggacctctactaccggctcaacgtcatcaccatcgccctcccccctctgcgggagcggcgcgaggacatcgagcccctggccatgcacttccttgccaagtatgcccgccgcatccggaagaatatccgcgggttcacgcccgaggcgctccagtccctccaggggtaccgctggcccggcaacgtgcgggagctggaaaacgtcgtcgagcgggccgccatcctcacccggggcgacctggtcactcccgaagtcctccccatccgcccccgggaggatgcgccacttctccggccggacaacctgctcgtttccctggaggagatggagcgggagcacatcgagcgggtcttgcgccagacaggcttccacaagagccgcacggcggagatcctcggcatctcccgcaagaccctcgaccgcaagatcgtggagtatgccctcgccatccccggccaagggatctccggaaccctggacgactga

SEQ ID NO: 44126 - protein, 462 aa, Geobacter metallireducens GS-15
MKARILICDDEEGIRRYLQKMFLAKEYDVETFADGTSLLARIEGGTEGDADILLQDVRMPDMDGIEVLKRVKKLRPAMPVVVMTAFGTIDAAVEAIKLGAYDYVTKPFPKEKILGLMENALQLDLLMKENRVLKEELSRPDIPDNIVFTSAKFREVYDLTVQVAGSDANILVLGESGTGKELIAGAIHVNSQRKGRRFLSINCAALSDTLLESQLFGHVRGAFTGAITTQKGLLEEADGGTLFLDEIGDVSAAVQAKLLRVIQEREFIPVGATKPKSVDIRFVAATNKDLAKEVAAGRFREDLYYRLNVITIALPPLRERREDIEPLAMHFLAKYARRIRKNIRGFTPEALQSLQGYRWPGNVRELENVVERAAILTRGDLVTPEVLPIRPREDAPLLRPDNLLVSLEEMEREHIERVLRQTGFHKSRTAEILGISRKTLDRKIVEYALAIPGQGISGTLDD

SEQ ID NO: 44127 - DNA, 1383 bp, Geobacter metallireducens GS-15
  CDS (1)..(1383)
atgtccgaaaacaagcgcatcatgctcatcgacaacgaggaggggctctgccggatgatggaggcggtgcttctggatagcggctatggcgtgaaggggtacacccgctccttcgaggcggtggaggagtttcggcccggcgactgggatctggtggtctcggacatcaagatgccggggatggatggtctggaggtgctccagcggatcaaggccaaggagccggccattccggtcatcatgatcaccgcctacgccacggtggagatgtcgatccaggccctgcgccggggcgcctacgacatgctgaccaagcccttcgagcccgaggagctcctctaccgggtgaaaaacgccctcaagcacaccgagcttctggaagagaaccgggagctgcgcgagaagctggtgggtaagttccgcttcgacaacataatcggcgcctcggacgggctcaagggggttttggagaaggtggagaaaatcgccatccgggacacgtcggtgctcatcaccggcgagtcggggaccggcaaggagctcatcgcccaggcgatccactacaactcggtccgcaaggaaaagaagttcgttgccatcaactgcggtgccctgccggagacgctcctggagagcgagctcttcggctaccgcaagggggccttcactggcgccaaggaaaaccgccagggacttctggaggcggccgacgggggaaccctgtttctggacgaggtggggaacctccccatgaacgtgcagaagacgcttctccgtttcctccaggagcaggagtttctccgcattggcgacaccacccccaccaaggtggacgtgcggatcatctcggccaccaacgccgacctgcgggaaggggtcaagagcggcgccttccgggaggacctctactaccgcctcaacgtggtgaacctccatctcccgccgctgcgggagcgcaagggggatatcccgctcctggcggcccatttcattgcccagcagaacaagaaattcgacaccgcaatcaaggggttgtcacccgactccctggaagcggccgttggctatgcctggcccggcaacatccgccagctcaggaacgtgatcgaggcctgcacagccatggagagcggcgaatacattacgctgtcggtcctctcccagttcatcgagcttcccgagccacgggacgagccggccgtggaggcggaaggggaggagggtgcctacgcccaggccctttcccgcttcgagatggactacatccggggactgttgcggaaaaaccgtggcaatgtggaggcagccgcccgtgaggcggggatgaacatggccaccatctaccggaaaatgaagaagtacaacctgcgccgcgaagaatag

SEQ ID NO: 44128 - protein, 460 aa, Geobacter metallireducens GS-15
MSENKRIMLIDNEEGLCRMMEAVLLDSGYGVKGYTRSFEAVEEFRPGDWDLVVSDIKMPGMDGLEVLQRIKAKEPAIPVIMITAYATVEMSIQALRRGAYDMLTKPFEPEELLYRVKNALKHTELLEENRELREKLVGKFRFDNIIGASDGLKGVLEKVEKIAIRDTSVLITGESGTGKELIAQAIHYNSVRKEKKFVAINCGALPETLLESELFGYRKGAFTGAKENRQGLLEAADGGTLFLDEVGNLPMNVQKTLLRFLQEQEFLRIGDTTPTKVDVRIISATNADLREGVKSGAFREDLYYRLNVVNLHLPPLRERKGDIPLLAAHFIAQQNKKFDTAIKGLSPDSLEAAVGYAWPGNIRQLRNVIEACTAMESGEYITLSVLSQFIELPEPRDEPAVEAEGEEGAYAQALSRFEMDYIRGLLRKNRGNVEAAAREAGMNMATIYRKMKKYNLRREE

SEQ ID NO: 44129 - DNA, 1413 bp, Geobacter metallireducens GS-15
  CDS (1)..(1413)
atggaaaacattgatgttcttgtggtggacgatgaagcggttattcgcgagggactgcggcgcatcctggagaaggagggattccatgtggagacctcggccagcgggcagattgccctcgaacggatgcaggaggaaaacttcagtcttgtgattaccgacctgaagatgcccggcatgagcggcatggaggttctcaaggcaatcaaggttctgcagccggaagttccggttatcatcattaccggcttctcaaccgtcgacaccgctgtggaggccatgaagaacggtgccttcgactacatcgccaaaccctttacccccgagcagattacggagaaagtgaggaaagctctcgatcagcgtgcagtcctgattgagaacatctttctgaagaaggagctgggagagcaccacggcttcgatctcttcgtgggggagagcaaggaaatccagaaggtctaccggcgcatcatccaggttgcccccaccgacagcaccgttctcatcaccggcgagagcggtaccgggaaggagctggttgcccgggccatccacaaccacagcaaccgccgcgaaaatccctttgttgccgtcgactgtacgtccctggccgagaacctcctggaaagcgaattgttcggccacgtgaaaggatcgttcaccggtgcgatccagacgaaaaccggactcttcaaggtggctgacggcggcaccctcttcttggacgagatatccaacataagcctcaccacccaggcgaagctcctgcgggttcttcaggagcgggagatcacccccatcggcggcacccagccggtccccatcgacatccgcctcgtggctgccaccaacaagaacctccggaccctggtcccccaggggaccttccgggaagacctcttcttccgcctgaacattattcccatagaccttcctcccctgcgtgagcgcaagggggatctgccgctcctcatcgccttcttcctcaagaagttttccgaggagatggggcgggaaatccggggactggcgcctgacgccatggcactcctggaggattacacgtttcccggcaacgtacgggagttggagaacatcatcgagcgggccgtggtccttgccgaggaggatttgatccagaaggaagatctggaactgcgtctctccggaagcgaggggaccggagttgcggcctatgtcccccagaacgtcgaggagttgaaggagaccaagcggcagattcgggagcgagccgtggaacccatcgaaaaggcctttgtcctccaggccctcaaacgcaacaactggaacattacccgggctgctgaggaaacgggtatgcttcggcccaacttccaggcgttgcttaaaaaactgcggatctcagtgcgaagtcagatgaacaattga

SEQ ID NO: 44130 - protein, 470 aa, Geobacter metallireducens GS-15
MENIDVLVVDDEAVIREGLRRILEKEGFHVETSASGQIALERMQEENFSLVITDLKMPGMSGMEVLKAIKVLQPEVPVIIITGFSTVDTAVEAMKNGAFDYIAKPFTPEQITEKVRKALDQRAVLIENIFLKKELGEHHGFDLFVGESKEIQKVYRRIIQVAPTDSTVLITGESGTGKELVARAIHNHSNRRENPFVAVDCTSLAENLLESELFGHVKGSFTGAIQTKTGLFKVADGGTLFLDEISNISLTTQAKLLRVLQEREITPIGGTQPVPIDIRLVAATNKNLRTLVPQGTFREDLFFRLNIIPIDLPPLRERKGDLPLLIAFFLKKFSEEMGREIRGLAPDAMALLEDYTFPGNVRELENIIERAVVLAEEDLIQKEDLELRLSGSEGTGVAAYVPQNVEELKETKRQIRERAVEPIEKAFVLQALKRNNWNITRAAEETGMLRPNFQALLKKLRISVRSQMNN

SEQ ID NO: 44131 - DNA, 1341 bp, Geobacter metallireducens GS-15
  CDS (1)..(1341)
atgagaacaatcctggtcgccgatgacgacagagccatccgtcggaccctggagctgcaccttgccgagacggggtatacggttctcaccgctgccaccggcaacgaagcggtcgacctggccctggcgcgggacgtgggcctggtgctcctcgatctgcggctgaccggcatggacggtttcgaggtgctgaccctgatcaaggaaagaaagccggccctgccggttatcatgatcaccgcctacgacgacatgcagaccgccatcgaggcaatccgcctcggggccatcgaccacctgggcaagcccctcgatctcgatcagctcgaccagattatcgacaagatattcgagatgagtgccctttcccggaccggcgtcgccttccgcgactctatcgatgccccctttgagcagaacatcatggtgggccgctcccgggccatgaaggaggtttacaaaaccatcggcgccattgccgacttccgggccacggtcctgatccagggggagagcggcaccggcaaggaaatggttgcccgtgccatccatttcaacagcaagttccgcaaccgtccgttcatcgccgtggcctgctccgccctctcgccgacggtcctcgaaagcgagctgttcggccatgagaagggggcgttcaccggggcgtatcgaaccaaaccggggaagttcgagctggcccagggggggaccctgttccttgatgagatatcggagatcagtcccgagttgcaggtgaaactgctccgctttatccaggagcgggagttcgagcgggtagggggaatcgagaccatcaaggccgatgtgcgcattgtggccgccaccaacaagaatctcctcacgctggtcaacagcggcattttccgccacgacctgtactaccgcctgaaagtggtctccatcgatctccctcccctcagggaacgcagggacgacattcccatcctggtgaaattcctgctggaaaagcttcaccatgagaccgggaagcgggtggatatcatcccccaggagaccatgaatgccatcctggcccatccgtgggcgggcaacgtccgggagctggagaacacgctgcggcgcgccgtcctcctttcgcacggctcggtgctgtcgcccgaatccctgcacctggaagaggaaagcgagagcgacagctttcccctggtgctcaggccgctccatgaggtcgagcgggaacatatccagaatgtccttgcctttacccacaacgagaagaagagggcggcggaaatcctcggcatttcccggccgaccctcgaccgccgcatcaaggagtatggtctggaagattcgtag

SEQ ID NO: 44132 - protein, 446 aa, Geobacter metallireducens GS-15
MRTILVADDDRAIRRTLELHLAETGYTVLTAATGNEAVDLALARDVGLVLLDLRLTGMDGFEVLTLIKERKPALPVIMITAYDDMQTAIEAIRLGAIDHLGKPLDLDQLDQIIDKIFEMSALSRTGVAFRDSIDAPFEQNIMVGRSRAMKEVYKTIGAIADFRATVLIQGESGTGKEMVARAIHFNSKFRNRPFIAVACSALSPTVLESELFGHEKGAFTGAYRTKPGKFELAQGGTLFLDEISEISPELQVKLLRFIQEREFERVGGIETIKADVRIVAATNKNLLTLVNSGIFRHDLYYRLKVVSIDLPPLRERRDDIPILVKFLLEKLHHETGKRVDIIPQETMNAILAHPWAGNVRELENTLRRAVLLSHGSVLSPESLHLEEESESDSFPLVLRPLHEVEREHIQNVLAFTHNEKKRAAEILGISRPTLDRRIKEYGLEDS

SEQ ID NO: 44133 - DNA, 1386 bp, Geobacter metallireducens GS-15
  CDS (1)..(1386)
atggcaaatggcgagaagaaaaccgtgcgggtgctgatcgttgacgatgatgtgtcgctgcgccgggtgctcgagtataatctccaggaggaggggtacgaagtgctcaccgccggcagcggcgaggaggggcttcgcctcttcgaggatggcgcgccgaccctcgtggtgaccgacctgaagatgcccggcatgggtggatttcagctcctcagggaggtgaaggagcgcttccccgacacggtcgtcatcgtcatcaccgccttcggcgcggtggaagcggcggtggaggccatgaaggccggggcctacgacttcattaccaagcctttcaatcgggaggcattgaagctgacggttcgcaaggccctggacatgcaggggctttcccgggagaaccggcgcctcagggaggagctttccgaacgggaggagttccgcagcatcatcggcatttcccctcccatggaggaggtcttccgtgtcatcgaccgggtggccgataccgacgcaaccgttctcatcaccggtgagtcggggaccggcaaggaactggtggcccgggccattcacaaccggagctcgcggcgcgccgcacccttcgtcgccatcaactgcgccgccatcccccgcgatctccttgagagtgagctcttcggccacgtgaagggggccttcaccggggcagtgcaggacaaggagggtaagttccggcaggccgaggcgggaacccttttcctcgacgaggtgggggaactgccggtggagctccagtcgaaacttctgcgcgcgctccaggaaaaggaagtgcagccggtcgggggggctcacaccatcaagctcgacgtgcgggtggtggcagccaccaacgccgacctggaggaagccatcgcggaagggcgcttccgggaggatctcttctaccgcctttcggttattcccgtccacctcccccccttgagggagcggaaggaggatatcccgctgctcgtgcgccattttgccgccaaacacggcggggcctccgtcactttttctcccgagatcctggcagtcatggccgcctacggctggcccggcaacgtgcgggaactggagaacaccgtggagcggatcctcatcatgcgcaacgccgacacgatccaccccgacgatcttcccgagaaggtgcggcgtgggcgctctccccagagggaatgccgggtcatcaacctccccgacgaggggtattccctagagcaactcgaacgggagatcgtcgtcgaggccctggagcgcaacaactggaaccagagttcggcggcgcgctttctgcgcataccgcgtcataccctcatctaccgcatggagaaatactccatcacaacgccggagagaaaaaaatga

SEQ ID NO: 44134 - protein, 461 aa, Geobacter metallireducens GS-15
MANGEKKTVRVLIVDDDVSLRRVLEYNLQEEGYEVLTAGSGEEGLRLFEDGAPTLVVTDLKMPGMGGFQLLREVKERFPDTVVIVITAFGAVEAAVEAMKAGAYDFITKPFNREALKLTVRKALDMQGLSRENRRLREELSEREEFRSIIGISPPMEEVFRVIDRVADTDATVLITGESGTGKELVARAIHNRSSRRAAPFVAINCAAIPRDLLESELFGHVKGAFTGAVQDKEGKFRQAEAGTLFLDEVGELPVELQSKLLRALQEKEVQPVGGAHTIKLDVRVVAATNADLEEAIAEGRFREDLFYRLSVIPVHLPPLRERKEDIPLLVRHFAAKHGGASVTFSPEILAVMAAYGWPGNVRELENTVERILIMRNADTIHPDDLPEKVRRGRSPQRECRVINLPDEGYSLEQLEREIVVEALERNNWNQSSAARFLRIPRHTLIYRMEKYSITTPERKK

SEQ ID NO: 44135 - DNA, 1395 bp, Geobacter metallireducens GS-15
  CDS (1)..(1395)
atggatacgccgcgactgctcattgccgacgacgacaaaaaaacccgagactttgtagccgcttttctcaagtacaaagggtacgacgtggtccaggcctgtgacggtcaggacgccctcgacaagctggaaaccgaagaggttcaccttgtcatcaccgacctgatgatgccccgggtgaacggcctcgaattcgtcaagaagctgaagaccatgcgtccgggcaccgtcatcattgcctacagcgccttcggcaactacgaaatggcctccaacctcctcaaggcaggggtctttttctatctggaaaagcccttcaatctggacgagcttgaaacgcacgtgaagcgcgggttcgagcaccagtccctccagagccagacctaccgggccaagccggccctcaagaaccgggccctcatgccgaatatcatcggcgagagctccaagatgctctccctcttcgagctgatcgaaaaggttgccgagtccgattccaccgtcctcattcagggtgagtcggggaccggcaaggaactggtcgcccgggcggtccatgacctgagcaatcgcaagactcgcaacttcgtgccggtcaactgcgccgccatccccgacgagctccttgaaagcgagctcttcggccacgtgaaaggttccttcaccggcgccgtggcgaaccgcatcggccgtttcgagatggccgaccgcggcaccctgtttctcgacgaaatcggcgacatgaaaccgaacctccaggtgaagctcttgcgggtgctgcagaaccgcgagctggagccggtgggtgccacccgctccaagaagatcgacgtgcggatcattgccgccaccaaccagaacctggaaaagctggtcgccacgaaacagttccgcgaagacctctactaccggctctctgtcattcccatcttcattccgcccctgcgggagcgcaaggaagatatcccgctcctggtcaactctttccttgagcgtttcaaccgcaacaagaagagcaaggtgaaggggatcgactccgacgccatggaccttctcgtccactacgactggcccggcaacgtgcgcgaactggagaacctcgtggagcgcctcgtgatcctcaaggggttcggcgccattggtgtcaatgatctgcccgaaaagttctccggcgtcaccatttcccccccttccgaaagcatgacccttcccgattcgggcatctgcctcaataccgtggtggaggagttcgaaaacaacctcatcctccaggccctcaagaagaccggcggcaacaagaaggaggccgctcttcttctgaacctcaagcgaaccaccctcatcgagaaattaaaaaagcggagactcgatacaattgccacgtcttttgcataa

SEQ ID NO: 44136 - protein, 464 aa, Geobacter metallireducens GS-15
MDTPRLLIADDDKKTRDFVAAFLKYKGYDVVQACDGQDALDKLETEEVHLVITDLMMPRVNGLEFVKKLKTMRPGTVIIAYSAFGNYEMASNLLKAGVFFYLEKPFNLDELETHVKRGFEHQSLQSQTYRAKPALKNRALMPNIIGESSKMLSLFELIEKVAESDSTVLIQGESGTGKELVARAVHDLSNRKTRNFVPVNCAAIPDELLESELFGHVKGSFTGAVANRIGRFEMADRGTLFLDEIGDMKPNLQVKLLRVLQNRELEPVGATRSKKIDVRIIAATNQNLEKLVATKQFREDLYYRLSVIPIFIPPLRERKEDIPLLVNSFLERFNRNKKSKVKGIDSDAMDLLVHYDWPGNVRELENLVERLVILKGFGAIGVNDLPEKFSGVTISPPSESMTLPDSGICLNTVVEEFENNLILQALKKTGGNKKEAALLLNLKRTTLIEKLKKRRLDTIATSFA

SEQ ID NO: 44137 - DNA, 1365 bp, Geobacter metallireducens GS-15
  CDS (1)..(1365)
atgaaacaacgggtgctggtcatcgacgacgaggagaacctgcggcacatgcttggggccatgcttcgcaagaacggctaccatgccgacgaggcggcggacggtgagcaggccctcgccatggcgggggagcatccctatgactttatcatctgcgatatccggatgccggtcctggatgggctcggtttcctccgcagggcccaggaggcggggataggtggcaccatcatcatgatgtccgcctatggcaccatcgatacggcgctccagtgcatgaaggagggggcctacgactacgtttccaagcccttcaaaaacgacgagatcctgctggtgctcaagaaggccgaggagcgggagcggctcaaaacggaaaactgccggctgcgggctgaggttgcccgggagtactccttcggcgccatcgtgagccgcaatcctcggatgcgggagattttcgagctcatccgcaaggtctgcgacgtgaagacttcggtcctcgtcctgggcgaatcgggcaccggcaaggaactggtggcccgggccattcaccacaacgggagccgccgggatgctccctttgtggcggtaaactgcggcgccatccccgagcaccttctggaatcggagctcttcggccacgtgcggggcgccttcaccgacgccgcctccgaccggaccgggctcttcgaggaggcccacggcggcacccttttcctggacgaaattggcgagatgcccccctcgctccaggtgaagctgttgcgggtcctccaggagggggaggtgcggcgcgtgggggccgagcgcctctcaaaggtcgacgtgcgggttatctcggccacatcccgggatctggagcgggaggtggccgaggggcacttccgcgaggatctcttcttccgtcttaacgtcgtcagcatcacccttccccccctgcgggagcggctggaggacgtgccgctcctcgcgggccattttcttaataaacacggcacttcccttgggaggccgggagcgcgggtgtctcccgaggcgttgcggctcctttccgcgtacgcatggcccggcaacgtgcgggagttggagaactgcattgagcgggccctcatcctgggagacggtgatgttgtcggccccggggcgctcccggacgggctgcggggaggtggcgcggggtgggctatggtgggcccggacaacgacaatctctccatcaaaaaggccgaggagcggcttgagcgggagttcatacgccgcgccctcgaaaagaccggcggcaaccgcacccacgcggcccggatcctggaaatcagccaccgtgctttgctctacaaactgaaagagtatgatatggaataa

SEQ ID NO: 44138 - protein, 454 aa, Geobacter metallireducens GS-15
MKQRVLVIDDEENLRHMLGAMLRKNGYHADEAADGEQALAMAGEHPYDFIICDIRMPVLDGLGFLRRAQEAGIGGTIIMMSAYGTIDTALQCMKEGAYDYVSKPFKNDEILLVLKKAEERERLKTENCRLRAEVAREYSFGAIVSRNPRMREIFELIRKVCDVKTSVLVLGESGTGKELVARAIHHNGSRRDAPFVAVNCGAIPEHLLESELFGHVRGAFTDAASDRTGLFEEAHGGTLFLDEIGEMPPSLQVKLLRVLQEGEVRRVGAERLSKVDVRVISATSRDLEREVAEGHFREDLFFRLNVVSITLPPLRERLEDVPLLAGHFLNKHGTSLGRPGARVSPEALRLLSAYAWPGNVRELENCIERALILGDGDVVGPGALPDGLRGGGAGWAMVGPDNDNLSIKKAEERLEREFIRRALEKTGGNRTHAARILEISHRALLYKLKEYDME

SEQ ID NO: 44139 - DNA, 1338 bp, Geobacter metallireducens GS-15
  CDS (1)..(1338)
atgcgggaattcctcgccattctcctcaaacgcgaggggtacgcggtggatcaggccgattgcgcggaaaaggccctggagttccttgactcaattacctacgatctggtcatttccgatgtgaaaatgcccggtctggacggcattgccctgctggggcggatcaaggaaaactctcccgacaccgcggtcctcatgatgaccgccttctccaccgccgagcaggccgtggaggccatgaagctgggggcctacgactacatcgccaagcccttcaaggtggaggaggtgaaggtcctcgtccgtaacgcccttgagaagcgggacctgaagcgggaaaaccagcgtctgcgccaggaggtccaggagcggtacggcttcagcggcttgatcggcaagagcaagaagatgcgggaactctactccctcatcgagcgggtggcccccagcatcgccaacgtcctgattctgggtgagagtggcaccggcaaggaactggtggcacgggccatccactacaacagcccccgcaaggacaaggccttcgtggcggtgaactgcggcgccattcccgaaacactcatggagagcgaactcttcggccacaagaagggctccttcaccggcgccatcaacgaccgggccggcctcttcgagcaggccggcggcggcaccctcttcctcgacgagatcggcgaagtgccgctccaacttcaggcaaagctcctgcgggtcctccaggaaaaggagttcaggcgggtagggggagtagccgaccagaaggccgacgtgcggatcgttgccgcctccaaccgcaacctggaagagcaggtgcgggaaggctccttccgggaagacctcttctaccggctgaacgtggtccagctccagatgcctcccctgcgggagcggacagaagacatccccctgctggtggagcatttttaccgcaagtacgttcagtccaaccgcaacggagagattatcacccctggcgccctgaagattctcatgtcatatccgtttccgggaaatgtgcgcgaactggagaacctggtggaacggtgcatggttcttggcggggggaccatttccgaggagagccttccgccccaggtccgggggagccagaagtccgcgacggccccggtcggtgatttcgagattccttccgaagggatggacctggaagggtacctggacggcatcgagaagaggatcctcctccaggccctggagcggtgcggcggggtcaagaagaaagcagccgagcttctggggctcacgttccggtcattccgctaccgtctggccaagttcgggatggatgaggaatga

SEQ ID NO: 44140 - protein, 445 aa, Geobacter metallireducens GS-15
MREFLAILLKREGYAVDQADCAEKALEFLDSITYDLVISDVKMPGLDGIALLGRIKENSPDTAVLMMTAFSTAEQAVEAMKLGAYDYIAKPFKVEEVKVLVRNALEKRDLKRENQRLRQEVQERYGFSGLIGKSKKMRELYSLIERVAPSIANVLILGESGTGKELVARAIHYNSPRKDKAFVAVNCGAIPETLMESELFGHKKGSFTGAINDRAGLFEQAGGGTLFLDEIGEVPLQLQAKLLRVLQEKEFRRVGGVADQKADVRIVAASNRNLEEQVREGSFREDLFYRLNVVQLQMPPLRERTEDIPLLVEHFYRKYVQSNRNGEIITPGALKILMSYPFPGNVRELENLVERCMVLGGGTISEESLPPQVRGSQKSATAPVGDFEIPSEGMDLEGYLDGIEKRILLQALERCGGVKKKAAELLGLTFRSFRYRLAKFGMDEE

SEQ ID NO: 44141 - DNA, 1365 bp, Geobacter metallireducens GS-15
  CDS (1)..(1365)
atgaacgaaacaatactcgtcgtcgatgacgaacagaacatccgcacggccctggccggcatcctcgaagacgagggataccgccccgtcttcgccaaggacggcctggaagccctcgacatggccaagaaggagaaccccgacctggtgctcctcgacatctggatgccgcggcttgacggcctggagacccttcaggccctcaaggagttccaccccctcctgaccgtagtgatgatgtcgggccacggcaccatcgaaacggcggtgaagtccacgaagctcggggcctatgacttcatcgagaaacccctctccctggaaaaggttctcgtcaccgtaaaaaacggcctcgacgtggggcgcctcaaggccgagaacgacaccctgcgcaccgtggctttcaagggacacgacatggtggggaacaccccggccattctccagctccaggagcaggtgaggcgcgtggcggccaccaacgcctcggtgctcatcaccggcgagaacggcaccggcaaggagctggtggcccgggccatccaccactggagcccccgcaaggagaagccctttgtggagatcaactgcgccgccctccccgaggagctcatcgaaagcgagcttttcggccacgaaaaaggagccttcaccggcgccgtggcccagaagaaggggaaattcgacctggccgacggcggcaccatcttcctggacgagatcggcgacatgtccctgaagacccaggccaaggtgctccgcatcctccaggagcggaaattcgagcgggtgggagggacaaagaccatcgaggtggatgtgcgggtggtggcggccaccaacaaggacctccccggcgagatccgcggcggcaccttccgcgaagacctcttctatcgcctcaacgtggtccccttcacggtgccgccgctcagggagcggcgggatgacatcccgctcctggtggagcatttcctcgccatcttcgcccagcgggagggacaggagcgcaagaagatgctcccggagacggtggaactcctcaaggggtacgactggcccggcaacgtgcgggagctgcgcaacatcatcgagcggctcgtcatcatgacgccgggaaaggtcatcacccccgaccaggtccctgacaccatcggcagcgcagccggcgaggcgcaccgccccggagctccccttgagctcaactccctccgggaagcccgggaggggttcgagcgggaattcatcctccagaagctggaggagaacggctggaacatctcccgcaccgccgaggcaatcgagctggaacggagcaatctctaccggaagatgaagagctacgggatcgacgccaggaaatga

SEQ ID NO: 44142 - protein, 454 aa, Geobacter metallireducens GS-15
MNETILVVDDEQNIRTALAGILEDEGYRPVFAKDGLEALDMAKKENPDLVLLDIWMPRLDGLETLQALKEFHPLLTVVMMSGHGTIETAVKSTKLGAYDFIEKPLSLEKVLVTVKNGLDVGRLKAENDTLRTVAFKGHDMVGNTPAILQLQEQVRRVAATNASVLITGENGTGKELVARAIHHWSPRKEKPFVEINCAALPEELIESELFGHEKGAFTGAVAQKKGKFDLADGGTIFLDEIGDMSLKTQAKVLRILQERKFERVGGTKTIEVDVRVVAATNKDLPGEIRGGTFREDLFYRLNVVPFTVPPLRERRDDIPLLVEHFLAIFAQREGQERKKMLPETVELLKGYDWPGNVRELRNIIERLVIMTPGKVITPDQVPDTIGSAAGEAHRPGAPLELNSLREAREGFEREFILQKLEENGWNISRTAEAIELERSNLYRKMKSYGIDARK

SEQ ID NO: 44143 - DNA, 1362 bp, Geobacter metallireducens GS-15
  CDS (1)..(1362)
atgaaagaacggacccgcatcctcctcatcgatgacgaagaatcggggcgcgaagctctcaccctcatcctcaggaatgccggccaccacgtcacgggggcggcatcggggcgggaagcggcccagcaccttgctcgggacaagttcgacatcatcattaccgacctcttccttcccgacaccaacggcattgacatcctcaaggacgtcaagaacgattcccccctcaccgaggtgatcctcatcaccggccacgcctccgccgaaaccgccgtgcgggccatgaaagagggggcctacgactacatcaccaagcccctcaacatcgacgaactcaggatcatcatcgccaaggccgtggagaagcaccagctcctctccgaaaacgtctacctcaggaaacagctccgggacaaattcgagttcgccaacatcatcggcgcctcgcctgccatgcagcaggtcttcgccctcatgaagcggatcgtcaagaccgactccacggtcctcatcgccggcgagtcggggaccggtaaggaaatcgtggccaaggcgatccatttcaacggctcacggcgcgagcggccgttcatcgccgtccactgcggcgccataccggagaatctcctggagtcggaactgttcggctacgtgaagggggctttcaccggcgcggtgagggacaagatcggcaagttcgaggcggccaacggcggtaccatcttcctggacgagatcgggaccatgccgctgcagctccagacaaagctcctgcgggtcctgcaggagcaggaggtggagcgggtcggttccacccgtcccatcaagatcgacgtgcggatcatctcggccaccaacctggacctggccgaggaagtgaagaaggggaccttccgcgaagacctctactaccggctcaacgtcatccccctgggcctgccgccgctccgggaccgggtcgaggacatcctccccctggcgaagcactttctcgccaagtactgcaaagagatgcagcgccgccggatgaccctcgccacggaagcggtggaggcccttgaagggtatcgatggggagggaacgtgagggaactggagaacgtcatggagcgggtcgtggccctcaccgaggcggacaccatcaccctccacgacctcccccccaacatccgcgaggaatccctcactcgggtcaccgaacggggtgtcgacctcgtgaaagtgatcgccgaaatcgagcggagcatgatcaccgacgccctggccctcaccgacggtgtcaaggcccgggccgcggcgctcctgaacctgaaccggaccaccctcgtggaaaagatgcgccggctcggcatgccgctgtaa

SEQ ID NO: 44144 - protein, 453 aa, Geobacter metallireducens GS-15
MKERTRILLIDDEESGREALTLILRNAGHHVTGAASGREAAQHLARDKFDIIITDLFLPDTNGIDILKDVKNDSPLTEVILITGHASAETAVRAMKEGAYDYITKPLNIDELRIIIAKAVEKHQLLSENVYLRKQLRDKFEFANIIGASPAMQQVFALMKRIVKTDSTVLIAGESGTGKEIVAKAIHFNGSRRERPFIAVHCGAIPENLLESELFGYVKGAFTGAVRDKIGKFEAANGGTIFLDEIGTMPLQLQTKLLRVLQEQEVERVGSTRPIKIDVRIISATNLDLAEEVKKGTFREDLYYRLNVIPLGLPPLRDRVEDILPLAKHFLAKYCKEMQRRRMTLATEAVEALEGYRWGGNVRELENVMERVVALTEADTITLHDLPPNIREESLTRVTERGVDLVKVIAEIERSMITDALALTDGVKARAAALLNLNRTTLVEKMRRLGMPL

SEQ ID NO: 44145 - DNA, 1374 bp, Geobacter metallireducens GS-15
  CDS (1)..(1374)
atgagaaagacgaagattctggttgtcgacgacgagcaccttatccgctggtccctggagcagaatctgaaaaaacagggatacgaggtggtttcggccggcaacggcgaggatgccctgcggctcgtccgggatgaacaaccggacctggtgctgctcgatatccagctccccggcatcagtggcctggatgtcctggagaagatcaaggagcacgacgaggagatcatcgtgatcatggtcacggcccacggagcgctggagacggcggttcatgccatgcggctcggggccttcgactatatcaacaagccctttaacctggacgagatggccatcgtcatccgcaaggccctggaaacctccgatctccggcgggaggtccagcggctgcggggtgagcaggcgaagaagttcggtacgcccgatatcatcggagcgagccgccacatgaagaacgtcctcgacatgatggagaaggtggccaagagcgacgcctccactgtcctcgttcagggagagtcggggaccggcaaggagctggtcgccaagtggatccactataaatccgcccgggccgaacgcccctttgtcgccataaactgcgctgctgtcccggcgacactcctcgaaagcgagctcttcggtcatgaaaaaggggccttcaccgacgccaaggcgatgaaaaaggggcttttcgagctggccgacggtggcacggtctttcttgacgagatcggcgacatggagttggggatgcaggcgaagctcctccgcttcctggaggaacggaccttccgccgcatcggcggcaccaagtcgttttccgtcgatgtccggatcatctccgccaccaaccgcgacctcatcaaggcgatcgaggaaaagagcttccgcaacgatctctactatcgcctccaggtgatccccatctatctcccccccctgcgggagcggcgggaagacatcctcaccctgaccagccatttcatcgagctgttcaacgccgagttcaacaagcatgtcaccggcatctccaagatggcggagaaactcttgctcgactacacctggcccggcaatatccgcgaattgaagaacgtcatcgagcgcgccatcattctcggcaatgacgagacgctcctccttgagcacctgccgctggaaatcgtcgccaaggcctcctcccagtccgtggggctcaccaccttcaagcttccccccgaggggatagacattgaagaggtggaaaaggagcttatccgccaggccctggagatctcggactggaaccagtccaaggcggccaggaagcttaatctcggcattgacgccttccgttaccggatgaagaaattcgggtatttgaagtag

SEQ ID NO: 44146 - protein, 457 aa, Geobacter metallireducens GS-15
MRKTKILVVDDEHLIRWSLEQNLKKQGYEVVSAGNGEDALRLVRDEQPDLVLLDIQLPGISGLDVLEKIKEHDEEIIVIMVTAHGALETAVHAMRLGAFDYINKPFNLDEMAIVIRKALETSDLRREVQRLRGEQAKKFGTPDIIGASRHMKNVLDMMEKVAKSDASTVLVQGESGTGKELVAKWIHYKSARAERPFVAINCAAVPATLLESELFGHEKGAFTDAKAMKKGLFELADGGTVFLDEIGDMELGMQAKLLRFLEERTFRRIGGTKSFSVDVRIISATNRDLIKAIEEKSFRNDLYYRLQVIPIYLPPLRERREDILTLTSHFIELFNAEFNKHVTGISKMAEKLLLDYTWPGNIRELKNVIERAIILGNDETLLLEHLPLEIVAKASSQSVGLTTFKLPPEGIDIEEVEKELIRQALEISDWNQSKAARKLNLGIDAFRYRMKKFGYLK

SEQ ID NO: 44147 - DNA, 1368 bp, Geobacter metallireducens GS-15
  CDS (1)..(1368)
atggaaaagctgctcatagttgatgacaacgaggatatccgccgtcagcttcgatgggggattgggaaggagtattcccttcatctggccgccgatggcacagaggcgctggaactcttccgcaagcaccgcccccaggtcgttactctcgacctggggctccctccccatgaggacagttcagaagaggggtttcgctgcctcggtgagatgcttcgcattgcccccgacgcaaaggtgatcgtcattaccggtaacgaggggaaggagaacgccgtgaaggcggtgcagatgggggcctatgacttttaccagaagcccatcgatctgaatgagctcaaggttataatcaagcgggcttttcacctgcagacccttgaggatgagaaccgtcgcctgcagagcgcccttggggggagcggcccggatgtcaaagggataatcggccagtgtgccgagatgcagcaggtattttcgacgatcaggaaggttgccacctctgacatctctgttcttatccacggcgagagtggcaccggcaaggagcttgtggctcgcgccatccacgctcagagtctgcgcaaggacggcccgttcatccccatcaactgcggtgctatccctgaaaatcttcttgaatcagagctgttcgggcatgagaagggcgcgttcactggagcaatggcccgggttcaggggaaggtggaatatgcccacaaggggacactcttcctggacgaaatcggtgagcttcccctcaacctccaggtcaagctccttcgtttcctgcaggaaaaagccattcaacgggttggggggagggaggatatctccattgactcccggatcatagcggccaccaatgtcgatatcgttcgcgccatggaagaggggaggtttcgggaagacctctattaccggatcggggtggtaaccgtcacgcttcctcccctcaggaaccgcggcgatgatgttatgctgttagccaatttcttcctgaagcggtgcgtcaatgagttcaagaagaagataaaaggttttagtgaaacatcccgtgaatacatcgaaaattatggttggccggggaacgtgcgcgaattggaaaacaaggttcagcgggcagtgctcatggcatcgggggcagtaatcgagcccgacgatctgggcttcaccgagcgaccctcggcacgaaaagcaggcatcggtgaggtgacgaccctgcgtgaagccagggaacaggttgagcgggagatgatcaggggggctattaccaatagcaaggggaatatcgccaaggctgcggaagagttgggaatcagcaggccaacactctatgatctcatgaggaagcacggcattaacgcatga

SEQ ID NO: 44148 - protein, 455 aa, Geobacter metallireducens GS-15
MEKLLIVDDNEDIRRQLRWGIGKEYSLHLAADGTEALELFRKHRPQVVTLDLGLPPHEDSSEEGFRCLGEMLRIAPDAKVIVITGNEGKENAVKAVQMGAYDFYQKPIDLNELKVIIKRAFHLQTLEDENRRLQSALGGSGPDVKGIIGQCAEMQQVFSTIRKVATSDISVLIHGESGTGKELVARAIHAQSLRKDGPFIPINCGAIPENLLESELFGHEKGAFTGAMARVQGKVEYAHKGTLFLDEIGELPLNLQVKLLRFLQEKAIQRVGGREDISIDSRIIAATNVDIVRAMEEGRFREDLYYRIGVVTVTLPPLRNRGDDVMLLANFFLKRCVNEFKKKIKGFSETSREYIENYGWPGNVRELENKVQRAVLMASGAVIEPDDLGFTERPSARKAGIGEVTTLREAREQVEREMIRGAITNSKGNIAKAAEELGISRPTLYDLMRKHGINA

SEQ ID NO: 44149 - DNA, 1362 bp, Geobacter metallireducens GS-15
  CDS (1)..(1362)
atggagaaactcatgcagggtaaagcgcacgggaaggtgctcattgtcgatgatgagccgaatgccctgaaggtgctcgctgcaatcctgcgggaggaaggttattctgtattcaaggccggcgatgccgccgaggcggagcaagccttgagtaaagaggatatagacactgtcattaccgacatgaagatgcctggcaaggacggcatacagttgatggattttatggcggagcactatcccgatataccgattattttcctgacggcgtatggttccgtggattcagccgtgcatgccatcacccgcggagcattctattatttcatcaaaccccctgattacgttaagctcaagggaatcctggctcgggcagtggaacaacgcagccttaagcgcgaactggaaactctgcgcaagagggtctctggcggaacgccggcacgcattgttggcgccactccggaaatgctccgtatctttgaaactgtcgaggccgtcaaggattccatgagcagcgtgctcatctgtggcgagaccggaaccggcaaggaactcattgcccgctcccttcactacggaagcgtgcgaagggataaaccgttcgttgcggtaaattgcgcggccatgcctcgcgagctgattgagtcggaactcttcgggtacgagaagggggctttcagcggggctttctcccgtcgcatcggccgatttgaagaagcggcggaaggaacgatctttctcgatgagatcggtgaactggaaatgccgcttcaggcaaaattgctcagagtccttcaggaaaaggaaatagaacgacttggcagcaacaagaagatcaaggtcaatttccggctaatctcatctacaaacaggaatataccctcggagataaccgccgggaactttcgggaggacctcttctatcggctcaacgtggttcaggtgcaggtgcctccccttcgcgaccgccgggaagacattcctctccttgccgccgaacttgtcagggagtacggcgcacgagaaggaaaggtgctccgtttcgacgacgaagtaatgcaggtctttctgaactatgactggcccggaaatatacgccagttgggcaacattattgaacgcgccgtagttcttgcgaagaaggaccgaatcacaaccaaggagcttcccgaagagctgaagccctatgtggtgcgggttgaaagccgtcagcaggtgcgtacccttcgtgaactcgaagaggcggcaatactggcggcattggaagagagcggtgggaataagtcgcatgcggccaaaatgctgggaatttctcgaaaggctctctacaagcgacttggtgaaatggaggttttttga

SEQ ID NO: 44150 - protein, 453 aa, Geobacter metallireducens GS-15
MEKLMQGKAHGKVLIVDDEPNALKVLAAILREEGYSVFKAGDAAEAEQALSKEDIDTVITDMKMPGKDGIQLMDFMAEHYPDIPIIFLTAYGSVDSAVHAITRGAFYYFIKPPDYVKLKGILARAVEQRSLKRELETLRKRVSGGTPARIVGATPEMLRIFETVEAVKDSMSSVLICGETGTGKELIARSLHYGSVRRDKPFVAVNCAAMPRELIESELFGYEKGAFSGAFSRRIGRFEEAAEGTIFLDEIGELEMPLQAKLLRVLQEKEIERLGSNKKIKVNFRLISSTNRNIPSEITAGNFREDLFYRLNVVQVQVPPLRDRREDIPLLAAELVREYGAREGKVLRFDDEVMQVFLNYDWPGNIRQLGNIIERAVVLAKKDRITTKELPEELKPYVVRVESRQQVRTLRELEEAAILAALEESGGNKSHAAKMLGISRKALYKRLGEMEVF

SEQ ID NO: 44151 - DNA, 1389 bp, Geobacter metallireducens GS-15
  CDS (1)..(1389)
atgaccggaaccattctcatagttgacgacgagcgggcacagcgggagatcatccagacgatcctggagggagaagggtaccgcgtggcagcggctcccggagggcgcgaggccctggagcagctcgaaacgagcgagttcgacgtgatcctcacggacctgaagatgcaggggatgtcggggatggagctcctggagcgggtcctggaggccgaccccctccagtgcgccatcatgatgaccgcccacggcaccgtcgactcggcggtggaggccatgaaaaagggggccttcgattatctggagaagcccctggagcgggacaacctcctcctcaccctgcgccgggccttcgagcgggtgaatctcctgcgggagaaccgggtcctccagaagcggctcaaggagacgagcagcatccccaacatcatcggcgaacacccgaagatgcgggaggtcttccggatcgtcaccaagatcgcccccaccgcctcaacagtcctcatctacggcgagtcggggaccggcaaggagctggtggccaaggcgatccacgacgggagcccccggaaagacaagcctttcttcgccataaactgcgccgccatccccgagagcctcatggagagcgagctcttcggccacgagaaaggggccttcaccggcgccagctcccgggagctgggaattttcgaggcggccaccggtgggacggttttcctggacgaaatcggcgagatgagtgtggccatgcaggcaaagctcctgcgggccatccagtcgaaggagatccgccgggtcgggggaaaggtgaacatccccgtggacgtgcggatcatttccgccaccaaccgggacctggaggcggagatcaaacgggggggcttccgggaggacctcttctaccgcctgaacgtgatccggatcactctcccccccctgcgggagcgggggagcgacatcgcggccctggccgacttcttcgtgaaaaagtgcagcgcccaggcgggagtcaccgtcagggggatcgccaaaccggccctgaagctcatcatggactacagctggcccggcaacgtccggcagttggaatcggtcatcgagcggggggcgctcatggcggaaagcgacctgatccagcccgaggatctgccggccgagatcaccgaagggctctcccgggcaggatggctccccttcgagcttccccccgacggaatccagttcgatgagctggagcgcaacctcatcatcaaggccatggaacgggccgactgggtcatcgccaaggcggccccgcttctgggcatgagctacaagacgcttcagtaccggctggagaagttcgagataggccgggaccggggaacggggaacggggaccagtaa

SEQ ID NO: 44152 - protein, 462 aa, Geobacter metallireducens GS-15
MTGTILIVDDERAQREIIQTILEGEGYRVAAAPGGREALEQLETSEFDVILTDLKMQGMSGMELLERVLEADPLQCAIMMTAHGTVDSAVEAMKKGAFDYLEKPLERDNLLLTLRRAFERVNLLRENRVLQKRLKETSSIPNIIGEHPKMREVFRIVTKIAPTASTVLIYGESGTGKELVAKAIHDGSPRKDKPFFAINCAAIPESLMESELFGHEKGAFTGASSRELGIFEAATGGTVFLDEIGEMSVAMQAKLLRAIQSKEIRRVGGKVNIPVDVRIISATNRDLEAEIKRGGFREDLFYRLNVIRITLPPLRERGSDIAALADFFVKKCSAQAGVTVRGIAKPALKLIMDYSWPGNVRQLESVIERGALMAESDLIQPEDLPAEITEGLSRAGWLPFELPPDGIQFDELERNLIIKAMERADWVIAKAAPLLGMSYKTLQYRLEKFEIGRDRGTGNGDQ

SEQ ID NO: 44153 - DNA, 1311 bp, Cytophaga hutchinsonii
  CDS (1)..(1311)
ttggaaaaggtactgattatagaagacgatatttcattacgcaccattcttgaaaaatttctccagaaaaatggatttgaagtaatttcaacggataggggcaaagccggattagaaataattacttcgcagcacatagattttgtattgctggatctgaggttgccggatagtaatggaatagaaattctgcagtcgattaaaaaacttcattcgcacgtttctgttatcatgatgacattttatgatgatgtacgttcggctgtaacagctattaaatcaggtgcgcgtgattaccttacaaaaccgatcaacccggaagaattattaagcctgttaaaacccattcaggcagtaaaaaaggcagttgaaatcaataagagtgagtttgtacaaggtaaaaatgaaaaatttgccggagttttagagcatgcaagactggttgcacctaccatgctttctgtattgataacaggtgaaagcggtacgggcaaagaagagttggctaaatacattcatacaaatagtcaacggaaacagaaagattttataacggttgattgcggttctatttcagaagaattattcggaagcgaatttttcggacacatgaaaggatcgtttacaggtgctgtatatgataaaccagggttgttggaatctgcaaacggggggacactttttttagatgagctaggtaatctcacctatgaaaatcagatcaagcttctgcgcgtgttacaggaaaaaaaagtgaaacgtattggttctaataaagaaatagatcttgatataaggctgatagcagcaaccaatgaagaaattgtgctgtctgtacaaaaagaaaaattccgggaagatttatatcatcggttaaatgaatttaaaattcatgtacccgcactaagagaacgccctgaagatttaaacgagctaatcaatcattttatagcaaaatcaaacagtgagtttggcaaacatgtaaaacagctttctgaaagtggcttagccgtattggctcaatatgcattccctggtaatatcagggaattaaaaaatattgtcagaagggctgtacttcttgctacatctgaaacaatagaaaaggatcaattgcctcaggaaatatttaatacacgcacacttgctgttgataccgtagatttaaaatccttacaggagcagcaggagagagatgcgattatcaaagccttaaaaaagacaggtaataataaaagcgaagctgcacggattctgaatattgaccgcaaaacactttataataaattaaagctttatcagttagaataa

SEQ ID NO: 44154 - protein, 436 aa, Cytophaga hutchinsonii
MEKVLIIEDDISLRTILEKFLQKNGFEVISTDRGKAGLEIITSQHIDFVLLDLRLPDSNGIEILQSIKKLHSHVSVIMMTFYDDVRSAVTAIKSGARDYLTKPINPEELLSLLKPIQAVKKAVEINKSEFVQGKNEKFAGVLEHARLVAPTMLSVLITGESGTGKEELAKYIHTNSQRKQKDFITVDCGSISEELFGSEFFGHMKGSFTGAVYDKPGLLESANGGTLFLDELGNLTYENQIKLLRVLQEKKVKRIGSNKEIDLDIRLIAATNEEIVLSVQKEKFREDLYHRLNEFKIHVPALRERPEDLNELINHFIAKSNSEFGKHVKQLSESGLAVLAQYAFPGNIRELKNIVRRAVLLATSETIEKDQLPQEIFNTRTLAVDTVDLKSLQEQQERDAIIKALKKTGNNKSEAARILNIDRKTLYNKLKLYQLE

SEQ ID NO: 44155 - DNA, 1380 bp, Microbulbifer degradans 2-40
  CDS (1)..(1380)
atgacgacacaaccaaaagtattggttattgatgacgagccagatattcgcgaactgcttactattaccttaagcagaatggacatagctgccgatactgctgccgatgtagctgaagctaaagcccagctaagtaaaaacaaatacaatttatgcctaaccgacatgaaactgcccgacggcaacggcatagatattgtgcattatattcaacagcattcgcccagcttgccggtggcgctaataaccgcacacggcaatatggatatagcaattcaagccatgaaagctggtgcatttgactttctaaataagcccgtcgacctagccagcctgcgtaaactcgttgccacggctattgcatctagcgaactacccgaagaggaatgcgacgaaaatactcgcattattggcaagtctccagccatacaaaaattgacgggcagtattaaaaagctagcccgctcacaggcgcctgtttacataagtggcgaatccggtagcggtaaagaattagtcgcacgctcaatccacgagcttggcccccgcagcaacaaaccgtttatgcccgttaattgcggcgccatccaaaaagaactaatggaaagtgaattgtttggtcacaaaaaaggggcttttacgggggcagtgcaagacaaacaaggtatttttcaagctgctgaaggcggtacgctatttctagatgaagttgccgatttgccgttagacatgcaagtaaaattactacgtgctatacaagaaaaagcggtacgccccgtgggtgcagaagccgaaataagcaccgatgtacgcatactttgcgccacgcacaaaaacttagaagaactcgttcaaaaaggcgacttccgccaagatttattttacagacttaacgttatacaactggccgtaccaccgcttcgcgatcgcacagatgacgttgaagtactcgccaaacatgtacttaaaaaaattataggccccgacgaaacaccgcccaaattagataagagcgccattaacgcgcttaaacaatatagcttcccgggcaacgtacgtgagctagaaaatattttagagcgcgcttacacgttgtgtgaggaagatgtaataaaagacacagaccttcagctatcaagttcacccaaaatagaaagcgcttcttcctacacaggaacggtcaatcactataaacaatcccagcaatacgaatcgttggacgactacctagcagaaatagaaaaagaaatattaagtgaagtactagaacaagtccgctggaataaaacattagcagccaaaaaactgggcatcagctttcgatcttttcgttatcgactaagtaaactcggtttggctaaagactggcaagatgaatag

SEQ ID NO: 44156 - protein, 459 aa, Microbulbifer degradans 2-40
MTTQPKVLVIDDEPDIRELLTITLSRMDIAADTAADVAEAKAQLSKNKYNLCLTDMKLPDGNGIDIVHYIQQHSPSLPVALITAHGNMDIAIQAMKAGAFDFLNKPVDLASLRKLVATAIASSELPEEECDENTRIIGKSPAIQKLTGSIKKLARSQAPVYISGESGSGKELVARSIHELGPRSNKPFMPVNCGAIQKELMESELFGHKKGAFTGAVQDKQGIFQAAEGGTLFLDEVADLPLDMQVKLLRAIQEKAVRPVGAEAEISTDVRILCATHKNLEELVQKGDFRQDLFYRLNVIQLAVPPLRDRTDDVEVLAKHVLKKIIGPDETPPKLDKSAINALKQYSFPGNVRELENILERAYTLCEEDVIKDTDLQLSSSPKIESASSYTGTVNHYKQSQQYESLDDYLAEIEKEILSEVLEQVRWNKTLAAKKLGISFRSFRYRLSKLGLAKDWQDE

SEQ ID NO: 44157 - DNA, 1422 bp, Microbulbifer degradans 2-40
  CDS (1)..(1422)
atgcataaaccaaacttggtgtggattattgacgatgaccgctctattcgctgggttcttgaaaaagcgctgcagcaggccggcattactaccaccagcttcgagtctggcgataaggccgttgagcacctcgcgcaggaaaaacccgatgtcgtgattagcgacgtgcgcatgcccggcatgaatggcctcaccctgcttacccatttgcacaaagaaataccgaacctgcccgtaataattatgacggcgcactcggatttagacagtgccgtagcagcctaccaaggcggtgcatttgaatacctgcccaaaccattcgacgtagatgaagcggtagcagtcacccagcgtgcgctctcgcacgcccaggagcaacgcgtagaagcaccagcggcgcaacctgccgtagatacagaaattattggtgaagcgccagccatgcaagaagtgtttcgcgcaattggccgcttatcacaatccaatattacggtattaattaacggtgaatcaggtacgggtaaagagcttgtcgctcacgccctgcacaagcacagcccgcgccgcgaaggccagtttattgcgcttaacatggcggctataccgcgcgacttaattgaatcggaattattcggccacgaaaaaggcgcgtttactggtgcaggcgcacagcgccaaggtcgcttccagcaagccgatggcggcacactgttcttagatgaaattggtgatatgcccgcagaaacacaaacccgcttactgcgcgtattggccgatggcgaattttaccgcgtgggcggccacacccccatcaaagtagatgtgcgcattattgcggccacccaccaaaacctagaagggctggttgaagaaaaccgtttccgcgaggatttattccaccgcttaaacgtaattcgcatccacctacctaaaatggcggatcgccgcgaagatattccaaagctagcgcagcactttttgcgccgcgccgccgaagagctcggggtagaaccaaaaacccttacccccgaaaccgaagcttacctcagccacttatcttggcctggtaacgtacgccagctagaaaacacctgtcgctggataaccgtaatggcttcaggccgcgaagtgcatattgccgacctgccaccagaactaatggaagccagaacggcagaagcgccaagtggcgactgggaaaaggctctgcgccactgggccgatcaagccttggcctgtggccaaagcgatattctttctgatgccgtgcccacctttgagcgcgcattaatagaaaccgccctcaaacacactgccggcagaaaacgcgatgcagcaaaccttttaggctgggggcgcaacacgctcacgcgcaaactaaaagagttgggtatggcctcctcggaagaagaagtcgaataa

SEQ ID NO: 44158 - protein, 473 aa, Microbulbifer degradans 2-40
MHKPNLVWIIDDDRSIRWVLEKALQQAGITTTSFESGDKAVEHLAQEKPDVVISDVRMPGMNGLTLLTHLHKEIPNLPVIIMTAHSDLDSAVAAYQGGAFEYLPKPFDVDEAVAVTQRALSHAQEQRVEAPAAQPAVDTEIIGEAPAMQEVFRAIGRLSQSNITVLINGESGTGKELVAHALHKHSPRREGQFIALNMAAIPRDLIESELFGHEKGAFTGAGAQRQGRFQQADGGTLFLDEIGDMPAETQTRLLRVLADGEFYRVGGHTPIKVDVRIIAATHQNLEGLVEENRFREDLFHRLNVIRIHLPKMADRREDIPKLAQHFLRRAAEELGVEPKTLTPETEAYLSHLSWPGNVRQLENTCRWITVMASGREVHIADLPPELMEARTAEAPSGDWEKALRHWADQALACGQSDILSDAVPTFERALIETALKHTAGRKRDAANLLGWGRNTLTRKLKELGMASSEEEVE

SEQ ID NO: 44159 - DNA, 1419 bp, Microbulbifer degradans 2-40
  CDS (1)..(1419)
atgagtaaaatactgatcgtagaagacgaagtgattattcgcacagcgctgcgcaagctgcttacgcgcaataaacacgacgtaaaagaagctggatcgatcagcgaggcaacaagcaagcacaaactcgataccttcgacctcatcatcagcgacctgcgccttcccggcgcccccggcacagaccttattcagctagctggcgacattcccgtattaatcatgaccagttacgccagcctgcgctcggccgtagattctatgcgcatgggcgccgtagactacatagccaagccattcgaccacgacgaaatgctggccgccgttaagcgcgtactgggtaaatcggccacccgcttagcccaaaccaataccggcaaggtagaaaacacctcggcaattgaaggcatgattggcaccagcgcagccattaaagaaatttacggcaaaatacacaaagtcgccccaaccaatgccacagtactggtattaggtgaaacaggtacgggtaaagagctagtggccaacgctattcaccgcgaaagcccgcgcaaagacaaaccgcttatatcggtaaactgcgccgctattccagaaacccttatcgaagccgagctatttggccacgaaaaaggcgcctttaccggcgcagccaccacccgcgaaggtttggtttcggccgccgatggcggtacattgtttttagatgagattggcgaattgccactcgaagcacaggcgcgcttactgcgcgtactgcaagaaggtgaagtgcgcccaattggctcgatagagtcgcgcaaagtggatgttcgcctagtggcggcaacacaccgcgatttgggccgcttggcccgcgaaggtaaattccgcgaggatttatacttccgtattaacgttgtacaaattaagttaccgcccctacgcgagcgcggcaaagacatactcgcactggccgagacctttgttaaacgctactgcgtagaaatgttaaaaccgcacctaaccctcaccccagaggccattcaggctattaccacgtacacttggccgggcaatattcgcgagttagaaaacgcgatccaaagagcagttattttgtgcgacgacgaagtggaaatcgatcatacccacttatcgatagatttagacctaattcgcgtagacgaataccgcgaacagcaatacgccccagaaccacagcgcaatcagcagcacaacacctcggccaaacccgaccccaacgaagacctctctctcgaagactacttccaacgcttcgtcctcgaacatcaagacaccatgagcgaaaccgaattggcgcgtaaattaggcgttagtcgcaaatgcttgtgggaacgtcgccagcgtctgggtatcccccgcaaaaagcctacccagtcggcaacaaccgactaa

SEQ ID NO: 44160 - protein, 472 aa, Microbulbifer degradans 2-40
MSKILIVEDEVIIRTALRKLLTRNKHDVKEAGSISEATSKHKLDTFDLIISDLRLPGAPGTDLIQLAGDIPVLIMTSYASLRSAVDSMRMGAVDYIAKPFDHDEMLAAVKRVLGKSATRLAQTNTGKVENTSAIEGMIGTSAAIKEIYGKIHKVAPTNATVLVLGETGTGKELVANAIHRESPRKDKPLISVNCAAIPETLIEAELFGHEKGAFTGAATTREGLVSAADGGTLFLDEIGELPLEAQARLLRVLQEGEVRPIGSIESRKVDVRLVAATHRDLGRLAREGKFREDLYFRINVVQIKLPPLRERGKDILALAETFVKRYCVEMLKPHLTLTPEAIQAITTYTWPGNIRELENAIQRAVILCDDEVEIDHTHLSIDLDLIRVDEYREQQYAPEPQRNQQHNTSAKPDPNEDLSLEDYFQRFVLEHQDTMSETELARKLGVSRKCLWERRQRLGIPRKKPTQSATTD

SEQ ID NO: 44161 - DNA, 1323 bp, Thiobacillus denitrificans ATCC 25259
  CDS (1)..(1323)
atgaaaccctcgaaccgcccgcgcatcctgctcgtcgacgacgagcccgacctgctcgacctgatggagctcacgcttctcaagatgggcctcgaaaccgaccgcgcgctgaccgtcaccgacgcctgttcccggctcgcgaatacgccttatgacttgtgcctgaccgacatgcgcctcggcgacggcgaaggtctggaagtcatcgccgcggccaatgccctgccggtcccggtccccgcggccgtcatcacggcttacggcaacgccggcaacgccgtcgcggcgctcaaggccggcgccttcgactacctcgccaagccggtggcgctcgatcaattgcgcacgctcgtgaagtccgcgctgcaggtcccggcctcgtcgggtcaggcggcgacagcccgcgggctcatcggaaactcgagcgcgatgcaggacatccgtgcccgcatcgccaagctcgcgcgcacgcaggcgccggttcacatcagcggcgagtcaggcagcggcaaggagctcgccgcacgtctgatccacgaaacgagcaatcgggccgacaagccgctggtcgccgtcaactgtggcgcgattcccgaggcgctcatggagagcgaattcttcggctatcgcaagggcgccttcacgggtgcggaagccgatcgcaccggcttcttccaagcggccaacggcggcacgctcttcctcgacgaggtcggcgacctgccgctgtcgatgcaggtcaagctgctgcgcgtgctgcaggaaaagaaggtgcgcaaggtcggcgcgaccaccgaggaagacgtcgacgtgcgcatcatcagcgcgacgcaccagaatctcgcggcactcgtcgaagccggccgattccgccaggatctctattaccggctcaacgtcatcgacctgctcatgccgagcctgcgcgaccgcgccgaggacatcccggaaatggcgcgctttctgctcgaaaagctcggcggacgcgcggtcgaactcgagcgcgacgccgaaaaggcactctgcacctacgctttccccggcaacgtgcgtgaactcgaaaacatcctcgaacgtgcgctcgccctgtgcgagaacgcgcgcatccgggccgcggacctcaacctcgtccccccgccgccttcgaccgcggcgatgccgggaagcaagtatccactgcaggactacctggatcagaccgaacgcgcggccatcatcgaagcgctcgagcagactcgatacaacaagaccgcggcggcgcggctactcggcgtgacctttcgcagcctgcgctatcggctggaacgcctgggcatcgaatag

SEQ ID NO: 44162 - protein, 440 aa, Thiobacillus denitrificans ATCC 25259
MKPSNRPRILLVDDEPDLLDLMELTLLKMGLETDRALTVTDACSRLANTPYDLCLTDMRLGDGEGLEVIAAANALPVPVPAAVITAYGNAGNAVAALKAGAFDYLAKPVALDQLRTLVKSALQVPASSGQAATARGLIGNSSAMQDIRARIAKLARTQAPVHISGESGSGKELAARLIHETSNRADKPLVAVNCGAIPEALMESEFFGYRKGAFTGAEADRTGFFQAANGGTLFLDEVGDLPLSMQVKLLRVLQEKKVRKVGATTEEDVDVRIISATHQNLAALVEAGRFRQDLYYRLNVIDLLMPSLRDRAEDIPEMARFLLEKLGGRAVELERDAEKALCTYAFPGNVRELENILERALALCENARIRAADLNLVPPPPSTAAMPGSKYPLQDYLDQTERAAIIEALEQTRYNKTAAARLLGVTFRSLRYRLERLGIE

SEQ ID NO: 44163 - DNA, 1350 bp, Thiobacillus denitrificans ATCC 25259
  CDS (1)..(1350)
atgaagaagctgaccatcctcgtcgtcgacgatgacgccgcgctgcgcgagctgatcacgctgcggctcgaagcgaacgggtttcgcgtggtcgccgtcgacagcggcgaggccgcgctcgcgcagctcgcgctggcgcggccggacgccgtgctgaccgacctgcagatggccggcatggacggcatggcgctgttccgcgcgatacaggcgcgcgatcctgcgctgcccgtcgtcgtgctgaccgcgcacggaaccattcccgacgcggtcgcggcgacccagcaagggctgttcggctatctgaccaagccctacgacgcgccgacgctgatcgaactcctgaagcgcgcgacccgcctgggcgtaagcgccgcggaggtcgcggacgactggcgcgccgaaatcatcaccgccagcccggcgatggaagccttgctggccgaggcgcggctcgccgcgcagagcgaagcctcgctgctgatccagggcgaatccggcaccggcaaggagttgctcgcgcgggccatccaccgcgccagcccgcgccgcgccaagccattcgtcgcgatcaactgcggcgcgatcccggccgaactgctcgaatccgagctcttcggccacctcaagggcgccttcacgggcgcggcgcgcgacaatccgggcctcttcatgagcgcgcagggcggcacggtgtttctcgacgagatcggcgacatgccgctgccgctgcaggtcaagctcctgcgcgtcctgcaggaaggcgaggtgcgtccggtgggggcgaccgagacgcgcccggtcgacgtgcgcatcctctcggcgacacacaggaacctcgaggatgccatcggcagcggcgaattccgcgaggacctctactaccgtctcaacgtcgtcaacctcatgctgccgccgctgcgcgagcggcgcgaggacattccgctgctggcgcagcatttcctcgccgagctgaccgagaaatacgaccgtcgtgtacgcggcttcgcccccgacgcgctcgacatgctggccgccgccgattggccgggcaacatccgccagctgcgcaacgtgctcgaacagtgcgtcgccctctgtacgacgccgacgatccccggcagcctcgtcgcgcgcgcactgcgcgagaaaccggcggagattcagccgctcgccgaagcccgcgccgccttcgagcgcgactatctcatctccctgctcaagctcacgcgcggccaggtcagcgaagtcgcgcggctcgccggacgcaaccgcaccgaggtctaccggctgctgcagcgtcacggcctgacgcccgcgctgttcaaggatcgcgacgacgcgccctga

SEQ ID NO: 44164 - protein, 449 aa, Thiobacillus denitrificans ATCC 25259
MKKLTILVVDDDAALRELITLRLEANGFRVVAVDSGEAALAQLALARPDAVLTDLQMAGMDGMALFRAIQARDPALPVVVLTAHGTIPDAVAATQQGLFGYLTKPYDAPTLIELLKRATRLGVSAAEVADDWRAEIITASPAMEALLAEARLAAQSEASLLIQGESGTGKELLARAIHRASPRRAKPFVAINCGAIPAELLESELFGHLKGAFTGAARDNPGLFMSAQGGTVFLDEIGDMPLPLQVKLLRVLQEGEVRPVGATETRPVDVRILSATHRNLEDAIGSGEFREDLYYRLNVVNLMLPPLRERREDIPLLAQHFLAELTEKYDRRVRGFAPDALDMLAAADWPGNIRQLRNVLEQCVALCTTPTIPGSLVARALREKPAEIQPLAEARAAFERDYLISLLKLTRGQVSEVARLAGRNRTEVYRLLQRHGLTPALFKDRDDAP

SEQ ID NO: 44165 - DNA, 1350 bp, Thiobacillus denitrificans ATCC 25259
  CDS (1)..(1350)
atgagcgacgccaaacaaaagattctgctggtcgaggacgaccttgggctgcaaaagcagctcaagtggagccttgccgattacgagctgatcgtcgccgcagaccgcgacagcgcgatcgcccagctgcgccgccacgaaccgccggtcgtgctgctcgacctcggtctgcctccggacgtcgacggcgcaaccgaagggctcgaagcgctgcaacagatcctttcactctcgccggtcaccaaggtgatcgtggtcaccggcaatctcgatcgcagcaacgcggtcaaagccatccgcctcggtgcctacgactttttccagaagccgttcgatcccgacgtcctcgcgctcatgatcgcgcgcgcgctccacgtccacgggctggaaaccgaaaaccgccggcttacgcggcagcggggttcttcccttcagggcctcatcacgagcagcgagccgatgctgaagatctgccgcacgatcgagaaagtggccccggccaatgcgaccgtgctcctgctcggcgaatccggcacaggcaaggaagttctcgcacgcggcgtgcacgagctgtcgccgcgctcgaacaagcgcttcgtcgcgatcaactgcgcggcgattcccgacacgctcctcgaatcggaattgttcggctacgagaaaggcgcgttcaccggggccgccaagcaaaccatcggccgcatcgaatacgccaacgaaggcacgctcttcctcgacgagatcggcgacctgccgatgccgctacaggccaagctgttgcgcttcctgcaggaacgcgtgatcgaacgcctcggcgggcgcggcgagattcccgtcgacgtgcgcgtcgtatgcgcgacgcaccgtgacctcgcggcgatgatccgcgagggcggcttccgcgaagacctctattaccggctctccgaaatttcggtgaacatcccgccgctgcgcgaacgccctggcgacgccgtattgctcgcgcaggcatttctcgaacgctatgcccgcgagctcggccgccgcatccgcggcttcaccgcagacgccctcgcggcgctggaagcgcatccctggcccggcaacgtgcgcgaaatggaaaacctgatcaagcgcgcgacgatcatggcggacggcagccagatcaccgccgccgacctcggcctcgacgccggcgaggtcgagccgcgccccttcaatctgcgtcaggcccgcgagaacgccgaacggatcgccgtcagccgcgccttggcgcacagcgacggcagcattgcgcaggccgccgaactgctcggaatcacccggccgaccttgtacgatctgatggcgaagatcggcatgaaataa

SEQ ID NO: 44166 - protein, 449 aa, Thiobacillus denitrificans ATCC 25259
MSDAKQKILLVEDDLGLQKQLKWSLADYELIVAADRDSAIAQLRRHEPPVVLLDLGLPPDVDGATEGLEALQQILSLSPVTKVIVVTGNLDRSNAVKAIRLGAYDFFQKPFDPDVLALMIARALHVHGLETENRRLTRQRGSSLQGLITSSEPMLKICRTIEKVAPANATVLLLGESGTGKEVLARGVHELSPRSNKRFVAINCAAIPDTLLESELFGYEKGAFTGAAKQTIGRIEYANEGTLFLDEIGDLPMPLQAKLLRFLQERVIERLGGRGEIPVDVRVVCATHRDLAAMIREGGFREDLYYRLSEISVNIPPLRERPGDAVLLAQAFLERYARELGRRIRGFTADALAALEAHPWPGNVREMENLIKRATIMADGSQITAADLGLDAGEVEPRPFNLRQARENAERIAVSRALAHSDGSIAQAAELLGITRPTLYDLMAKIGMK

SEQ ID NO: 44167 - DNA, 1434 bp, Pseudomonas syringae pv. syringae B728a
  CDS (1)..(1434)
atgccgcatattttgatcgtcgaagacgaaacgattatccgctcagccctgcgtcgcctgcttgaacgcaaccagtatgaagtcagtgaagccggctccgttcaagaggctcaggaacgcttcagcatcccgtcgttcgatctgatcgtcagcgacctgcgcttgcccggcgcacccggcaccgagctgatcaagctcggcgagggcaaaccggtgctgatcatgaccagttacgcgagcctgcgctcggcagtcgattcgatgaagatgggcgcggtggactacatcgccaaacccttcgatcacgatgaaatgctccaggccgtctcgcggatcctgcgtgatcggcagacggtcaagcaccttcaggacgaacgcggcgccaccgcccggaccagcagcgctgaaaaaggcccggcacagaaccacaatggcgagatcggtatcatcggctcatgcccgcccatgctggatctttacagcaagatccgcaaagttgccccgactgattccaacgtcctgattcaaggggaatcgggcaccggtaaggaactggtcgcccgcgccctgcacaacctctcacgccgcgccaaggcgccgatgatttccgtcaactgtgcggccattcccgaatcgctgatcgagtccgaactgttcggtcatgaaaaaggcgcgttcaccggggccagcgcaggccgcgcaggtctggtcgaggctgctgacggtggcacgctgtttctcgatgaaatcggcgagctgccgctggaagcccaggctcgcctgctgcgcgtattgcaggaaggcgagattcgccgggtcggttcggtgcaatcgcaaaaggtcgacgtacgcctgattgccgcgacccaccgggacctgaaaacgctggccaaaaatggcgagtttcgtgaagacctgttctatcgtctgcacgtcatcgccctgaagctcccggcgctgcgcgaacgtggcaacgacatcctggaaatcgcccatgcgttcctggttcgccagagcggcaaggtcgggcgcgacgacctcaaatttgcacacgacgccgaacaagcgatccgccattacagctggccgggtaacgtacgcgagctggaaaacgctgtggaacgctcggtgattctgtgcgagaacccggaaatcaccgctgacctgctgggcatcgacatcgagctcgacggtctggatgacgacgagtacatgggcatggcgccgttaccgggctcttccggctcgtcgggcaacgagcccgccgaagacctgtcactcgaagactattttcagcacttcgttctggagcatcaggatcacatgactgaaaccgagctggcgcgcaagctgggcgtcagtcgcaaatgtctgtgggaacgccgtcagcgtctgggcatcccgcggcgcaagggcgtcgccagcgagacataa

SEQ ID NO: 44168 - protein, 477 aa, Pseudomonas syringae pv. syringae B728a
MPHILIVEDETIIRSALRRLLERNQYEVSEAGSVQEAQERFSIPSFDLIVSDLRLPGAPGTELIKLGEGKPVLIMTSYASLRSAVDSMKMGAVDYIAKPFDHDEMLQAVSRILRDRQTVKHLQDERGATARTSSAEKGPAQNHNGEIGIIGSCPPMLDLYSKIRKVAPTDSNVLIQGESGTGKELVARALHNLSRRAKAPMISVNCAAIPESLIESELFGHEKGAFTGASAGRAGLVEAADGGTLFLDEIGELPLEAQARLLRVLQEGEIRRVGSVQSQKVDVRLIAATHRDLKTLAKNGEFREDLFYRLHVIALKLPALRERGNDILEIAHAFLVRQSGKVGRDDLKFAHDAEQAIRHYSWPGNVRELENAVERSVILCENPEITADLLGIDIELDGLDDDEYMGMAPLPGSSGSSGNEPAEDLSLEDYFQHFVLEHQDHMTETELARKLGVSRKCLWERRQRLGIPRRKGVASET

SEQ ID NO: 44169 - DNA, 1374 bp, Dechloromonas aromatica RCB
  CDS (1)..(1374)
atggctgaacacaatttgccaattcttgtggtcgaagatgatcccagtttgcgcgaggcaatcgccgacacgctggaactggctgggcgtccttgtgttgccgtcgatggtggcgaagcggcactcaaggtcctggaggagcaggccttttccattgtcgtcagcgatgttcggatgatgccgatggacggcatcaccttgctcaaggaaatccgcgcccgtctgccgcatttgccggtggtgttgatgacggcctacgccgaagtggataaggccgttgatgccatgcgctctggcgcgtgcgactttttgctcaagcctttcgagccccaggcattgctcgcccatatcaacaaatacgaattgccagcctctgatgatggcagtggcgtggtggcgatcgatccggccagtagagagttgtttgccgtagcccagcgggtggcgcagaccgacgctacggtgttgctgactggagaatcgggcgttggcaaggaagtggtcgctcgcttcattcatcgtcaatcggcccgtaagaatggtccttttgttgccatcaactgcgcggcgattccggatagcctgcttgaagcaaccttgttcggctacgaaaagggggcgtttaccggtgcccagcaagcacaggccggcaagttcgagcaggcccaggatggcaccttgctgcttgatgaagtgaccgaaatgccgatggggcttcaggccaagctgctgcgcgttctgcaggagcgcgaggtggagcgggtcggtggtaagaagccggtcgcgctgaatatccggatcatcgccacctcgaaccgcgatatggccgaagccgtggccaagggcgttttccgagaggatttgtattaccgtcttaatgtattcccggttggcatcccctccttgcggcagcgccgtggggatatcgtgccgattgcccggcattttgtcgtcgaacatggcgggcgttttgggcgaaccggcatgtctttgtcgccggcggctgaggctgcgctaagggagcattcctggcccggaaacgtgcgcgaactggagaatgtgatacagcgggccttgatcatggcgacggggagcacgatcggcccggaggtcctgaatcttgcacctcgatcgtcaggcgaaacagcggtagtgcagccagcggctgcgcctatgcctgtggagcattcagggctgacggacacggacaaaaaggtcgataatatgaaagacttggagcgtgaacatatcctgcgcaccttggccgaagttggaggttcccgcaagaaggccattgagcgcttgggtatttcagagcggaccttgcgctacaagttacagcaatatcgggatgaggggcattttcaggattga

SEQ ID NO: 44170 - protein, 457 aa, Dechloromonas aromatica RCB
MAEHNLPILVVEDDPSLREAIADTLELAGRPCVAVDGGEAALKVLEEQAFSIVVSDVRMMPMDGITLLKEIRARLPHLPVVLMTAYAEVDKAVDAMRSGACDFLLKPFEPQALLAHINKYELPASDDGSGVVAIDPASRELFAVAQRVAQTDATVLLTGESGVGKEVVARFIHRQSARKNGPFVAINCAAIPDSLLEATLFGYEKGAFTGAQQAQAGKFEQAQDGTLLLDEVTEMPMGLQAKLLRVLQEREVERVGGKKPVALNIRIIATSNRDMAEAVAKGVFREDLYYRLNVFPVGIPSLRQRRGDIVPIARHFVVEHGGRFGRTGMSLSPAAEAALREHSWPGNVRELENVIQRALIMATGSTIGPEVLNLAPRSSGETAVVQPAAAPMPVEHSGLTDTDKKVDNMKDLEREHILRTLAEVGGSRKKAIERLGISERTLRYKLQQYRDEGHFQD

SEQ ID NO: 44171 - DNA, 1368 bp, Methylobacillus flagellatus KT
  CDS (1)..(1368)
atgagtgccttccccgcctgtctggtcgtcgatgacgaaaccgatatccgcgaactcctggtgctgaccctggagcgcatggacatccgtgcggatagcgcgagcagcctatctgaggctatgcacctgctgaaaaaagggcaatatggcttatgtctcactgacatgcgattaccggatggcagcgggttggacctggtcaatcgcattgcccaggactatcccggcctgccggttgccgtcattaccgcctacggcagtgcggagaatgccgtatccgcgctcaaagctggcgccttcgactacctcaccaagcccatttcgctcaagcaattgcgccccctggtgcaatccgcgctcaagctgtccgccgcagacaaggcaaatgcatccgaagacacgggcgccctgaagcttatcggcaacagccccgccatccagcatgtgcggagcatgatagaaaaactgtcgcgcagccaggcgccagtctatatcagtggcgaatccggcagtggcaaggagttggcggcccgactgatccatcagcacagctcgcgccgcgacggtcccttcattgccgtcaactgcggcgccattccggaaaatctcatggagagcgaattttttggccacaagaaaggggcatttaccggtgcaattcaggataaggagggcatgttccatgccgccaagggcggcacccttttcctggatgaggtcgccgacctgccgcttgccatgcaggtcaagctgttgcgcgccattcaggaaaaaaaggtgcgcatggttgggggcacccaggaagaaagcgtggatgtgcgcatcatcagcgccacccataaaaacctgtccgttctcatggagcgtggcgagttccgccaggatctttattaccgcctcaatgtaatagaactcaagctgcctgccctgcgcgacatgccggaagacattcccatgctggtggatgccttgctagccaagcagtgccgggagcagaatcgccccatccccacattatcccctgaagcaagccacatgctggcaaggcatagcttcccaggcaatgtgcgtgaactggaaaacgtcttggaacgggccctggcattatgcgacggcaacaccatcaccgtcgatgaccttctgctggaccaggatgccagcgctcacgcgccctctgcccgatcagccccggaagacgaaggcctgccattgcctgactacctagaacatatcgaaaaaactgccattctcaatgccctggaaaaaacccagcataacaagacagccgccgccaagctattgggcgtcagtttccgcacctttcgctaccgcctcagcaagctgggcctgagcaaggatacggattga

SEQ ID NO: 44172 - protein, 455 aa, Methylobacillus flagellatus KT
MSAFPACLVVDDETDIRELLVLTLERMDIRADSASSLSEAMHLLKKGQYGLCLTDMRLPDGSGLDLVNRIAQDYPGLPVAVITAYGSAENAVSALKAGAFDYLTKPISLKQLRPLVQSALKLSAADKANASEDTGALKLIGNSPAIQHVRSMIEKLSRSQAPVYISGESGSGKELAARLIHQHSSRRDGPFIAVNCGAIPENLMESEFFGHKKGAFTGAIQDKEGMFHAAKGGTLFLDEVADLPLAMQVKLLRAIQEKKVRMVGGTQEESVDVRIISATHKNLSVLMERGEFRQDLYYRLNVIELKLPALRDMPEDIPMLVDALLAKQCREQNRPIPTLSPEASHMLARHSFPGNVRELENVLERALALCDGNTITVDDLLLDQDASAHAPSARSAPEDEGLPLPDYLEHIEKTAILNALEKTQHNKTAAAKLLGVSFRTFRYRLSKLGLSKDTD

SEQ ID NO: 44173 - DNA, 1401 bp, Polaromonas sp. JS666
  CDS (1)..(1401)
atgagtgactcctcgacgagttccgccgcgacggcgaccccgtcggcccatctgctggtcgttgacgacgacccggacatgctgcgcctgctgacgatacggctcaccgcggcgggttaccgcgtgacggcggtcacctctgcagaggctgccatgacccagctccatatcgagcggccgcagctggtgctgagcgacgtgcagcttcccggccgggatggcctggccctgtttgacgacatccgcgcccggcatccgtcgctgccggtgatcctgctgacggcgcatggcaccattcccgatgcggtggaggcgaccgagcgaggtgtcttcacctacctgaccaaaccttttgatggcaagggcctgctcgacaagatcgcccaggcgctggcgctgagcgcgccttcgcatccggccaagcggggcagccccgaggcatggcaacaccagatcatcagccgctccagccgcatggccgaagcgctggcggaagcgcgcatgatctcgcaatcggatgccagtgtgctgctgcgcggtgaaagcggcaccggcaaggaactgctggcccaggccatccaccaggccagcccgcgcgccggcaaaccctttattgccgtcaactgcggcgccatccccgaggccctgctggagtcggaactgttcggccacgtcaagggcgccttcaccgacgcggtggccagtcacaagggcttgttccaggcggccgatggcggcaccttgttgcttgacgagattggcgacatgccgccggccctccaggtcaagctgctgcgcgtgctgcaggagcgggtggtgcggcccctgggctcaagccagtccatcccggtggacgtgcgcatcatctcggccacgcaccgcgacctggacgccgccatggccgagggccagttccgcgccgatctgtattaccgcctcaatgtggtgacgctgacgctgccgccgctgtcggagcgccgcgaagacattcccttgctggccaaccatttcctcatcaagctggccaacaagtacgacaagcgcctgagcggcttcgccccggaagccatcaaggccctgaccacggccgcctggccaggcaatgtgcgacagctctacaacgtggtggagcaggtctgtgcgctgtcgacgacgccgctcgtgccactggccctggtgcagcgcgccctgcgctcgcccagtgtgcaggtacttacttttgcagaggccaggcaacgttttgagcgcgactacctggtcggcctgctcaaactgaccgatggcaatgtggccgacgccgcgcgcctggccgaccgtaaccgcaccgagttttaccgcctgatgcaaaaacacggcctgacccccgggcatttcaaggccgacaacgccaccgctgcctga

SEQ ID NO: 44174 - protein, 466 aa, Polaromonas sp. JS666
MSDSSTSSAATATPSAHLLVVDDDPDMLRLLTIRLTAAGYRVTAVTSAEAAMTQLHIERPQLVLSDVQLPGRDGLALFDDIRARHPSLPVILLTAHGTIPDAVEATERGVFTYLTKPFDGKGLLDKIAQALALSAPSHPAKRGSPEAWQHQIISRSSRMAEALAEARMISQSDASVLLRGESGTGKELLAQAIHQASPRAGKPFIAVNCGAIPEALLESELFGHVKGAFTDAVASHKGLFQAADGGTLLLDEIGDMPPALQVKLLRVLQERVVRPLGSSQSIPVDVRIISATHRDLDAAMAEGQFRADLYYRLNVVTLTLPPLSERREDIPLLANHFLIKLANKYDKRLSGFAPEAIKALTTAAWPGNVRQLYNVVEQVCALSTTPLVPLALVQRALRSPSVQVLTFAEARQRFERDYLVGLLKLTDGNVADAARLADRNRTEFYRLMQKHGLTPGHFKADNATAA

SEQ ID NO: 44175 - DNA, 1443 bp, Polaromonas sp. JS666
  CDS (1)..(1443)
atgcaaataccccccacctcacccgcccatattcttgtcgtcgatgacgagccggacctgcgcaccctgtacgagctgaccctgcttcgcgaaggttatcgggtggaagcggccggcgatttgttgcaggcgcgcgagcagcttgagagcaagcgcttcgatgcagtcattaccgacatgcgcctgcccgacgggttgggactggagctgctgcgtgagctggtggcccagcaacgcgcggaacgctgcgtgatcatcacggcgcacggctctgccgaaaatgcggtggaagccctcaaggctggcgcgttcgactacctgaccaaacccgttgacctgaaacagttccgcagcgtcgtggcgtcggccatcctgggcacgcagaacctgtcgcgacccgccgcgggcgatagcggtcttggcgagctgggcccgggaccgaccgcggccacctcaaccaagtcggaaaaatctgacaagtcggcgtcagccatcctgcaaaaactggtgggcgaatcggcggtgatgcgggccgtcaagtcgcgcatcgtcaaggtagctggcagcatggcaccggtgctgatacagggagaatccggcacgggcaaggaactggtcgcacgcgcggtgcacgcctgcagccaccgtgcggccggtccctttgtggccgtcaactgcggcgccattcctgaaaacctgcttgaagccgagttttttggcgcccgcaaaggtgcctacaccggatcgacgcaggaccggcaaggctactttcaggccgccaaggggggaaccctgtttctcgatgagatcggtgacctgccgctggccatgcaatcaaagctgctgcgggcgatccaggaacgctcggtgcggccgctgggctccccccaggaagacacggtagatgtccgcatcgtcagcgccacacacaaagagctgggcgcgcaggttcaggcaggcgccttccggcaggatctgtattaccggctcaacgtgatcgaaatcggtgtgccgccgctgcgcgagcggcgcgaagacctgccggcactttgccaggccctgctgtcaagaatctgcaaggagtcggggctcgctgtgcctgagctcaccggcgcggtgatggagcagctgcgctcgcatccctttgacggcaatgtcagggagctggaaaacatcctgcaccgcgcggtggcgctcggcgaaggcaatgacctgcatttcgaggcccccccccaggatttcgtggcggttccggaaaatctgcaggcgtttctcgaccagcaggagcgaagcatcctctccaaggtgctgcaggagaccgggtttaaccgcaccgctgccgcctccaaactggggctgagcctgcgccagatccgctaccgcattgcccgtctgaacatcgagacacccggcggcgatgacgcatccgatgagtcagcctga

SEQ ID NO: 44176 - protein, 480 aa, Polaromonas sp. JS666
MQIPPTSPAHILVVDDEPDLRTLYELTLLREGYRVEAAGDLLQAREQLESKRFDAVITDMRLPDGLGLELLRELVAQQRAERCVIITAHGSAENAVEALKAGAFDYLTKPVDLKQFRSVVASAILGTQNLSRPAAGDSGLGELGPGPTAATSTKSEKSDKSASAILQKLVGESAVMRAVKSRIVKVAGSMAPVLIQGESGTGKELVARAVHACSHRAAGPFVAVNCGAIPENLLEAEFFGARKGAYTGSTQDRQGYFQAAKGGTLFLDEIGDLPLAMQSKLLRAIQERSVRPLGSPQEDTVDVRIVSATHKELGAQVQAGAFRQDLYYRLNVIEIGVPPLRERREDLPALCQALLSRICKESGLAVPELTGAVMEQLRSHPFDGNVRELENILHRAVALGEGNDLHFEAPPQDFVAVPENLQAFLDQQERSILSKVLQETGFNRTAAASKLGLSLRQIRYRIARLNIETPGGDDASDESA

SEQ ID NO: 44177 - DNA, 1680 bp, Ralstonia solanacearum
  CDS (1)..(1680)
atgtccaaagccgccatcgttcgcgaacccattctcgtcgtcgatgacgaggccgacctgcgcgagctgctggagatctccctgcggcgcatggggcacgacgtggtactggccgctggcctgggcgaggcgcgcgaggcgctggcgcggcaacgctttgcgctggtgctgaccgacatgcgcttgggcgatggcctgggcatcgatctggtgcgccagctttcggccaccgccgaccgcacgccggtggccgtcatcaccgcctacggcagcgccgagaacgcggtggaggcgctcaaggcgggggcgttcgactatattgccaagccgctgtcgctcgatcagttgcgcagcctggtgctcaacgcgctgggtcgccagcagcgcgatcccgatcccggcagcgctgatctcgccgagcgcaccaatgcgctgttgcccggccattccgccgccatgcaggaggtgcgccgctcgctgctgcggctggcgcgcagcatggccccggtggtgatcagcggcgagtcgggcagcggcaaggagcgtgcggcgcgcgccatccatgcgctgtcggcacgctcgccgcggccgttcgtggcggtcaactgcggcgcgattcccgagaacctgatggaagccgagttcttcggctatgtgaaaggcgccttcaccggcgccgacagcgaccgccagggtttcttccaggcagcccatggcggcacgctcatgctcgacgaggtggccgacctgccgctgaccatgcaggtcaagctgctgcgccggctgcaggacggccgcgtgcgcaagatcggcgagagccgcgaagacccggtcgacgtgcgcgtggtgtgcgcgacgcaccagaatcttgcgcgcctggttgccgccggacgtttccgcgaagacctgttttaccggctgaacgtgctggagctgcgcatgccgacgctgcgcgagcgtgccgaggatgtgccggtcctggcgggcgtgctgctggagcaactggccacgcgttacggcgatccgcggccgaagcggctcacgcgccaggcgctgcagcagttgtgcgcctatccgttccccggcaacgtgcgcgacgtggacaacctgctggagcgtgcctacgccttcgccgagggcgagtcgatcgacgtggaccacctcggcgcgctgggttcagacatcgagcgctcgccgctgttccaccgagcgcgcgaggcgcacgccggccatccggtacatccggcgcacctcccgccggtgccggcgccgggccatccggcccatccggggcattccggccatgtcgcgcatccgctcggcgtgccgcagccggtgggcgggtggcccgatgccgccgcctacattcccgtgcccggcccgatgggcctggtgccgcatcccgccgccgtgccgttcgagcccgcgccggccgccgaaccggccgcgtcgcccatgcccgccgtgtccttgccggtggacctgccggcctacctcgaatcggtggagcgcagcgtgatcctggccgcactggcgcagaccggcttcaatcggacggcggccgccaagctgctcggcctgagcttccggcagttgcgttaccggatgcagcagctggacatccgcgatccgcgcgatattgacgccgcggcgggcaacggcggggtgggcgatgcctga

SEQ ID NO: 44178 - protein, 559 aa, Ralstonia solanacearum
MSKAAIVREPILVVDDEADLRELLEISLRRMGHDVVLAAGLGEAREALARQRFALVLTDMRLGDGLGIDLVRQLSATADRTPVAVITAYGSAENAVEALKAGAFDYIAKPLSLDQLRSLVLNALGRQQRDPDPGSADLAERTNALLPGHSAAMQEVRRSLLRLARSMAPVVISGESGSGKERAARAIHALSARSPRPFVAVNCGAIPENLMEAEFFGYVKGAFTGADSDRQGFFQAAHGGTLMLDEVADLPLTMQVKLLRRLQDGRVRKIGESREDPVDVRVVCATHQNLARLVAAGRFREDLFYRLNVLELRMPTLRERAEDVPVLAGVLLEQLATRYGDPRPKRLTRQALQQLCAYPFPGNVRDVDNLLERAYAFAEGESIDVDHLGALGSDIERSPLFHRAREAHAGHPVHPAHLPPVPAPGHPAHPGHSGHVAHPLGVPQPVGGWPDAAAYIPVPGPMGLVPHPAAVPFEPAPAAEPAASPMPAVSLPVDLPAYLESVERSVILAALAQTGFNRTAAAKLLGLSFRQLRYRMQQLDIRDPRDIDAAAGNGGVGDA

SEQ ID NO: 44179 - DNA, 1467 bp, Caulobacter crescentus
  CDS (1)..(1467)
atgaccaaaacggtccttgtcgtcgatgacgacccgacacaacgtcggttgattcaagcggtgctcgagcgcgacgggttcgcggtctcgcacgcggaaggcggcgacgcggcgatcgcgcacctgacgtccggcgcgcccgccgatgtcatcctgctggatctcgtcatgcctggcctcaacggtcaggacgccctgaaggaaatgcgcgcccgcggcttcaaccagcccgtgatcgtgctgacggccagcggtggcgtcgacaccgtggtcaaggccatgcaggccggcgcctgcgacttcttcatcaagcccgcctcgcccgagcggatcaccgtgtcgatccgcaacgccctgtcgatgggcgacctcaagggcgaggtcgagcggctgaccaagcgcgcgggcggcaagaccaccttcgcggacctgatcggcgcctcgccggtcatgaccatggtcaagcgcatgggcgagcgggccgccaagagcggtatcccggtgctgatcaccggcgaaagcggcgtcggcaaggagctgatcgcccgcgccgtccacggctcttccgaccgcgccggcaagccgtttgtcgcggtcaactgcggcgcgatccccgagaacctcgtcgagtcgatcctgttcggccacgagaagggctcgttcaccggcgccaccgacaagcatctgggcaagttcaaggaggccgacgcgggcaccctgttcctcgatgaggtcggcgagctgccgctcgacatgcaggtcaagctgctgcgcgccctgcaggagggcgagatcgacccgatcggctccaagcgctcgatcaaggtcgatgtccggatcgtgtcggcgaccaatcgcgatctgcagcaggccgtttcgggcggcccgttccgcgaagacctgttttatcgcctgaacgtgttcccgatcgaggcgccgtccctgcgcgagcgtcgcgaggacatcccggccctcgtcgaggcgttcatccgccggttcaacgtcgaagaaggcaagcgcgtgatcggcgcctcgcccgagacgatgcaactgctgaccagcttcgactggcccggcaatgtgcgccaactggaaaacaccgtctatcgcgccatcgtgctggccgatgcgccctatctgcagccgttcgacttcccggcgatctcgggcctggccgcgccgatcgaggccgtatcgatctcgccctcgccgccgcctgcagccctgttgcaagccacgcatgcggcgatggccgccgccgtcgcagaggcgcctgtgcgcatcctcgacgatcgcggtcacctgcggaccctggaggagatcgagcgcgacctcatccagcatgcgatcgacgtctatgccggccacatgagcgaggtcgcgcggcgtttgggcatcggtcgctcgaccctctatcgcaaggttcgcgagcagggcatcgaagtcgacatgaaggaagcgggctga

SEQ ID NO: 44180 - protein, 488 aa, Caulobacter crescentus
MTKTVLVVDDDPTQRRLIQAVLERDGFAVSHAEGGDAAIAHLTSGAPADVILLDLVMPGLNGQDALKEMRARGFNQPVIVLTASGGVDTVVKAMQAGACDFFIKPASPERITVSIRNALSMGDLKGEVERLTKRAGGKTTFADLIGASPVMTMVKRMGERAAKSGIPVLITGESGVGKELIARAVHGSSDRAGKPFVAVNCGAIPENLVESILFGHEKGSFTGATDKHLGKFKEADAGTLFLDEVGELPLDMQVKLLRALQEGEIDPIGSKRSIKVDVRIVSATNRDLQQAVSGGPFREDLFYRLNVFPIEAPSLRERREDIPALVEAFIRRFNVEEGKRVIGASPETMQLLTSFDWPGNVRQLENTVYRAIVLADAPYLQPFDFPAISGLAAPIEAVSISPSPPPAALLQATHAAMAAAVAEAPVRILDDRGHLRTLEEIERDLIQHAIDVYAGHMSEVARRLGIGRSTLYRKVREQGIEVDMKEAG

SEQ ID NO: 44181 - DNA, 1530 bp, Myxococcus xanthus
  CDS (1)..(1530)
atgaccgacgcgaacactccgccgacccgaggacggctcctcgtcgtggacgaccagcgcaacatgcgcgccaccaccgccctgttgttgcgggcggagaactacaccgtcttcgaggccgccaccggcgaggaagccctggcccagctcgccagcggcagcatcgacctgctgctgacggacctgaaaatggagcccatggacgggctcacgctcctgcggcgcgcgctggaggtggctccccggctccaggtcatcatgatgacggccttcggctccatcgagagcgccgtggaggccatgcgcctgggggcctacgactatgtcaccaagcccttcaaggagagcgagctgcgctaccgcgtggagcgcgccctggagcgcgcgcgcctgcagcgcgacgtggacaacctcaccaccgacttcaaccagcgccacggcctgtccgccctggtggggcgcagcgccgccatgcgcgagctcaccacgcggctgatgcgcgtggcgcagagtgacgccaccgtcctcatccagggcgagagcggcacgggcaaggagctggtggcgcgcgcgctccatgcgcacagccgccgcaaggcccgctccttcgtgcctgtcaactgcgcggccatcagcgagtccctgctggagagcgagctgttcggccacgccaagggcgccttcaccggtgcggtgaagtcccgccggggcctcttcgaggaggcggacggcggcacgctcttcatcgacgaggtgacggagaccagccccaccttccagtccaagctgctgcgcgccctccaggagggcgaggtccgccgcgtcggtgagtccaccgcgctgcgtgtggatgtgcgcatcgtcgccgccaccaaccgggacatcgagtcggaggtgcgcgacaagcgcttgcggcaggacctctactaccgcctcaacgtggtggccctccgcgtcccgcccctgcgcgagcgcctggaggacgtgccagcgctggcggagcacttcctggagcgggccaatgcccgcagccccaaccccaagcgcctttccgccgccgcggtgtctcacctgatgagctacggcttccccggcaacgtgcgcgagctggagaacctggtggagcaggccgccgcgctcgcggagggcgatgagctgctgcccgaggacttccccgtgcggcagggccgcatgacgccggcccatggcacccccagcgtcgccttcctggacgggcagggcggggcgctcgggcgcaacgccagcgcggggcccacgctggcccaggtggtggaagaggcggagcgccacgccatcacccaggccctggagcggcacggggtggacctggcgcgcgtcgcggatgagctcggcgtctcctccaccacgctctggcggaagatgaagcggctcaacctccgccccccagtgagctggcccgggaatagccctgaagtagggggaaggctcacccatgtaactttcccgcggccatggattcagatccgaaatggacgggttcataggtga

SEQ ID NO: 44182 - protein, 509 aa, Myxococcus xanthus
MTDANTPPTRGRLLVVDDQRNMRATTALLLRAENYTVFEAATGEEALAQLASGSIDLLLTDLKMEPMDGLTLLRRALEVAPRLQVIMMTAFGSIESAVEAMRLGAYDYVTKPFKESELRYRVERALERARLQRDVDNLTTDFNQRHGLSALVGRSAAMRELTTRLMRVAQSDATVLIQGESGTGKELVARALHAHSRRKARSFVPVNCAAISESLLESELFGHAKGAFTGAVKSRRGLFEEADGGTLFIDEVTETSPTFQSKLLRALQEGEVRRVGESTALRVDVRIVAATNRDIESEVRDKRLRQDLYYRLNVVALRVPPLRERLEDVPALAEHFLERANARSPNPKRLSAAAVSHLMSYGFPGNVRELENLVEQAAALAEGDELLPEDFPVRQGRMTPAHGTPSVAFLDGQGGALGRNASAGPTLAQVVEEAERHAITQALERHGVDLARVADELGVSSTTLWRKMKRLNLRPPVSWPGNSPEVGGRLTHVTFPRPWIQIRNGRVHR

SEQ ID NO: 44183 - DNA, 1503 bp, Herbaspirillum seropedicae
  CDS (1)..(1503)
atgaaaccaatctggattgttgacgacgacgaatcgatacgctgggtgctcgaaaaagcactggcccgggaaaatctcgccacacaaagtttttccagcgcacgcgatgccatcgccgccctgcaaaacgggacgccgcaagtactggtttccgacatccgcatgcccggcgcttccgggctggagttgctgcagaccgtcaaggccaagcatccgggcatcccggtgatcatcatcaccgcattctcggacctggactcggccgtctcggccttccagggcggtgctttcgaatacctggccaagcccttcgacgtcgacaaggcggtcgagctgatccgccgcgccctcgacgaaagcctgcgcgagaccgacatcgagcagggcgctgcacagacccccgagattctcggccaggccccggccatgcaggatgtgttccgcgccattggtcgcctgtcgcagtcgaacgtgaccgtgctcatcaccggcgagtccggctccggcaaggaactggtggcgcgcgccctgcacaagcacagcccgcgcgccagccagcccttcgtggcgctcaacacggcggccattcccaaggacttgctggaatccgaactgttcggtcacgagcgcggcgccttcaccggcgcgcaagccatgcgccgtggccgcttcgagcaggccgagggcggcaccttgttcctcgatgaaatcggcgacatgccgctggacctgcagacgcgcctgttgcgcgtcctctccgacggccacttctatcgcgtcggcggccatcaatccctgaaggccaatgtgcgcgtcattgccgccacccaccagaacctggaacaacgggtgcgtgaaggtctgttccgcgaagacttgtaccaccgcctcaacgtgatccgcctgcgcctgcccagcctgcgcgagcgcagcgaggacattcccatcctggcccgctacttcctggcgcagagcgcgcgccagctcggcgtggaagccaagcggctctcgccgcaggccatgcagttcctgtcgcagctggaattccccggcaacgtgcgccagctggagaacctgtgcaactggatcaccgtgatggcccctggccagaccgtggaaatcaaggacctgccgcaagacctggtggaagagcgcgtgcatgcgccgcaaccggcccagaaccgtggctgctccggcatcggcggcagcccttccgacggcctataccgagcctgcccgggcgtggcgtccgcgtcggccgatggcgctgccggcgccagctggatcacgctgctggaaaccgaagccgcgcagatgctggcctctgaacagcccgaggtgatggacatcctcggtcgccagttcgaggctgcgctgatcaaggtcgccctgaagcatacccatggccgcaagaacgatgccgccgtgcgcctgggcatcggacgtaataccatcacccgcaagatccagaagctgggcatcggcggcgcggaagacgactga

SEQ ID NO: 44184 - protein, 500 aa, Herbaspirillum seropedicae
MKPIWIVDDDESIRWVLEKALARENLATQSFSSARDAIAALQNGTPQVLVSDIRMPGASGLELLQTVKAKHPGIPVIIITAFSDLDSAVSAFQGGAFEYLAKPFDVDKAVELIRRALDESLRETDIEQGAAQTPEILGQAPAMQDVFRAIGRLSQSNVTVLITGESGSGKELVARALHKHSPRASQPFVALNTAAIPKDLLESELFGHERGAFTGAQAMRRGRFEQAEGGTLFLDEIGDMPLDLQTRLLRVLSDGHFYRVGGHQSLKANVRVIAATHQNLEQRVREGLFREDLYHRLNVIRLRLPSLRERSEDIPILARYFLAQSARQLGVEAKRLSPQAMQFLSQLEFPGNVRQLENLCNWITVMAPGQTVEIKDLPQDLVEERVHAPQPAQNRGCSGIGGSPSDGLYRACPGVASASADGAAGASWITLLETEAAQMLASEQPEVMDILGRQFEAALIKVALKHTHGRKNDAAVRLGIGRNTITRKIQKLGIGGAEDD

SEQ ID NO: 44185 - DNA, 1386 bp, Eubacterium acidaminophilum
  CDS (1)..(1386)
atgaaatcggactcaagcttcagaatactaatagttgatgatgaagatgaatacagagacatactaaaaagaatactggaaatcaatgcatacgatgctgacaccgcggtcagtggccaggatgcacttgtaaagataaaaaaagatgagtacgatcttgtgcttagcgatctaataatgccgggaatggacggtgtggagttgctaggcgaaataaaaaaaataaaaaaggacatcgaggtgatacttgtcacgggctatggcagcatcgagaatgcagtcgaagccatgaggaagggagccttttcatactttgtaaaagggaatgctcctgaggagctgctcggcgaaatcgaaaaggttcgtgaaagcgcggcgctgcaaaacaagatgaagcagcatatcagcgatagcctgggcggagagttcctacttggcacaaggagcgagaagttcaaaaaggcacttcagaccgcagaaaaggccgcaaagagtaatattacaatactgcttctgggagagtctggtgttggtaaggaggtatttgcaaaatatattcatagctgcagcgaaagaaaggataagccttttatagctgtaaactgctgtgcattttcggaaagccttctggaatcagagctctttggacatgagaaaggtgcctttaccggggcctcggactccagaaagggaagattcgaggcggcagacaagggcacgctttttctggatgaaataggtgatgtgtcgctcgacatacaggtaaagcttcttagagttctcgagaccagaaggatagaaaagattggcagcaacgttcctgcgcctgtggatttcaggctcatatgcgcaactaacaaggacctgcagcaggagatggtcgaaggaagaattagagaagatttcttctacagaatcagttcaatagtaattactattccaccgcttcgggagaggcgggaggacctgccggatttaatagaattttttcttggcaaggcgcagcttgaaatgggaaaagagataacgtcggtacaaaaagaagtaatgagcttcctgctttcatacgattatccgggaaatatacgcgagctgagaaacatattaaacaggcttgtagtgctttctgaaaatggggttctcagggcgagcgaccttccaaatgttgaaaatcaggcggatgtgctctgcgaatacgacgtcaggccgcttagggatatacggcgcgatttcgaatcggaatatatcgaaagagtgctcgaggtctgcggcaacaatgtgtcaaaggcggcaaagctgctcgacataagcaggaggcaactgaccaaaaaaatagctgaattcggcttgagggaagcttcacagccttccgaaatggttgactag

SEQ ID NO: 44186 - protein, 461 aa, Eubacterium acidaminophilum
MKSDSSFRILIVDDEDEYRDILKRILEINAYDADTAVSGQDALVKIKKDEYDLVLSDLIMPGMDGVELLGEIKKIKKDIEVILVTGYGSIENAVEAMRKGAFSYFVKGNAPEELLGEIEKVRESAALQNKMKQHISDSLGGEFLLGTRSEKFKKALQTAEKAAKSNITILLLGESGVGKEVFAKYIHSCSERKDKPFIAVNCCAFSESLLESELFGHEKGAFTGASDSRKGRFEAADKGTLFLDEIGDVSLDIQVKLLRVLETRRIEKIGSNVPAPVDFRLICATNKDLQQEMVEGRIREDFFYRISSIVITIPPLRERREDLPDLIEFFLGKAQLEMGKEITSVQKEVMSFLLSYDYPGNIRELRNILNRLVVLSENGVLRASDLPNVENQADVLCEYDVRPLRDIRRDFESEYIERVLEVCGNNVSKAAKLLDISRRQLTKKIAEFGLREASQPSEMVD

SEQ ID NO: 44187 - DNA, 1446 bp, Azospirillum brasilense
  CDS (1)..(1446)
atgagcgcacgcacgatcctggttgcggacgacgaccgcgccatccgcaccgttctgacccaggcactcgcccgtctcgggcacgaggtgcgcaccaccggcaatgcctccacgctctggcgctgggtggcggacgggcagggcgacctcatcatcaccgacgtggtgatgcccgacgagaacgggctggacctgattccgcggatcaagaagatccggcccgatctgcgcatcatcgtgatgagcgcgcagaacacgctgatcacagcggtgaaggcggcggagcgcggtgccttcgagtatctgcccaagcccttcgacctgaaggagctggtctcagtcgtcgaacgggcactgaactccaacacgccgccggcggccttgcccgccgacgccggcgaggcggacgagcagcttcccctgatcggacgctcgccggccatgcaggagatctaccgcgtccttgcccgtttgatgggcaccgacctgacggtgacgattaccggcgagtcgggaaccggcaaggagctggtggcccgcgcgctgcacgattacggcaagcggcgcaacggccccttcgtcgcgatcaacatggcggccattccgcgcgaactgatcgagtccgagctgttcggtcacgagaagggcgccttcaccggagccaccaaccgctccaccggccggttcgagcaggcgcagggcggcaccctgttcctcgacgagatcggcgacatgccgctggaggcgcagacccgcctgctgcgcgtgctacaggaaggcgagtacacgaccgtcggcggacgtacaccgatcaagacggacgtacgcatcgtcgccgcgacccaccgcgatctgcgcaccctgatccgccagggcctgttccgcgaggacctgttctaccgcctgtgcgtcgtccctatccgcctgccgccgctgcgcgagcgtacggaggacgtaccgctcttggttcgccacttcctgaaccaatgctcggcccaagggctgccggtgaagagcatcgaccagcctgccatggaccggttgaagcgctaccgctggccgggcaacgtgcgcgagctggaaaacctcgtccgccgcctcgccgcgctctattcgcaagaggtcattgggctcgacgtggtggaggcggagcttgccgataccacccccgctgcccaaccggtggaggaaccgcagggcgagggcctgtccgccgccgtggagcgccatctcaaggattatttcgccgcgcacaaggacggcatgccgtcgaacggactgtacgaccgggtgctccgcgaggtggagcggccgctgatctcgctcagcctctcggcgacgcggggcaaccagatcaaggcggcgcaactcctcgggctcaaccgcaacacattgcgcaagaagatccgcgacctcgacatccaggtggtgcgcgggctgaagtga

SEQ ID NO: 44188 - protein, 481 aa, Azospirillum brasilense
MSARTILVADDDRAIRTVLTQALARLGHEVRTTGNASTLWRWVADGQGDLIITDVVMPDENGLDLIPRIKKIRPDLRIIVMSAQNTLITAVKAAERGAFEYLPKPFDLKELVSVVERALNSNTPPAALPADAGEADEQLPLIGRSPAMQEIYRVLARLMGTDLTVTITGESGTGKELVARALHDYGKRRNGPFVAINMAAIPRELIESELFGHEKGAFTGATNRSTGRFEQAQGGTLFLDEIGDMPLEAQTRLLRVLQEGEYTTVGGRTPIKTDVRIVAATHRDLRTLIRQGLFREDLFYRLCVVPIRLPPLRERTEDVPLLVRHFLNQCSAQGLPVKSIDQPAMDRLKRYRWPGNVRELENLVRRLAALYSQEVIGLDVVEAELADTTPAAQPVEEPQGEGLSAAVERHLKDYFAAHKDGMPSNGLYDRVLREVERPLISLSLSATRGNQIKAAQLLGLNRNTLRKKIRDLDIQVVRGLK

SEQ ID NO: 44189 - DNA, 1413 bp, Myxococcus xanthus
  CDS (1)..(1413)
ctggggtcgcgcggccacatcctcgtggtcgatgacgagctgtccatgcgtgagtacctcgagctgttgcttcagcgggaggggtactcggtgacgagcgtggccagtgtgaaggccgcatgtgatgtgctggccctggacggagtggacctggtcatctccgacttgaagctgggcacgggcagtggcctcgacgtcctgcgggcggcccgggcccggtcggcttctcccgaggtggtgctcatcactgcctatggcacgcccgcggcagcggtcgaagcgatgcgggaaggcgcttacgactacatctgcaagcccttcgacaacgaggagttgcggctcctggtgcagaaggcgctggagaagcgaacgctccgtcaggagaacagtggtctcagggcgcggctatttcctggcctggatggcgcggtgggtcagagcgagcgcatgcaggcggtctgggccttggtggagaaagtcgcttccggccgcagcacggtgctggtgacgggggagagcgggacgggcaaggaactggtggcgcgggccatccatatgcgcggcactcgagccgcgcgtcccttcctgcccttcaactgcgcggcgttgaacgaggggacgctggagagcgagctctttgggcatgtgaagggggcattcactggcgcgaccaccgaccgctctggcctcctggtggccgcaggcgatggcaccgtcatgttggacgaggtcggggagatgccgctcgcgacgcaggtgaagctgcttcgtgtgctccaggagcggaaggtgaagccggtcggcagcgccgcggagattcccttccaggcgcgtgtcatcgcggcaacgaaccggcggctcgaagccgaagtaaaggccggacgctttcgtgaggacctcttctaccggctcaacgtcatcacgttggagctgcctccactgcgcgagcgttccggcgacgtgtcgttgctggcgaactacttcctgtccagactgtcggaggagttggggcgacccggtctgcgtttctcccccgagacactggggctattggagcgctatcccttcccaggcaacgtgcggcagctgcagaacatggtggagcgggccgcgaccctgtcggattcagacctcctggggccctccacgcttccacccgcagtgcggggcgatacagaccccgccgtgcgtcccgtggagggcagtgagccagggctggtggcgggcttcaacctggagcggcatctcgacgacagcgagcggcgctatctcgtcgcggcgatgaagcaggccgggggcgtgaagacccgtgctgcggagttgctgggcctttcgttccgttcattccgctaccggttggccaagcatgggctgacggatgacttggagcccgggagcgcttcggatgcgtag

SEQ ID NO: 44190 - protein, 470 aa, Myxococcus xanthus
MGSRGHILVVDDELSMREYLELLLQREGYSVTSVASVKAACDVLALDGVDLVISDLKLGTGSGLDVLRAARARSASPEVVLITAYGTPAAAVEAMREGAYDYICKPFDNEELRLLVQKALEKRTLRQENSGLRARLFPGLDGAVGQSERMQAVWALVEKVASGRSTVLVTGESGTGKELVARAIHMRGTRAARPFLPFNCAALNEGTLESELFGHVKGAFTGATTDRSGLLVAAGDGTVMLDEVGEMPLATQVKLLRVLQERKVKPVGSAAEIPFQARVIAATNRRLEAEVKAGRFREDLFYRLNVITLELPPLRERSGDVSLLANYFLSRLSEELGRPGLRFSPETLGLLERYPFPGNVRQLQNMVERAATLSDSDLLGPSTLPPAVRGDTDPAVRPVEGSEPGLVAGFNLERHLDDSERRYLVAAMKQAGGVKTRAAELLGLSFRSFRYRLAKHGLTDDLEPGSASDA

SEQ ID NO: 44191 - DNA, 1422 bp, Pseudomonas aeruginosa
  CDS (1)..(1422)
atggcagccaaagtcctgctggtcgaagacgaccgcgcactacgcgaagccctcagcgacaccctgctgctgggcggtcacgagttcgtcgccgtggactcggcggaggcggcgctgccggtcctggcccgcgaagccttcagcctggtgatcagcgacgtgaacatgccgggcatggacggacaccagttgctcggcctgatccgtacacgctacccgcacctgccggtgttgctgatgaccgcctacggcgcggtcgatcgcgccgtcgaggcgatgcgccagggcgccgccgactacctggtcaagccgttcgaggcgcgggcgctgctcgacctggtggcacgccatgcgctgggccagttgccggcctgcgaggaggatggtccggtggccctggagccggccagccggcagttactggaactggccgcgcgggtcgcgcgcagcgattccaccgtgctgatctccggcgagtccgggaccggcaaggaagtcctggccaactatatccaccagcaatcgccgcgtgccggcaagccgttcatcgcgatcaactgcgcggcgatcccggacaacatgctcgaggccaccctgttcggccacgagaaaggttccttcaccggcgccattgccgcccagcccggcaagttcgagctggccgacggcggcaccattcttctcgacgagatatcggaaatgcccctcggcctgcaggccaagttgctgcgcgtattgcaggagcgcgaggtggagcgggtcggtgcgcgcaaaccgatcaacctggatatccgcgtgcttgccacgaccaaccgcgacctcgcggcggaagtcgcggcggggcgtttccgcgaggacctctactatcgcctgtcggtcttcccgctggcctggcggccgctgcgcgaacgccctgcggacatcctgccgctggccgagcgtctgctgcgcaagcacagccgcaagatgaacctcggcgcggtggcgctcggccccgaggccgcccagtgcctggtccggcatgcctggccgggcaacgtacgggaactcgacaacgccatccagcgtgcgttgatcctgcaacagggcggcctgatccagcccgccgacctgtgcctcaccgcgccgatcggcatgccgctcgcggccccggtgccggtgcccatgccggcaatgccaccggccaccccgccgagcgtcgagattccgtcgccggccgcaggccaggacgctagcggcgcgctgggcgacgacctgcgccgccgcgaattccaggtgatcatcgataccctgcgcaccgagcgcggccgccgcaaggaggccgccgagcgccttggcatcagcccgcggaccctgcgctacaagctcgcccagatgcgcgacgcggggatggacgtggaggcctatctctacgccatctga

SEQ ID NO: 44192 - protein, 473 aa, Pseudomonas aeruginosa
MAAKVLLVEDDRALREALSDTLLLGGHEFVAVDSAEAALPVLAREAFSLVISDVNMPGMDGHQLLGLIRTRYPHLPVLLMTAYGAVDRAVEAMRQGAADYLVKPFEARALLDLVARHALGQLPACEEDGPVALEPASRQLLELAARVARSDSTVLISGESGTGKEVLANYIHQQSPRAGKPFIAINCAAIPDNMLEATLFGHEKGSFTGAIAAQPGKFELADGGTILLDEISEMPLGLQAKLLRVLQEREVERVGARKPINLDIRVLATTNRDLAAEVAAGRFREDLYYRLSVFPLAWRPLRERPADILPLAERLLRKHSRKMNLGAVALGPEAAQCLVRHAWPGNVRELDNAIQRALILQQGGLIQPADLCLTAPIGMPLAAPVPVPMPAMPPATPPSVEIPSPAAGQDASGALGDDLRRREFQVIIDTLRTERGRRKEAAERLGISPRTLRYKLAQMRDAGMDVEAYLYAI

SEQ ID NO: 44193 - DNA, 1401 bp, Thiobacillus ferrooxidans
  CDS (1)..(1401)
atgacacaagtctggattatcgatgacgacccttccattcgctgggttttggagaaggcgttgactcaggccgatatcctggtgcgcagctttgcagacgccgacagcgcgctgcgggccttggggcgtgagcagccaggggccgttgtcaccgatctgcgtatgcccggcctggacggattggcgtttctgcgcgaagttcagtcgcgctggccaaaactgccggtgatcgtgatgacggcgcactctgatctcgacaatgccgtcgccgcttttcaaagtggggcctttgagtatctgcccaagccgtttgacatggacgaggcggttacgctggtgcagcgcgccctcggcagccgggctggaccgggcgcggcgggtgtggaggagagcgatccggcggaaatgatcggtgaggctccggccatgcaagaggtgtttcgtgccatcgggcgtctgtcgcgctcacagatcaatgtgctgattaccggcgaatcgggatccggcaaggaactggtggccagtgcactgcaccggcacagcccccgtgcgcgcggacctttcattgccatcaacacggcggccattcccgccgagttgctggaatcggaacttttcggccatgaaaagggcgcttttaccggggcggtgcagactcggcaggggcgcttcgagcaggcctccgggggaaccctctttctggatgaaatcggcgatatgccggccgccctgcaaacgcgcctgctgcgggtgctttccgacggcactttctatcgggtcggtggccacgcgccccagcgtgcggacgtccgcgtcctcgccgcgacccaccagaacctcgaagccaaggtgcgcgatggcagcttccgggaagatctctaccaccgtctcaacgtcatccatatccatcttccgcccatacgcgagcggcgtgaggacattccgcgtctggcccgccattttctccgtcgtagcgcggagcaactggatgtcgagcggcgaatattgagcccggagcgagtcgccttcatgaactggcattggcccggcaatgtgcgccaattggaaaacgtctgtcgctggattacggtgatggcacccacccgcgaggtccaggtgacggatttgccgccggaaatggccgcatcgccgatgtccgccatgatgccggatccgaacacccaggattggcgcctgctgctgggggcggtggtgcggcacgtctcgcggcgtgaagaagccttgctggacaagattcagccgctgttcgaacgctgtctgctggaagcggccctgcaacatacccgtggccataagcagagcgccgcgcacaaactcgggtgggggcgcaatacgctcacccgcaagctgaaagagttgggcatggcggaggatacgtaa

SEQ ID NO: 44194 - protein, 466 aa, Thiobacillus ferrooxidans
MTQVWIIDDDPSIRWVLEKALTQADILVRSFADADSALRALGREQPGAVVTDLRMPGLDGLAFLREVQSRWPKLPVIVMTAHSDLDNAVAAFQSGAFEYLPKPFDMDEAVTLVQRALGSRAGPGAAGVEESDPAEMIGEAPAMQEVFRAIGRLSRSQINVLITGESGSGKELVASALHRHSPRARGPFIAINTAAIPAELLESELFGHEKGAFTGAVQTRQGRFEQASGGTLFLDEIGDMPAALQTRLLRVLSDGTFYRVGGHAPQRADVRVLAATHQNLEAKVRDGSFREDLYHRLNVIHIHLPPIRERREDIPRLARHFLRRSAEQLDVERRILSPERVAFMNWHWPGNVRQLENVCRWITVMAPTREVQVTDLPPEMAASPMSAMMPDPNTQDWRLLLGAVVRHVSRREEALLDKIQPLFERCLLEAALQHTRGHKQSAAHKLGWGRNTLTRKLKELGMAEDT

SEQ ID NO: 44195 - DNA, 1461 bp, Vibrio anguillarum
  CDS (1)..(1461)
atgcaacctgacttttctctacaaaaggctaaatatcttttgatggtggaagatacggcttccgttgcggcgctgtatcgttcatacctcaccccccttgaaatcgatatcaatattgttggtacaggtcgtgatgcgatagagagtttagctcaccgagagccggacctcatattgctggatcttcgattacccgatatgacgggcatggacgttttacatgctgtgaaaagtcactaccccaatgtgccagtgatattcatgaccgctcatggttcgattgataccgcagtggaagcgatgcgtcacggtgcccaagatttcttgatcaaaccttgtgaagcagaccgcttgcgcgtcacggttaacaacgccatacgtaaagctagcaaactaaaaaatgaggctggtaacccgggtaatcagaactaccaaggttttatcggcagcagtcaaaccatgcaatcagtctatcgaaccattgactcagcggcctccagtaaagctagtatttttattactggcgaaagtggtacgggtaaagaggtgtgcgcagaagcgattcatgcggccagtaaacgtggcgataaacccttcattgcgattaactgcgccgccattcctaaagacttaatagagagtgaactctttggccacgtgaaaggcgcatttactggcgcagcgaccgatcgccaaggcgcagccgagttggctgatggcggcacactgtttttggatgaactgtgtgaaatggatttggatttgcagaccaagctgttgcgctttatccaaacgggcacattccagaaagtgggctcatcgaagatgaaaagtgtcgatgttcgttttgtctgcgctaccaaccgcgatccatggaaagaggtacaagagggtcgttttcgtgaagatttgtactatcgtctttatgtgatcccattgcatttaccaccgctacgcgagcgaggcgatgacgttattgaaattgcttactctttgctcggctttatgtctaaagaagaaggcaaaggttttgtccgcttagcgccagaggttgtggagcgttttacgcgctatgaatggccgggtaatgtgcgtcaactgcaaaacgtgttgcggaatgtggtggtattgaaccacggcaacgagatcgaactgagcatgttaccgccaccgctaaatcaagtcgtggataacaagatccgattagcaaacctaacgacggaaacgcgcaaggaaaatataaccgtgcacgatatttttcctttatggatgacggaaacgcgcaaggaaaatataaccgtgcacgatatttttcctttatggatgacggaaaagcaagccatcgaacaagcgatagaagcgtgtgatggtaatattcctaaagcagccagttatttagacgttagcccttcaacgatctaccgcaagcttcaagcgtggaacagtagagagaactcatag

SEQ ID NO: 44196 - protein, 486 aa, Vibrio anguillarum
MQPDFSLQKAKYLLMVEDTASVAALYRSYLTPLEIDINIVGTGRDAIESLAHREPDLILLDLRLPDMTGMDVLHAVKSHYPNVPVIFMTAHGSIDTAVEAMRHGAQDFLIKPCEADRLRVTVNNAIRKASKLKNEAGNPGNQNYQGFIGSSQTMQSVYRTIDSAASSKASIFITGESGTGKEVCAEAIHAASKRGDKPFIAINCAAIPKDLIESELFGHVKGAFTGAATDRQGAAELADGGTLFLDELCEMDLDLQTKLLRFIQTGTFQKVGSSKMKSVDVRFVCATNRDPWKEVQEGRFREDLYYRLYVIPLHLPPLRERGDDVIEIAYSLLGFMSKEEGKGFVRLAPEVVERFTRYEWPGNVRQLQNVLRNVVVLNHGNEIELSMLPPPLNQVVDNKIRLANLTTETRKENITVHDIFPLWMTETRKENITVHDIFPLWMTEKQAIEQAIEACDGNIPKAASYLDVSPSTIYRKLQAWNSRENS

SEQ ID NO: 44197 - DNA, 1446 bp, Azospirillum brasilense
  CDS (1)..(1446)
atgagcgcagccacgatcctggttgcggacgacgaccgcgccatccgcaccgttctgacccaggcactcgcccgtctcgggcacgaggtgcgcaccaccggcaatgcctccacgctctggcgctgggtggcggacgggcagggcgacctcatcatcaccgacgtggtgatgcccgacgagaacgggctggacctgattccgcggatcaagaagatccggcccgatctgcgcatcatcgtgatgagcgcgcagaacacgctgatcacagcggtgaaggcggcggagcgcggtgccttcgagtatctgcccaagcccttcgacctgaaggagctggtctcagtcgtcgaacgggcactgaactccaacacgccgccggcggccttgcccgccgacgccggcgaggcggacgagcagcttcccctgatcggacgctcgccggccatgcaggagatctaccgcgtccttgcccgtttgatgggcaccgacctgacggtgacgattaccggcgagtcgggaaccgacaaggagctggtggcccgcgcgctgcacgattacggcaagcggcgcaacggccccttcgtcgcgatcaacatggcggccattccgcgcgaactgatcgagtccgagctgttcggtcacgagaagggcgccttcaccggagccaccaaccgctccaccggccggttcgagcaggcgcagggcggcaccctgttcctcgacgagatcggcgacatgccgctggaggcgcagacccgcctgctgcgcgtgctacaggaaggcgagtacacgaccgtcggcggacgtacaccgatcaagacggacgtacgcatcgtcgccgcgacccaccgcgatctgcgcaccctgatccgccagggcctgttccgcgaggacctgttctaccgcctgtgcgtcgtccctatccgcctgccgccgctgcgcgagcgtacggaggacgtaccgctcttggttcgccacttcctgaaccaatgctcggcccaagggctgccggtgaagagcatcgaccagcctgccatggaccggttgaagcgctaccgctggccgggcaacgtgcgcgagctggaaaacctcgtccgccgcctcgccgcgctctattcgcaagaggtcattgggctcgacgtggtggaggcggagcttgccgataccacccccgctgcccaaccggtggaggaaccgcagggcgagggcctgtccgccgccgtggagcgccatctcaaggattatttcgccgcgcacaaggacggcatgccgtcgaacggactgtacgaccgggtgctccgcgaggtggagcggccgctgatctcgctcagcctctcggcgacgcggggcaaccagatcaaggcggcgcaactcctcgggctcaaccgcaacacattgcgcaagaagatccgcgacctcgacatccaggtggtgcgcgggctgaagtga

SEQ ID NO: 44198 - protein, 481 aa, Azospirillum brasilense
MSAATILVADDDRAIRTVLTQALARLGHEVRTTGNASTLWRWVADGQGDLIITDVVMPDENGLDLIPRIKKIRPDLRIIVMSAQNTLITAVKAAERGAFEYLPKPFDLKELVSVVERALNSNTPPAALPADAGEADEQLPLIGRSPAMQEIYRVLARLMGTDLTVTITGESGTDKELVARALHDYGKRRNGPFVAINMAAIPRELIESELFGHEKGAFTGATNRSTGRFEQAQGGTLFLDEIGDMPLEAQTRLLRVLQEGEYTTVGGRTPIKTDVRIVAATHRDLRTLIRQGLFREDLFYRLCVVPIRLPPLRERTEDVPLLVRHFLNQCSAQGLPVKSIDQPAMDRLKRYRWPGNVRELENLVRRLAALYSQEVIGLDVVEAELADTTPAAQPVEEPQGEGLSAAVERHLKDYFAAHKDGMPSNGLYDRVLREVERPLISLSLSATRGNQIKAAQLLGLNRNTLRKKIRDLDIQVVRGLK

SEQ ID NO: 44199 - DNA, 1395 bp, Xanthomonas campestris
  CDS (1)..(1395)
atgaacgaaacgaaaagtgccctggtcgtcgatgacgagcgtgacatccgcgaattgcttgttctcaccctgggccgcatggggctgcgcatcagcaccgccgccaacctggccgaagcacgcgaattgctggccagcaacccgtacgacctgtgcctgaccgacatgcggttgcccgacggcaacggcatcgagctggtgaccgagatcgcgcgccaatacccgcagacgccggtggccatgatcaccgcgttcggcagcatggacctggcggtggaagcgctgaaagccggcgcgttcgacttcgtcagcaagccggtggacatcagcgtgctgcgcggcctggtcaagcacgcactggaattgaacaaccgcgaccggccggcgccgccaccgcctccgctggaacaggccagccgcctgctcggcgattcgaccgccatggagagcctgcgctccaccatcggcaaggtcgcgcgcagccaggcgccggtctacatcgttggcgaatccggcgtgggcaaggaactggtggcccgcaccatccacgagcagggcgcgcgcgcggccgggccgttcattccggtcaactgcggcgcgatccccgccgagctgatggagagcgagttcttcggccataagaagggcagctttaccggcgcgcatgccgacaaaccgggtctgtttcaggccgcgcatggcggcacgctgtttctggacgaagtggccgagctgccgctgcagatgcaggtcaagctgctgcgcgccatccaggaaaaatcagtgcgcccggtcggcgcctcgggcgagacgctggtggacgtgcgcattctgtcggccacacacaaggacctgggcgacctggtctccgacggccgctttcgtcacgatctgtattaccgcatcaacgtgatcgagctgcgtgtgccaccgctgcgcgagcgcagtggcgacctgccgcaactggccgccgccatcattgcgcgcctggcccgcagccatggccgcccgatcccgctgctgacccagtcagccctggatgcattggatacttacggctttccgggcaacgtgcgcgaactggaaaacatcctcgaacgcgccctggccctggccgaagacgaccagatcagcgccagcgatctgcgcctacccgcccacggcggccatcgccttgccgccagccccggcagcgccgccatcgaaccgcgcgaagcggtcgtcgacatcgatccggcctcctctgccctgccctcctacatcgagcaactggaacgcgccgcgatccagaaggcgctggaagaaaaccgctggaacaagaccaagaccgccgcccagctcggcatcacgtttcgtgcgttgcgctacaagctgaagaaattggggatggagtag

SEQ ID NO: 44200 - protein, 464 aa, Xanthomonas campestris
MNETKSALVVDDERDIRELLVLTLGRMGLRISTAANLAEARELLASNPYDLCLTDMRLPDGNGIELVTEIARQYPQTPVAMITAFGSMDLAVEALKAGAFDFVSKPVDISVLRGLVKHALELNNRDRPAPPPPPLEQASRLLGDSTAMESLRSTIGKVARSQAPVYIVGESGVGKELVARTIHEQGARAAGPFIPVNCGAIPAELMESEFFGHKKGSFTGAHADKPGLFQAAHGGTLFLDEVAELPLQMQVKLLRAIQEKSVRPVGASGETLVDVRILSATHKDLGDLVSDGRFRHDLYYRINVIELRVPPLRERSGDLPQLAAAIIARLARSHGRPIPLLTQSALDALDTYGFPGNVRELENILERALALAEDDQISASDLRLPAHGGHRLAASPGSAAIEPREAVVDIDPASSALPSYIEQLERAAIQKALEENRWNKTKTAAQLGITFRALRYKLKKLGME

SEQ ID NO: 44201 - DNA, 1359 bp, Borrelia burgdorferi
  CDS (1)..(1359)
atgagcaaaatacttgtagctgatgatgaaaagaatattagagaaggaattgctacttatcttgaggatgaaggatattttgttttcactgctagtgacggagaagaagctcttgaaacaattgaaaatgaaaatcttgatgtaataatatctgacctgagaatgcctcagatatctggagaaaaattgctcaaaatagttaaagaaaaaaacttgggaataccttttattattctaacagcccacggaacagttgattctgctgtagatgccatgagagagggtgcttatgattttttaacaaagcccttagaccttgaaagacttttgctaataataaaaagatcactaaataaaaaagaaaataacgatgatgaaaatcctaatttagaaaatatactaataagaaaagatctaaaatactatgaaaaaatcatgggaaaatccctattaatgcaaaaaatttttgaacttgtaataaaaatagcaaaatcaaatgcatctgttcttataacaggcgaaagcggtgttggtaaagaaataatagcagatgctatttttgatctttcaaatagaaatgacaaaccatttataaaagtaaattgcgcagcactttctgaaagcattcttgaaagtgaactttttggccatgaaaaaggagcattcactggagcaatttccaaaaaaaaaggcagatttgaacttgcaaacaaaggcacaatttttcttgatgagatagcagaaatttcacctgaaattcaagtcaaacttttaagagtactgcaaaacaaaacttttgaacgtgttgggggagaagctacaattaaagttgatatcaggcttctggctgcaacaaacaaaaacattgaagaggaaattaaaaaggaaaaatttagagaagatttattttatagattaaatatcattaatataaacataccgcctttaagagaaagaaaagatgatatatcttatttaacaaacatactaataaaagacgtcgcaaaggaaaacaatagagaagaaaaaactctttctaatgatgcaatgaaagctctctattattacgattggccaggaaatattagagaattaaaaaatgtgcttgaaagcgcattaatattatcaaaaggcaaacaaatcactaaagaagatttaccagcaaaaatcaaaaataatgaaaatcttatatttaaaataacactaccaataggaattagcctaaaagaagccgaaaaagaaataataaaacaaacactttttcattccaaaaacaacaaaagcaaatgcgccgaaatactaaaaataggaagaaaaactttacacaataaaataatcgaatataatattgatcaatag

SEQ ID NO: 44202 - protein, 452 aa, Borrelia burgdorferi
MSKILVADDEKNIREGIATYLEDEGYFVFTASDGEEALETIENENLDVIISDLRMPQISGEKLLKIVKEKNLGIPFIILTAHGTVDSAVDAMREGAYDFLTKPLDLERLLLIIKRSLNKKENNDDENPNLENILIRKDLKYYEKIMGKSLLMQKIFELVIKIAKSNASVLITGESGVGKEIIADAIFDLSNRNDKPFIKVNCAALSESILESELFGHEKGAFTGAISKKKGRFELANKGTIFLDEIAEISPEIQVKLLRVLQNKTFERVGGEATIKVDIRLLAATNKNIEEEIKKEKFREDLFYRLNIININIPPLRERKDDISYLTNILIKDVAKENNREEKTLSNDAMKALYYYDWPGNIRELKNVLESALILSKGKQITKEDLPAKIKNNENLIFKITLPIGISLKEAEKEIIKQTLFHSKNNKSKCAEILKIGRKTLHNKIIEYNIDQ

SEQ ID NO: 44203 - DNA, 1338 bp, Pseudomonas aeruginosa
  CDS (1)..(1338)
atgagccgacaaaaagccctgatcgtcgacgatgaaccggatatccgcgaactgctggaaatcactctcggccgcatgaagctggacacccgcagcgcccgcaacgtcaaggaagcccgcgagttgctggcccgcgagccgttcgacctgtgcctcaccgacatgcgcctgccggacggcagcggcctcgatctggtccagtacatccagcagcgccatccacagaccccggtggccatgatcaccgcgtacggcagcctggacaccgcgatccaggcgctcaaggccggtgccttcgacttcctcaccaaaccggtcgacctcggtcgcttgcgggagctggtggcaaccgccctacgcttgcgcaacccggaagccgaggaagcgccggtggacaaccgcctgctcggcgagtcgccgccgatgcgcgccctgcgcaaccagatcggcaagctggcgcgcagccaggcgccggtctacatcagtggcgagtccggcagcggcaaggaactggtggcgcgcctgatccacgagcaggggccacgtatcgagcggccgttcgtgccggtgaactgcggcgcgattccctccgagctgatggaaagcgagttcttcggccacaagaaaggcagcttcactggcgctatcgaagacaagcagggcctgttccaggccgccagcggtggcaccctgttcctcgacgaagtcgccgacctgccgatggccatgcaggtcaaactgctccgggcgatccaggaaaaggccgtgcgcgcggtcggcggccagcaggaggtcgccgtcgacgtgcgcatcctctgcgccacccacaaggacctcgccgccgaagtcggcgccgggcgcttccgccaggacctctactaccgcctcaacgtcatcgagctgcgcgtacagccgctgcgcgaacgccgcgaggacatcccgctgctcgccgaacgcatcctcaagcgcctggccggcgacaccggcctgccggccgccaggctgaccggcgacgcacaggagaagctgaagaactaccgcttcccgggcaacgtccgcgagctggaaaacatgctggagcgcgcctataccctgtgcgaagacgaccagatccagcctcacgacctgcgcctggccgatgcgccgggtgccagccaggaaggcgccgcgagcctgagcgaaatcgacaacctcgaggactacctggaagacatcgagcgcaagctgatcatgcaggcactcgaggagacccgctggaaccgcaccgccgcggcccagcgcctgggcctgacgttccgctcgatgcgctaccgcctgaaaaagctgggcatcgactga

SEQ ID NO: 44204 - protein, 445 aa, Pseudomonas aeruginosa
MSRQKALIVDDEPDIRELLEITLGRMKLDTRSARNVKEARELLAREPFDLCLTDMRLPDGSGLDLVQYIQQRHPQTPVAMITAYGSLDTAIQALKAGAFDFLTKPVDLGRLRELVATALRLRNPEAEEAPVDNRLLGESPPMRALRNQIGKLARSQAPVYISGESGSGKELVARLIHEQGPRIERPFVPVNCGAIPSELMESEFFGHKKGSFTGAIEDKQGLFQAASGGTLFLDEVADLPMAMQVKLLRAIQEKAVRAVGGQQEVAVDVRILCATHKDLAAEVGAGRFRQDLYYRLNVIELRVQPLRERREDIPLLAERILKRLAGDTGLPAARLTGDAQEKLKNYRFPGNVRELENMLERAYTLCEDDQIQPHDLRLADAPGASQEGAASLSEIDNLEDYLEDIERKLIMQALEETRWNRTAAAQRLGLTFRSMRYRLKKLGID

SEQ ID NO: 44205 - DNA, 1395 bp, Xanthomonas axonopodis
  CDS (1)..(1395)
atgaacgaacccaaaagcgccctggttgtcgatgacgagcgtgatatccgcgagttgcttgttctcaccctgggccgcatgggcctgcgcatcagcactgctgccaacctggccgaagcgcgcgagttgctggccaacaatccctacgatctgtgcctgaccgacatgcgtttgccggacggcaacggcatcgaactggtcaccgaaatcgcaaaacactatccgcagacgccggtggcgatgatcaccgcgttcggcagcatggacctggccgtggaagcactgaaagccggcgccttcgatttcgtcagcaagccggtcgacatcggcgtactgcgcggcctggtcaagcacgcgctggaattgaacaaccgcgaccgccctgctccgccaccgccgccaccggaacaggccagccgcctgctcggcgactccagtgccatggaaatcctgcgcgccaccatcagcaaggtcgcgcgcagccaggcgccggtctacatcgtcggcgaatcgggcgtgggcaaggagctggtcgcacgcaccatccacgaacaaggcgcacgtgccgccggcccgttcgtgccggtcaactgcggcgccattccccggcagctgatggaaagcgaattcttcggccacaagaaaggcagcttcaccggcgcgcatgccgacaagcccgggctgttccaggccgcgcatggaggcacgctgtttctggacgaagtggccgaattgccgttgcagatgcaggtcaagctgctgcgcgcgatccaggaaaagtcggtgcgaccggtcggcgcatccagcgaatcgctggtggatgtgcgcatcctctcggccacccacaaggacctgggcgacctggtctccgacggccgctttcggcatgacctgtactaccgcatcaacgtgatcgagttgcgtgtgccgccgctgcgcgaacgcggtggcgacctgccgcagctggccgctggcatcatcgcgcgcctggcgcacagccacggccgccccattccgctgctgacccaatccgcactcaacgccttgaatcactacggcttccccggcaacgtgcgcgaactgggaaacatcctcgaacgcgccctggccctggccgaagacgaccagatcagcgctaccgacctgcgcctgcccgcgcacgggggccaccggttggccgcccccccaggaggcgccgcggccgaaccgcgcgaagccgtcgtcgacatcgaccccgcctcggccgcgctgccttcctacatcgagcaactggaacgcgccgcgatccagaaggcgctggaagaaaaccgctggaacaagaccaagactgctgcgcagttgggcatcacgtttcgggcgctgcgttacaagctgaagaagctggggatggagtag

SEQ ID NO: 44206 - protein, 464 aa, Xanthomonas axonopodis
MNEPKSALVVDDERDIRELLVLTLGRMGLRISTAANLAEARELLANNPYDLCLTDMRLPDGNGIELVTEIAKHYPQTPVAMITAFGSMDLAVEALKAGAFDFVSKPVDIGVLRGLVKHALELNNRDRPAPPPPPPEQASRLLGDSSAMEILRATISKVARSQAPVYIVGESGVGKELVARTIHEQGARAAGPFVPVNCGAIPRQLMESEFFGHKKGSFTGAHADKPGLFQAAHGGTLFLDEVAELPLQMQVKLLRAIQEKSVRPVGASSESLVDVRILSATHKDLGDLVSDGRFRHDLYYRINVIELRVPPLRERGGDLPQLAAGIIARLAHSHGRPIPLLTQSALNALNHYGFPGNVRELGNILERALALAEDDQISATDLRLPAHGGHRLAAPPGGAAAEPREAVVDIDPASAALPSYIEQLERAAIQKALEENRWNKTKTAAQLGITFRALRYKLKKLGME

SEQ ID NO: 44207 - DNA, 1497 bp, Myxococcus xanthus
  CDS (1)..(1497)
atgcccgcctctgtcctcatcgtcgatgacgagaagaacatcctcctcaccctgagccagtcgctccaactggcggggtatcagacgcacctggcaaacagcgggcaggtggccctggatgtcgtcagcgcccgtcccgtggacgcggtgctgatggacgtgaagatgccggacatggacggcctcacggccctggcgaagctgaccgagctgaagccggagctgcccgtcatcatgatgtccgggcacggcaccatcgacaccgcggtgaaggctacccagttgggggccagggatttcctggaaaagccaatcgcccgggagcggctgctggtggcgctgcgcaacgtgctcaagcaccaggcggccatggcggagctccaggagctgcgggcgcagttgggccgctacgacatggtcggcagtggaccggccatgcagcgcatcttctcgctcatccagcgaacggcgccgtccgagggccgcgtgctgattacgggtgagaacggcacgggcaaggagctcatcgcgcgggcgctgcaccagcactcgaagcgcaaggggcagcccttcgtgaagctcaactgcgccgcggtgccgcacgagctcatcgagagcgagctgttcggccacgagaagggcgccttcaccggcgcggtgagcgtgcggcgaggcaagttcgagctggcccacgagggcacgctcttcctggacgagattggcgacatgccgcaggcgatgcaggccaagctgctgcgcgtgttgcaggaaggcgagttggagcgcgtgggcggcgcggagacgcacaaggtggacgtgcgcgtcgtcgcggcgacgaacaagaacctggaggcggagattgccgccgggcgcttccgcgaggacctctactaccgcatcaacgtggtgcagattcattcgcctccgctgcgtgagcggcgcgaagatttgccggacctcatcaagacgttcctcgacgaggcctgcgccaagaatggacgccggccgttgacgctgtcccccgacgcgctggcggtgatgagcgcctacgactatcccggcaacgtgcgcgagctgcgcaacctcgtggagcggctggccatcctgtgtgaaggccccatcgtcacccggacggatgcgctggagctgttgccccggggccggaacgtgccgccgcccgcaccggtggagacacccgcgagccccctaccccctccttctcccgaggcggccgtggtcctggcgtccagtacgcccgcgcccgccatcgccgccccggtggcgaccgagcctcccgcgcccgtgggcttccggcctcgcgcggaccggacgttccgcgagcaggtggaagacgccgagcgggaaatcatccagcacgtgctttcccatacacacgacaacgtgacggaagccgcgcgattgctcgacctggaacgcggtcacttctacaaaaaaatgaaggccctgggcttgcgccgcggcagctccgagtcgtag

SEQ ID NO: 44208 - protein, 498 aa, Myxococcus xanthus
MPASVLIVDDEKNILLTLSQSLQLAGYQTHLANSGQVALDVVSARPVDAVLMDVKMPDMDGLTALAKLTELKPELPVIMMSGHGTIDTAVKATQLGARDFLEKPIARERLLVALRNVLKHQAAMAELQELRAQLGRYDMVGSGPAMQRIFSLIQRTAPSEGRVLITGENGTGKELIARALHQHSKRKGQPFVKLNCAAVPHELIESELFGHEKGAFTGAVSVRRGKFELAHEGTLFLDEIGDMPQAMQAKLLRVLQEGELERVGGAETHKVDVRVVAATNKNLEAEIAAGRFREDLYYRINVVQIHSPPLRERREDLPDLIKTFLDEACAKNGRRPLTLSPDALAVMSAYDYPGNVRELRNLVERLAILCEGPIVTRTDALELLPRGRNVPPPAPVETPASPLPPPSPEAAVVLASSTPAPAIAAPVATEPPAPVGFRPRADRTFREQVEDAEREIIQHVLSHTHDNVTEAARLLDLERGHFYKKMKALGLRRGSSES

SEQ ID NO: 44209 - DNA, 1437 bp, Pseudomonas stutzeri
  CDS (1)..(1437)
atgagccgaagcgaaaacgtctggatcgtcgacgacgaccgctccatccgctgggtcctggaaaaggccctgcaacaggaaggcatggccacgcagagcttcgacagcgctgacagcgtgctggcccgcctcgcccgccagcagccggatgtgatcatctccgacatccgcatgcccggcctcagcggcctggacatgctctcgcagatccgcgagcagtacccgcgcctgccggtgatcatcatgaccgcgcactccgacctggatagcgcggtggcttcctaccagggcggcgccttcgagtacctgcccaagccgttcgacgtcgacgacgccgtgtcgctggtcaagcgcgccaaccagcacgcccaggaacagcagaaccagcagcagccggccaaccgtcatcacacaccggagatcatcggcgaggcaccggcgatgcaggaggtgttccgcgccatcggtcgcctcagccattccaacatcaccgtgctgatcaatggcgaatcgggtaccggcaaggaactggtggcccatgcgctgcaccggcacagcccacgctcggcatcgccgttcatcgcgctgaacatggcggcgattcccaaggacctgatggaatccgagctgttcggtcacgagaaaggtgccttcaccggtgcggccaaccagcgccgcggccgcttcgagcaggccgacggcggcaccctgttcctcgacgagatcggcgacatgccggccgacacccagacccgcctgctgcgcgtgctggccgatggcgagttctaccgggtcggcggccacacgccggtgcgggtcgacgtgcgcatcatcgccgcgacgcaccaggacctggaaaccctggtgcaggccggcaagttccgcgaagacctgttccaccggctgaacgtcatccgcatccacattccgcgcctggccgatcgccgcgaagacattccggcactggctgaacacttcctcgccagcgccgcgcaggagctgtcggtggagaccaaggtgctcaagccggaaaccaaggaatacctgcagcatctgccctggccgggcaacgtgcgccaactggagaacacctgccgctggatcacggtcatggcgtccgggcgcgaagtgcatgtcgatgacctgccgcccgagctgctcaaccagcaggccgaggcgcagccggcacacaactgggaacaggcgctgcgcaactggtcggatcaggccctggcgcgcggccagagcaacctgctcgacgaggcggtgccggccttcgagcgcatcatgatcgagaccgcgctcaagcacaccgccggtcgccgccgcgatgccgccctgttgctcggctggggtcgcaacaccctgacgcgcaagatcaaggagctgggcatgcgcgtcgatggcagcgatgacgacgacggcgacgacagctga

SEQ ID NO: 44210 - protein, 478 aa, Pseudomonas stutzeri
MSRSENVWIVDDDRSIRWVLEKALQQEGMATQSFDSADSVLARLARQQPDVIISDIRMPGLSGLDMLSQIREQYPRLPVIIMTAHSDLDSAVASYQGGAFEYLPKPFDVDDAVSLVKRANQHAQEQQNQQQPANRHHTPEIIGEAPAMQEVFRAIGRLSHSNITVLINGESGTGKELVAHALHRHSPRSASPFIALNMAAIPKDLMESELFGHEKGAFTGAANQRRGRFEQADGGTLFLDEIGDMPADTQTRLLRVLADGEFYRVGGHTPVRVDVRIIAATHQDLETLVQAGKFREDLFHRLNVIRIHIPRLADRREDIPALAEHFLASAAQELSVETKVLKPETKEYLQHLPWPGNVRQLENTCRWITVMASGREVHVDDLPPELLNQQAEAQPAHNWEQALRNWSDQALARGQSNLLDEAVPAFERIMIETALKHTAGRRRDAALLLGWGRNTLTRKIKELGMRVDGSDDDDGDDS

SEQ ID NO: 44211 - DNA, 1449 bp, Acetobacter diazotrophicus
  CDS (1)..(1449)
atgcccctgccgaccgtccttgtcgccgacgacgaccgttccatccgcaccgtccttagccaggcgctggggcgcgcgggctatcaggtgcgcgtcaccgcccatgccgcgaccctgtggcaatgggtcgaggagggcgagggcgacctggtcatcaccgacgtggtgatgcccgacgaaaacggccttgacctgattccgcgcatcaagcgggcccggcccgacctgcgcgtggtggtcatgagcgcgcaatccaccctgatgaccgccgtcaaggcgacccagcgcggcgcgttcgagtacctgcccaagcccttcgacctgaaggagctgctgtcggtggtcgcgcgcgcgctggcgtcgccggccggcgccctggccgaacccgcgccggtcgatacggacgaacgcatgccgctgatcggccggtcgatggtgatgcaggacatctatcgcatcatcgcgcgactgacgacgtcggacctgacggtgatgatcaatggcgagagcggcaccggaaaggaactggtggcgcgcgccctgcacgattacggccgccggcgcggcgggcccttcgtcgccgtcaacatggcggcgatcccgcgcgaactgatcgagagcgagctgttcggccatgagcgcggcgcgttcaccggggccaccagccgcaatcccggccgcttcgaacaggccgccgggggcaccctgttcctggacgagatcggggacatgccgcccgaggcccagacgcgccctctgcgcgtgctgcaggacggcgagttcaccaccgtgggcggccgccagccgatccgcgcgaatgtccgcatcatcgccgccacccatcgcgacctgcgccaggcgatccgcaccggatcgttccgcgaggacctgttctatcgcctgaacgtggtgcccatccgcctgccgcccctgcgcgagcgggccgaggacatccccctgctggcccgccacttcctggaccgctgccgcgaggacggcctgccgggcaagattctggacgacggcgcggtggaacggctccaggccagccgctggccgggcaatgtgcgcgaactggaaaacctgatgcgccggctggcggccctgtacccgcaggagacgatcaccgccgacctgatcgattccgaactggccgaaacgctgcacgagcagggcgccgatacgccggacctgcgcgagcaggaaccgctggccgacgccgtggcccgccatatccgccatttcctggcctcgggccaggacggcatgccgctgcacgacatctatgaccgcgtgatcgccgaggtcgaacggccgctgatccagatgaccctggcggccacccgcggcaaccagatcaaggcggcggcgatgctggggctgaaccgcaacaccctgcgcaagaagatccgcgacctggaaatccctggtcgtcgcggcgcgaactga

SEQ ID NO: 44212 - protein, 482 aa, Acetobacter diazotrophicus
MPLPTVLVADDDRSIRTVLSQALGRAGYQVRVTAHAATLWQWVEEGEGDLVITDVVMPDENGLDLIPRIKRARPDLRVVVMSAQSTLMTAVKATQRGAFEYLPKPFDLKELLSVVARALASPAGALAEPAPVDTDERMPLIGRSMVMQDIYRIIARLTTSDLTVMINGESGTGKELVARALHDYGRRRGGPFVAVNMAAIPRELIESELFGHERGAFTGATSRNPGRFEQAAGGTLFLDEIGDMPPEAQTRPLRVLQDGEFTTVGGRQPIRANVRIIAATHRDLRQAIRTGSFREDLFYRLNVVPIRLPPLRERAEDIPLLARHFLDRCREDGLPGKILDDGAVERLQASRWPGNVRELENLMRRLAALYPQETITADLIDSELAETLHEQGADTPDLREQEPLADAVARHIRHFLASGQDGMPLHDIYDRVIAEVERPLIQMTLAATRGNQIKAAAMLGLNRNTLRKKIRDLEIPGRRGAN

SEQ ID NO: 44213 - DNA, 1458 bp, Myxococcus xanthus
  CDS (1)..(1458)
gtgaaccaagtcaagcgcgccaaagtcctcgtcgtggatgacgactccgtcgtcctcaaggccgtgacgcagattctccagcgcgagggccacccggtggtggccattgacgacgcggtggagggcctggcggccgcgaaggatccgaccatcgacgtggtcgtcctcgacatcaagatgcccaacctgtccggcatggacctgctgcgcggcatcaaggccgaccgcccggacgtggaggtcatcatgatgacggccttcgccaccgtggagacggcggtggaggcggtgaaggcgggggcgtacgactacctcaccaagcccttcgagaacatcgacgaggtcagcctcacggtggccaaggcggccgagcgcaaggcgctcaaggaccgcacccgcgcgctggaggaggccctcacggtccgcagccagttcgaggacctcatcggccagtccacgcagatgcgctccgtcttcaagctggtggagacggtgagccactccaccgccacggtgctcatccagggggagagcggcaccggcaaggagctggtggcccgcgccatccactaccgcagcgcgcgcaaggacaagcccttcgtggcggtcaactgttcggcgctgacggagacgctgctggagagcgagctcttcggccacgtgaagggcagcttcaccggcgccaccggcaacaagaagggcctcttcgaggcggctgacggcggcaccatcttcctggacgaaattggcgacgtgcccccggccacccaggtccgcctgctgcgcgtgctccaggaaggggaagtcaaacgcgtgggcgccaacgagccggtgaaggtggacgtgcgcgtcatcgccgccacccacgtggacctgtcccgcgccaaggagcagggcaagttccgcgaggacctcttctaccgcctcaacgtcatcaccatcgacctgccgcccctgcgtgaccggcccgaggacgtgcccctgctggcgcaccacttcctcaagctctacgcctccaaggcggacaagaaggtgacgggcatctccccgcgcgccatggaagccctcacctgcaaccggtggacgggcaacgtgcgtgagctggagaacgtcatcgagcgcgcggtggtgctgacgggcaacgaggtcatcgacgtggaggacctgccgccgggcttccagtccgcgccgcagccggactccacggtggaggtgttcagcctggcacacctgccgtacgcccaggccaagcgcctggcgatgcgtgccttcgagcgccgctacctgtccgccctgctggagaagaacaaccagaacgtctccagcgccgcgcgcgcggcgggcgtggaccgctccaacttccgtcgtctgctcaagcagtacgaggtggccggccggtccatgaagccccgcgtggtctcccaggacgacggcgaggcgctggaagccgcgtcctga

SEQ ID NO: 44214 - protein, 485 aa, Myxococcus xanthus
MNQVKRAKVLVVDDDSVVLKAVTQILQREGHPVVAIDDAVEGLAAAKDPTIDVVVLDIKMPNLSGMDLLRGIKADRPDVEVIMMTAFATVETAVEAVKAGAYDYLTKPFENIDEVSLTVAKAAERKALKDRTRALEEALTVRSQFEDLIGQSTQMRSVFKLVETVSHSTATVLIQGESGTGKELVARAIHYRSARKDKPFVAVNCSALTETLLESELFGHVKGSFTGATGNKKGLFEAADGGTIFLDEIGDVPPATQVRLLRVLQEGEVKRVGANEPVKVDVRVIAATHVDLSRAKEQGKFREDLFYRLNVITIDLPPLRDRPEDVPLLAHHFLKLYASKADKKVTGISPRAMEALTCNRWTGNVRELENVIERAVVLTGNEVIDVEDLPPGFQSAPQPDSTVEVFSLAHLPYAQAKRLAMRAFERRYLSALLEKNNQNVSSAARAAGVDRSNFRRLLKQYEVAGRSMKPRVVSQDDGEALEAAS

SEQ ID NO: 44215 - DNA, 1434 bp, Myxococcus xanthus
  CDS (1)..(1434)
atgcagggagaatcgactcaagccatggcgcgaatcctcgtcatcgacgaccacgacacgctgcgtgaagggatggctgtcaccctcactcgggcaggccacaccgtgtccgcggtgcgcagtggccaggacggattggccgcctaccgcaaggcaccgttcgacctggtcgtcaccgacctgaagatggacggtatggacggcatcgaggtgacgaagtcgctcaaggcgctggatgccggcgccgtcgtcatggtggtgacggccttcggcaccatcgagaccgcggtgcaggcgatgcagcaaggcgcctacgacttcatcaccaagcccttcccgcccgaggtgctgcgcgccaaggtggacaaggggctggagctggcctccacgcgcaagcaggtggagcgactgacggcgcgcaccgccgcgcacgacacggacgcggccctcacgcacggcagcctggtgggcgacagcgagcccatgcagcggctggtgtcccaggtgctcaaggtggcgcagagcgacgccacggtgctggtgcgcggagagagcggcaccggcaaggagctggtggcacggatgctccaccagcgctccccgcgccgagacggccccttcatcgtcgtgcactgcgcggcgctggcggagaccctgctggagagcgagctgttcgggcacgagcgcggcgccttcaccggcgcggtgaagcgcaagctggggcgcttcgagctggccgacggcggcacgctgttcctggacgagattggcgagattcccgcctctgtgcagacgaagctcttgcgcgtgctccaggagaaggaaatccagcgcgtcggcggagaggacacgttcaaggtggacgtgcgcgtggtgagcgccacccaccgggacctccaggccgaggtgaaggccggacgcttccgcgaggacctctactaccgcctgcacatcgttccggtggtactgccgcccctgcgcgagcgtcccgaggacatctccctgctggcccgacacttcgtggccaagcacgccatgcgcgtgaaccgacgtgtgatgggcttggacgacagcgcgctgcgcgccctggcccgccacgcgtggcccggcaacgtgcgcgagctggagaacgtcatcgaacaggcgctcgtcttcgccgaaggtgagcagctcaccgacctggacctgccctcacacctcaccgccagtggcaccccgcgcgtcgaggcgggcctgccagtgctccagggcgaccgccccctgcccgacatcctggaggatttggagcgtcagctcatcgcccgggcctatgagaaggccagcggcgtgaagacggagacggcccgcctgctaggtatcaagacgtccgcgctgtactacaagctggagaagtacggcttcctccccaaggggacgcctcccgaggagagctga

SEQ ID NO: 44216 - protein, 477 aa, Myxococcus xanthus
MQGESTQAMARILVIDDHDTLREGMAVTLTRAGHTVSAVRSGQDGLAAYRKAPFDLVVTDLKMDGMDGIEVTKSLKALDAGAVVMVVTAFGTIETAVQAMQQGAYDFITKPFPPEVLRAKVDKGLELASTRKQVERLTARTAAHDTDAALTHGSLVGDSEPMQRLVSQVLKVAQSDATVLVRGESGTGKELVARMLHQRSPRRDGPFIVVHCAALAETLLESELFGHERGAFTGAVKRKLGRFELADGGTLFLDEIGEIPASVQTKLLRVLQEKEIQRVGGEDTFKVDVRVVSATHRDLQAEVKAGRFREDLYYRLHIVPVVLPPLRERPEDISLLARHFVAKHAMRVNRRVMGLDDSALRALARHAWPGNVRELENVIEQALVFAEGEQLTDLDLPSHLTASGTPRVEAGLPVLQGDRPLPDILEDLERQLIARAYEKASGVKTETARLLGIKTSALYYKLEKYGFLPKGTPPEES

SEQ ID NO: 44217 - DNA, 1476 bp, Myxococcus xanthus
  CDS (1)..(1476)
atggagacccttctcatcgtcgacgacgacgtctcgctcctcgaaacgctgaagatgcatttcgaggagatcgagcaggacggccagccccgctaccaggtggccaccgccaccagcgccgcggcaggactgcgcgctgcccaggaggccatgcccagcgtggtcatcctcgacatgatgctcccggaccgcacgggtctggaaatcatcgaggagatgaagggcctgtgcggggacgcgcgcatcatcctggtcaccgcgtaccacgacatggagaccaccatccgggccatgaaggccggggctttcgactacatccacaagcccttcccggacccggccgccctggacctggtggtggagcgcgcgctggagtaccgccagctgtcgcgccgcgcggacgaggtccaccgggagaacgccgccgcccgcctgggcgacatcgtgggcaccagcccgctgatgcagcaactggtgaaggagattggaaaagtcaccggcagccacgccaccgtgctgattacgggcgagagcggcaccggcaaggagctcatcgcccgcgtcatccacaactactcctacgacgagccccggcccttcatcggcatcaactgttcggccatcgtcgacacgctgctggagagcgagctcttcggccacgagaagggcgccttcaccggcgccacggcgggcaagccgggcaagttcgagctggccgaggacggcacggtgttcctggacgagattggcgacatgtcgctgatgctccaggccaagctcctgcgcgtactgcaggagcgcgagttcgagcgcgtgggcggcgtcaaacgcatcaagctgcgcgcccgcgtcatcgccgccacccaccgcgcgctggtggaggaggtggaggccggccgcttccgcgaggacctctaccaacgcctcaaggtcatcaccctccagattcccccgctgcgcgagcggcgcgaggacatccccccgctggtgaagcacctgctcgagcgcatcaacgagaaggtccacaagcgcgtcacccgcgtgcccggcgaggtcatggagcgcctcacccgcctgccctggcgcggcaacgtgcgcgaactggagaacgtgctcacccgcgccacccgcgccgtggtgctggcccccggtgacgtcctgcgcggggacgatttgcccgccctggagtctcccctcccctcgccggagccgggccgggccacctccgcccaccacaccgccagcgccatgttcgccgcgccggccgaggacgacgccagcctgattcccactttggaagaggccgagcgccagctcatcgcccgtgcgatgaccgtcacgaaggggcacaagggtcgcacctgccagatccttggaatcagccgccccaccctggagcgcaagctccagaagtacggtcttgcacagagccagagccctcaagtgcacaccttccctgtgaaggatgcgttgtga

SEQ ID NO: 44218 - protein, 491 aa, Myxococcus xanthus
METLLIVDDDVSLLETLKMHFEEIEQDGQPRYQVATATSAAAGLRAAQEAMPSVVILDMMLPDRTGLEIIEEMKGLCGDARIILVTAYHDMETTIRAMKAGAFDYIHKPFPDPAALDLVVERALEYRQLSRRADEVHRENAAARLGDIVGTSPLMQQLVKEIGKVTGSHATVLITGESGTGKELIARVIHNYSYDEPRPFIGINCSAIVDTLLESELFGHEKGAFTGATAGKPGKFELAEDGTVFLDEIGDMSLMLQAKLLRVLQEREFERVGGVKRIKLRARVIAATHRALVEEVEAGRFREDLYQRLKVITLQIPPLRERREDIPPLVKHLLERINEKVHKRVTRVPGEVMERLTRLPWRGNVRELENVLTRATRAVVLAPGDVLRGDDLPALESPLPSPEPGRATSAHHTASAMFAAPAEDDASLIPTLEEAERQLIARAMTVTKGHKGRTCQILGISRPTLERKLQKYGLAQSQSPQVHTFPVKDAL

SEQ ID NO: 44219 - DNA, 1689 bp, Myxococcus xanthus
  CDS (1)..(1689)
atgcagcgggcgagtggaggcgaggggatggaccggatcgcggtgctggtggtggatgacgaagaggcggtgcgcacgtttctgtccgagctgctcggaagtgcggggtaccaggtgcgctgtgccgcgagtggcacccaggcgctggagatgctctcagggggctccttcgacgcggtgttgctggacgtggtgatgccggagatgagcggcctggaagtgctgcgccgttaccagtccatgggcggcggcgcgcccgtcatcgtgctcagcgcgctggcgggggcggacgacgccgttcgggcgatgaagatgggcgccagcgactacctggccaagccgttcggcaacgacgagctgcaggacgcgctggcccgggccctggggacgcgggcgccggagcgtcaggccgtggcgcccatcctgccctcgcgcacggtgctgccggtggtggattcggcgcaggagcagcgcgtcctcatctccacctcgccggccatgcgccgcgcgcgtgcgctggtggagcgcatcgccgacacggacgtccccgtgctgctgctgggtgagtccggtacgggcaaggaggtcatcgcgcgggagattcacgcgcgcagccagcggcgcaaccgtccgttcatcaaggtgaactgcgcggcgctgcccggcgagctgctggagagtgagctgttcggccacgagcgcggcgccttcaccggcgccactgccgagaagcccggcaagttcgaactggcggaccagggcaccatcttcctggacgagattggcgaaatggccatccggctccaggccaagctgctccaggtgctccaggacgaggagttcttccgcgtcggtggcaagaagagcgtgcgcgtggacagccgcgtcgtcgtggccaccaaccgcgacctggagaaggaaatcgcgctgggcaacttccgcgaggacctcttctatcgcctcaacgtggtggccatccgcctgccggcgctgcgcgagcgccgcgaggacgtggttccgctgacggaccacttcctcaagaagtacggccgaggctacctcagcggcgtgtccgagctgcccacggaggtgctgcacgccttcgcggactacgactggccgggcaacgtgcgcgagctggagaacatggtccgccggctgtgcgtgctgaaggacccgacgctggtgctcgacgagctgcgggccgcggtccgcgctcccgcgagcgcgccgtccctgcccacgtcctacgccggtgacgacggtggccccttcggccgcgcgcacgacgagggcttccgcacgccgccgcccgccgtgcaggtgctggagatgccgtcgcgcggcgccgcctttgggctggcgtccgtcgcgccgctggcgccgcccgcgcacgcgcccatggtgatggagtccgcgaacgcggtggtgtccgcgccgcgctacgtcaatcccttcgacgtgccgcagccgccgccgccgcccgcgcccaccggggagctgtcgctgaaggacatcggcaaacgggcggcgatgctggccgagcgcgaggcgattctggccatgctccaacgcaccgcgtggaacaagcggcgcgcggccaccaagctgcgcatcagctacaaggcgctcctctacaaaatcaaggagtgcggcatcatcgacccgcgcgcgagcgcggagctgtag

SEQ ID NO: 44220 - protein, 562 aa, Myxococcus xanthus
MQRASGGEGMDRIAVLVVDDEEAVRTFLSELLGSAGYQVRCAASGTQALEMLSGGSFDAVLLDVVMPEMSGLEVLRRYQSMGGGAPVIVLSALAGADDAVRAMKMGASDYLAKPFGNDELQDALARALGTRAPERQAVAPILPSRTVLPVVDSAQEQRVLISTSPAMRRARALVERIADTDVPVLLLGESGTGKEVIAREIHARSQRRNRPFIKVNCAALPGELLESELFGHERGAFTGATAEKPGKFELADQGTIFLDEIGEMAIRLQAKLLQVLQDEEFFRVGGKKSVRVDSRVVVATNRDLEKEIALGNFREDLFYRLNVVAIRLPALRERREDVVPLTDHFLKKYGRGYLSGVSELPTEVLHAFADYDWPGNVRELENMVRRLCVLKDPTLVLDELRAAVRAPASAPSLPTSYAGDDGGPFGRAHDEGFRTPPPAVQVLEMPSRGAAFGLASVAPLAPPAHAPMVMESANAVVSAPRYVNPFDVPQPPPPPAPTGELSLKDIGKRAAMLAEREAILAMLQRTAWNKRRAATKLRISYKALLYKIKECGIIDPRASAEL

SEQ ID NO: 44221 - DNA, 1407 bp, Vibrio fischeri
  CDS (1)..(1407)
atggtagaagataccgcttccgttgctgcgttatatcgctcttatttaaacccgttaggttttgatattgatgtcgtagctaaaggtgttgaagccattgagaaaatcaaattaagaacccctgatcttgtgttactagatttgcgcctgcctgacatgacaggttttgatgtgttggctgaaattcgcaaagataaccaaagtattcctgttgtattaatgacggctcatggctcaattgatgctgcagtagaagccatgcagttaggggctcaagatttcttaatcaaaccatgtgaagctgaccgtttgaggggtacggtaaataacgcattacgacgtgcacaaaaagaccagaaagagttccaagagaatccaaaagataccaataaacagtatcaaggatttattggtagtagctctcaaatgcatcaggtttatcgcacgatagattctgccgcaccaagtaaagcaacggtatttattactggtgagtcggggacgtgtaaagaggtgtgtgcagaagccattcatgcggctagtaagcgtggagacgggcctttcatcgctattaactgtgcggcaattccaaaagatttaattgaaagtgagctttttggtcacgttaaaggtgcatttacaggtgcttctgttgatcgaaaaggtgctgccgaacaagcagatggaggtacgcttttcctcgatgaattatgtgaaatggatttggatttacagaccaaattactgcgatttattcaaaccggaaccttccaaaaggtaggttcatctaaaatgagtcgagtagatgttcgatttgtttgtgcaacaaaccgagacccttggttagaagtacaagccggtcgatttagagaggatttatattatcgtttacatgttatccctctaacattacctcctctaagggacagaggaaatgatattattgaaattggtcactcaatccttgggcatttttctcacgaggaaggtcgtgaatttattacatttagtcctgaggttgtggataggtttttgaattacgattggcctggaaacgtacgacaattacaaaatgtgattaggaatgtagtcgtattaaataaaggaaaagaagtcgaattatccatgctgcctcctccattatcattagatagtaagagtggtgtaaatattgcatctaatgtatccataagcgattcaactaagcctacagaatctattctgcctagtaataggatcttagatagtaaagatcaagaaactattattccgttatggcaatctgaaaaacagatcattgaaaacgcaattgaactatgtggtgggaacattccacaagccgctaagcaattagaggttagtccctctacgatatatagaaaactacagtcttggaatgaaagataa

SEQ ID NO: 44222 - protein, 468 aa, Vibrio fischeri
MVEDTASVAALYRSYLNPLGFDIDVVAKGVEAIEKIKLRTPDLVLLDLRLPDMTGFDVLAEIRKDNQSIPVVLMTAHGSIDAAVEAMQLGAQDFLIKPCEADRLRGTVNNALRRAQKDQKEFQENPKDTNKQYQGFIGSSSQMHQVYRTIDSAAPSKATVFITGESGTCKEVCAEAIHAASKRGDGPFIAINCAAIPKDLIESELFGHVKGAFTGASVDRKGAAEQADGGTLFLDELCEMDLDLQTKLLRFIQTGTFQKVGSSKMSRVDVRFVCATNRDPWLEVQAGRFREDLYYRLHVIPLTLPPLRDRGNDIIEIGHSILGHFSHEEGREFITFSPEVVDRFLNYDWPGNVRQLQNVIRNVVVLNKGKEVELSMLPPPLSLDSKSGVNIASNVSISDSTKPTESILPSNRILDSKDQETIIPLWQSEKQIIENAIELCGGNIPQAAKQLEVSPSTIYRKLQSWNER

SEQ ID NO: 44223 - DNA, 1401 bp, Myxococcus xanthus
  CDS (1)..(1401)
gtgaacgaatcattgagaggcacggtgctgctggtcgacgacgaccccgccgtggccaaggtgctgggcgccctgctgacgcaggcgggcctgacgacgcatgcggcgcgcgacgggcaggaagccctggcgctgctggcaagcaagccggtggacgtggtggtgagcgacgtgcgcatgccgggcatggatggcctgcaggtgctcgcggaggtggcgcgcggctggccggacgtgcccgtcatcctcctcaccgcgcacggcacggtgccgctggcggtggaggcgatgaaggcgggcgccgcggacttcgtgctcaagcccttcgaccgggaggagattctcttcaccgtccgcaaggcgctgctgcgcgcgcagggcgaggaggcgcgccagcaggtgcggcccacgggtggcttcatcggccggagccgggccatggcggacgtacaggccgtgctggcgaaggcggccgccggtacagccacggtgctgctgcgcggcgagtccggcacgggcaaggagctggcagccaaggccgttcacgacgccagtccccggcgggatggccccttcgtgaagctgcactgcgcggcgctgccggacaccctgctggagagcgagctgttcggctacgagaagggcgccttcacgggcgccgccacgcgcaagccggggcgcgtggagctggcccatggcggcacgctgttcctcgatgaggtgggcgacatctcccccgcggtccaggtgaagctgctgcgagtcatccaggagcgcgaactggagcggctgggcggcacgcagacggtgaaggtggacgtccgcttcgtggcggccacgcatcagcccttggaagagcgtgtgaaggaaggccgcttccgcgaggacctcttctaccgcctcaacgtggtgcccgtgtggataccggccctgcgcgaacgcccggacgacatcgagccgttggccctgcacttcctggaggtccacgcgaagacgaacgggcgcccgcccttcaccctcatgaccgacgggctcgcggcgctgcgggcccagccgtggcccggcaacgtgcgccagctccagaacttcctggagcggttggtggtgctctccgacacgcaggtgattggcgggcgggaagtccttcaagagctggcgcgccagccaggcctggcccccgcccccttcgccgcgacaccttccgtcagcgccctggaagcgccaacggtgcctgtcacggactccgcccggacactggagtcccagcgcaaggagatggagcgccaggcgatggcggatgcgctcaagcgcgcgggcgacaaccggacgctggcggcgcggctgctcggcatcagccggcgcacgctctacaacaagctggaggagtacgggctgctgtag

SEQ ID NO: 44224 - protein, 466 aa, Myxococcus xanthus
MNESLRGTVLLVDDDPAVAKVLGALLTQAGLTTHAARDGQEALALLASKPVDVVVSDVRMPGMDGLQVLAEVARGWPDVPVILLTAHGTVPLAVEAMKAGAADFVLKPFDREEILFTVRKALLRAQGEEARQQVRPTGGFIGRSRAMADVQAVLAKAAAGTATVLLRGESGTGKELAAKAVHDASPRRDGPFVKLHCAALPDTLLESELFGYEKGAFTGAATRKPGRVELAHGGTLFLDEVGDISPAVQVKLLRVIQERELERLGGTQTVKVDVRFVAATHQPLEERVKEGRFREDLFYRLNVVPVWIPALRERPDDIEPLALHFLEVHAKTNGRPPFTLMTDGLAALRAQPWPGNVRQLQNFLERLVVLSDTQVIGGREVLQELARQPGLAPAPFAATPSVSALEAPTVPVTDSARTLESQRKEMERQAMADALKRAGDNRTLAARLLGISRRTLYNKLEEYGLL

SEQ ID NO: 44225 - DNA, 1341 bp, Pseudomonas stutzeri
  CDS (1)..(1341)
atgactgcccgccagaaagcgctgatcatcgacgacgaaccggacatccgcgagctgctggagatcaccctcggccggatgaagctggacacccgtagcgcacgcaacctcaaggaggcacgcgagtgcctcgcccgtgaacactacgacctctgcctgaccgatatgcgcctgcccgacggctgcgggctggagctggttcagttcatccagcggcactacccgcaactgccggtggccatgatcacggcctatggcagcctggatacggcgatcagcgcactgaaggcaggggccttcgattttctcaccaagccggtcgacctgggccggctccgcgaactggtcagcaccgcgctgcggttgcgcgccgccggtccggaggagctaccggtggatggtcggttgctgggcgtatcgccgcccatggccacgctgcgcaagcagatcggcaagctggcgcgcagtcaggctccggtctacatcagcggcgaatcgggcagcggcaaggagctccttgcccacctgatccacgagcagggccctcgtggcgagcgccctttcgtgccggtcaactgcggcgccatcccctcggaattgatggaaagcgaattcttcggccacaagaaaggcagcttcaccggcgccatcgaagacaagcaaggactgttccaggcggccaatggcggcacactgttcctcgacgaagtggccgacctgccactgccgatgcaggtcaagctgctgcgcgcaatccaggaaaaggcggttcgtgcggtcggcggcgcagtggaaatcgcagtggatgtacgcatcctctgcgcaacccacaaggacctggccagcgaggtcgccgccggacgcttccgccaggacctgtactaccgcctgaacgtcatcgagcttcgcgtaccacccctgcgcgagcgtcgtgaagacgtcgccctgctggccgacaacatgctgcgccggctggcccaggaatgcggcgacagcccggcccggctacagccggaagcgcttgccaagctgcagagctaccgttttccaggcaacgttcgcgagctggaaaacatgctagaacgggcctatacgctgtgcgaaggcgacgtcatcaaggccagtgacctgcgcctggccgatgcgccgggcgcaacggacggcggcgacgccagcctggcgcagatcgacaatctcgaagaccatctggaagaagtcgagcgcaagctgatcatgcaggcgctcgaagaaacccgctggaaccgcaccgccgcggcacaacggctgggattgtcgtttcgctcgatgcgctaccgcctgaagaagctcgggttggactga

SEQ ID NO: 44226 - protein, 446 aa, Pseudomonas stutzeri
MTARQKALIIDDEPDIRELLEITLGRMKLDTRSARNLKEARECLAREHYDLCLTDMRLPDGCGLELVQFIQRHYPQLPVAMITAYGSLDTAISALKAGAFDFLTKPVDLGRLRELVSTALRLRAAGPEELPVDGRLLGVSPPMATLRKQIGKLARSQAPVYISGESGSGKELLAHLIHEQGPRGERPFVPVNCGAIPSELMESEFFGHKKGSFTGAIEDKQGLFQAANGGTLFLDEVADLPLPMQVKLLRAIQEKAVRAVGGAVEIAVDVRILCATHKDLASEVAAGRFRQDLYYRLNVIELRVPPLRERREDVALLADNMLRRLAQECGDSPARLQPEALAKLQSYRFPGNVRELENMLERAYTLCEGDVIKASDLRLADAPGATDGGDASLAQIDNLEDHLEEVERKLIMQALEETRWNRTAAAQRLGLSFRSMRYRLKKLGLD

SEQ ID NO: 44227 - DNA, 1410 bp, Shewanella violacea
  CDS (1)..(1410)
atgacagagcaagtttgggtactcgatgacgacagttcaattcgctgggtcgtagaaagagcattaaaaggtgccaagatatcttcagcaagctttgccgcagcagagtctctatgggaggcattggagctatcacagcctaaggtgatcatctcagatatacgcatgcctggcacagatgggttatctctattagagaggcttcaaattcattaccctaatattccagtcatcataatgactgctcattcagatctagatagtgcagtaagcgcatatcaggctggtgccttcgaatacttacctaaaccgttcgatatcgatgaagccgtgaccttagtagagcgagcattaactcactctacagaccaggcagtaaatacggttgaagagatacaagttaaagcccccgaaattattggtgaggcccccgctatgcaggaggtctttcgcgccataggtcgcctatctcgatcttcgattagcgtactcattaatggccagtctggtacaggtaaagagctagtcgccagcgccctacataagcacagcccaagaaaagataaaccctttatcgccatcaatatggctgcgatccctaaagatctaatcgaatctgaactctttggccatgagaaaggtgcctttaccggtgcgtcaggtgtcaggcaaggcaggttcgaacaggcaaatggtggcacactctttctagatgaaattggtgatatgcctctagacgtccagacccgattactcagagtattagctgatggccagttttatcgtgtcggcggccactctccagtgcaagtcgacgttagaatcatagccgcaacccatcaagacttagagcagttagtccagaagggaggtttcagggaagatctgtatcataggctcaatgtcattaaggtccacctgcccccattatcacaacgaagagaggacattcctcaactcgcgagacattttctttcatccgccgccaaagaaatagctgttgaacctaaaatattgacccctgagacagccgaaaaactctcagaactaccttggccgggtaatgtccgtcaattggaaaatacctgtcgttggctcatggtcatggcatctggacaagagatattaccccaagatctgccacctgaattgctcaaagagcaaaatcaaattaaaaatcaatcagcagctgatccgtcgaattggcaagagtcattgaaactttggattgatgagcgactcagtgcaggtgaaaataatctcctcaccgaagtccaaccagcattcgagcgaattttactggaaaccgcactggcccacaccaatggccataaacaggaagccgccaagcgactcggctggggccgaaataccctcacccgaaagctcaaagaactctcaatggattaa

SEQ ID NO: 44228 - protein, 469 aa, Shewanella violacea
MTEQVWVLDDDSSIRWVVERALKGAKISSASFAAAESLWEALELSQPKVIISDIRMPGTDGLSLLERLQIHYPNIPVIIMTAHSDLDSAVSAYQAGAFEYLPKPFDIDEAVTLVERALTHSTDQAVNTVEEIQVKAPEIIGEAPAMQEVFRAIGRLSRSSISVLINGQSGTGKELVASALHKHSPRKDKPFIAINMAAIPKDLIESELFGHEKGAFTGASGVRQGRFEQANGGTLFLDEIGDMPLDVQTRLLRVLADGQFYRVGGHSPVQVDVRIIAATHQDLEQLVQKGGFREDLYHRLNVIKVHLPPLSQRREDIPQLARHFLSSAAKEIAVEPKILTPETAEKLSELPWPGNVRQLENTCRWLMVMASGQEILPQDLPPELLKEQNQIKNQSAADPSNWQESLKLWIDERLSAGENNLLTEVQPAFERILLETALAHTNGHKQEAAKRLGWGRNTLTRKLKELSMD

SEQ ID NO: 44229 - DNA, 1350 bp, Pseudomonas aeruginosa
  CDS (1)..(1350)
atggaaaccacttccgaaaaacaggggcgcatcctgctggtcgatgacgagtcggcgatcctgcgcactttccgttattgcctcgaagacgaaggctacagcgtggccaccgccagcagcgcgccgcaggcggaggccctgttgcagcgccaggtattcgacctgtgcttcctcgacctgcgcctgggcgaagacaacgggctcgacgttctcgcccagatgcgcgtccaggcgccatggatgcgcgtggtgatcgtcaccgcgcattcggcggtggataccgcggtcgatgccatgcaggccggcgcggtggattacctggtcaagccctgcagcccggaccaactgcgcctggccgccgccaagcaactggaggtgcgccaactgaccgcgcgcctggaggccctggaggacgaagtgcgccgccagggcgacggcctggaatcgcacagcccggccatggccgcggtactggagaccgcgcgccaggtagcggcgaccgacgccaacatcctcatcctcggcgaatccggctccggcaagggcgaactggcacgcgccatccacacctggagcaaacgcgcgaagaagccccaggtcaccatcaactgcccgtcgctgaccgccgaactgatggaaagcgaactgttcgggcacagtcgcggcgccttcaccggtgccaccgaaagcaccctgggcagggtcagccaggctgacggcggcaccctgttcctcgacgagatcggcgacttcccgctgaccttgcaacccaagctgctgcgcttcatccaggacaaggaatacgaacgcgtcggcgatccggtgacccgccgcgccgacgtacgcatccttgccgcgaccaaccgcgacctgggcgcgatggtcgcccagggccagttccgcgaggacctgctctaccgcctcaacgtgatcgtgctcaacctgcctcccctgcgcgaacgcgccgaggatatcctcggcctggccgaacgtttcctcgcccgcttcgtcaaggactacggccgccccgcccgcggcttcagcgaagccgcccgcgaggccatgcggcaatacccctggccgggcaacgtacgcgagctacgcaacgtgatcgaacgcgccagcatcatctgcaaccaggaactggtggatgtcgaccacctcggtttcagcgctgcgcaatctgccagcagcgcgccgcggatcggcgaatcgctgagcctggaagacctggagaaagcccatatcacggcggtgatggcctccagcgcgaccctcgaccaggccgccaagaccctcggtatcgatgcctcgaccctgtaccggaagcgcaagcagtacggcctatga

SEQ ID NO: 44230 - protein, 449 aa, Pseudomonas aeruginosa
METTSEKQGRILLVDDESAILRTFRYCLEDEGYSVATASSAPQAEALLQRQVFDLCFLDLRLGEDNGLDVLAQMRVQAPWMRVVIVTAHSAVDTAVDAMQAGAVDYLVKPCSPDQLRLAAAKQLEVRQLTARLEALEDEVRRQGDGLESHSPAMAAVLETARQVAATDANILILGESGSGKGELARAIHTWSKRAKKPQVTINCPSLTAELMESELFGHSRGAFTGATESTLGRVSQADGGTLFLDEIGDFPLTLQPKLLRFIQDKEYERVGDPVTRRADVRILAATNRDLGAMVAQGQFREDLLYRLNVIVLNLPPLRERAEDILGLAERFLARFVKDYGRPARGFSEAAREAMRQYPWPGNVRELRNVIERASIICNQELVDVDHLGFSAAQSASSAPRIGESLSLEDLEKAHITAVMASSATLDQAAKTLGIDASTLYRKRKQYGL

SEQ ID NO: 44231 - DNA, 1347 bp, Pseudomonas syringae
  CDS (1)..(1347)
atggaagcagccactgagaatcagggccgtattctgcttgtggacgatgagtccgccatcctccgcaccttccggtactgtctggaagacgaaggttatagtgtcgccactgccaacagcgcagcgcaggccgacacgctcatgcaacgccaggtgttcgacctgtgcttccttgatttgcgtctgggagaagacaacggcctcgatgtgctggcgcagatgcgcattcaggcgccgtggatgcgcgtggtgatcgtgactgcgcactcggcggtggataccgctgtcgatgccattcaggcaggtgcagccgactatctggtcaaaccctgcagccctgaccaattgcgcctggcgaccgccaagcagcttgaagtccgtcagctgtctgcacgcctcgaggcgctcgaaggcgaagttcgcaagcccaaggacggactggattcccacagcccttcaatgatggccattctggaaacagcccgtcaggtcgcggtcaccgatgccaacatcctgattctgggtgagtcgggcacgggtaagggcgaactggctcgggcgattcatggctggagcaagcgcgccaagaagtcctgcgtcacgatcaactgcccatcgctcaccgcagagctgatggaaagcgaattgttcggtcacagccgcggggccttcaccggtgccagcgaaagcacgctggggcgcgtcaatcaggcggacggcggtacgttgtttctcgacgagatcggtgactttccgctgacgctgcagcccaagctgctgcgctttattcaggacaaggaatacgagcgcgttggcgatccggtcacccgcagggccgacgtgcgcatccttgctgccaccaacctcaatctggaggacatggtgcgcagcggacgcttccgcgaagacttgctgtaccgcctgaacgtcatcaccctgcatttgcctgccttgcgtgagcgcagcgaagacattctgaccctggcggaccgctttctggcccgcttcgtcaaagagtacgcccgcccggcacggggtttcagcgaagaagcccgcgccgcgctgctcaactaccgctggccgggcaacattcgtgagctgcgcaacgtgatcgaacgcgccagcatcatctgcccgcaggagcgtgtagaggtcagccatctgggcatggccgagcaaccggcgaacaacgcgccgcgcgtcggggccgctctgagtctggacgagctggaaaaagcgcacatcggtgccgtgctggcgaccagcgaaaccctggatcaggccgccaagacgctgggtatcgatgcttcgacgctttaccgcaaacgcaaacagtacaacctatga

SEQ ID NO: 44232 - protein, 448 aa, Pseudomonas syringae
MEAATENQGRILLVDDESAILRTFRYCLEDEGYSVATANSAAQADTLMQRQVFDLCFLDLRLGEDNGLDVLAQMRIQAPWMRVVIVTAHSAVDTAVDAIQAGAADYLVKPCSPDQLRLATAKQLEVRQLSARLEALEGEVRKPKDGLDSHSPSMMAILETARQVAVTDANILILGESGTGKGELARAIHGWSKRAKKSCVTINCPSLTAELMESELFGHSRGAFTGASESTLGRVNQADGGTLFLDEIGDFPLTLQPKLLRFIQDKEYERVGDPVTRRADVRILAATNLNLEDMVRSGRFREDLLYRLNVITLHLPALRERSEDILTLADRFLARFVKEYARPARGFSEEARAALLNYRWPGNIRELRNVIERASIICPQERVEVSHLGMAEQPANNAPRVGAALSLDELEKAHIGAVLATSETLDQAAKTLGIDASTLYRKRKQYNL

SEQ ID NO: 44233 - DNA, 1386 bp, Escherichia coli
  CDS (1)..(1386)
atgactgctattaatcgcatccttattgtggatgatgaagataatgttcgccgtatgctgagcaccgcttttgcactacaaggattcgaaacacattgtgcgaacaacggacgcacagcattacacctgtttgccgatattcaccctgatgtggtgttgatggatatccgcatgccagagatggacggcatcaaggcactaaaggagatgcgcagccatgagacccggacacccgttattctgatgacggcctatgcggaagtggaaaccgccgtcgaagcgctacgctgcggagccttcgactatgttattaaaccgtttgatctcgatgagttgaatttaatcgttcagcgcgctttacaactccagtcaatgaaaaaagagatccgtcatctgcaccaggcactgagcaccagctggcaatgggggcacattctcaccaacagcccggcgatgatggacatctgcaaagacaccgccaaaattgccctttctcaggccagcgtcttgattagcggtgaaagcggcaccgggaaagagttgattgccagagcgattcactacaattcgcggcgggcaaaggggccgttcattaaagtcaactgcgcggcgctgccggaatcgttgctcgaaagtgaactgtttggtcatgaaaaaggtgcatttactggtgcacaaaccttgcgtcagggattatttgaacgagccaacgaaggtactctgctcctcgacgaaattggcgaaatgccgctggtactacaagccaaattactacgcattctacaggaacgggaatttgaacggattggcggccatcagaccataaaagttgatatccgcatcattgctgccaccaaccgcgacttgcaggcaatggtaaaagaaggcaccttccgtgaagatctcttttatcgccttaacgttattcatttaatactgccgcctctgcgcgatcgccgggaagatatttccctgttagctaatcactttttgcaaaaattcagtagtgagaatcagcgcgatattatcgacatcgatccgatggcaatgtcactgcttaccgcctggtcatggccgggaaatattcgagagctttccaacgttattgaacgcgccgtcgtgatgaattcaggcccgatcattttttctgaggatcttccgccacagattcgtcagccagtctgtaatgctggcgaggtaaaaacagcccctgtcggtgagcgtaatttaaaagaggaaattaaacgcgtcgaaaaacgcatcattatggaagtgctggaacaacaagaaggaaaccgaacccgcactgctttaatgctgggcatcagtcgccgtgcattgatgtataaactccaggaatacggtatcgatccggcggatgtataa

SEQ ID NO: 44234 - protein, 461 aa, Escherichia coli
MTAINRILIVDDEDNVRRMLSTAFALQGFETHCANNGRTALHLFADIHPDVVLMDIRMPEMDGIKALKEMRSHETRTPVILMTAYAEVETAVEALRCGAFDYVIKPFDLDELNLIVQRALQLQSMKKEIRHLHQALSTSWQWGHILTNSPAMMDICKDTAKIALSQASVLISGESGTGKELIARAIHYNSRRAKGPFIKVNCAALPESLLESELFGHEKGAFTGAQTLRQGLFERANEGTLLLDEIGEMPLVLQAKLLRILQEREFERIGGHQTIKVDIRIIAATNRDLQAMVKEGTFREDLFYRLNVIHLILPPLRDRREDISLLANHFLQKFSSENQRDIIDIDPMAMSLLTAWSWPGNIRELSNVIERAVVMNSGPIIFSEDLPPQIRQPVCNAGEVKTAPVGERNLKEEIKRVEKRIIMEVLEQQEGNRTRTALMLGISRRALMYKLQEYGIDPADV

SEQ ID NO: 44235 - DNA, 1368 bp, Vibrio cholerae
  CDS (1)..(1368)
atggtagaagacacggcgtcggtggcggcgctgtatcgttcttacctcacaccgctggatattgatatcaatatcgtgggtaccggacgcgatgccatcgagagtattggccgtcgcgagcctgacttaatcctgctggatttacgtttgccagatatgacggggatggacgtactctatgcagtgaaagagaaatcaccggatgtgcctatcgtgtttatgaccgctcatggttcgattgatacggcggttgaagccatgcgtcatggtgcgcaagactttttgatcaagccgtgtgaagcggaccgactgcgggtcacagtgaataatgcgattcgcaaagcctcgaaactcaaaaacgatgttgataataaaaatcaaaactatcaaggctttattggtagcagtcaaaccatgcaggcggtgtaccgcaccattgactctgcggcgagcagcaaagccagtatttttattaccggcgaaagtggtacaggtaaagaagtgtgcgcggaagcgattcatgccgcgagcaagcgtggagataagccatttatcgccatcaactgtgcggccattccgaaagatctgattgaaagtgagttgtttggtcacgtcaaaggggcttttactggggcggcgactgagcgtcaaggcgcggcagaagcggctgatgggggaaccctctttttggatgaattgtgcgaaatggatctggatctgcagaccaaacttctgcgctttattcagacagggacattccaaaaagtcggctcttccaaaatgaaaagcgtggatgtgcgttttgtgtgtgcaacgaaccgcgatccgtggaaggaagtgcaagaaggacgctttcgtgaagacctgtactaccgcttgtatgtgatcccgctgcatttaccgccattgcgcgcgcgtggtgatgatgtgatcgagattgcttattcactgcttggctttatgtccaaggaagagggcaaagattttgtccgtttgtcggctgaagtggtggagcgttttcgccaatacgagtggccgggcaacgtgcgtcaattgcaaaacgttttgcgcaacgtggttgtgctcaatgaaggtcgtgaaatcaccctagatatgctgcctcctcctcttaatcaaatgtccgcgccgatcaatcgggctttaccgcttgcgcatgagaataaagtatccgtgcatgagatttttccgctgtggatgaccgaaaaacaagccattgaacaagccatcgaagcgtgtgatggcaacattccccgtgccgcaacctatctggatgtcagcccgtcaaccatctatcgcaagctgcaaacttggaatgaaaaagtgaaagaaaaagagaaggaacggtaa

SEQ ID NO: 44236 - protein, 455 aa, Vibrio cholerae
MVEDTASVAALYRSYLTPLDIDINIVGTGRDAIESIGRREPDLILLDLRLPDMTGMDVLYAVKEKSPDVPIVFMTAHGSIDTAVEAMRHGAQDFLIKPCEADRLRVTVNNAIRKASKLKNDVDNKNQNYQGFIGSSQTMQAVYRTIDSAASSKASIFITGESGTGKEVCAEAIHAASKRGDKPFIAINCAAIPKDLIESELFGHVKGAFTGAATERQGAAEAADGGTLFLDELCEMDLDLQTKLLRFIQTGTFQKVGSSKMKSVDVRFVCATNRDPWKEVQEGRFREDLYYRLYVIPLHLPPLRARGDDVIEIAYSLLGFMSKEEGKDFVRLSAEVVERFRQYEWPGNVRQLQNVLRNVVVLNEGREITLDMLPPPLNQMSAPINRALPLAHENKVSVHEIFPLWMTEKQAIEQAIEACDGNIPRAATYLDVSPSTIYRKLQTWNEKVKEKEKER

SEQ ID NO: 44237 - DNA, 1362 bp, Vibrio parahaemolyticus
  CDS (1)..(1362)
atggttgaggatacagcatcggttgcggcgttataccgttcgtacctcacgccgttagggatcgacattaatattgtcggtacaggtagagatgccattgaaagtctcaatcatcgaattccagatcttattcttctcgatcttcgtctgccagatatgacggggatggatgttttgcacgccgttaaaaagagtcatccagatgtgccgatcattttcatgacggctcatggctctatcgatacagcggtagaagcgatgcgtcatggctctcaagactttttgatcaaaccgtgtgaagcagaccgtctgcgtgttacggtcaacaacgcaattcgcaaagcaactaagctaaaaaatgaagcagataatccgggtaatcagaattaccaaggttttatcggcagcagccaaaccatgcagcaggtctatcgcaccattgactctgccgctagcagtaaagcgagtatctttattactggtgaaagtggtacgggtaaagaggtatgcgcagaagccatccacgctgcaagcaaacgtggtgataagccgtttattgccatcaactgtgcggccatacctaaagacttaatcgaaagtgaactatttggtcacgtaaaaggggcatttactggtgcggcaaatgaccgtcaaggtgccgctgagttagccgatggtggcacgttgttcctcgatgaattgtgtgaaatggatttggacttacaaaccaaattattgcgattcatccaaaccggtacgttccagaaagtgggctcttcaaaaatgaagagtgtggacgtgcgcttcgtttgtgcgaccaaccgagacccttggaaagaagttcaagaagggcgtttccgcgaagacttatactaccgtttatacgtgattcctttgcatcttccgcctcttcgcgaacgtggtgaagatgtgattgaaattgcgtactcactgttaggctacatgtctcatgaagagggcaaaaactttgtccgcttttctcaagaagtgattgaccgctttaacagttatgagtggccgggtaacgtccgacaactacaaaacgtactacgcaatatcgtggtgctcaacaacggcaaagaaattacgttagatatgttgccaccgccgctgaatcaaccgttagataggccatctgtatctaaactgattgagccaaaagcgatgactgtttcagagatcatgccgctatggatgacagagaaaatggcgattgagcaagcgattgaggcgtgtgacggcaatattccaagagccgctgggtatcttgatgtcagtccgtcaacgatttaccgcaaactacaagcatggaatggtaaagaagagcggcagaaggtgtaa

SEQ ID NO: 44238 - protein, 453 aa, Vibrio parahaemolyticus
MVEDTASVAALYRSYLTPLGIDINIVGTGRDAIESLNHRIPDLILLDLRLPDMTGMDVLHAVKKSHPDVPIIFMTAHGSIDTAVEAMRHGSQDFLIKPCEADRLRVTVNNAIRKATKLKNEADNPGNQNYQGFIGSSQTMQQVYRTIDSAASSKASIFITGESGTGKEVCAEAIHAASKRGDKPFIAINCAAIPKDLIESELFGHVKGAFTGAANDRQGAAELADGGTLFLDELCEMDLDLQTKLLRFIQTGTFQKVGSSKMKSVDVRFVCATNRDPWKEVQEGRFREDLYYRLYVIPLHLPPLRERGEDVIEIAYSLLGYMSHEEGKNFVRFSQEVIDRFNSYEWPGNVRQLQNVLRNIVVLNNGKEITLDMLPPPLNQPLDRPSVSKLIEPKAMTVSEIMPLWMTEKMAIEQAIEACDGNIPRAAGYLDVSPSTIYRKLQAWNGKEERQKV

SEQ ID NO: 44239 - DNA, 1362 bp, Vibrio vulnificus
  CDS (1)..(1362)
atggtagaagacaccgcttctgtcgcagccctctatcgctcctatctcatgccattgggtatcgatatcaatatcgtgggtactgggcgcgacgcgatagacagtttaaaacatcgcattccagatcttattctgctggatttacgtctaccggacatgacgggaatggacgtattgcatgcagtgaaagcaagtcaccctgatgttcctatcattttcatgaccgcacacggctcgatcgatactgccgttgaagcaatgcgacatggttctcaggattttcttatcaagccatgcgaagcggatcgcttgagggtcacggtaaacaacgctatccgcaaagcgagtaaattgaagaatgatgcggacagtgcaggcagccaaaattatcaaggctttatcggcagtagccaaaaaatgcagcaggtttatcgcaccattgactccgcggcgagcagtaaagcaagcatctttatcacaggtgaaagtggtacaggtaaagaggtgtgcgcagaagccattcatgcggccagtcgacgtggagacaagccatttattgcgattaactgtgctgcgattcccaaagatttgattgaaagcgagctatttggtcatgtcaaaggtgcgtttaccggcgctgcgaccgatcgccaaggggcggcagagctcgctgatggaggcacacttttcctggatgagctgtgtgaaatggacttggatctgcaaacaaaattgctgcgttttatccaaacgggtactttccaaaaagtaggctcttcaaaaatgaagagtgttgacgtgcgttttgtgtgcgcgacaaaccgagacccctggaaagaggtacaagaagggcgctttcgtgaagatttgtactaccgactttatgtgattccactgcacttgccaccacttcgtgaacgtggagaggatgtcatcgagatcgcttactcgttactgggttacatgtcacacgaggaagggaaaaactttgttcgtttctctcaacctgtgatagatagatttaacgaatatgagtggccaggtaatgtgcgtcagttacaaaatgtgctgcgtaatgtggtggtgcttaacaacggtaaagagattaccatggagatgctgccgcctcctttgaaccagccctttgaacgcaaagaaagtgtgcagcctgatctgagtgagttgatttccgtcagggatatttgtccattgtggttgacagagaaactggcgattgaacaagcgatcaaagcgtgtgatggtaacattccgagagccgccggctatctggatgtcagcccgtcaacgatttatcgcaagttacaggcgtggaacgaaaaagaagaaaaacagaaagcataa

SEQ ID NO: 44240 - protein, 453 aa, Vibrio vulnificus
MVEDTASVAALYRSYLMPLGIDINIVGTGRDAIDSLKHRIPDLILLDLRLPDMTGMDVLHAVKASHPDVPIIFMTAHGSIDTAVEAMRHGSQDFLIKPCEADRLRVTVNNAIRKASKLKNDADSAGSQNYQGFIGSSQKMQQVYRTIDSAASSKASIFITGESGTGKEVCAEAIHAASRRGDKPFIAINCAAIPKDLIESELFGHVKGAFTGAATDRQGAAELADGGTLFLDELCEMDLDLQTKLLRFIQTGTFQKVGSSKMKSVDVRFVCATNRDPWKEVQEGRFREDLYYRLYVIPLHLPPLRERGEDVIEIAYSLLGYMSHEEGKNFVRFSQPVIDRFNEYEWPGNVRQLQNVLRNVVVLNNGKEITMEMLPPPLNQPFERKESVQPDLSELISVRDICPLWLTEKLAIEQAIKACDGNIPRAAGYLDVSPSTIYRKLQAWNEKEEKQKA

SEQ ID NO: 44241 - DNA, 1410 bp, Escherichia coli
  CDS (1)..(1410)
atgcaacgagggatagtctgggtagtcgatgacgatagttccatccgttgggtgcttgaacgtgcgctcgctggggcaggtttaacctgtacgacgtttgagaacggcgcagaagtgctggaggcgctggcgagcaaaacgccggatgtgctgctttcagatatccgtatgccgggaatggacgggctggcgctgctcaagcagattaaacagcgccatccaatgcttccggtcatcattatgaccgcacattccgatctggatgctgccgtcagcgcctatcaacaaggggcgtttgattatctgcccaaaccgtttgatatcgacgaagcagtggcgctggttgagcgcgctatcagtcattaccaggaacagcagcagccgcgtaatgttcagcttaacggcccaacgaccgatatcatcggcgaagcgccagccatgcaggacgtgttccgtattatcggtcggctttcgcgttcttctattagcgtgctgattaacggcgaatccggcaccggtaaagaactggtcgctcatgccctgcatcgccacagtccgcgcgccaaagcgccgtttatcgcgctgaatatggcagctatcccaaaagatttgatcgaatcagaactgtttggccacgagaaaggcgcgtttactggcgcgaataccattcgtcaggggcgttttgaacaggccgatggcggtacattattcctcgacgaaattggtgatatgccgctggatgtgcagacgcgtttgctgcgcgtgctggcagacggtcagttttaccgcgttggcggctatgcgccggtgaaagtggatgtgcggattatcgctgccactcaccagaatctcgaacagcgagtgcaggaaggtaagttccgtgaggatctgttccaccgcctgaacgttatccgcgttcatctgccgccgctgcgcgaacgtcgggaagatattccccgtctggcgcgccattttttacaggttgccgcgcgcgaactgggcgtagaagcgaagttactgcatccggaaaccgaagctgctctgacgcgtctggcgtggccaggcaacgtgcgccagctggaaaacacctgccgctggctaacggtgatggccgccgggcaggaagtgttgattcaggatttgcccggcgaactgtttgaatcaacggttgcggagagtacttcgcaaatgcaaccggacagctgggcgacgcttcttgcgcagtgggcagacagagcgctgcgttccggtcatcaaaatctgctttccgaagcgcagccagagctggagcggacgttactgacgaccgcgttgcgacatacgcaggggcataaacaggaagcggcgcggctactcggctggggccgcaacaccctgacgcgtaagttaaaagagctggggatggagtga

SEQ ID NO: 44242 - protein, 469 aa, Escherichia coli
MQRGIVWVVDDDSSIRWVLERALAGAGLTCTTFENGAEVLEALASKTPDVLLSDIRMPGMDGLALLKQIKQRHPMLPVIIMTAHSDLDAAVSAYQQGAFDYLPKPFDIDEAVALVERAISHYQEQQQPRNVQLNGPTTDIIGEAPAMQDVFRIIGRLSRSSISVLINGESGTGKELVAHALHRHSPRAKAPFIALNMAAIPKDLIESELFGHEKGAFTGANTIRQGRFEQADGGTLFLDEIGDMPLDVQTRLLRVLADGQFYRVGGYAPVKVDVRIIAATHQNLEQRVQEGKFREDLFHRLNVIRVHLPPLRERREDIPRLARHFLQVAARELGVEAKLLHPETEAALTRLAWPGNVRQLENTCRWLTVMAAGQEVLIQDLPGELFESTVAESTSQMQPDSWATLLAQWADRALRSGHQNLLSEAQPELERTLLTTALRHTQGHKQEAARLLGWGRNTLTRKLKELGME

SEQ ID NO: 44243 - DNA, 1410 bp, Klebsiella pneumoniae
  CDS (1)..(1410)
atgcaacgagggatagcatggatcgttgacgacgatagctccatccgttgggtgcttgaacgcgcgctcaccggggcaggcttgagttgtacaacgtttgaaagcggcaatgaggtgcttgatgccctcacgaccaaaaccccggatgtactgctgtctgatatccgcatgccggggatggatgggctggcgctgctaaagcaaattaaacagcgtcatccgatgctcccggtcatcataatgacggcgcattcggatcttgacgcggcggtcagcgcctatcagcagggcgcttttgattatctgccgaaaccgtttgatattgatgaagcggtggcgctggtcgaccgtgcgattagccattaccaggaacagcagcagccgcgtaatgcgccgattaatagcccgacggccgatattatcggcgaacggccggccatgcaggacgtttttcgcattatcggccgcctgtcgcgctcatcaatcagcgtactgatcaacggggaatccggtaccggtaaagagctggttgcccatgctctccatcggcatagtccgcgcgccaaggcgccgtttattgcgctaaatatggcagcaattcctaaagatttaatcgaatcagagctatttggccacgagaaaggggcctttaccggcgccaataccgtgcgtcagggacgctttgagcaggcagacggcggcacgctattcctcgacgagatcggcgatatgccgctggacgtacagactcgcctgctgcgcgtcctcgctgatggccagttttatcgcgtcggcggctatgcgccggtgaaagtggatgtgcgcatcattgccgccactcaccagaaccttgagctgcgcgtccaggaaggaaaattccgcgaggatttattccaccgcctgaacgtgattcgcgtccatctgccgccgctgcgcgagcgtcgggaagatattcctcgcctggcgaggcacttcctgcaaattgccgctcgtgaactgggcgtcgaggccaaacagctgcatccggagacggagatggcgttaacccgactggcatggccgggtaacgtacgtcagctggaaaacacctgtcgctggctgacggtaatggccgcaggtcaggaggttctgacgcaggatcttcccagcgagctgtttgaaaccgcgataccggataacccaacgcaaatgctgccggatagctgggccacgctgctgggacaatgggccgatcgcgctttgcgttccggtcatcaaaacctgctctcggaagcgcagcctgagatggagcgcacgctgctgaccaccgccttacgccacactcaggggcataaacaagaggcggcccggctgctgggatggggtcgtaataccctgacgcgtaagctaaaagagttggggatggagtag

SEQ ID NO: 44244 - protein, 469 aa, Klebsiella pneumoniae
MQRGIAWIVDDDSSIRWVLERALTGAGLSCTTFESGNEVLDALTTKTPDVLLSDIRMPGMDGLALLKQIKQRHPMLPVIIMTAHSDLDAAVSAYQQGAFDYLPKPFDIDEAVALVDRAISHYQEQQQPRNAPINSPTADIIGERPAMQDVFRIIGRLSRSSISVLINGESGTGKELVAHALHRHSPRAKAPFIALNMAAIPKDLIESELFGHEKGAFTGANTVRQGRFEQADGGTLFLDEIGDMPLDVQTRLLRVLADGQFYRVGGYAPVKVDVRIIAATHQNLELRVQEGKFREDLFHRLNVIRVHLPPLRERREDIPRLARHFLQIAARELGVEAKQLHPETEMALTRLAWPGNVRQLENTCRWLTVMAAGQEVLTQDLPSELFETAIPDNPTQMLPDSWATLLGQWADRALRSGHQNLLSEAQPEMERTLLTTALRHTQGHKQEAARLLGWGRNTLTRKLKELGME

SEQ ID NO: 44245 - DNA, 1422 bp, Proteus vulgaris
  CDS (1)..(1422)
atgcaaaaaggaaatgtatgggttgttgatgatgacagctcaattcgctgggttcttgaacgcgcaattacacgagaaggtatgttatgtcgtgcttttgaacatgctaacgatgtactcaaggcgctaaatagcgaacagcctgatgtattattatcagacattcgtatgcctgatatggatggtttatctctacttaaaataataaaagaacaatatcctacactgcccgttattattatgactgcacattctgatcttgatgccgcagtgaatgcttatcaacaaggtgcttttgattacttaccaaaaccttttgatatcgatgaaacgcttgcactaatagagagagcaatcacacactatcgagagcaaaagcagccgaataatgctgaaaatatacttcaatctgtttctgatatgattggcgaagcccctgcaatgcaagaagtttatcgtattatcggtcgactttctcgctcatctattagtgtgctaattaatggagaatcgggtacaggtaaagagcttgttgctcacgcactgcatcgtcatagccctcgtgctttggctccttttattgccctaaatatggcagcgatccccaaagatttaattgaatctgaactctttggtcatgaaaaaggtgcgtttactggtgcttctcaagtacgccaaggccgttttgaacaagccaatggtggttctctttttctggatgaaattggtgatatgccattagatatccaaactcgtttattacgcgtattggctgaagggcaattttatcgagttggaggctatgcccctgttaaagtggatgtccgaattattgcagcaacccatcaggatttagaaaaacgagtgaatgaaggcgattttcgtgaagatctctaccatcgcctaaatgtgattcgtatccaattaccacctcttcgcgatagaacagaagatattcctagtttagcgcgctactttctgcaaaaaacggcaaaagagctgggtgttgaaaccaaatctctgcatgaacaaagcttaaaaaccatgatggaatacgtttggtctggaaacgtaagacaactcgaaaatgtgtgtcgttggctgacggttatgactgcaagccaagaaatcatgccacaagatttaccgtctgagatccgtttagcagatgagaaagcaaaaaatattaatcggcttacatctcaacattggtcgcagcatctctctttatgggcagatgaagctttaggtgaaggcaaagaaaatattcttaatgatgcactgccacaatttgaacgcacgctattattaagcgcccttgcttatacacaaggccataaacaagacgcagcgcggctgttaggttggggtagaaatacgctaacacgcaaacttaaagaattgggtatagaggattattaa

SEQ ID NO: 44246 - protein, 473 aa, Proteus vulgaris
MQKGNVWVVDDDSSIRWVLERAITREGMLCRAFEHANDVLKALNSEQPDVLLSDIRMPDMDGLSLLKIIKEQYPTLPVIIMTAHSDLDAAVNAYQQGAFDYLPKPFDIDETLALIERAITHYREQKQPNNAENILQSVSDMIGEAPAMQEVYRIIGRLSRSSISVLINGESGTGKELVAHALHRHSPRALAPFIALNMAAIPKDLIESELFGHEKGAFTGASQVRQGRFEQANGGSLFLDEIGDMPLDIQTRLLRVLAEGQFYRVGGYAPVKVDVRIIAATHQDLEKRVNEGDFREDLYHRLNVIRIQLPPLRDRTEDIPSLARYFLQKTAKELGVETKSLHEQSLKTMMEYVWSGNVRQLENVCRWLTVMTASQEIMPQDLPSEIRLADEKAKNINRLTSQHWSQHLSLWADEALGEGKENILNDALPQFERTLLLSALAYTQGHKQDAARLLGWGRNTLTRKLKELGIEDY

SEQ ID NO: 44247 - DNA, 1455 bp, Rhizobium meliloti
  CDS (1)..(1455)
atgacgggcgcaacgatcctcgtcgcggatgacgacgcagccattcgcaccgtgctgaaccaggcgctcagccgtgccggatacgatgtgcgcatcacctccaatgccgcaaccctctggcgctggatagcagccggcgacggcgacctggtcgtgaccgatgtcgtgatgccggatgaaaacgccttcgatctcctgccacggatcaagaaggcacggccggatctgccggttctcgtgatgagcgctcaaaataccttcatgacggccatcaaggcttcggagaagggcgcttacgattatctgccgaagccgttcgatctgacggagctgatcggcatcatcggccgggcgctcgccgaaccgaagcgacggccctccaaactcgaggacgattcgcaggacgggatgccgctggtcggccgttccgccgccatgcaggaaatctaccgcgtgcttgcgcggctgatgcagaccgacctcacgctgatgatcaccggcgagtccggcaccggcaaggaactcgttgcccgtgcactgcacgactatggcaagcggagaaatggccccttcgtcgccatcaacatggcggcgatcccgcgcgacctcatcgagtcggaactgttcggtcatgagaagggggcttttaccggcgcccagacgcgctccaccgggcgcttcgagcaggccgaaggggggacgctcttcctcgacgaaatcggcgacatgccgatggatgcgcagacgcgtctcctgcgcgtgctgcagcagggcgagtatacgaccgtcggcggacgcacgccgatccgctcggatgtccgcatcgtcgctgccaccaacaaggacctgaaacaatcgatcaatcagggccttttccgcgaagacctctactatcgcctgaatgtcgtgcccctgcgtctgccgcccctgagagaccgcgccgaagacatcccggaccttgtccgccatttcgtccagcaggccgaaaaggaagggctcgacgtcaagcgcttcgatcaggaggcgctcgaattgatgaaggcgcatccctggccgggcaatgtgcgcgagctcgagaacctcgttcgccgtctgacggcactttatccacaggatgtcattacccgcgaaatcatcgagaacgaactgcgttcggagatcccggacagcccgatcgagaaggccgcggcgcgctcgggctcgctgtcgatatcgcaggcggtcgaggaaaacatgcggcagtatttcgcgagctttggcgatgccttaccgccctccggcctctacgatcgcgtccttgcggaaatggaatatcctctgatcctcgcggctctgacggcgactcgcggcaaccagatcaaggcggccgacctcctgggtctcaaccgcaatacgctgcgcaagaagatccgcgaactcggggtctcggtgtaccgcagctcgcgtagcgcttga

SEQ ID NO: 44248 - protein, 484 aa, Rhizobium meliloti
MTGATILVADDDAAIRTVLNQALSRAGYDVRITSNAATLWRWIAAGDGDLVVTDVVMPDENAFDLLPRIKKARPDLPVLVMSAQNTFMTAIKASEKGAYDYLPKPFDLTELIGIIGRALAEPKRRPSKLEDDSQDGMPLVGRSAAMQEIYRVLARLMQTDLTLMITGESGTGKELVARALHDYGKRRNGPFVAINMAAIPRDLIESELFGHEKGAFTGAQTRSTGRFEQAEGGTLFLDEIGDMPMDAQTRLLRVLQQGEYTTVGGRTPIRSDVRIVAATNKDLKQSINQGLFREDLYYRLNVVPLRLPPLRDRAEDIPDLVRHFVQQAEKEGLDVKRFDQEALELMKAHPWPGNVRELENLVRRLTALYPQDVITREIIENELRSEIPDSPIEKAAARSGSLSISQAVEENMRQYFASFGDALPPSGLYDRVLAEMEYPLILAALTATRGNQIKAADLLGLNRNTLRKKIRELGVSVYRSSRSA

SEQ ID NO: 44249 - DNA, 1410 bp, Salmonella typhimurium
  CDS (1)..(1410)
atgcaacgaggaatagtctgggtcgtcgatgatgatagttccatccgttgggtgcttgagcgtgctctcgccggggcagggttgacctgtaccacctttgagaatggtaatgaagtactggctgcgctggccagtaaaacgccggacgtcttgctgtcggatatccgaatgccgggaatggacgggctggcgctattaaagcagattaaacagcgtcacccgatgcttccggtcatcattatgaccgcgcattccgatttagatgccgccgtgagcgcctatcagcagggggcgtttgattatctgcctaaaccgtttgatattgatgaagccgtcgctctggtcgagcgcgcgattagccactatcaggagcagcaacagccgcgtaatatcgaggttaacggcccgacaacagacatgataggcgaagcgcccgccatgcaggatgtgtttcgcattattggtcggctgtcgcgttcttcgattagcgtgctgattaacggcgaatcagggaccggtaaagaactggtcgcccatgcgcttcaccgccatagcccacgcgccaaagcgccgtttatcgcactcaatatggcggccatcccgaaagatttgattgaatccgaactgtttggccatgagaaaggcgcttttaccggggcgaataccatccggcagggccgtttcgagcaggctgacggcggcacgctgtttctggacgaaattggcgatatgccgctggatgtccagactcgtctgttacgcgtgctggctgacggacagttctaccgcgtgggcgggtacgcgccggtaaaagtcgatgtgcgcattatcgccgccacccaccagaacctcgaacgacgcgttcaggaagggaaattccgcgaagacctgttccaccgcctgaacgtgattcgtatccatcttccgccgttgcgtgaacgccgtgaggatattccgcgcctggcgcgccattttttgcaggtcgccgcccgtgaattaggcgtggaagccaaattattacatccggaaaccgaaacggcgttaacgcgcctggcatggcctggtaacgtgcgtcagttagaaaatacctgccgctggctcaccgtcatggccgccggacaggaggtattgatccaggatttaccgggcgaactgtttgaagcctcgacgccggatagcccgtcccacctgccgccggatagctgggctacattactggcacaatgggcggaccgcgccttgcgatccggtcatcaaaacctgctttctgaagcgcagccagaactggagagaacgctactgaccacggcattacgccatacgcagggtcataaacaggaagccgccaggctgctcggttgggggcgaaacaccctaacgcggaagttgaaagagctgggaatggagtaa

SEQ ID NO: 44250 - protein, 469 aa, Salmonella typhimurium
MQRGIVWVVDDDSSIRWVLERALAGAGLTCTTFENGNEVLAALASKTPDVLLSDIRMPGMDGLALLKQIKQRHPMLPVIIMTAHSDLDAAVSAYQQGAFDYLPKPFDIDEAVALVERAISHYQEQQQPRNIEVNGPTTDMIGEAPAMQDVFRIIGRLSRSSISVLINGESGTGKELVAHALHRHSPRAKAPFIALNMAAIPKDLIESELFGHEKGAFTGANTIRQGRFEQADGGTLFLDEIGDMPLDVQTRLLRVLADGQFYRVGGYAPVKVDVRIIAATHQNLERRVQEGKFREDLFHRLNVIRIHLPPLRERREDIPRLARHFLQVAARELGVEAKLLHPETETALTRLAWPGNVRQLENTCRWLTVMAAGQEVLIQDLPGELFEASTPDSPSHLPPDSWATLLAQWADRALRSGHQNLLSEAQPELERTLLTTALRHTQGHKQEAARLLGWGRNTLTRKLKELGME

SEQ ID NO: 44251 - DNA, 1338 bp, Pseudomonas aeruginosa
  CDS (1)..(1338)
atgagccgacaaaaagccctgatcgtcgacgatgaaccggatatccgcgaactgctggaaatcactctcggccgcatgaagctggacacccgcagcgcccgcaacgtcaaggaagcccgcgagttgctggcccgcgagccgttcgacctgtgcctcaccgacatgcgcctgccggacggcagcggcctcgatctggtccagtacatccagcagcgccatccacagaccccggtggccatgatcaccgcgtacggcagcctggacaccgcgatccaggcgctcaaggccggtgccttcgacttcctcaccaaaccggtcgacctcggtcgcttgcgggagctggtggcaaccgccctgcgcttgcgcaacccggaagccgaggaagcgccggtggacaaccgcctgctcggcgagtcgccgccgatgcgcgccctgcgcaaccagatcggcaagctggcgcgcagccaggcgccggtctacatcagtggcgagtccggtagcggcaaggagctggtggcgcgcctgatccacgagcaggggccacgtatcgagcggccgttcgtgccggtgaactgcggcgcgattccctccgaactgatggaaagcgagttcttcggccacaagaaaggcagcttcactggcgctatcgaagacaagcagggcctgttccaggccgccagcggcggcaccctgttcctcgacgaagtcgccgacctgccgatggccatgcaggtcaaactgctccgggcgatccaggaaaaggccgtgcgcgcggtcggcggccagcaggaggtcgccgtcgacgtgcgcatcctctgcgccacccacaaggacctcgccgccgaagtcggcgccgggcgcttccgccaggacctctactaccgcctcaacgtcatcgagctgcgcgtaccgccgctgcgcgaacgccgcgaggacatcccgctgctcgccgaacgcatcctcaagcgcctggccggcgacaccggcctgccggccgccaggctgaccggcgacgcacaggagaagctgaagaactaccgcttcccgggcaacgtccgcgagctggaaaacatgctggagcgcgcctacaccctgtgcgaagacgaccagatccagcctcacgacctgcgcctggccgatgcgccgggtgccagccaggaaggcgccgcgagcctgagcgaaatcgacaacctcgaggactacctggaagacatcgagcgcaagctgatcatgcaggcgctcgaggagacccgctggaaccgcaccgccgcggcccagcgcctgggcctgacgttccgctcgatgcgctaccgcctgaaaaagctgggcatcgactga

SEQ ID NO: 44252 - protein, 445 aa, Pseudomonas aeruginosa
MSRQKALIVDDEPDIRELLEITLGRMKLDTRSARNVKEARELLAREPFDLCLTDMRLPDGSGLDLVQYIQQRHPQTPVAMITAYGSLDTAIQALKAGAFDFLTKPVDLGRLRELVATALRLRNPEAEEAPVDNRLLGESPPMRALRNQIGKLARSQAPVYISGESGSGKELVARLIHEQGPRIERPFVPVNCGAIPSELMESEFFGHKKGSFTGAIEDKQGLFQAASGGTLFLDEVADLPMAMQVKLLRAIQEKAVRAVGGQQEVAVDVRILCATHKDLAAEVGAGRFRQDLYYRLNVIELRVPPLRERREDIPLLAERILKRLAGDTGLPAARLTGDAQEKLKNYRFPGNVRELENMLERAYTLCEDDQIQPHDLRLADAPGASQEGAASLSEIDNLEDYLEDIERKLIMQALEETRWNRTAAAQRLGLTFRSMRYRLKKLGID

SEQ ID NO: 44253 - DNA, 1335 bp, Escherichia coli
  CDS (1)..(1335)
atgagccataaacctgcgcatttattattggtcgatgacgatccgggattgctgaaactgcttggcctgcgcctgaccagcgaaggctacagtgtggtcacggcggaaagtggcgctgaaggattacgggtactgaatcgcgaaaaagtagatttagtcatcagcgacctgcggatggatgaaatggacggtatgcagctgtttgctgaaatccagaaagtgcagccgggaatgccggtaattattcttaccgcgcatggttctattcccgatgccgttgctgcaacacagcagggcgtttttagtttcctcaccaagcctgtcgacaaagacgcgctatatcaggcaattgacgatgcgctggagcaatccgcgccagccaccgatgaacgctggcgcgaggcaattgtcacccgcagcccgctgatgctgcgtttgctggaacaggcgcggctggtggcgcaatcagacgtcagcgttttgattaacggtcagagcggcaccgggaaagagattttcgcccaggctatccacaacgccagcccgcgcaacagcaaaccatttattgctattaactgtggcgcattgcccgagcaattgctggagtcggagctgtttggtcatgcgcgtggcgcgtttactggcgctgtcagcaatcgcgaaggtttattccaggcggcggaaggcggaacgctatttctcgatgaaattggcgatatgcctgcgccgttacaggtcaaactgctgcgcgtgttgcaggagcgtaaagtgcgcccgctgggcagtaaccgcgatattgatatcaatgtgcggattatttctgccactcaccgtgatctgccaaaagcgatggcgcgcggggaattccgcgaagatctctattaccgcctcaacgttgtcagcctgaaaattccggcactggcggagcgcacagaagacattccgctactggcaaatcacctgttgcgccaggcggcagagcgacataaaccgtttgtccgcgcgttctctaccgatgcgatgaaacgcctgatgaccgcgagctggccgggtaatgtgcgccagttggtcaacgtgattgaacagtgcgtggcgctgacctcatctccggtgattagtgatgcgctggtggagcaggcgctggagggtgaaaatacggcgctgccaacctttgttgaggcacgtaatcagtttgaactcaactatttgcgtaagctgctgcaaatcaccaaaggcaacgtcacccacgcggcgagaatggcggggcgcaaccggacagaattttataaactgctttcccgacacgagctggatgcaaacgatttcaaggaatga

SEQ ID NO: 44254 - protein, 444 aa, Escherichia coli
MSHKPAHLLLVDDDPGLLKLLGLRLTSEGYSVVTAESGAEGLRVLNREKVDLVISDLRMDEMDGMQLFAEIQKVQPGMPVIILTAHGSIPDAVAATQQGVFSFLTKPVDKDALYQAIDDALEQSAPATDERWREAIVTRSPLMLRLLEQARLVAQSDVSVLINGQSGTGKEIFAQAIHNASPRNSKPFIAINCGALPEQLLESELFGHARGAFTGAVSNREGLFQAAEGGTLFLDEIGDMPAPLQVKLLRVLQERKVRPLGSNRDIDINVRIISATHRDLPKAMARGEFREDLYYRLNVVSLKIPALAERTEDIPLLANHLLRQAAERHKPFVRAFSTDAMKRLMTASWPGNVRQLVNVIEQCVALTSSPVISDALVEQALEGENTALPTFVEARNQFELNYLRKLLQITKGNVTHAARMAGRNRTEFYKLLSRHELDANDFKE

SEQ ID NO: 44255 - DNA, 1332 bp, Klebsiella oxytoca
  CDS (1)..(1332)
atgagtggcgagcaggtcgatattctggtggtggacgatgacattagccactgcactatcttacaggcgctgttgcggggctggggttatcgggttgcgctggccaacaacggcttacaggcgctggaaaaggtgcgcgagaaggtctttgatctggtgctttgcgatattcgcatggcggagatggacggcatcgaaacgctaaaagagatcaaaaccttcaatccgtcgattcccgttctgatcatgaccgcgtactccagcgttgataccgctgtagaggcgctgaaatccggtgcgctggactaccttattaagccgctggactttgacaagctgcagctgacgctatccgaggcgttggcccacacccggctaagcgagtctcccgtcacagagacccccgccgcccagtttggtatggtgggggatagcccggcgatgcgggcgctgctgaacaatatcaccctggttgcgccctccgatgcgacggtattaattcacggcgagtcgggcacagggaaagagctggtcgcgcgagcgctgcacgccagcagcgctcgcagccgcaggccgctggtgatcctcaactgtgcggcgctcaacgagtcgttgctggagtcggagctgtttggccatgagaagggcgcgtttaccggtgcggacaaacggcgagaagggcgcttcgttgaagcggacggcggtacgctgttccttgatgagataggcgacatttcgccgttgatgcaggtgcgcctgctgcgggcgattcaggagcgcgaagtgcagcgcgtgggcagcaaccagaccctttcggttgacgtacggctgattgccgccacccatcgggatttagccgaagaggtcagcgccggacgttttcgccaggatctctactaccgtttgaacgtcgtgactatcgacatgccgccgctgcgtcatcgcagggaggatatccccccgctggcgcgctatttcctgcaacggtatgccgagcgtaaccgcaaagcggtacagggatttacgccacaggcgatggacttgctgattcactacgcctggccgggcaatattcgcgagctggaaaatgcggtggagcgggcggtggtcctgctgaccggcgagtacatctccgaacgcgagctgccgctggcgattaccggtacgccggttgcggacgcgccgcacggcgatgatagtattcagccgctggtggaggtggagaaagaagcgattctggcggcacttgaaagaacgggcggcaacaaaactgaagccgcccgtcggttaggcattacgcgcaaaacgctgctggcaaagctcagccgttag

SEQ ID NO: 44256 - protein, 443 aa, Klebsiella oxytoca
MSGEQVDILVVDDDISHCTILQALLRGWGYRVALANNGLQALEKVREKVFDLVLCDIRMAEMDGIETLKEIKTFNPSIPVLIMTAYSSVDTAVEALKSGALDYLIKPLDFDKLQLTLSEALAHTRLSESPVTETPAAQFGMVGDSPAMRALLNNITLVAPSDATVLIHGESGTGKELVARALHASSARSRRPLVILNCAALNESLLESELFGHEKGAFTGADKRREGRFVEADGGTLFLDEIGDISPLMQVRLLRAIQEREVQRVGSNQTLSVDVRLIAATHRDLAEEVSAGRFRQDLYYRLNVVTIDMPPLRHRREDIPPLARYFLQRYAERNRKAVQGFTPQAMDLLIHYAWPGNIRELENAVERAVVLLTGEYISERELPLAITGTPVADAPHGDDSIQPLVEVEKEAILAALERTGGNKTEAARRLGITRKTLLAKLSR

SEQ ID NO: 44257 - DNA, 1326 bp, Salmonella typhi
  CDS (1)..(1326)
gtgatacgcggaaaaatcgatattctggttgtggatgatgatgtaagccactgcacgattttacaggcgctgcttcggggctggggctataacgtcgctctggcctacagtgggcatgatgcgttggctcaggtgcgtgagaaagtctttgatctggtactgtgcgatgtgcgtatggcggagatggacggtatcgccacgctgaaggagattaaagcgctcaaccccgccattccgattttgattatgacggcattctccagcgtggaaacggcggtagaggcgttgaaagccggcgcgctcgactatttaattaaaccgctggattttgaccgtctgcaggagacgctggaaaaggcgttggcgcatacgcgggaaacgggcgctgaattgccatcggcgtcggctgcgcaatttggcatgattggcagcagcccggcgatgcaacatttattgaatgaaatcgcgatggtcgcaccatcagacgccacggtattgattcacggagactccggcacgggtaaagagctggtggcgcgggcgctgcacgcctgtagcgccaggagcgataaaccgctggtcacgctcaactgcgcggcgcttaatgaatcgctgctggagtctgagctgttcggacacgaaaaaggcgcgtttaccggcgcggataaacgtcgggagggacgctttgtcgaagctgacggcgggacattgtttcttgatgaaatcggcgatatctcgccgttaatgcaggtacgtttgctgcgggcgattcaggagcgcgaagtgcaacgcgtgggaagtaaccagacgatatctgtggatgtttggttaattgccgctacccaccgcgacctggcggaagaggtgagtgccggtcgctttcgccaggatctctattaccgcctgaatgtggtggcgattgaaatgccttctttgcgccagcgtcgggaagatattccgctactggcagaccattttctgcggcgttttgccgaacgtaaccgaaaagcggtgaaggggtttacgccgcaggcgatggatctgctgatccactacgactggccgggtaatatccgtgagctggaaaacgctatcgaacgagcggtggtgttgctgacgggagaatacatttctgaacgcgaattgcctctcgctattgccgcgacgccgataaaagcggaaaacagcgccgaaatccaaccgttggtcgatgtggagaaagaggtgattctggcggcgctggaaaaaacgggcggcaacaaaacggaagccgcccgtcaattgggcattacgcgcaaaacgctgctggctaaactcagccgttag

SEQ ID NO: 44258 - protein, 441 aa, Salmonella typhi
MIRGKIDILVVDDDVSHCTILQALLRGWGYNVALAYSGHDALAQVREKVFDLVLCDVRMAEMDGIATLKEIKALNPAIPILIMTAFSSVETAVEALKAGALDYLIKPLDFDRLQETLEKALAHTRETGAELPSASAAQFGMIGSSPAMQHLLNEIAMVAPSDATVLIHGDSGTGKELVARALHACSARSDKPLVTLNCAALNESLLESELFGHEKGAFTGADKRREGRFVEADGGTLFLDEIGDISPLMQVRLLRAIQEREVQRVGSNQTISVDVWLIAATHRDLAEEVSAGRFRQDLYYRLNVVAIEMPSLRQRREDIPLLADHFLRRFAERNRKAVKGFTPQAMDLLIHYDWPGNIRELENAIERAVVLLTGEYISERELPLAIAATPIKAENSAEIQPLVDVEKEVILAALEKTGGNKTEAARQLGITRKTLLAKLSR

SEQ ID NO: 44259 - DNA, 25 bp, Primer
atgacgcacgataatatcgatattc

SEQ ID NO: 44260 - DNA, 25 bp, Primer
ttaacgcgacagttttgccaatagc

SEQ ID NO: 44261 - protein, 548 aa, consensus
  MISC_FEATURE (1)..(548): consensus for the disclosure of xaa see table XV
DDXXXXXXXXXXXLXXXXXXXXXXXXXXXXXXXXXXXXXXXXXXXXXXXXDXXXXXXXXXGXXXXXXXXXXXXXXXXXXVXXXTXXXXXXXAVXAXXXXGAXXXXXKPXXXXXXXXXXXXXXXXXXXXXXXXXXXXXXXXXXXXXXXXXXXXXXXXXXXXXXXXXXXXXXXXXMXXXXXXXXXXXXXXXXXVXIXGESGXGKEXXAXXXHXXSXRXXXPFXXXNXXAXXXXLXESELFGHXXGAFTGAXXXXXGXXXXAXXGTLFLDEXXXXXXXXQXXLLRXXXXXXXXXXGXXXXXXXDXRXXXATXXXLXXXXXXGXFRXDLXXRLXVXXXXXPXLRXRXXDXXXLXXXXXXXXXXXXXXXXXXXXXXXXXXXXXXXXWPGNXRXLXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXLXXXXXXXXXXAXXL

SEQ ID NO: 44262 - protein, 59 aa, consensus
  MISC_FEATURE (1)..(59): consensus for the disclosure of xaa see table XV
XXDXXXXXXXXXXXXXXXXXXXXXXXXXXXXXXXXXXXXXXXXXXXXXXXGXXXXXXKP

SEQ ID NO: 44263 - protein, 200 aa, consensus
  MISC_FEATURE (1)..(200): consensus for the disclosure of xaa see table XV
XXXXGXXGXGKXXXXXXXXXXXXXXXXXXXXXXXXXXXXXXXXXXXFGXXXGXXXXAXXXXXGXXXXXXXXXXXXDEXXXXXXXXQXXXLXXXXXXXXXXXGXXXXXXXXXRXXXXXXXXXXXXXXXXXXRXXLXXRXXXXXXXXXXXXXRXXDXXXXXXXXXXXXXXXXXXXXXXXXXXXXXXXXXXXXXPGNXRXXXX

SEQ ID NO: 44264 - DNA, 1932 bp, Saccharomyces cerevisiae; identical to SEQ ID NO: 19414
  CDS (469)..(1725)

SEQ ID NO: 44265 - protein, 418 aa, Saccharomyces cerevisiae; identical to SEQ ID NO: 19415

SEQ ID NO: 44266 - DNA, 1020 bp, Caenorhabditis elegans; identical to SEQ ID NO: 19416
  CDS (1)..(1020)

SEQ ID NO: 44267 - protein, 339 aa, Caenorhabditis elegans; identical to SEQ ID NO: 19417

SEQ ID NO: 44268 - DNA, 1038 bp, Caenorhabditis elegans; identical to SEQ ID NO: 19418
  CDS (1)..(1038)

SEQ ID NO: 44269 - protein, 345 aa, Caenorhabditis elegans; identical to SEQ ID NO: 19419

SEQ ID NO: 44270 - DNA, 1080 bp, Caenorhabditis elegans; identical to SEQ ID NO: 19420
  CDS (1)..(1080)

SEQ ID NO: 44271 - protein, 359 aa, Caenorhabditis elegans; identical to SEQ ID NO: 19421

SEQ ID NO: 44272 - DNA, 1305 bp, Candida glabrata; identical to SEQ ID NO: 19422
  CDS (1)..(1305)

SEQ ID NO: 44273 - protein, 434 aa, Candida glabrata; identical to SEQ ID NO: 19423

SEQ ID NO: 44274 - DNA, 1716 bp, Homo sapiens; identical to SEQ ID NO: 19424
  CDS (101)..(1114)

SEQ ID NO: 44275 - protein, 337 aa, Homo sapiens; identical to SEQ ID NO: 19425

SEQ ID NO: 44276 - DNA, 1118 bp, Bos taurus; identical to SEQ ID NO: 19426
  CDS (1)..(1008)

SEQ ID NO: 44277 - protein, 335 aa, Bos taurus; identical to SEQ ID NO: 19427

SEQ ID NO: 44278 - DNA, 1433 bp, Bos taurus; identical to SEQ ID NO: 19428
  CDS (199)..(1284)

SEQ ID NO: 44279 - protein, 361 aa, Bos taurus; identical to SEQ ID NO: 19429

SEQ ID NO: 44280 - DNA, 1386 bp, Ashbya gossypii; identical to SEQ ID NO: 19430
  CDS (1)..(1386)

SEQ ID NO: 44281 - protein, 461 aa, Ashbya gossypii; identical to SEQ ID NO: 19431

SEQ ID NO: 44282 - DNA, 1850 bp, Anopheles gambiae str; identical to SEQ ID NO: 19432
  CDS (537)..(1598)

SEQ ID NO: 44283 - protein, 353 aa, Anopheles gambiae str; identical to SEQ ID NO: 19433

SEQ ID NO: 44284 - DNA, 1830 bp, Neurospora crassa; identical to SEQ ID NO: 19434
  CDS (1)..(1830)

SEQ ID NO: 44285 - protein, 609 aa, Neurospora crassa; identical to SEQ ID NO: 19435

SEQ ID NO: 44286 - DNA, 1839 bp, Mus musculus; identical to SEQ ID NO: 19436
  CDS (51)..(1055)

SEQ ID NO: 44287 - protein, 334 aa, Mus musculus; identical to SEQ ID NO: 19437

SEQ ID NO: 44288 - DNA, 1074 bp, Homo sapiens; identical to SEQ ID NO: 19438
  CDS (70)..(1074)

SEQ ID NO: 44289 - protein, 334 aa, Homo sapiens; identical to SEQ ID NO: 19439

SEQ ID NO: 44290 - DNA, 1263 bp, Homo sapiens; identical to SEQ ID NO: 19440
  CDS (171)..(1196)

SEQ ID NO: 44291 - protein, 341 aa, Homo sapiens; identical to SEQ ID NO: 19441

SEQ ID NO: 44292 - DNA, 906 bp, Mus musculus; identical to SEQ ID NO: 19442
  CDS (1)..(906)

SEQ ID NO: 44293 - protein, 301 aa, Mus musculus; identical to SEQ ID NO: 19443

SEQ ID NO: 44294 - DNA, 1167 bp, Homo sapiens; identical to SEQ ID NO: 19444
  CDS (1)..(1167)

SEQ ID NO: 44295 - protein, 388 aa, Homo sapiens; identical to SEQ ID NO: 19445

SEQ ID NO: 44296 - DNA, 1133 bp, Umbelopsis ramanniana; identical to SEQ ID NO: 19446
  CDS (40)..(1089)

SEQ ID NO: 44297 - protein, 349 aa, Umbelopsis ramanniana; identical to SEQ ID NO: 19447

SEQ ID NO: 44298 - DNA, 1280 bp, Umbelopsis ramanniana; identical to SEQ ID NO: 19448
  CDS (26)..(1093): n means a or g or c or t/u

SEQ ID NO: 44299 - protein, 355 aa, Umbelopsis ramanniana; identical to SEQ ID NO: 19449

SEQ ID NO: 44300 - DNA, 1152 bp, Mus musculus; identical to SEQ ID NO: 19450
  CDS (73)..(1080)

SEQ ID NO: 44301 - protein, 335 aa, Mus musculus; identical to SEQ ID NO: 19451

SEQ ID NO: 44302 - DNA, 2263 bp, Mus musculus; identical to SEQ ID NO: 19452
  CDS (202)..(1368)

SEQ ID NO: 44303 - protein, 388 aa, Mus musculus; identical to SEQ ID NO: 19453

SEQ ID NO: 44304 - DNA, 1023 bp, Caenorhabditis elegans; identical to SEQ ID NO: 19454
  CDS (1)..(1023)

SEQ ID NO: 44305 - protein, 340 aa, Caenorhabditis elegans; identical to SEQ ID NO: 19455

SEQ ID NO: 44306 - DNA, 1269 bp, Drosophila melanogaster; identical to SEQ ID NO: 19456
  CDS (122)..(1180)

SEQ ID NO: 44307 - protein, 352 aa, Drosophila melanogaster; identical to SEQ ID NO: 19457

SEQ ID NO: 44308 - DNA, 1280 bp, Drosophila melanogaster; identical to SEQ ID NO: 19458
  CDS (140)..(1198)

SEQ ID NO: 44309 - protein, 352 aa, Drosophila melanogaster; identical to SEQ ID NO: 19459

SEQ ID NO: 44310 - DNA, 1086 bp, Xenopus laevis; identical to SEQ ID NO: 19460
  CDS (1)..(1086)

SEQ ID NO: 44311 - protein, 361 aa, Xenopus laevis; identical to SEQ ID NO: 19461

SEQ ID NO: 44312 - DNA, 1918 bp, Xenopus tropicalis; identical to SEQ ID NO: 19462
  CDS (48)..(1133)

SEQ ID NO: 44313 - protein, 361 aa, Xenopus tropicalis; identical to SEQ ID NO: 19463

SEQ ID NO: 44314 - DNA, 26 bp, Primer
atgtcaggaacattcaatgatataag

SEQ ID NO: 44315 - DNA, 25 bp, Primer
ttacccaactatcttcaattctgca

SEQ ID NO: 44316 - protein, 379 aa, consensus
  MISC_FEATURE (1)..(379): consensus for the disclosure of xaa see table XV
LQXXXXXXXXXXXXXXXXXXXXXXXXXXXXXXXXXWXXXXXYXXXXXXDXXXXXXXXXXXXXXXXRXXXXWXXXXXYFPXXLXKTXXLXXXXNXXXXXXXXXXXXXXXXXXXXXXXXXXXXXXXXXXXXXXXXXXXXXXXYXXGXHPHGXXXXGXXXXXXTXXXXXXXXFPGXXXXLXXLXXXFXXPXXRXXXXXXGXXXXXXXXXXXXLXXXXXXXXXXXXXXXXXXXXXIXXGGAXEXLXXXPGXXXLXLXXRKGFXXXAXXXGXXXLVPXXXFGENXXXXQXXXXXXSXXXXXXXXXQXXXXXXXGXXXXXXXXRGXFXXXXXGXXPXXXPIXXVVGXPIXVXXXXXXXXXPXXXXXXXXHXXYXXXLXXXXXXXK

SEQ ID NO: 44317 - protein, 47 aa, consensus; identical to SEQ ID NO: 22528
  MISC_FEATURE (1)..(47): consensus for the disclosure of xaa see table XV

SEQ ID NO: 44318 - protein, 70 aa, consensus; identical to SEQ ID NO: 22529
  MISC_FEATURE (1)..(70): consensus for the disclosure of xaa see table XV

SEQ ID NO: 44319 - protein, 60 aa, consensus; identical to SEQ ID NO: 22530
  MISC_FEATURE (1)..(60): consensus for the disclosure of xaa see table XV

SEQ ID NO: 44320 - protein, 79 aa, consensus; identical to SEQ ID NO: 22531
  MISC_FEATURE (1)..(79): consensus for the disclosure of xaa see table XV

SEQ ID NO: 44321 - DNA, 378 bp, Escherichia coli
  CDS (1)..(378)
atgatcaattcgccccgagtgtgtattcaggttcaaagcgtctacattgaggcacaatcttcacctgataatgaacgttacgtttttgcttataccgtaaccatacgcaatctggggcgagcgccagtgcagttgttggggcgttactggctgatcaccaatggcaatggccgtgaaaccgaagtccagggcgaaggagtggttggcgtccagccacttatcgcgcctggcgaagagtaccagtacaccagcggtgcaatcattgaaaccccgctgggcaccatgcagggtcactacgaaatgatcgatgaaaatggcgtccctttcagcatcgacattcccgtattccgactcgccgttcccacactcattcattaa

SEQ ID NO: 44322 - protein, 125 aa, Escherichia coli
MINSPRVCIQVQSVYIEAQSSPDNERYVFAYTVTIRNLGRAPVQLLGRYWLITNGNGRETEVQGEGVVGVQPLIAPGEEYQYTSGAIIETPLGTMQGHYEMIDENGVPFSIDIPVFRLAVPTLIH

SEQ ID NO: 44323 - DNA, 474 bp, Gluconobacter oxydans 621H
  CDS (1)..(474)
atgcctgacaagtcatcccacccccatctgcacgccgatcccgagacggcactcgccgaagccatggaaagcgccccccgcttcagcgaaaccacggacgacgtgacggtcacggtccggaccttctggctggacgaccagtcccaccccgaagaccatcaatacgcctgggcctatcacatcagcatcgagaacgagcggaaagacacgttccagcttctctcccgctcttgggaaatcgtggacgggcttggacgcaaggaacatgtccacggcgatggtgtcgttggtgaacagcccgtgatcgcgcctaacgaacagttcgactacacgtccggcgccatgctcacgacgccgaccggcttcatgcgcggcacctaccacatggtcgagccccgctcgggccatcgcttcgacgtcagcatccccgttttcagcctcgacagcccccacgacagcacactggtgcactga

SEQ ID NO: 44324 - protein, 157 aa, Gluconobacter oxydans 621H
MPDKSSHPHLHADPETALAEAMESAPRFSETTDDVTVTVRTFWLDDQSHPEDHQYAWAYHISIENERKDTFQLLSRSWEIVDGLGRKEHVHGDGVVGEQPVIAPNEQFDYTSGAMLTTPTGFMRGTYHMVEPRSGHRFDVSIPVFSLDSPHDSTLVH

SEQ ID NO: 44325 - DNA, 405 bp, Wolbachia endosymbiont strain TRS of Brugia malayi
  CDS (1)..(405)
atgactttagaatatacacttactactaactctgttgaagttacagttttgccagtctatattgaggagcaatctattccttatgaaaattgctatgtatggatgtacaatgtcaagataaaaaataaaagcctatcaactattcaattgctgagccgccattggcaaataatagactacaaaggaaagataaatgaaattgttggggctggtgttattggagagcagcctgtgataaaacctggagaggtatttaaatacacaagcggaacatacttgaatgcaccgtcaggaataatgcaaggtaagtacgaatttctaaatgaagaaaacacaaaagttttcgaggtcacaataccgtctttttctttagatagcccatacacaaacattaggccacattaa

SEQ ID NO: 44326 - protein, 134 aa, Wolbachia endosymbiont strain TRS of Brugia malayi
MTLEYTLTTNSVEVTVLPVYIEEQSIPYENCYVWMYNVKIKNKSLSTIQLLSRHWQIIDYKGKINEIVGAGVIGEQPVIKPGEVFKYTSGTYLNAPSGIMQGKYEFLNEENTKVFEVTIPSFSLDSPYTNIRPH

SEQ ID NO: 44327 - DNA, 384 bp, Xanthomonas oryzae pv. oryzae KACC10331
  CDS (1)..(384)
atgcacgatgatccgcgctatcgggtcgaggtcgaggtatcgccccgcttcctcgcccatcaatccaccccggacgagggccgctatgccttcgcctacagcatccgcatccagaatgcgggcgccgtgcctgcgcggttgatcgcgcgccattggcagatcaccgatggcaacggacgcaccgagcaggtggatggcgaaggcgtggtcggcgagcagccgaggctgcgcccgggcgaggcgttccattacacctccggcgtgctgctggagaccgagcagggacagatgcaaggccactacgacatggtggccgacgacggcaccgaatttatcgccccgatcgccgccttcgtgctgagcgtacccaggacgctgcactga

SEQ ID NO: 44328 - protein, 127 aa, Xanthomonas oryzae pv. oryzae KACC10331
MHDDPRYRVEVEVSPRFLAHQSTPDEGRYAFAYSIRIQNAGAVPARLIARHWQITDGNGRTEQVDGEGVVGEQPRLRPGEAFHYTSGVLLETEQGQMQGHYDMVADDGTEFIAPIAAFVLSVPRTLH

SEQ ID NO: 44329 - DNA, 465 bp, Caulobacter crescentus CB15
  CDS (1)..(465)
gtgcgctcgatcaggcgtgagacctccccgcccatgcaacgcatgagacgccgccggggcagcgacagcgccgcctatgaggcccgcacgcgcgacatcgtcgtgcgcgtcttccccacctatgcggccgaggaaagctcgcccgagcagggcctctatctgtggtcctacacggtcgagatcgagaaccacggcgaagagacggtcaccctgatcgcgcgccgctggacgatcaccgacggcttcaaccgggtgaacgaggtcgagggcagcggcgtggtcggcgaacagcccgagctgaagccgcgcgaggcgttccgctatgtctccaactgccctctgcctacgccgtcgggcgcgatgcgggggagctaccagatggtcaccgacgcgggcgacctgttcgacgtggcgatcccggagttctcgctgcacctgccgggcgcggcgatgaagctcaactga

SEQ ID NO: 44330 - protein, 154 aa, Caulobacter crescentus CB15
MRSIRRETSPPMQRMRRRRGSDSAAYEARTRDIVVRVFPTYAAEESSPEQGLYLWSYTVEIENHGEETVTLIARRWTITDGFNRVNEVEGSGVVGEQPELKPREAFRYVSNCPLPTPSGAMRGSYQMVTDAGDLFDVAIPEFSLHLPGAAMKLN

SEQ ID NO: 44331 - DNA, 402 bp, Agrobacterium tumefaciens str. C58
  CDS (1)..(402)
gtggcgcgtatgtatcgtgctctgacaagggatatcgaggtgacggtcgatccgtattatctcgaggaacaatccgacccggatgacgatcgttacgtctggggctataaagtcgtgatcgcgaacaattccgatgtccccgtaaaactcgtcaaccgttattggcatatcaccgatcagaacggacaggtggacgaggtctacgggccgggcgtcgtgggtgaacagccgcagctcaaaccaggcgacagctatgaatattcctcgggctgcccgctggatacgccttcaggcctgatgttcggccattatgagatggaaacggaaaatggcgaggtgttcaatgtcaccatacccgccttttcgctggattcacccggcctgatgcgcgtcctgaactga

SEQ ID NO: 44332 - protein, 133 aa, Agrobacterium tumefaciens str. C58
MARMYRALTRDIEVTVDPYYLEEQSDPDDDRYVWGYKVVIANNSDVPVKLVNRYWHITDQNGQVDEVYGPGVVGEQPQLKPGDSYEYSSGCPLDTPSGLMFGHYEMETENGEVFNVTIPAFSLDSPGLMRVLN

SEQ ID NO: 44333 - DNA, 426 bp, Brucella melitensis 16M
  CDS (1)..(426)
atgctccagccatggaatgcggagggtggattgatgtatagtgcggtaacacgcgggatcgaagttacggtcgagcccttttatctggaagtccaatccgagccggaagaaaaccgttatgtatggggttatcgcgtcacgatcgtgaacaattcatccgaaacggtgcagctttgctcgcgctactggcagatcaccgacgccaacggccatgtgcaagaagtgcgcggttcaggcgtggtcggcaagcagcctgttctcgatccgggcgattcataccagtattcttccggttgcccgctcacaacctcgtcaggcgtgatggtcgggcgctaccagatgaagggcgaagacggcgcacaattcgagatcgagattcccgccttttcactcgacgtacccgaacagcgccgcacgctgaactga

SEQ ID NO: 44334 - protein, 141 aa, Brucella melitensis 16M
MLQPWNAEGGLMYSAVTRGIEVTVEPFYLEVQSEPEENRYVWGYRVTIVNNSSETVQLCSRYWQITDANGHVQEVRGSGVVGKQPVLDPGDSYQYSSGCPLTTSSGVMVGRYQMKGEDGAQFEIEIPAFSLDVPEQRRTLN

SEQ ID NO: 44335 - DNA, 405 bp, Bradyrhizobium japonicum USDA 110
  CDS (1)..(405)
atgatggcagccatgtaccgcgccgtgacccgccagatcgaagtgaccgtcgagccgaactttgttccggaacagtcgtcggccgaccgctcccgctacttctggtcctacaccatcgtcatcaccaattcgggcgaggagaccgtgcagctcaagacgcggcactggatcatcaccgacgccaccggccgccagcaggaggtgaagggcgagggcgtggtcggcgagcagccgaccctggcccccggcgagcgcttcgaatacacctccggcgtgccgctctcgaccgcctccggcttcatgaccggccgctaccagatggtcagcgaaagcggcgaacgcttcgagatcgacgtgccgacgttttcgctggatagcccggacaacaagcgggtgttgaactag

SEQ ID NO: 44336 - protein, 134 aa, Bradyrhizobium japonicum USDA 110
MMAAMYRAVTRQIEVTVEPNFVPEQSSADRSRYFWSYTIVITNSGEETVQLKTRHWIITDATGRQQEVKGEGVVGEQPTLAPGERFEYTSGVPLSTASGFMTGRYQMVSESGERFEIDVPTFSLDSPDNKRVLN

SEQ ID NO: 44337 - DNA, 375 bp, Bordetella bronchiseptica RB50
  CDS (1)..(375)
gtgaaaccctatgatctgaccgtatccgtgaccccgcgttatgtgccggagcagtccgatcccagtcagcagcaatacgtgtttgcctacacggtgcgcatcaccaataccggttcgcacccggcccaggtcatcagccgccactggatcatcaccgacggcgaggagcgcgtgcaggaagtgcgcggccttggcgtggtgggccagcaaccgctgctggcgccgggcgagaccttcgaatacaccagcggctgtccgcttccgacccccatcggcacgatgcggggtacctaccattgcgtcggcgaaaacggcattccgttcgaggtgccgatcgcggagttcctgctggccatgccgcgtacactgcactga

SEQ ID NO: 44338 - protein, 124 aa, Bordetella bronchiseptica RB50
MKPYDLTVSVTPRYVPEQSDPSQQQYVFAYTVRITNTGSHPAQVISRHWIITDGEERVQEVRGLGVVGQQPLLAPGETFEYTSGCPLPTPIGTMRGTYHCVGENGIPFEVPIAEFLLAMPRTLH

SEQ ID NO: 44339 - DNA, 378 bp, Erwinia carotovora subsp. atroseptica SCRI1043
  CDS (1)..(378)
atgattaatgcgccccgtgtttgtgtacaaattcagagcttctatgtggaatcacaatcagagcctgatgaagaacgtttcgtgtttgcttacacggttacggttcgcaatctggggcgtcatgaagtccagcttttggggcgttattggctgatcaccaacggtaatggccgtcagactgaagttcagggtgaaggcgtagtcggtgaacagccgattatcgagcctggcggcgagttccaatataccagcggtgcagtcatggaaacgcccctcggcacaatggaaggccactaccatatggttgaccatcagagtaaagcgtttcaggtcccaatccccgtcttccgactggcaatcccctcactgatacattaa

SEQ ID NO: 44340 - protein, 125 aa, Erwinia carotovora subsp. atroseptica SCRI1043
MINAPRVCVQIQSFYVESQSEPDEERFVFAYTVTVRNLGRHEVQLLGRYWLITNGNGRQTEVQGEGVVGEQPIIEPGGEFQYTSGAVMETPLGTMEGHYHMVDHQSKAFQVPIPVFRLAIPSLIH

SEQ ID NO: 44341 - DNA, 378 bp, Yersinia pseudotuberculosis IP 32953
  CDS (1)..(378)
atgattgaacagccccgtatttgtgtgcaggtacaaagtatctatgtggaaacgcaatcgatacccgaagaggagcgtttcgtcttcgcctataccgttactgttcgtaatttagggcgttcaaacgtgcaactgcttggccgctattggttaattaccaatagcaatggccgccagactgaagttcagggagaaggggttatcggcgaacaaccacttatcctgccaggtaatgaatttcaatacaccagcggtgccgttctggaaaccccgctgggtactatggaaggacattatgaaatgattgatcaccttggacaggccttccgtactgtaattccggtattccgcttagcgatcccagccctgatccattaa

SEQ ID NO: 44342 - protein, 125 aa, Yersinia pseudotuberculosis IP 32953
MIEQPRICVQVQSIYVETQSIPEEERFVFAYTVTVRNLGRSNVQLLGRYWLITNSNGRQTEVQGEGVIGEQPLILPGNEFQYTSGAVLETPLGTMEGHYEMIDHLGQAFRTVIPVFRLAIPALIH

SEQ ID NO: 44343 - DNA, 381 bp, Methylococcus capsulatus str. Bath
  CDS (1)..(381)
atgcgacgtaaaccctatgaactgaaagtcgaagtcaaggccgtctatctgcgggagcactcccggcccgatgctcatcagtacaccttcgcctacaccgtgaccatggagaacaccggcaccgttcccgccaagctcctgggccggcgctggatcatcaccgatgccaacggcaagacggtggaggtggtcggggagggcgtcgtcggcgagcatccgtatctccggcccggcgaggctttcgagtacaccagcgccgcgaccatcgccaccccggtcggcagtatgcacggcagctatcagctgatcgccgacgacgggatgccattcgaggcgcccatcgccgcgttcagcctcgcaatcccgcgccggctgcactga

SEQ ID NO: 44344 - protein, 126 aa, Methylococcus capsulatus str. Bath
MRRKPYELKVEVKAVYLREHSRPDAHQYTFAYTVTMENTGTVPAKLLGRRWIITDANGKTVEVVGEGVVGEHPYLRPGEAFEYTSAATIATPVGSMHGSYQLIADDGMPFEAPIAAFSLAIPRRLH

SEQ ID NO: 44345 - DNA, 453 bp, Anaplasma marginale str. St. Maries
  CDS (1)..(453)
gtggaccgcgcgtttgttttacgaagttgtggggtgtgctgcgctatgacgacgcctagatgtggcggtgcgactggtctgatagaagttgaggtaacaccgagctacctcgaggagcattcgatgccgcacgagaattgctacatatggctttacagcgtcaagatcaaaaatgtcagcaattctacggtacagctgctgaagcgtagctggaaaataatagattccaaaggcatggtgaacgaggtaagcggatctggtgttgtgggccgtcagcctgtgctaaagcccggggggtttttcgagtacactagtggcacatgcctcagtacgccgtccggggttatgaacgggtggtatcaatttgtggatgaagacaaggcgcaggtgttctacgtagatgtgcctaccttttcgctcgatagcccgtacgatattgtgaggcttaactag

SEQ ID NO: 44346 - protein, 150 aa, Anaplasma marginale str. St. Maries
MDRAFVLRSCGVCCAMTTPRCGGATGLIEVEVTPSYLEEHSMPHENCYIWLYSVKIKNVSNSTVQLLKRSWKIIDSKGMVNEVSGSGVVGRQPVLKPGGFFEYTSGTCLSTPSGVMNGWYQFVDEDKAQVFYVDVPTFSLDSPYDIVRLN

SEQ ID NO: 44347 - DNA, 375 bp, Idiomarina loihiensis L2TR
  CDS (1)..(375)
atgacagtcagtaaaattgaaattgatgtaaaaacgcaatatttagcggcgcagtcaaaccctgatgccggacaatatgtattttcttacaccataaccataaccaatgagtccagccagttagtgcagttgcttgcccgcgaatggcgcattaccgacgcagacaataaaattacccgggtagccggtgacggtgtagtcggacaacagcctaaactggctgccggtgaatcattcagttataccagcggtaccgttctggctacgcctataggcactatggaagggcattacctaatgatagatgaacagggctcgcagtttaaagcacctattccttcgttccggctggccatccctaatattattcattaa

SEQ ID NO: 44348 - protein, 124 aa, Idiomarina loihiensis L2TR
MTVSKIEIDVKTQYLAAQSNPDAGQYVFSYTITITNESSQLVQLLAREWRITDADNKITRVAGDGVVGQQPKLAAGESFSYTSGTVLATPIGTMEGHYLMIDEQGSQFKAPIPSFRLAIPNIIH

SEQ ID NO: 44349 - DNA, 384 bp, Azoarcus sp. EbN1
  CDS (1)..(384)
atgagcgaatccgaaaaatatcgcatcgaggtggaagccatcgccgagttcgtaccgggacaatccgacccggacgaaaaccgctacgtttttgcataccacatcacgctgacgaacaccggcgaagtgcccgcccagttgatcagccggcactgggtcatcaccgacggcgcgggcaaggtccaggaagttcgcggcctcggagtgatcggcgaacagccgatgctcgcgccgggacagcagttcagctattcgagcgggtctgtcctcgaaaccccggtcggcacgatgcagggcagctaccagatggcggccgaggacggccaccgtttcgacgccgaaatcccggccttcatgctggcgatgccgcgcgtgctgcactga

SEQ ID NO: 44350 - protein, 127 aa, Azoarcus sp. EbN1
MSESEKYRIEVEAIAEFVPGQSDPDENRYVFAYHITLTNTGEVPAQLISRHWVITDGAGKVQEVRGLGVIGEQPMLAPGQQFSYSSGSVLETPVGTMQGSYQMAAEDGHRFDAEIPAFMLAMPRVLH

SEQ ID NO: 44351 - DNA, 405 bp, Ehrlichia ruminantium str. Welgevonden
  CDS (1)..(405)
atgacattgcaatattacagtatgacaaagctgattgaagtgaaggttgttccaagttacttagaagagcagtcttctcctcatgagaactgttatatatggttgtataatattagagtaaaaaataagagtacatctactgttcagttattaaggagaagttggaaaattattgattctactggcattattaatgaagtaacaggacttggtgttataggaaaacagccagttttaaaacctggtgagttttttgagtatactagtggtgcatacttaagtactccatctggtatgatgcatggagaatatcagtttatggatgaagatgctgcacaggttttctatgtaaatatacctatgttttctcttgatagtccatatgttaatacaaaaccacattaa

SEQ ID NO: 44352 - protein, 134 aa, Ehrlichia ruminantium str. Welgevonden
MTLQYYSMTKLIEVKVVPSYLEEQSSPHENCYIWLYNIRVKNKSTSTVQLLRRSWKIIDSTGIINEVTGLGVIGKQPVLKPGEFFEYTSGAYLSTPSGMMHGEYQFMDEDAAQVFYVNIPMFSLDSPYVNTKPH

SEQ ID NO: 44353 - DNA, 384 bp, Xylella fastidiosa Ann-1
  CDS (1)..(384)
atggaaaacaatcccaattcaaagattgaggtcgctgtctcgtcccgcttcctcgaccagcaatctaatcgtaatgaaggccgctacgtcttcgcctacaccatccggatctacaatgctggaaatgtccctgcacgactgatcgcgcgccactggcagattaccgatgcaaacggcaaagtcgaatacgtcactggtgaaggagtcattggagaacaaccacggctgcgtcccggcgaagaatttcgctacacctctggggtcgtgttgggaaccgaacagggccagatgcaaggacattacgacatgatggccgatgacggtaccgaattcaccgccacaatctccccattcgtactcagtgtgccgcgaacactacactga

SEQ ID NO: 44354 - protein, 127 aa, Xylella fastidiosa Ann-1
MENNPNSKIEVAVSSRFLDQQSNRNEGRYVFAYTIRIYNAGNVPARLIARHWQITDANGKVEYVTGEGVIGEQPRLRPGEEFRYTSGVVLGTEQGQMQGHYDMMADDGTEFTATISPFVLSVPRTLH

SEQ ID NO: 44355 - DNA, 393 bp, Magnetospirillum magnetotacticum MS-1
  CDS (1)..(393)
atgtacaaggccgagacgcgcggcattacggtgacggtggagccccgcttcgtcgaggaggaatcctcgccgggggagagccgctacttctttgcctacaccgtcgagatcgtgaacaacggcagcgagcaggtgcagctgcgctcgcgccactggcggatcatcgacgggcgcggcacctgccaggaggtgcgcggcgccggcgtggtcggcaagcagccggttctggagcccggagagtcgttcagctacaccagcggttgcccgctcaccacgccggacgggctgatggccggcagctacacgatggcaacggtcggcggcgagagtttcgaggcggagatcccggccttctccctcgactcgccgcatatgcgccgcgtcgtccattga

SEQ ID NO: 44356 - protein, 130 aa, Magnetospirillum magnetotacticum MS-1
MYKAETRGITVTVEPRFVEEESSPGESRYFFAYTVEIVNNGSEQVQLRSRHWRIIDGRGTCQEVRGAGVVGKQPVLEPGESFSYTSGCPLTTPDGLMAGSYTMATVGGESFEAEIPAFSLDSPHMRRVVH

SEQ ID NO: 44357 - DNA, 393 bp, Magnetospirillum magnetotacticum MS-1
  CDS (1)..(393)
atgtacagccagaccacccgagacgtcgaggtcagcgtcaagcccttctacctggacgaccagtcctcgcccgaagacaatcacttcgtctgggcctatcgcgtgcgcatcatcaacaaggggacccgtaccgtccagctcatgcgccgccactgggtcatcaccgacgccatcggccgggtacaggaagtcaagggaccgggagtggtgggcgaacagcccgttctgcgccccggcgatgcctatgaatacacgtccggcacgcccttgcccacgccgtccggcatcatggtcggcacctacgagatggaggacgaggacggctcggccttcgacatcgccatccccgctttttccctcgacagcccccatgagaaacccagactgaattag

SEQ ID NO: 44358 - protein, 130 aa, Magnetospirillum magnetotacticum MS-1
MYSQTTRDVEVSVKPFYLDDQSSPEDNHFVWAYRVRIINKGTRTVQLMRRHWVITDAIGRVQEVKGPGVVGEQPVLRPGDAYEYTSGTPLPTPSGIMVGTYEMEDEDGSAFDIAIPAFSLDSPHEKPRLN

SEQ ID NO: 44359 - DNA, 381 bp, Azotobacter vinelandii
  CDS (1)..(381)
atgtcagatccccgctatcagatcgacgtcagcgtcgagacccgttacctgccggagcagtcgcagccggagcagaaccgctatgtcttcgcctacagcgtgaccatccgcaacaacggcctgctgccggcccaactgctgtcgcgccactggctgatcaccgacggcgacggccatgtccaggaggttcgcggccccggcgtgatcggcacgcagccgctgctcggcccggggcagagccacaactacgacagcagcacgctgctcgccacccaggtcggcaccatgcagggcagctaccagatggtcgccgaggacgggcacgctttcgacgccccgatccgtccgttccgcctggccgtgcccggggccctgcactga

SEQ ID NO: 44360 - protein, 126 aa, Azotobacter vinelandii
MSDPRYQIDVSVETRYLPEQSQPEQNRYVFAYSVTIRNNGLLPAQLLSRHWLITDGDGHVQEVRGPGVIGTQPLLGPGQSHNYDSSTLLATQVGTMQGSYQMVAEDGHAFDAPIRPFRLAVPGALH

SEQ ID NO: 44361 - DNA, 384 bp, Desulfitobacterium hafniense DCB-2
  CDS (1)..(384)
atgaaccgccccaccgtatacgtcttcgacatcgacgtggccacccgttacctggacgatcaatccgctccggagcaggaccgctacgtgttcgcctacaccatccacatccgcaacgccggcaccgttcccgcgcgcctgatcgcgcgccactgggtgatcaccgacgccaacggcaaggtgcaggaagtgcgcggcgacggcgtggtcggcgagcagccgtggctgcgtccgggcgacgattacgaatacacctccggcgcggtgctggaaaccagcctgggcacgatggaaggcagctacgcgatggtggccgacgacggcacccgtttcgatgcgccggttccgtcgttcaccctgaccgtgccgcgcacgctgcactga

SEQ ID NO: 44362 - protein, 127 aa, Desulfitobacterium hafniense DCB-2
MNRPTVYVFDIDVATRYLDDQSAPEQDRYVFAYTIHIRNAGTVPARLIARHWVITDANGKVQEVRGDGVVGEQPWLRPGDDYEYTSGAVLETSLGTMEGSYAMVADDGTRFDAPVPSFTLTVPRTLH

SEQ ID NO: 44363 - DNA, 384 bp, Methylobacillus flagellatus KT
  CDS (1)..(384)
atgaccaaggacaagcgctatgcattttcagtgaaggtagagacagcgtttgtgcctgaccaatcagacgtggaacagaaccgctacgtcttcacctatacggtccatatcgagaataccggcaacgtggcggcgcaattgatcagccgccactggatcattaccgatgccaccggcaagacgcaggaagtgcgcggtcttggggtcatcggccagcaacccctgctccagcctggcgagcgctttcaatataccagtggcactatgttgaacacgcctgtgggcgagatgcgcggcttctaccacatcacggcagaagacggtacgcagttcgatagcgagatcgcgcctttccagctcaacatgccacgcgtactgcactga

SEQ ID NO: 44364 - protein, 127 aa, Methylobacillus flagellatus KT
MTKDKRYAFSVKVETAFVPDQSDVEQNRYVFTYTVHIENTGNVAAQLISRHWIITDATGKTQEVRGLGVIGQQPLLQPGERFQYTSGTMLNTPVGEMRGFYHITAEDGTQFDSEIAPFQLNMPRVLH

SEQ ID NO: 44365 - DNA, 393 bp, Mesorhizobium sp. BNC1
  CDS (1)..(393)
atgtatcgagcgatcacccaaggcatagaggtttgtgtcgaacccttcttcctgccggagcactccgatccggaggaaagcaaatatgtctgggcttatcaggtaacgatcgccaattattctccgcaggcggtgaagctgctctcgcgttactggcatatcacggacgggatgggccgggtgcaggaagtgcgcggagaaggcgttgtgggcgaacaacccgaaatcgaaccgggcgacacctatcgctatacatcgggctgcccccttaccacctcctccgggatcatggttggccgatacaccatgcagactgaacgaggcgacatgctggaggtggacatccctgccttctcgctcgattttcccggcaacagcgtattgctgaattag

SEQ ID NO: 44366 - protein, 130 aa, Mesorhizobium sp. BNC1
MYRAITQGIEVCVEPFFLPEHSDPEESKYVWAYQVTIANYSPQAVKLLSRYWHITDGMGRVQEVRGEGVVGEQPEIEPGDTYRYTSGCPLTTSSGIMVGRYTMQTERGDMLEVDIPAFSLDFPGNSVLLN

SEQ ID NO: 44367 - DNA, 384 bp, Ehrlichia canis str. Jake
  CDS (1)..(384)
atgactaagcttattgaagttaaagtcgttccaagttacttagaagaacagtctgctccacatgagaattgttatatctggttatataacattagggttaaaaatagaagtaattctacagtacagctcttgagaagaagttggaaaatcattgattcaactggtattattaatgaagttacaggtcttggtgtgatagggaagcagcctattttgaagcctggagagttctttgagtatactagtggtgcatatttaagtactccatctgggatgatgcatggagagtatcaatttatggatgaggatgcagctcaggttttctatgttaatataccggtgttttcactagatagtccttatgttaatacaaaaccgcattag

SEQ ID NO: 44368 - protein, 127 aa, Ehrlichia canis str. Jake
MTKLIEVKVVPSYLEEQSAPHENCYIWLYNIRVKNRSNSTVQLLRRSWKIIDSTGIINEVTGLGVIGKQPILKPGEFFEYTSGAYLSTPSGMMHGEYQFMDEDAAQVFYVNIPVFSLDSPYVNTKPH

SEQ ID NO: 44369 - DNA, 375 bp, Rubrivivax gelatinosus PM1
  CDS (1)..(375)
atggcacgtcccgagttcaccatcagcgtcgtcgcgcgctacctgcccgagcaatcggcccccgagcaacaggcgtacgcgttctcgtactcggtgaccatcgtcaacagcggcgatgtgcccgcccagctgatcggccgccactggctgatcaccgacgccagcggcgcccggcaggaggtacgcggcctgggcgtcatcggccagcagccgctcctgcagcccggtgagcagttcgaataccagagctgggcccgcattgccgcgcctcgcggccagatgcagggcagctacttctgcatgagcgccgacgcacaggccttcgaggccgcgatcccgccgttcgagctgtcgcagcactcggcgctgcattga

SEQ ID NO: 44370 - protein, 124 aa, Rubrivivax gelatinosus PM1
MARPEFTISVVARYLPEQSAPEQQAYAFSYSVTIVNSGDVPAQLIGRHWLITDASGARQEVRGLGVIGQQPLLQPGEQFEYQSWARIAAPRGQMQGSYFCMSADAQAFEAAIPPFELSQHSALH

SEQ ID NO: 44371 - DNA, 381 bp, Pseudomonas fluorescens PfO-1
  CDS (1)..(381)
atgtccgatcctcgctaccaggtcgatgtcagtgtcgttacccactatctggcagaccaatcgcaacccgagcacgagcgctttgccttcgcctacaccatcaccgtgcagaacaatggcgagcaaccggcccgcctgatgtcgcgccactgggtgataaccgatggcgacgggcatgtcgaagaagtgcgcggcgccggcgtggttggccagcaaccgttgatcggcgctggcaaaagccacacctacagcagcggcacggtgatgaccaccaaggtcggcaccatgcaaggcagttacgaaatggtcgccgacgacggcaagcacttcgatgcgatcatcaagcccttccgcctcgccgttcccggagccctgcactga

SEQ ID NO: 44372 - protein, 126 aa, Pseudomonas fluorescens PfO-1
MSDPRYQVDVSVVTHYLADQSQPEHERFAFAYTITVQNNGEQPARLMSRHWVITDGDGHVEEVRGAGVVGQQPLIGAGKSHTYSSGTVMTTKVGTMQGSYEMVADDGKHFDAIIKPFRLAVPGALH

SEQ ID NO: 44373 - DNA, 408 bp, Rhodospirillum rubrum
  CDS (1)..(408)
atgaccgacgaaaccgtctatgagcgaacgaccgaagggatcaccgtgcgcgtgcttccaatcttcctcgacgagcaatccgagcccgagcgcggccattatctgtgggcctatcaggttctgatcgtcaaccgcggggcgcggaccgtgcaactgatgcgccgacactggatcgtgaccgacgccttcggccgggttcaggaagtggaaggcgaaggcgtggtcggcgagcagccgattctcgcgcccggggcgcagtttgattacacctcgggcacgccgctgcccacgccctcgggattcatgggcggcagctatctgatgcgcgacgacaccggccgcgagttgaccgtcgccattcccaccttcagcctcaacagcccggaatcggcggggcatctgcactga

SEQ ID NO: 44374 - protein, 135 aa, Rhodospirillum rubrum
MTDETVYERTTEGITVRVLPIFLDEQSEPERGHYLWAYQVLIVNRGARTVQLMRRHWIVTDAFGRVQEVEGEGVVGEQPILAPGAQFDYTSGTPLPTPSGFMGGSYLMRDDTGRELTVAIPTFSLNSPESAGHLH

SEQ ID NO: 44375 - DNA, 375 bp, Ralstonia metallidurans CH34
  CDS (1)..(375)
atgagcgagtacgcattttccgtggccgtgcgcacgcagtacatgccggaccaatcggacccagaccgtggacgctacgcgttcgcctacaccatcacgatccacaacaccggcgaagtcgccgcgcagctgatctcgcgccactggatcatcaccgacagcgacaactcgacgcaggaagtctcgggcctgggcgtggtcggccatcagccgctgctcaagccgggcgagcacttcgagtattcgagctgggcgacgatctccaccccggtgggatcgatgaagggcgattatttctgcgtggccgaagacggccaccgtttcgaggtgccgattcccgaattcgcgctggtgctgccccgaatgctgcactga

SEQ ID NO: 44376 - protein, 124 aa, Ralstonia metallidurans CH34
MSEYAFSVAVRTQYMPDQSDPDRGRYAFAYTITIHNTGEVAAQLISRHWIITDSDNSTQEVSGLGVVGHQPLLKPGEHFEYSSWATISTPVGSMKGDYFCVAEDGHRFEVPIPEFALVLPRMLH

SEQ ID NO: 44377 - DNA, 375 bp, Burkholderia fungorum LB400
  CDS (1)..(375)
atgagccagtacgaattcagcgtctcgacgcaggtgcaatatctgcccgaagagtcggacccggagcgccgccagtatgcattcgcatacacgctgactatccgtaacaccggccaggtgcccgcgcagttgatcgcgcggcattgggtcatcacagacagcgacaagaacgtgcaggaagtgaagggtcttggcgtggtcggccatcagccgctgctcaaaccgggcgagcatttcgagtacacgagttgggcggtgatcgccacaccggtcggcaccatgcgcggagaatacttctgtgtggccgaggacggcgagcggttcgatgcgccggtgccggagttcatcctgcgcatgccgcgtacgttgcattga

SEQ ID NO: 44378 - protein, 124 aa, Burkholderia fungorum LB400
MSQYEFSVSTQVQYLPEESDPERRQYAFAYTLTIRNTGQVPAQLIARHWVITDSDKNVQEVKGLGVVGHQPLLKPGEHFEYTSWAVIATPVGTMRGEYFCVAEDGERFDAPVPEFILRMPRTLH

SEQ ID NO: 44379 - DNA, 381 bp, Magnetococcus sp. MC-1
  CDS (1)..(381)
atggctaacgaaaaataccaagtggatgtccaggtaaacgcgacctatctgccggatcaatccttgcctgcacataatcaatatgtgtttgcttacaccgtgaccctccttaatcgtggcagtatgggggccaaactgctctcgcgtcactggattattagtgatgccaacgggggtgagcaagaggtgcggggtgagggtgtggtgggggaacagccccatttaaatcccggggagagttttcaatataccagcggtacccccctaacgacgcctatgggtagcatgcggggcagctaccagatggtggccgacgatggaacctattttgaggccaccattccaccctttgccctgtttggaccggccactctgcactag

SEQ ID NO: 44380 - protein, 126 aa, Magnetococcus sp. MC-1
MANEKYQVDVQVNATYLPDQSLPAHNQYVFAYTVTLLNRGSMGAKLLSRHWIISDANGGEQEVRGEGVVGEQPHLNPGESFQYTSGTPLTTPMGSMRGSYQMVADDGTYFEATIPPFALFGPATLH

SEQ ID NO: 44381 - DNA, 399 bp, Novosphingobium aromaticivorans DSM 12444
  CDS (1)..(399)
atgaagcagcttttccagcatgccgcgataacggatggagtgacggtgcgggtcgccgtcagtttcctgccggaacagtcacgcgtcgacgccggcaagtggttctgggtctatcacatccggatcgagaacgatgccgcccagccgatccagcttctttcccggcactggcgcatcaccgacgggcgcgggatggtcaatttcgtcgacggggacggtgtggtgggcgagcagcccgtgctccagccggggcagtctcacgattatgtctcgggctgcccgctgggcacccatcacggcagcatggaaggccattacacgatgcagcgtgccgatggggcgctgttcgacgtggcgattccgttctttcctctggcggcaccggctccggcaaactaa

SEQ ID NO: 44382 - protein, 132 aa, Novosphingobium aromaticivorans DSM 12444
MKQLFQHAAITDGVTVRVAVSFLPEQSRVDAGKWFWVYHIRIENDAAQPIQLLSRHWRITDGRGMVNFVDGDGVVGEQPVLQPGQSHDYVSGCPLGTHHGSMEGHYTMQRADGALFDVAIPFFPLAAPAPAN

SEQ ID NO: 44383 - DNA, 387 bp, Cytophaga hutchinsonii
  CDS (1)..(387)
atgatttcaaaaattaccgaaggtgtacgggttagcattgtaacagactatcagcaggaatactccagtccgttacagtcgcactatgtatttacctatcgtatattaattgaaaactacagcgaacatactgtacgcctgttacgcaggcattggttcatctttgacgcaaatggtgtaatccgtgaggtagaaggcgaaggcgttgttggtgtacagccaacgcttgaaccgggtgcttctcatgaatatgtttccggatgcaatttaaaaacagagatgggtaaaatgcgcggtacttacttaatggaacgcattgttgatggaaatcaatttacggttgtgattcccgaatttatgctcatagcaccttttaaattaaattga

SEQ ID NO: 44384 - protein, 128 aa, Cytophaga hutchinsonii
MISKITEGVRVSIVTDYQQEYSSPLQSHYVFTYRILIENYSEHTVRLLRRHWFIFDANGVIREVEGEGVVGVQPTLEPGASHEYVSGCNLKTEMGKMRGTYLMERIVDGNQFTVVIPEFMLIAPFKLN

SEQ ID NO: 44385 - DNA, 372 bp, Microbulbifer degradans 2-40
  CDS (1)..(372)
atgccacacgcaataaatatagaagtaaaaaccaaataccttagcgaacagtcccgcccagcggaaaataaatacgtgttcgcctacaccattacaattaccaaccaaggcgaccaacccgcacagctcgttggccgctactggcgcatagtggatgcaaacagccaaatacaagaagtacaggggataggcgtggtaggtgaacaaccgcacctcgcaccgagcgaaagctatacctacaccagcggcgcggtattgcaaacacctaccggcacaatggaaggccactacgaaatgcagggggaaggcggcgaaacctttaacgcaaccattcccgcctttgcattagtgaagccctctttattacactag

SEQ ID NO: 44386 - protein, 123 aa, Microbulbifer degradans 2-40
MPHAINIEVKTKYLSEQSRPAENKYVFAYTITITNQGDQPAQLVGRYWRIVDANSQIQEVQGIGVVGEQPHLAPSESYTYTSGAVLQTPTGTMEGHYEMQGEGGETFNATIPAFALVKPSLLH

SEQ ID NO: 44387 - DNA, 384 bp, Thiobacillus denitrificans ATCC 25259
  CDS (1)..(384)
atggccgaaggcaagaaataccagataaacatcagcgtcaacacggcttatctggcggagcagagcgacccgtcggccgaccgttacgtgttcgcctacaccatcacgatcgaaaacgtcggcacggtcgccgcgcagctgatctcgcgtcactgggtgatcaccgacgccgacgacgtcgtgcaggaagtcaagggcctcggcgtcgtcggcgagcagccgctgctgcgccccggcgagaccttcgaatacagcagcggggcagcgctcgcgacgccggtcggaaccatgcagggcagctatcagatggtggccgaggacggcaacaagttcgacgccgagattccccgcttcacgctggccatgccgcgcgtgctgcactga

SEQ ID NO: 44388 - protein, 127 aa, Thiobacillus denitrificans ATCC 25259
MAEGKKYQINISVNTAYLAEQSDPSADRYVFAYTITIENVGTVAAQLISRHWVITDADDVVQEVKGLGVVGEQPLLRPGETFEYSSGAALATPVGTMQGSYQMVAEDGNKFDAEIPRFTLAMPRVLH

SEQ ID NO: 44389 - DNA, 384 bp, Dechloromonas aromatica RCB
  CDS (1)..(384)
atgtccgacaccaacaagtaccgaatcgaagtgcaacccatgccgcagttcattccggagcaatccgacccggaaaacgaccgctacatctttgcctacaccatcaccatcaagaatatcggcgaagtaccggcccaactggtttcccggcactggatcatcaccgatggcaacaacgaggtacaggaagtgcgcggccttggcgtcgtcggcaagcagccgctgctccagcccggcgaaagttttcagtacaccagtggctcctcgctgacgaccgcaatcggcaccatgaaagggacttaccagatggtggccgaggacggcacccacttcgaagccgaaatcccggagtttgttctggccagtccgcgcgccctgcattga

SEQ ID NO: 44390 - protein, 127 aa, Dechloromonas aromatica RCB
MSDTNKYRIEVQPMPQFIPEQSDPENDRYIFAYTITIKNIGEVPAQLVSRHWIITDGNNEVQEVRGLGVVGKQPLLQPGESFQYTSGSSLTTAIGTMKGTYQMVAEDGTHFEAEIPEFVLASPRALH

SEQ ID NO: 44391 - DNA, 414 bp, Chloroflexus aurantiacus
  CDS (1)..(414)
atgcgccgaccattttattaccgtttgagtgaagggatgcggatcagtgtgcgtccccaatacctaccggggcactcattcccgccactacaacgcttcgtcttcgcctacgatgtacgaattgaaaatattagccgacgaacagcgcagttgatgagtcggcgctggctcatttacgactcgattggtgaggaactggaagttgttggtgatggagtggttgggttacagccggtgctcggccccggcgatgtccacgaataccagagctactgtgtgctcaagtcgccacgcggctggatggagggagagtacttttttcgcaccctcgataacacgacgttcgccgccatcattccgcgtttcgacctgatcgccgatgcggagatgatcgatgatgaggagagattatga

SEQ ID NO: 44392 - protein, 137 aa, Chloroflexus aurantiacus
MRRPFYYRLSEGMRISVRPQYLPGHSFPPLQRFVFAYDVRIENISRRTAQLMSRRWLIYDSIGEELEVVGDGVVGLQPVLGPGDVHEYQSYCVLKSPRGWMEGEYFFRTLDNTTFAAIIPRFDLIADAEMIDDEERL

SEQ ID NO: 44393 - DNA, 396 bp, Polaromonas sp. JS666
  CDS (1)..(396)
atgtccaaataccatttttcctgcgaagtcataccccagtaccagcctggccagtcagcgcccgaggacgggatttacgggttttcctacaccgtcacgctcaccaataccggcgatgtggccgcccaactgatttcccgccactggctcatcagtgacgccaacggccacaccgaagaagtcaagggactgggcgtcgtggggcatcagccgctgctcaagccgggcgaatccttccagtacaccagcggctcgcgcctgcgcacgcccagcggcaccatgcacggcagttatttttgtgtggcggaagacggcacgcggtttgaggtcgccatccccatgtttgtgctggaggcacaccaggggggcaatccggccggccgcgtcctgcattga

SEQ ID NO: 44394 - protein, 131 aa, Polaromonas sp. JS666
MSKYHFSCEVIPQYQPGQSAPEDGIYGFSYTVTLTNTGDVAAQLISRHWLISDANGHTEEVKGLGVVGHQPLLKPGESFQYTSGSRLRTPSGTMHGSYFCVAEDGTRFEVAIPMFVLEAHQGGNPAGRVLH

SEQ ID NO: 44395 - DNA, 903 bp, Oryza sativa
  CDS (1)..(903)
atgcagtgggcggcgctgagctcgccgccggcaccggcggcgccggcggcggtgtggatggggcggagggcaagaaccgcgaggttgccgtcgccggggccgcgccgggtggtgctggccgccgcggcgtcgtcgtcgtcgccgtcgccggatgcgaactcgagctcgaactcgaactcgccggggagtggtggcggcggcgaggaggtggaggaggagagggaggacgcggcgcggatggagaaggcggcggccttcctgatgcggagccagaagtacgccatgctcaagcagcagctcgccgtggccgcccagttcgaggattacaaggaggcggcgaggctgagggattcgctcaagtcattcgaggaggaggagccagttcttcgtctccgccgatcgctcaagaaggcggttgaggaggagaggttcgaggatgctgctaagtacagagatgaactgaagattttggctccacacgccctcctaaaatgttctagtgatgctactaccctggggattagagttcaagtcaggagtgtttatattgaaagccggagccagcctttgaagggccagttcttctttgcctacagaatcagaatcacaaataattctcagcgccctgttcagcttctcagaagacattggattgtcactgatgcaaatggaaggacggagaacatttggggtgtaggtgttgtgggagagcaacctgtcatatttccaaggactggttttgagtactcatctgcatgcccattaaacacaccaaatgggagaatggaaggtgattttgagatgaagcacatcgacaaagctgggtcgtctacattcaatgtcgcaattgcaccattctctctgtcaatccttggagatgacaacgatgatgttctcctctaa

SEQ ID NO: 44396 - protein, 300 aa, Oryza sativa
MQWAALSSPPAPAAPAAVWMGRRARTARLPSPGPRRVVLAAAASSSSPSPDANSSSNSNSPGSGGGGEEVEEEREDAARMEKAAAFLMRSQKYAMLKQQLAVAAQFEDYKEAARLRDSLKSFEEEEPVLRLRRSLKKAVEEERFEDAAKYRDELKILAPHALLKCSSDATTLGIRVQVRSVYIESRSQPLKGQFFFAYRIRITNNSQRPVQLLRRHWIVTDANGRTENIWGVGVVGEQPVIFPRTGFEYSSACPLNTPNGRMEGDFEMKHIDKAGSSTFNVAIAPFSLSILGDDNDDVLL

SEQ ID NO: 44397 - DNA, 384 bp, Bdellovibrio bacteriovorus
  CDS (1)..(384)
atgcaaaaaacttcaatccctgatttccagatcaccgcgaaagtcgtctacgtaccgtctgagtcgcgtcctgatgaaggctaccatttctttgcctataaaattactatcaccaacacaggatcaacccctgcccaactgatgagccgtcactgggtcatcaccgatgcgttgggtaaaaaagaagaagtccgcggccctggtgttgtcggattacagcctaaaattcaacctggtcagacctttgaatacgacagcgcctgcccactgacaacctccaccggcagcatggtgggacgctatttcttcgtgggcgaaagtggcgaaagcttctctgtggaagttcccgagttctatctgattgcccctttggcactgcattaa

SEQ ID NO: 44398 - protein, 127 aa, Bdellovibrio bacteriovorus
MQKTSIPDFQITAKVVYVPSESRPDEGYHFFAYKITITNTGSTPAQLMSRHWVITDALGKKEEVRGPGVVGLQPKIQPGQTFEYDSACPLTTSTGSMVGRYFFVGESGESFSVEVPEFYLIAPLALH

SEQ ID NO: 44399 - DNA, 393 bp, Brucella suis
  CDS (1)..(393)
atgtatagtgcggtaacacgcgggatcgaagttacggtcgagcccttttatctggaagtccaatccgagccggaagaaaaccgttatgtatggggttatcgcgtcacgatcgtgaacaactcatccgaaacggtgcagctttgctcacgctactggcagatcaccgacgccaacggccatgtgcaagaagtgcgcggttcaggcgtggtcggcgagcagcctgttctcgatccgggcgcttcataccagtattcttccggttgcccgctcacaacctcgtcaggcgtgatggtcgggcgctaccagatgaagggcgaagacggcgcacaattcgagatcgagattcccgccttttcactcgacgtacccgaacagcgccgcacgctgaactga

SEQ ID NO: 44400 - protein, 130 aa, Brucella suis
MYSAVTRGIEVTVEPFYLEVQSEPEENRYVWGYRVTIVNNSSETVQLCSRYWQITDANGHVQEVRGSGVVGEQPVLDPGASYQYSSGCPLTTSSGVMVGRYQMKGEDGAQFEIEIPAFSLDVPEQRRTLN

SEQ ID NO: 44401 - DNA, 381 bp, Chromobacterium violaceum
  CDS (1)..(381)
atggccgataaactctaccagatggaggtgcaggcggagccacaatacgtggccgaacagtccagcgtcgccaacgacgtctacgtgttcgcctaccgcgtccgcatcaccaataccggcagcgagccggcgcagctgatcagccgccactggatcatcaccgacgccaatcagcaggtgcaggaggtgcgcggcatgggcgtggtgggcgagcagccgcatctcgacccgggccaggtgttcgagtactccagcgcggcccacatcaccacgccgtacggcagcatgaagggcgcctaccagatgatggcggacgacggtcggcgcttcgaggcgtccattcccgagatgacgctggtggcgccccgggtgctgcactaa

SEQ ID NO: 44402 - protein, 126 aa, Chromobacterium violaceum
MADKLYQMEVQAEPQYVAEQSSVANDVYVFAYRVRITNTGSEPAQLISRHWIITDANQQVQEVRGMGVVGEQPHLDPGQVFEYSSAAHITTPYGSMKGAYQMMADDGRRFEASIPEMTLVAPRVLH

SEQ ID NO: 44403 - DNA, 387 bp, Deinococcus radiodurans
  CDS (1)..(387)
atgacctcttctcccgacatcaccgtgtccgtacaggtccaccacctgcccgcgcagagcaccccgcaacgccaattgttcgcgtatttcatcaccatcgaaaacaacaccgacgacagctggaaactgctcagccgccactggaccatcaccagcggcgacggccagcagttcacggtggagggtgaaggcgtcgtcggggagcagccgctgctcgcgccgggcgcccagtacacctacaactcgttcgtgacggtagacgcgctgccgggccgcatggaaggccactacgtgatgggcgacgcctgggggcagacggcgcaggtgccgattccgcctttccgcttggacatcgcgcccgaaagcggcgaacggctgctgaactga

SEQ ID NO: 44404 - protein, 128 aa, Deinococcus radiodurans
MTSSPDITVSVQVHHLPAQSTPQRQLFAYFITIENNTDDSWKLLSRHWTITSGDGQQFTVEGEGVVGEQPLLAPGAQYTYNSFVTVDALPGRMEGHYVMGDAWGQTAQVPIPPFRLDIAPESGERLLN

SEQ ID NO: 44405 - DNA, 384 bp, Nitrosomonas europaea
  CDS (1)..(384)
atggaaaacgaacgaaaatatagcatcaaggtggaagtacgcacaatttatttaccagatcagtctgatcccgaggcggagcggtacgtgtttgcttataccattacgatcaacaataccggcagtgtggcttcacaactggtgagccgccactggatcatcaccagcggggatggcgttacgcgtgaagtgcgcgggctgggcgtagtcggcgagcaacccttgctcaaacccggtgaaacctttgaatataccagcggaaccgcgatttcatcgattgccggttcgatgaagggctcctatcagatggtggctgaagacggttttcatttttcggtggaaattcctgaattcatcctgagcgtgccgcgcgtgctgcactga

SEQ ID NO: 44406 - protein, 127 aa, Nitrosomonas europaea
MENERKYSIKVEVRTIYLPDQSDPEAERYVFAYTITINNTGSVASQLVSRHWIITSGDGVTREVRGLGVVGEQPLLKPGETFEYTSGTAISSIAGSMKGSYQMVAEDGFHFSVEIPEFILSVPRVLH

SEQ ID NO: 44407 - DNA, 378 bp, Photorhabdus luminescens
  CDS (1)..(378)
atgattaatacgcccagggtttctattcaggtacaaagtgtttatgtagaaagccaatcgtgtcccgatcaacggcgtttcgtttttgcctatacaattactattcgaaatcttgggcgcgaacgggtccaattaattaatcgttactggctgattaccaacagcgacagccatcaaacggaagttcaaggggaaggtgttgttggtgagcaacccataatccagccaggtaccgaataccgttacaccagcggggcgatattggaaacgcccttgggtactatggaaggccattatgaaatgattgatcacaatggtgaaccatttcgcgttgctattccggttttccgtctggctatcccaacgctgattaattga

SEQ ID NO: 44408 - protein, 125 aa, Photorhabdus luminescens
MINTPRVSIQVQSVYVESQSCPDQRRFVFAYTITIRNLGRERVQLINRYWLITNSDSHQTEVQGEGVVGEQPIIQPGTEYRYTSGAILETPLGTMEGHYEMIDHNGEPFRVAIPVFRLAIPTLIN

SEQ ID NO: 44409 - DNA, 384 bp, Photobacterium profundum
  CDS (1)..(384)
ttgagcgcgaattcccccccaacaattaaatgcaacgtcgttactcattatattgaggaacagtctgaacctaacaatcaacgttatgttttctcatacaccattacgattagaaacctagggaaaggttcggccaaattactaagtcgttattggctaataaccgatgcaaatgggaaacggctcgtgattgaaggtgaaggtgtggttggcgaacaaccagaaataaagatgaacgaagaatatacttataccagcggtacgatcattgaaaccccacttggtgtaatgcaaggccactacgtcatgggcactgaagatggtgagacctttaaagcagaagtatctccgtttaggttagcaatacccaatattctccattaa

SEQ ID NO: 44410 - protein, 127 aa, Photobacterium profundum
MSANSPPTIKCNVVTHYIEEQSEPNNQRYVFSYTITIRNLGKGSAKLLSRYWLITDANGKRLVIEGEGVVGEQPEIKMNEEYTYTSGTIIETPLGVMQGHYVMGTEDGETFKAEVSPFRLAIPNILH

SEQ ID NO: 44411 - DNA, 381 bp, Pseudomonas aeruginosa
  CDS (1)..(381)
atgagcgatacccagcaccaggtcaacgtcagggtcgacacccgctaccttccggaacagtccgccccggagcagaaccgtttcgccttcgcctacacggtgaccatcgagaaccagggcgaggttccggcccaactgctgtcgcgccactggatcatcaccgacggcgacggccgtacccaggaagttcgcggcgccggcgtggtcggcgagcaaccgctgatcgcccccggcgcgcaacacacctacaccagcggcacggtgctggcgacccgggtcggcagcatgcgcggcagctatcagatgctcggcagcgacggaatcgccttcgacgccgcgatcccggtgtttcgcctggccgtaccgggagcgctgcactga

SEQ ID NO: 44412 - protein, 126 aa, Pseudomonas aeruginosa
MSDTQHQVNVRVDTRYLPEQSAPEQNRFAFAYTVTIENQGEVPAQLLSRHWIITDGDGRTQEVRGAGVVGEQPLIAPGAQHTYTSGTVLATRVGSMRGSYQMLGSDGIAFDAAIPVFRLAVPGALH

SEQ ID NO: 44413 - DNA, 375 bp, Ralstonia solanacearum
  CDS (1)..(375)
atgtcccgctacgaactcaccgtccaggtccggacgcgctacctgcctgagcaatccgagccctcgcaggaccagtacgcctttgcctacaccatcactatccgcaatacgggcgaggtaccgagccagctggtctcgcggcactgggtcatcaccgacgcggagagccacgtgcaggaggtcgccggcctcggcgtggtcggccaccagccgctgctgccgccgggcgaatcgttcgagtacaccagctgggcgaccatcaagacgccggtgggcaccatgcgcggcgaatacttctgcgtggccgaggacggccatcgcttcgaggcgccgattcccgagtttgcgctggcgatgccgcgcatgctgcattga

SEQ ID NO: 44414 - protein, 124 aa, Ralstonia solanacearum
MSRYELTVQVRTRYLPEQSEPSQDQYAFAYTITIRNTGEVPSQLVSRHWVITDAESHVQEVAGLGVVGHQPLLPPGESFEYTSWATIKTPVGTMRGEYFCVAEDGHRFEAPIPEFALAMPRMLH

SEQ ID NO: 44415 - DNA, 393 bp, Rhizobium etli
  CDS (1)..(393)
atgtatcgcgccctcacaagagatatcgaagtcgtggtcgaaccgttctatctggaggagcaatccgatccggaggacgatcgctatgtctggggttaccggatcgtcatcagcaacaattccggcgtcgccgttcgtctggtcaaccgctactggaacatcaccgaccagaacggccaggtagacgaggtgaccggccccggcgtcgtcggcgaacagccgcggctcagccccggcgatacctacgaatattcctccggctgcccgctcgacaccccgtccgcggtgatgttcggccattaccagatggaaacggatgaaggcgagcttttcgacgtcgacatccccgccttctcgctggattcaccggggctgctgcgcgtgctgaattga

SEQ ID NO: 44416 - protein, 130 aa, Rhizobium etli
MYRALTRDIEVVVEPFYLEEQSDPEDDRYVWGYRIVISNNSGVAVRLVNRYWNITDQNGQVDEVTGPGVVGEQPRLSPGDTYEYSSGCPLDTPSAVMFGHYQMETDEGELFDVDIPAFSLDSPGLLRVLN

SEQ ID NO: 44417 - DNA, 393 bp, Rhizobium loti
  CDS (1)..(393)
atgtaccgcgccgtcacgcgcaacatcgaagtgcaggtcaggccgttctacctcgaggatcgctccgatccttccgagaaccgctatgtctggggctatcagataacgatcgacaatcagtcggacgaattcgtgcagcttctgtcacgctactggcacatcaccgacggcgccggccgggtcgaggaagtgcgcggcccgggcgtcgtcggcgaccagcccgaactcaatcccggcgacagctatcaatatacgtctggctgcccgctctcgacgccatcaggcatcatggtcgggcactacacgatgcgcaacaagcgtggcgagaccttcgacatcgccatcccggcgttctcgctggacctgccggggaccagacggacggtgaattag

SEQ ID NO: 44418 - protein, 130 aa, Rhizobium loti
MYRAVTRNIEVQVRPFYLEDRSDPSENRYVWGYQITIDNQSDEFVQLLSRYWHITDGAGRVEEVRGPGVVGDQPELNPGDSYQYTSGCPLSTPSGIMVGHYTMRNKRGETFDIAIPAFSLDLPGTRRTVN

SEQ ID NO: 44419 - DNA, 393 bp, Rhodopseudomonas palustris
  CDS (1)..(393)
atgtaccgcgccgtcacccgccggatcgaagtgaccgttgaacccaattatctgccggagcgttcctcggcggagaaccgccagtatttctggtcctacaccgtggtgatcaccaattcgggcgaggaaaccgtcaagctgcgcacccggcattgggtgatcaccgacgcctccggccggacccaggaagtgcgcggcgaaggcgtggtcggcgaacagccggttctcgcgccgggcgagcggttcgaatataccagcggcgtccccctcccgaccgcctccggcttcatggccggccgctatcagatggaaaccgaagcgggcgaaaaattcgagatcgacgttccgccgttttcgctcgatagcccggaagggaagcggacactgaactaa

SEQ ID NO: 44420 - protein, 130 aa, Rhodopseudomonas palustris
MYRAVTRRIEVTVEPNYLPERSSAENRQYFWSYTVVITNSGEETVKLRTRHWVITDASGRTQEVRGEGVVGEQPVLAPGERFEYTSGVPLPTASGFMAGRYQMETEAGEKFEIDVPPFSLDSPEGKRTLN

SEQ ID NO: 44421 - DNA, 378 bp, Salmonella typhi
  CDS (1)..(378)
atgatcaattcgcccagagtgtgtattcaggtgcaaagcgtctacattgaggcgcaatcctcacctgacgatgaacgttacgtttttgcctataccgtaaccatccgcaatctgggtcgggcgccagtgcagctattgggccgctactggctgattaccaatggtcatggccgtgaaactgaagtccagggcaaaggtgtggttggcgtccagccgcgcattgcgcctggcgaagagtatcagtacaccggcggcgcggtaattgaaacgccgctgggcaccatgcagggtcattacgaaatgatcgatgaaaatggcgacgcctttaccatcgacattcccgtgtttcgactcgccgtccctacactcattcactaa

SEQ ID NO: 44422 - protein, 125 aa, Salmonella typhi
MINSPRVCIQVQSVYIEAQSSPDDERYVFAYTVTIRNLGRAPVQLLGRYWLITNGHGRETEVQGKGVVGVQPRIAPGEEYQYTGGAVIETPLGTMQGHYEMIDENGDAFTIDIPVFRLAVPTLIH

SEQ ID NO: 44423 - DNA, 378 bp, Salmonella typhimurium
  CDS (1)..(378)
atgatcaattcgcccagagtgtgtattcaggtgcaaagcgtctacattgaggcgcaatcctcacctgacgatgaacgttacgtttttgcctataccgtaaccatccgcaatctgggccgggcgccagtgcagctattgggccgctactggctgattaccaatggtcatggccgtgaaaccgaagtccagggcgaaggtgtggttggcgtccagccgcgcattgcgcctggcgaagagtaccagtacaccagcggcgcggtaattgaaacgccgctgggcaccatgcagggtcattacgaaatgatcgatgaaaatggcgacgcctttaccatcgacatccccgtgtttcgactcgccgtccctacactcattcactaa

SEQ ID NO: 44424 - protein, 125 aa, Salmonella typhimurium
MINSPRVCIQVQSVYIEAQSSPDDERYVFAYTVTIRNLGRAPVQLLGRYWLITNGHGRETEVQGEGVVGVQPRIAPGEEYQYTSGAVIETPLGTMQGHYEMIDENGDAFTIDIPVFRLAVPTLIH

SEQ ID NO: 44425 - DNA, 381 bp, Shewanella oneidensis
  CDS (1)..(381)
atgagcgcattggataactctatccgagtcgaagtcaaaaccgagtacattgaacaacaatcctcacctgaggatgagaaatacctctttagctacactatcaccattattaacctcggtgagcaagccgcaaaactcgaaacccgtcactggatcattaccgacgctaacggcaaaaccagtgaagtacaaggtgcgggtgttgtcggtgaaacgcccaccattcctccaaataccgcttaccaatataccagtggcacagtactcgataccccctttggcattatgtatggcacttatggtatggtcagcgaatcgggcgagcattttaacgctataattaagccgttccgcttagccacccctggcttattacattga

SEQ ID NO: 44426 - protein, 126 aa, Shewanella oneidensis
MSALDNSIRVEVKTEYIEQQSSPEDEKYLFSYTITIINLGEQAAKLETRHWIITDANGKTSEVQGAGVVGETPTIPPNTAYQYTSGTVLDTPFGIMYGTYGMVSESGEHFNAIIKPFRLATPGLLH

SEQ ID NO: 44427 - DNA, 381 bp, Vibrio cholerae
  CDS (1)..(381)
atggatgtttcgctgccctgtatcaaaattcaggttcaaactcgctacattgaggaacaatcaaatcctgagtatcagcgctttgtgttcgcctatctcatcaccatcaaaaatctcagctcccagaccgtccaactgatgagtcggcgctggttgatcacggatgccgatggcaaacagaccgtggttgaaggcgatggcgttgtgggagagcaacctcgcatcaaagctaacgatgaatatacctacagcagtggcacggccttagatactcccgtcggtgtgatgcaggggcaatatttgatgatcgatgaacaaggtgagtctttcacggttgagattgaaccatttcgtttagccgttccgcatgtattgaattaa

SEQ ID NO: 44428 - protein, 126 aa, Vibrio cholerae
MDVSLPCIKIQVQTRYIEEQSNPEYQRFVFAYLITIKNLSSQTVQLMSRRWLITDADGKQTVVEGDGVVGEQPRIKANDEYTYSSGTALDTPVGVMQGQYLMIDEQGESFTVEIEPFRLAVPHVLN

SEQ ID NO: 44429 - DNA, 381 bp, Vibrio parahaemolyticus
  CDS (1)..(381)
atggacgtcattcaaccctgcatcaagattcaagttcacaccaaatacatcgaagagcaatccaatccagagctacaacgctttgttttcgcctacgtcattaccattaaaaacctcagccaacagacagtgcagctcataagtcgccgatggttgattaccgattccaacggtaaacaaatgacggtagagggagaaggtgttgttgggcagcagccgtttattccaagcaacgatgaatacacttacagcagtggtaccgcgttagaaacgcctgttggtgtcatgcaaggacactacaaaatgctggatgaaaaaggccaggaattcatcactgaaattgagccatttcgtttagcgattccgaacgttttaaattaa

SEQ ID NO: 44430 - protein, 126 aa, Vibrio parahaemolyticus
MDVIQPCIKIQVHTKYIEEQSNPELQRFVFAYVITIKNLSQQTVQLISRRWLITDSNGKQMTVEGEGVVGQQPFIPSNDEYTYSSGTALETPVGVMQGHYKMLDEKGQEFITEIEPFRLAIPNVLN

SEQ ID NO: 44431 - DNA, 402 bp, Wolbachia pipientis wMel
  CDS (1)..(402)
atgatagaatacacactaactaccaactttgttgaagttacagttttaccaatttatattgaagagcaatccattccttatgaaaattgctatgtatggatgtataacgttaagataaaaaacaaaagccaatcaactattcaattgttaagtcgtcattggcaaataatagattataagggaaaagtaaatgaaattgccggagttggtgttatcggagaacaacctgtgataaaatctggagaggtatttaaatacacaagtggaacatacttaaatgtaccgtcaggaataatgcagggtaagtatgaatttctgaatgaagaaagcataaaagtttttgaagttatgataccacccttttctttggatagtccatacatcaaaactagaccccattaa

SEQ ID NO: 44432 - protein, 133 aa, Wolbachia pipientis wMel
MIEYTLTTNFVEVTVLPIYIEEQSIPYENCYVWMYNVKIKNKSQSTIQLLSRHWQIIDYKGKVNEIAGVGVIGEQPVIKSGEVFKYTSGTYLNVPSGIMQGKYEFLNEESIKVFEVMIPPFSLDSPYIKTRPH

SEQ ID NO: 44433 - DNA, 384 bp, Xanthomonas campestris
  CDS (1)..(384)
atgcaagatgatccgcgctaccgggtcgaggtcgaggtgtcaccacgcttcctcgcccatcaatcgactccggaagaaggccgctacgccttcgcttacagcattcgcatccagaacgccggcgccgtgccagcgcgactgattgcgcgccactggaaaatcaccgacgccaacggccgcaccgagcaggtggacggcgaaggtgtggtcggcgagcagccgcggttgcgtccgggcgaggccttccactacacctccggtgtgctgctggaaaccgaacaggggcagatgcagggctactacgacatggtggccgacgatggcaccgaattcaccgcgccaatcgccgccttcgtgctgagcgtgccgaggacgctgcactga

SEQ ID NO: 44434 - protein, 127 aa, Xanthomonas campestris
MQDDPRYRVEVEVSPRFLAHQSTPEEGRYAFAYSIRIQNAGAVPARLIARHWKITDANGRTEQVDGEGVVGEQPRLRPGEAFHYTSGVLLETEQGQMQGYYDMVADDGTEFTAPIAAFVLSVPRTLH

SEQ ID NO: 44435 - DNA, 384 bp, Xylella fastidiosa
  CDS (1)..(384)
atggaaaacaatcccagttcaaagattgaggtcgctatctcgtcccgcttcctcgaccaccaatctaatcgtaatgaaggccgctacgtcttcgcctacaccatccggatctacaatgctggaaatgtccctgcacgactgatcgcgcgccactggcagattaccgatgcaaacggcaaagtcgaatacgtcactggtgaaggagtcattggagaacaaccacggctgcgtcccggcgaagaatttcgctacacatctggggtcgtgttggggaccgaacagggccagatgcaaggacactacgacatgatggccgatgacggcaccgaattcaccgccacaatcgccccattcgtactcagtgtaccgcgaacactacactga

SEQ ID NO: 44436 - protein, 127 aa, Xylella fastidiosa
MENNPSSKIEVAISSRFLDHQSNRNEGRYVFAYTIRIYNAGNVPARLIARHWQITDANGKVEYVTGEGVIGEQPRLRPGEEFRYTSGVVLGTEQGQMQGHYDMMADDGTEFTATIAPFVLSVPRTLH

SEQ ID NO: 44437 - DNA, 23 bp, Primer
atgatcaattcgccccgagtgtg

SEQ ID NO: 44438 - DNA, 24 bp, Primer
ttaatgaatgagtgtgggaacggc

SEQ ID NO: 44439 - protein, 78 aa, consensus
  MISC_FEATURE (1)..(78): consensus for the disclosure of xaa see table XV
SXXXXXXXXXXYXXXXXNXXXXXXXXXXRXWXXXXXXXXXXXXXGXGVXGXXPXXXXXXXXXYXXXXXXXXXXXXMXG

SEQ ID NO: 44440 - protein, 112 aa, consensus
  MISC_FEATURE (1)..(112): consensus for the disclosure of xaa see table XV
VXXXXXXXXSXPXXXXXXXXYXXXIXNXXXXXXXLXXRXWXIXDXXGXXXXVXGXGVVGXQPXXXPGXXXXYXSXXXXXTXXGXMXGXYXXXXXXXGXXFXXXIXXFXLXXP

SEQ ID NO: 44441 - protein, 114 aa, consensus
  MISC_FEATURE (1)..(114): consensus for the disclosure of xaa see table XV
XXXXXXXXXXXSXXXXXXXXXXYXXXXXNXXXXXXXXXXRXWXXXXXXXXXXXXXGXGVXGXXPXXXXXXXXXYXXXXXXXXXXXXMXGXXXXXXXXXXXXXXXXXXXXXXXXX

SEQ ID NO: 44442 - DNA, 858 bp, Escherichia coli
  CDS (1)..(858)
atgacacaggcagaacgccgccatgaccggctggctgtcaggctgtcactgataatcagccgtctggtggcaggggaaacgctgagtgtgcgtaagcttgccgctgagtttggtgtgtcggtgcgcacgctgcggcgtgattttcgtgagcggctgatgtatctggacctggagtatcagtccggatattgccattatcgccattgttgtcatcgtcatcattctgaacaaaaccggggtgtccgacagtctcgcggccctgacccttgccactgttgccgcactgctgacgggaggtggcgcagccggtgctgccagtgtcgcgctgacaccgttcgtcggcgtgccggtgggtattttcgtgggcatttatgtctttgccaaagtggttcgtctgatttcaggaaaaaaataatgaaacgtaaaacactgcctctgctggcgctggttgccaccactctgtttctcatcgcatgcgatgacagaagtgatgacctgaaggccatcagtaaatttaaggacctcaccccaccgcgtttcagtgatgtggtcagccaccaggatgatgtcagcgaagaatggtcacaggttgactacttatccggtcccaccttgcaggttttacgtacccgccagtcgcccgatggctgcgaggatggcagttactactacctcgtggatatgcaggaaaaaaccgtccagccactgatgaatgcgctgtgtattgccgataacatcaaactggaataccaggaggtgacggacccgtataccaaagaaaaatactttgagtacgcccatgacggcaaactgatggggcagctactgataccctcgaaccctgacaatcaggaataa

SEQ ID NO: 44443 - protein, 285 aa, Escherichia coli
MTQAERRHDRLAVRLSLIISRLVAGETLSVRKLAAEFGVSVRTLRRDFRERLMYLDLEYQSGYCHYRHCCHRHHSEQNRGVRQSRGPDPCHCCRTADGRWRSRCCQCRADTVRRRAGGYFRGHLCLCQSGSSDFRKKIMKRKTLPLLALVATTLFLIACDDRSDDLKAISKFKDLTPPRFSDVVSHQDDVSEEWSQVDYLSGPTLQVLRTRQSPDGCEDGSYYYLVDMQEKTVQPLMNALCIADNIKLEYQEVTDPYTKEKYFEYAHDGKLMGQLLIPSNPDNQE

SEQ ID NO: 44444 - DNA, 693 bp, Escherichia coli K12
  CDS (1)..(693)
atggaggagcccagtgcccgttattgccattatcgccattgttatcatcgtcatcattctgaacaaaaccggagtgtccgacagcctcacggccctgacacttgcaaccgttgccgcactactgacgggaggtggtgcagccggtgctgccagtgtcgcgctgacgccgttcgtcggcgtgccggtgggtatttttgtgggaatttatgtctttgccaaagtggttcgtctgatttcagggaaaaaataatgaaacgtaaaacactacctctgctggcgctggttgccacctctctgtttctgagcgcctgcgatgacaggagtgatgacctcaaagctatcagtaaatttaaggacctcacgcccccgcgcttcagcgatgtggtcagccgtcaggatgatgtcagcgaagaatggtcacaggttggcttctcatccggtctcaccctgcaggtcttacgtacccgtgagtcgcccgatggttgcgagggtggcagttactactatctggtagatatggaggagaaaaccgtccagccgctgatgaatgcgctttgtattgccgacaatatcaaactggaataccacgaagttacggacccgtatacgaaagaaaaatacttcgaatattcccatgacggcaaactgatgggacggctgctgataccgtcaaaccctgataaccgggaataa

SEQ ID NO: 44445 - protein, 230 aa, Escherichia coli K12
MEEPSARYCHYRHCYHRHHSEQNRSVRQPHGPDTCNRCRTTDGRWCSRCCQCRADAVRRRAGGYFCGNLCLCQSGSSDFREKIMKRKTLPLLALVATSLFLSACDDRSDDLKAISKFKDLTPPRFSDVVSRQDDVSEEWSQVGFSSGLTLQVLRTRESPDGCEGGSYYYLVDMEEKTVQPLMNALCIADNIKLEYHEVTDPYTKEKYFEYSHDGKLMGRLLIPSNPDNRE

SEQ ID NO: 44446 - DNA, 20 bp, Primer
atgacacaggcagaacgccg

SEQ ID NO: 44447 - DNA, 24 bp, Primer
ttattcctgattgtcagggttcga

SEQ ID NO: 44448 - protein, 228 aa, consensus
  MISC_FEATURE (1)..(228): consensus for the disclosure of xaa see table XV
EXXXXYCHYRHCXHRHHSEQNRXVRQXXGPDXCXXCRTXDGRWXSRCCQCRADXVRRRAGGYFXGXLCLCQSGSSDFRXKIMKRKTLPLLALVATXLFLXACDDRSDDLKAISKFKDLTPPRFSDVVSXQDDVSEEWSQVXXXSGXTLQVLRTRXSPDGCEXGSYYYLVDMXEKTVQPLMNALCIADNIKLEYXEVTDPYTKEKYFEYXHDGKLMGXLLIPSNPDNXE

SEQ ID NO: 44449 - DNA, 405 bp, Escherichia coli
  CDS (1)..(405)
atgatatgctcacctcagaacaacacaggtgtcataatgaaaaaaagaaatttcagcgcagagtttaaacgcgaatccgctcaactggtcgttgaccagaactacaccgtggcagatgcagccagcgctatggatgtcggcctttccacaatgacgcgatgggtgaaacaattacgtgatgaacggcagggcaaaacaccaaaagcctcccccattaccccggaacaaattgaaatccgtgagctcaggaaaaagctacaacgtattgaaatggaaaatgaaatattaaaaaaggctactgtagattcaattggtcaacgcaacagttatgtgaaaacatggggttgcggaggttttttgaatgagacgaacatttacagcagaggaaaaagcctctgtttttga

SEQ ID NO: 44450 - protein, 134 aa, Escherichia coli
MICSPQNNTGVIMKKRNFSAEFKRESAQLVVDQNYTVADAASAMDVGLSTMTRWVKQLRDERQGKTPKASPITPEQIEIRELRKKLQRIEMENEILKKATVDSIGQRNSYVKTWGCGGFLNETNIYSRGKSLCF

SEQ ID NO: 44451 - DNA, 303 bp, Shigella flexneri
  CDS (1)..(303)
atgagcagaaaaaaccaacgttactctacggagtttaaagccgaagccgtcaaaacggttcctgaaaatcagctttcgatcagtgaaggcgcttcccgattatctcttcctgaaggcactttaggacaatgggttaccgccgcaagaaaagggctcaatacaccaggctcccgcacagtggctgagctggaatctgaagttatgcaactgcgtaaggctttaaatgaagcacgacttgagcgagatatattaaaaaaagcaacagcgtattttgcacaggagtcgctgaaaaatacgcgttag

SEQ ID NO: 44452 - protein, 100 aa, Shigella flexneri
MSRKNQRYSTEFKAEAVKTVPENQLSISEGASRLSLPEGTLGQWVTAARKGLNTPGSRTVAELESEVMQLRKALNEARLERDILKKATAYFAQESLKNTR

SEQ ID NO: 44453 - DNA, 303 bp, Shigella flexneri
  CDS (1)..(303)
atgagcagaaaaacccaacgttactctaaagagttcaaagccgaagctgtcagaacggttcttgaaaatcaactttcgatcagtgaaggcgcttcccgattatctcttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcaacagcgtattttgcacaggagtcgctgaaaaatacgcgttaa

SEQ ID NO: 44454 - protein, 100 aa, Shigella flexneri
MSRKTQRYSKEFKAEAVRTVLENQLSISEGASRLSLPEGTLGQWVTAARKGLGTPGSRTVAELESEILQLRKALNEARLERDILKKATAYFAQESLKNTR

SEQ ID NO: 44455 - DNA, 303 bp, Shigella flexneri
  CDS (1)..(303)
atgagcagaaaaacccgacgttactctaaagagttcaaagccgaagctgtcagaacggttcttgaaaatcaactttcgatcagtgaagacgcttcccgattattccttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcaacagcgtattttgcacaggagtcgctgaaaaatacgcgttaa

SEQ ID NO: 44456 - protein, 100 aa, Shigella flexneri
MSRKTRRYSKEFKAEAVRTVLENQLSISEDASRLFLPEGTLGQWVTAARKGLGTPGSRTVAELESEILQLRKALNEARLERDILKKATAYFAQESLKNTR

SEQ ID NO: 44457 - DNA, 339 bp, Shigella flexneri
  CDS (1)..(339)
gtgatatgctcacctcagaacaacacaggtgctccaatgaaaaaaagaaattttagcgcagagtttaaacgcgaatccgctcaactggttgttgaccagaaatacacggtggcagatgccgccaaagctatggatgttggcctttccacaatgacaagatgggtcaaacaactgcgtgatgagcgtcagggcaaaacaccaaaagcctctccgataacaccagaacaaatcgaaatacgtaagctgaggaaaaagctacaacgcattgaaatggagaatgaaatattaaaaaaggctaccgcgctcttgatgtcagactccctgaacagttctcaataa

SEQ ID NO: 44458 - protein, 112 aa, Shigella flexneri
MICSPQNNTGAPMKKRNFSAEFKRESAQLVVDQKYTVADAAKAMDVGLSTMTRWVKQLRDERQGKTPKASPITPEQIEIRKLRKKLQRIEMENEILKKATALLMSDSLNSSQ

SEQ ID NO: 44459 - DNA, 297 bp, Mesorhizobium loti MAFF303099
  CDS (1)..(297)
gtgggaatgcaaagaaggaagttcagccgcgagttcaagcttgaggcggtgagattgatcaaggatcggggcgttgcggtggcccaggctgcccgcgacctcgatgtccacgagaacgtgctgcgcaaatgggtgcgcgatctgtcgacggatcctcagcatgcgtttcccggccacgggcagatgaagccggagcagctcgagattgaccggctgcgcaaggaagtggcgaagctgaaggcggagcgcgacatcctaaaaaaggccgcagcctacttcgcgagggaagtgacatga

SEQ ID NO: 44460 - protein, 98 aa, Mesorhizobium loti MAFF303099
MGMQRRKFSREFKLEAVRLIKDRGVAVAQAARDLDVHENVLRKWVRDLSTDPQHAFPGHGQMKPEQLEIDRLRKEVAKLKAERDILKKAAAYFAREVT

SEQ ID NO: 44461 - DNA, 297 bp, Mesorhizobium loti MAFF303099
  CDS (1)..(297)
gtgggaatgcagagaaggaagttcagccgcgagttcaagcttgaggcggtgagattgatcgaggatcggggcgttgcggtggcccaggctgcccgcgacctcgatgtccacgagaatgtgctgcgcaaatgggtgcgcgagctatcggccgatccgcagcgtgcgtttcccggtcatgggcagatgaagccggagcagcaggagattgaccggctgcgtaaggaagtcgcgaagctgaaggcggagcgcgacatcctaaaaaaggccgcagcctacttcgcgagggaagtgacatga

SEQ ID NO: 44462 - protein, 98 aa, Mesorhizobium loti MAFF303099
MGMQRRKFSREFKLEAVRLIEDRGVAVAQAARDLDVHENVLRKWVRELSADPQRAFPGHGQMKPEQQEIDRLRKEVAKLKAERDILKKAAAYFAREVT

SEQ ID NO: 44463 - DNA, 345 bp, Vibrio cholerae O1 biovar eltor str. N16961
  CDS (1)..(345)
gtgatatcatcacctcataagttaacaggtgacattatgacaaaacgtacaagacgactatttagcgcagaatttaagttagaagcagcgcagctagtcttagaccaaaattactcagtgacggaagcagcccaagccatgaatgtgggcaagtccacgatggataaatgggttcgccagcttagagaagaacgccaagggaaaacacctaaagcttcacctatgacccctgagcaaatagaaattcgggaattgaaaaagaagctggctcgccttgaagagcataatgaaatactaaaaaaagccacggctctcttgatgtcggactcactgaacaattcttga

SEQ ID NO: 44464 - protein, 114 aa, Vibrio cholerae O1 biovar eltor str. N16961
MISSPHKLTGDIMTKRTRRLFSAEFKLEAAQLVLDQNYSVTEAAQAMNVGKSTMDKWVRQLREERQGKTPKASPMTPEQIEIRELKKKLARLEEHNEILKKATALLMSDSLNNS

SEQ ID NO: 44465 - DNA, 285 bp, Bacillus halodurans C-125
  CDS (1)..(285)
atgaccaagcgtccgagaagaagctatacaaaagaatttaaggatcaaatcgttcaacttcatgtttctggcaagccccgtgcagaaattatcaaagaatacgagctgacgccttctgcctttgataagtgggttcggcagcaccagaacagtggatcctttgaagaaaaagacaaccgtacacccgaacaggaagagttgattcggctgcggaaagagaatcaaaagcttgccatggagaatgatattttaaagcaagccgcgctgatcatgggacgaaagtag

SEQ ID NO: 44466 - protein, 94 aa, Bacillus halodurans C-125
MTKRPRRSYTKEFKDQIVQLHVSGKPRAEIIKEYELTPSAFDKWVRQHQNSGSFEEKDNRTPEQEELIRLRKENQKLAMENDILKQAALIMGRK

SEQ ID NO: 44467 - DNA, 309 bp, Pseudomonas aeruginosa PAO1
  CDS (1)..(309)
atgagcaagcaacgacgtacgttttccgccgagttcaaacgagaggccgcggccctggtgttggaccaaggctacagccatatcgacgcctgccgttcgctgggggtggtggattcggccttgcgccgttgggtgaaacagctccaggcggaacgccaaggcgtgaccccgaagagcaaggcgctgacgcccgaacagcagaagatccaggaactggaagcccggatcaaccggctggagcgggagaaagcgatcctaaaaaaggctaccgctctcttgatgtcggacgaactcgatcgtacgcgctga

SEQ ID NO: 44468 - protein, 102 aa, Pseudomonas aeruginosa PAO1
MSKQRRTFSAEFKREAAALVLDQGYSHIDACRSLGVVDSALRRWVKQLQAERQGVTPKSKALTPEQQKIQELEARINRLEREKAILKKATALLMSDELDRTR

SEQ ID NO: 44469 - DNA, 288 bp, Pseudomonas aeruginosa PAO1
  CDS (1)..(288)
atgagcatccagcgattcaccccggaattcaaggccgaagccgttaggcaggtcatcgagcgcggatactcagtcgcggaaatcgccgcgggcttcggcgtctctactcacagcctctacaaatgggtaaaggctgtgacccccgacaagtcggagaaacaggccagcgaactgttggaagccaagagcgaaatcctgcggctgcgggcccaaatgcgtcgccttgaagaagaacgggacatcttaaaaaaaccgagcggctcatcacatactgcatggcgtccttga

SEQ ID NO: 44470 - protein, 95 aa, Pseudomonas aeruginosa PAO1
MSIQRFTPEFKAEAVRQVIERGYSVAEIAAGFGVSTHSLYKWVKAVTPDKSEKQASELLEAKSEILRLRAQMRRLEEERDILKKPSGSSHTAWRP

SEQ ID NO: 44471 - DNA, 309 bp, Pseudomonas aeruginosa PAO1
  CDS (1)..(309)
atgagcaagcaacgacgtacgttttccgccgagttcaaacgagaggccgcggccctggtgttggaccaaggctacagctatatcgacgcctgccgttcgctggggggggtggattcggccttgcgccgttgggtgaagcagctcgaggcggagcgccagggtgtgaccccgaagagcaaggcgttgacgcctgagcagcaaaagatccaggagctggaagcccggatcaaccggttggagcgggagaaagcgatattaaaaaaggctaccgctctcttgatgtcggacgaactcgatcgtacgcgctga

SEQ ID NO: 44472 - protein, 102 aa, Pseudomonas aeruginosa PAO1
MSKQRRTFSAEFKREAAALVLDQGYSYIDACRSLGGVDSALRRWVKQLEAERQGVTPKSKALTPEQQKIQELEARINRLEREKAILKKATALLMSDELDRTR

SEQ ID NO: 44473 - DNA, 291 bp, Lactococcus lactis subsp. lactis Il1403
  CDS (1)..(291)
atggcaagaagaaaattcgataaacaatttaaaaattctgcagtaaaactcattcttgaagagggttactctgttaaagaagtcagccaagagcttgaggttcatgccaatagtctctatcgctgggttcaagaagttgaagaatatggagaaagtgcttttccaggcaatgggacagccctagctaatgcccaacataagattaaattgttagagaaagaaaatcgttatcttcaggaggaacttgaacttctaaaaaagttccgggtcttcttgaagcgaagcaagtaa

SEQ ID NO: 44474 - protein, 96 aa, Lactococcus lactis subsp. lactis Il1403
MARRKFDKQFKNSAVKLILEEGYSVKEVSQELEVHANSLYRWVQEVEEYGESAFPGNGTALANAQHKIKLLEKENRYLQEELELLKKFRVFLKRSK

SEQ ID NO: 44475 - DNA, 291 bp, Lactococcus lactis subsp. lactis Il1403
  CDS (1)..(291)
atggcaagaagaaaattcgataaacaatttaaaaattctgcagtaaaactcattcttgaagagggttactctgttaaagaagtcagccaagagcttgaggttcatgccaatagtctttatcgctgggttcaagaagttgaagaatatggagaaagtgcttttccaggcaatgggacagccctagctgatgcccaacataagattaaattgttagagaaagaaaatcgttatcttcaggaggaacttgaacttctaaaaaagttccgggtcttcttgaagcgaagcaagtaa

SEQ ID NO: 44476 - protein, 96 aa, Lactococcus lactis subsp. lactis Il1403
MARRKFDKQFKNSAVKLILEEGYSVKEVSQELEVHANSLYRWVQEVEEYGESAFPGNGTALADAQHKIKLLEKENRYLQEELELLKKFRVFLKRSK

SEQ ID NO: 44477 - DNA, 345 bp, Deinococcus radiodurans R1
  CDS (1)..(345)
atgacgaccagaaagatttacaccgcagaattcaaacgtcaggccattgacctggcagcacgtgaggatgttggccccatccgggccgcccgcgaccttggtatcagcacttcagtgctctaccgttggcgactccaagctcaagaagcaggacaagcagcctttcccggtcagggtcgttcgaccctgacgccacaagaacaggaaatccaacgactccgcaaagagaacgaaattttgcgacaggaacgtgaaatcctgaaaaaagcagcggccttcttgcccagagcaggccccaaagcggtttggagccttgggcgcttctttgccaaagaaaatctctga

SEQ ID NO: 44478 - protein, 114 aa, Deinococcus radiodurans R1
MTTRKIYTAEFKRQAIDLAAREDVGPIRAARDLGISTSVLYRWRLQAQEAGQAAFPGQGRSTLTPQEQEIQRLRKENEILRQEREILKKAAAFLPRAGPKAVWSLGRFFAKENL

SEQ ID NO: 44479 - DNA, 342 bp, Escherichia coli O157:H7
  CDS (1)..(342)
atgagcagaaaaacccaacgttactctaaagagttcaaagccgaagctgtcagaacggttcttgaaaatcaactttcgatcagtgaaggcgcttcccgattatctcttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcagctgtagattcaatctgtcaatgcaacacccctttcaattatctctttcactgcccgcgacggtatcggttatcagtttga

SEQ ID NO: 44480 - protein, 113 aa, Escherichia coli O157:H7
MSRKTQRYSKEFKAEAVRTVLENQLSISEGASRLSLPEGTLGQWVTAARKGLGTPGSRTVAELESEILQLRKALNEARLERDILKKAAVDSICQCNTPFNYLFHCPRRYRLSV

SEQ ID NO: 44481 - DNA, 345 bp, Escherichia coli O157:H7
  CDS (1)..(345)
atgaacaagaaaaccaaacgtactttcacccctgaattcaggctggaatgtgcacagctaattgttgataagggctactcatatcgacaagccagtgaagcgatgaatgtcggttctaccacgcttgagagttgggtgcgccagctcaggcgagagcgtcaggggattgcgccctctgccacacctattactccagaccagcaacgtatccgcgaactggaaaagcaggttcgccgcctggaggaacacaatacgatattaaaaaaggcttctcaccgatggtcatcgcaacacgacgccagccaatcatggtgccaatgccgagcgccagtgctactgccatga

SEQ ID NO: 44482 - protein, 114 aa, Escherichia coli O157:H7
MNKKTKRTFTPEFRLECAQLIVDKGYSYRQASEAMNVGSTTLESWVRQLRRERQGIAPSATPITPDQQRIRELEKQVRRLEEHNTILKKASHRWSSQHDASQSWCQCRAPVLLP

SEQ ID NO: 44483 - DNA, 351 bp, Escherichia coli O157:H7
  CDS (1)..(351)
gtgatatcctcaccacaacacaaaacaggtgacttaatgaacaagaaaaccaaacgtactttcacccctgaattcaggctggaatgtgcacagctaattgttgataagggctactcatatcgacaagccagtgaagcgatgaatgtcggttctaccacgcttgagagttgggtgcgccagctcaggcgagagcgtcaggggattgcgccctctgccacacctattactccagaccagcaacgtatccgcgaactggaaaagcaggttcgccgcctggaggaacacaatacgatattaaaaaaggctacaaccgcgctcttgatgtccgactcgctgaacggttcacgatag

SEQ ID NO: 44484 - protein, 116 aa, Escherichia coli O157:H7
MISSPQHKTGDLMNKKTKRTFTPEFRLECAQLIVDKGYSYRQASEAMNVGSTTLESWVRQLRRERQGIAPSATPITPDQQRIRELEKQVRRLEEHNTILKKATTALLMSDSLNGSR

SEQ ID NO: 44485 - DNA, 309 bp, Ralstonia solanacearum GMI1000
  CDS (1)..(309)
atggtcaagcaacgacgttcgttttcccccgagttcaagcagcaggctgcctgcctggttctcgaccagtgctacagccatatcgaagcgagtcgctcggtcggcgtcgccgagtcggtgctgcgtcgctgggtgcagcagcttcagatggaacgccagggcatcacgccgcgaggcttggccatgacgccggatcagcagcatatccaggagcttgaagcgcgcattgagcgcctcgagcgcgagaaggccattttaaaaaaggctaccgcgctcttgatgtcggaaggcatcgaacgtacgaggtaa

SEQ ID NO: 44486 - protein, 102 aa, Ralstonia solanacearum GMI1000
MVKQRRSFSPEFKQQAACLVLDQCYSHIEASRSVGVAESVLRRWVQQLQMERQGITPRGLAMTPDQQHIQELEARIERLEREKAILKKATALLMSEGIERTR

SEQ ID NO: 44487 - DNA, 294 bp, Ralstonia solanacearum GMI1000
  CDS (1)..(294)
atgttcaaggtaccgaaacagtcatacacggcggagttcaaggcggcagccgtacaacgagtcaaagacgggcaaggcgtgggtgcggtggcccgcgagttgagcgtctcggagcagacgctgcgcaactggatgaaggccgagcaggctggcaagctgggcggcgccggcgcgaaggtcgtcacgccggagcagatggagctctcgcgcctgcgcgccgagaacaagcggctgcaaatggaactcgaaatcgcaaaaaaggcggcggcgtacttcgcgaaagacctgctgtga

SEQ ID NO: 44488 - protein, 97 aa, Ralstonia solanacearum GMI1000
MFKVPKQSYTAEFKAAAVQRVKDGQGVGAVARELSVSEQTLRNWMKAEQAGKLGGAGAKVVTPEQMELSRLRAENKRLQMELEIAKKAAAYFAKDLL

SEQ ID NO: 44489 - DNA, 291 bp, Agrobacterium tumefaciens str. C58
  CDS (1)..(291)
atgcaaagacgaatattcagccgcgagtacaagcttgaggcggtgaagctggtcagggaacgcggggtcactgttgcgcaggctgcccgtgaccttgatgtccacgagaatgtgttgcgcaaatgggttcgggaatacggcgacgatccaagccagtcctttcctggaaaagggcagatgaagcccgagcagcttgagatcgagcggctccgtcgtgaagtcacaaagctgaaggcggagcgcgatatcctaaaaaaggccgcagcctactttgccaaggacgcgatatga

SEQ ID NO: 44490 - protein, 96 aa, Agrobacterium tumefaciens str. C58
MQRRIFSREYKLEAVKLVRERGVTVAQAARDLDVHENVLRKWVREYGDDPSQSFPGKGQMKPEQLEIERLRREVTKLKAERDILKKAAAYFAKDAI

SEQ ID NO: 44491 - DNA, 294 bp, Xanthomonas campestris pv. campestris str. ATCC 33913
  CDS (1)..(294)
atggtcgattcggaggtgtctatgagcagcaagcgatatacggatgagttcaagatcgaggcggtccggcaagtgactgatcgtgggttcaaggtggcagaagtcgccgagcggctgggtgtcacgacgcacagcctgtacgcctggctgcgcacgttcggcaagtctggcgtggtgcatcgcgccgaggtggaccagagcgccgaggttcggcggctgaaggcagagttgcgtcgagtgaccgaggagcgcgacatcctaaaaaaggccgccgcgtactttgccaaggggtaa

SEQ ID NO: 44492 - protein, 97 aa, Xanthomonas campestris pv. campestris str. ATCC 33913
MVDSEVSMSSKRYTDEFKIEAVRQVTDRGFKVAEVAERLGVTTHSLYAWLRTFGKSGVVHRAEVDQSAEVRRLKAELRRVTEERDILKKAAAYFAKG

SEQ ID NO: 44493 - DNA, 294 bp, Xanthomonas campestris pv. campestris str. ATCC 33913
  CDS (1)..(294)
atggtcgattcggaggtgcctatgagcagcaagcgatatacggatgagttcaagatcgaggcggtccggcaagtgactgatcgtgggttcaaggtggcagaagtcgccgagcggctgggtgtcacgacgcacagcctgtacgcctggctgcgcacgttcggcaagtctggcgtggtgcatcgcgccgaggtggaccagagcgccgaggttcggcggctgaaggcagagttgcgtcgagtgaccgaggagcgcgacatcctaaaaaaggccgccgcgtactttgccaaggggtaa

SEQ ID NO: 44494 - protein, 97 aa, Xanthomonas campestris pv. campestris str. ATCC 33913
MVDSEVPMSSKRYTDEFKIEAVRQVTDRGFKVAEVAERLGVTTHSLYAWLRTFGKSGVVHRAEVDQSAEVRRLKAELRRVTEERDILKKAAAYFAKG

SEQ ID NO: 44495 - DNA, 288 bp, Proteus vulgaris
  CDS (1)..(288)
atgaaacgaaaatcaccaaagcaatatactgaagactttaagaaagaagcgattaatttagtcgctgaacaaggctacaccgtttcgcaagcggctaacgctctcggaataacaactaaacttctctatgcttggcgaaaacatcgtgaagctgaaaataaacccaatgcattaaccttccttgaacgacaggaattactcactttacgtaaagaagttaagcaattgaaaatggagaaagaaatcctaaaaaaggcgagtgccttctttgcgaaagagttgctataa

SEQ ID NO: 44496 - protein, 95 aa, Proteus vulgaris
MKRKSPKQYTEDFKKEAINLVAEQGYTVSQAANALGITTKLLYAWRKHREAENKPNALTFLERQELLTLRKEVKQLKMEKEILKKASAFFAKELL

SEQ ID NO: 44497 - DNA, 312 bp, Proteus vulgaris
  CDS (1)..(312)
atggtaaaacgtataagacggcttttcagcgcagaattcaaacttgaagcggctcaactggtgcttgaccaaaactattccgtggtcgaggccgccaacgcgatgggcgtcggtaaatcaaccatggacaaatgggttcggcaactcaagctagaacgcaagggcatttcaccgaaagcgtcacccatgacgcctgagcaggttgaaatccgtgaattaaaaaagaaaatcgcgcaacttgaagagcataatgagatcttaaaaaaggctacagcgctggtgatgtcggactctctgaacaattctcgctga

SEQ ID NO: 44498 - protein, 103 aa, Proteus vulgaris
MVKRIRRLFSAEFKLEAAQLVLDQNYSVVEAANAMGVGKSTMDKWVRQLKLERKGISPKASPMTPEQVEIRELKKKIAQLEEHNEILKKATALVMSDSLNNSR

SEQ ID NO: 44499 - DNA, 273 bp, Xanthomonas axonopodis pv. citri str. 306
  CDS (1)..(273)
atgagcagtaagcggtatacggatgagttcaagatcgaggcggtccggcaagtgaccgatcgtgggttcaaggtggcagaggtcgccgagcgactgggtgtcaccacgcacagcctgtacgcttggctgcgcaagttcggcaagcccggcgtagtacagcgcgctgaggcggaccagagcgccgaagtccggcggctgaagatcgagttgcgccgggtgacggaggagcgcgacatcctaaaaaaggccgccgcgtactttgccaaggggtaa

SEQ ID NO: 44500 - protein, 90 aa, Xanthomonas axonopodis pv. citri str. 306
MSSKRYTDEFKIEAVRQVTDRGFKVAEVAERLGVTTHSLYAWLRKFGKPGVVQRAEADQSAEVRRLKIELRRVTEERDILKKAAAYFAKG

SEQ ID NO: 44501 - DNA, 282 bp, Brucella suis 1330
  CDS (1)..(282)
ttgaagcagcgtgaatttacagaagatttcaagcgcgaagctgttcggattttaaccacgagtggtcgaaacatttcatcagttgctgaggaccttgggattggtaagtcaacgcttgagcgttggcggcgcaattttgctgagaaagatttactttctggtccacatgaggacatggaccaggagcttgcccggcttcgtaaagaaaacgaacttctgcgacaggaacgtgacctactaaaaaaagcgacggccttcttcgctcgggagacaagtcgatga

SEQ ID NO: 44502 - protein, 93 aa, Brucella suis 1330
MKQREFTEDFKREAVRILTTSGRNISSVAEDLGIGKSTLERWRRNFAEKDLLSGPHEDMDQELARLRKENELLRQERDLLKKATAFFARETSR

SEQ ID NO: 44503 - DNA, 294 bp, Corynebacterium efficiens
  CDS (1)..(294)
atgccaagcaagacctacacagaggagttcaagcgcgacgccgtcgccttgtatgagaactccccgggggcttcgattcagaccatcgccactgaccttgggatcaatcgcgccacgttagcgaactgggtaaaaaaatacggcaccgcaactcccagcgaaacgccttcaccagcctcggtgactgaggctgagcggatccgccagctggaacgggaagttagccgactgagagaagagcgcgatatcctgcggaaggccgctaaatatttcgcggaagagacgaactggtga

SEQ ID NO: 44504 - protein, 97 aa, Corynebacterium efficiens
MPSKTYTEEFKRDAVALYENSPGASIQTIATDLGINRATLANWVKKYGTATPSETPSPASVTEAERIRQLEREVSRLREERDILRKAAKYFAEETNW

SEQ ID NO: 44505 - DNA, 303 bp, Shigella flexneri 2a str. 301
  CDS (1)..(303)
atgagcagaaaaacccaacgttactctaaagagttcaaagccgaagctgtcagaacggttcttgaaaatcaactttcgatcagtgaaggcgcttcccgattatctcttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcaacagtgtattttgcacaggagtcgctgaaaaatacgcgttaa

SEQ ID NO: 44506 - protein, 100 aa, Shigella flexneri 2a str. 301
MSRKTQRYSKEFKAEAVRTVLENQLSISEGASRLSLPEGTLGQWVTAARKGLGTPGSRTVAELESEILQLRKALNEARLERDILKKATVYFAQESLKNTR

SEQ ID NO: 44507 - DNA, 363 bp, Shigella flexneri 2a str. 301
  CDS (1)..(363)
atgcttccatcggaaacgatgatctggcagcctgagttcacagataaaacactctccaggaaacccggggcggttcaacgttactctaaagagttcaaagccgaagctgtcagaacggttcttgaaaatcaactttcgatcagtgaaggcgcttcccgattatctcttcctgaaggcactttaggacaatgggttaccgccgccagaaaagggctcggtactcctggttcccgcacgctggctgaactggaatctgaaattctgcaactgcgtaaggcgttaaatgaagctcgccttgagcgagatatattaaaaaaagcaacagcgtattttgcacaggagtcgctgaaaaatacgcgttaa

SEQ ID NO: 44508 - protein, 120 aa, Shigella flexneri 2a str. 301
MLPSETMIWQPEFTDKTLSRKPGAVQRYSKEFKAEAVRTVLENQLSISEGASRLSLPEGTLGQWVTAARKGLGTPGSRTLAELESEILQLRKALNEARLERDILKKATAYFAQESLKNTR

SEQ ID NO: 44509 - DNA, 285 bp, Shigella flexneri 2a str. 301
  CDS (1)..(285)
gtgcccatgagcggtaagcgttatcccgaagagtttaaaactgaagcagtcaaacaggttgttgatcgcggttattctgttgccagcgttgcaacacgtctcgatatcaccacccacagcctttatgcctggataaagaagtacggtccggattcttccactaataaagaacagtcagatgctcaggccgagatccgccgtctccagaaagagctgaaacgggttaccgacgaacgggacatattaaaaaaagccgcggcgtacttcgcaaagctgtccgactga

SEQ ID NO: 44510 - protein, 94 aa, Shigella flexneri 2a str. 301
MPMSGKRYPEEFKTEAVKQVVDRGYSVASVATRLDITTHSLYAWIKKYGPDSSTNKEQSDAQAEIRRLQKELKRVTDERDILKKAAAYFAKLSD

SEQ ID NO: 44511 - DNA, 306 bp, Leptospira interrogans serovar Lai str. 56601
  CDS (1)..(306)
gtgagaatgaaaggaagaagaaaatattcgctggagtttcgggaacaagcagtaaaccggacgttaagcggatcgtttacaataaaagaagtagcagagtccttaggagttagctactttgtattgagacaatggaaggccgagcatttgaaaaagaaggaaacagagcaaccacttccggataaacagctaaaggaaagcgaagaattgaaaagacttcgtaaagagaatctgagattaaaggatgagaacgcgatcttaaaaaagtttgcggccatgctttcccgcgaacagaatcccgattga

SEQ ID NO: 44512 - protein, 101 aa, Leptospira interrogans serovar Lai str. 56601
MRMKGRRKYSLEFREQAVNRTLSGSFTIKEVAESLGVSYFVLRQWKAEHLKKKETEQPLPDKQLKESEELKRLRKENLRLKDENAILKKFAAMLSREQNPD

SEQ ID NO: 44513 - DNA, 291 bp, Shewanella oneidensis MR-1
  CDS (1)..(291)
atgagtctgaaaaaatcacataagagttatccgcaggcatttaaagatgaagccgtcttgatggtgctggagcaaggttatagcgttgccgatgcggcaaagtctcttggagttagcacgagcctgctttacaactggaaggaaaaacacgaagccctgcaacaaggcatcaccttagaagagtctgagcgtgatgagttgaagcgattgcgtagagaaaacaaagaattacgcatggaaaaagaaattctaaaaaaggcaagcgccttctttgcgagagaaatgaagtaa

SEQ ID NO: 44514 - protein, 96 aa, Shewanella oneidensis MR-1
MSLKKSHKSYPQAFKDEAVLMVLEQGYSVADAAKSLGVSTSLLYNWKEKHEALQQGITLEESERDELKRLRRENKELRMEKEILKKASAFFAREMK

SEQ ID NO: 44515 - DNA, 297 bp, Vibrio vulnificus CMCP6
  CDS (1)..(297)
atgacaggtgaagctatgaccaagcgtaccagacgcactttcagtgcagaatttaaactcgaagcagcacagcttgtgctcgaccaaaactacaccgttgttgaagctgcaaaagccatgggtgtcggtaaatcgacaatggacaagtgggtaaggcagcttaagcaagaaagaaagggagtcactccccaagccgcacctatgacaccagagcaaattgagatacgtgagctgaagaagaaacttgcacgccttgaagagcacaatgaaatattaaaaaagctacagctctcttga

SEQ ID NO: 44516 - protein, 98 aa, Vibrio vulnificus CMCP6
MTGEAMTKRTRRTFSAEFKLEAAQLVLDQNYTVVEAAKAMGVGKSTMDKWVRQLKQERKGVTPQAAPMTPEQIEIRELKKKLARLEEHNEILKKLQLS

SEQ ID NO: 44517 - DNA, 300 bp, Bradyrhizobium japonicum USDA 110
  CDS (1)..(300)
atggaacgtcaacgtcggtcatttaccgaggagtacaagcgccaggccgtcgagttggtggtgtccagccgtcgcacggtcacgtcggtggccaaggagctcggtctgcgcgactcggtgctgcggcgctgggtcgacaagctccggcaggagccggcatcggcgaggtggcgccccaccacgcaggtgacgccgatgtcggcggaccaggcttcggagatcgcccggctgcgccaggagaccgaacgagcgcgacattttaaaaaactgtccagagccgttgcacgctgcgcgggttag

SEQ ID NO: 44518 - protein, 99 aa, Bradyrhizobium japonicum USDA 110
MERQRRSFTEEYKRQAVELVVSSRRTVTSVAKELGLRDSVLRRWVDKLRQEPASARWRPTTQVTPMSADQASEIARLRQETERARHFKKLSRAVARCAG

SEQ ID NO: 44519 - DNA, 303 bp, Shigella flexneri 2a str. 2457T
  CDS (1)..(303)
atgaaaaaaagaaattttagcgcagagtttaaacgcgaatccgctcaactggttgttgaccagaaatacacggtggcagatgccgccaaagctatggatgttggcctttccacaatgacaagatggggcaaacaactgcgtgatgagcgtcagggcaaaacaccaaaagcctcccccattaccccggaacaaattgaaatccgtgagctcaggaaaaagctacaacgcattgaaatggagaatgaaatattaaaaaaggctaccgcgctcttgatgtcagactccctgaacagttctcgataa

SEQ ID NO: 44520 - protein, 100 aa, Shigella flexneri 2a str. 2457T
MKKRNFSAEFKRESAQLVVDQKYTVADAAKAMDVGLSTMTRWGKQLRDERQGKTPKASPITPEQIEIRELRKKLQRIEMENEILKKATALLMSDSLNSSR

SEQ ID NO: 44521 - DNA, 303 bp, Nitrosomonas europaea ATCC 19718
  CDS (1)..(303)
atggaacgactcccgaaagggatctacacgccggaatttcgggcggaagcggtgaagctggtggaagcggaagggctgtcggtggatgcggcagcgaagcgcttgttggtgccaaagagcagtcttggcaattgggtgagggcatcgcgtacaggcagcctggcgaaggttgggcaaggtcagcgggtgccgacggaaacggaaattgaactggcgcgactgcgcaaggaattggcggaagtgaaactggagcgtgatctgctaaaaaaatgtgcggcgtatttcgcgaaggagtcgcggtga

SEQ ID NO: 44522 - protein, 100 aa, Nitrosomonas europaea ATCC 19718
MERLPKGIYTPEFRAEAVKLVEAEGLSVDAAAKRLLVPKSSLGNWVRASRTGSLAKVGQGQRVPTETEIELARLRKELAEVKLERDLLKKCAAYFAKESR

SEQ ID NO: 44523 - DNA, 285 bp, Escherichia coli
  CDS (1)..(285)
atgggcacatcacgttttacccctgaatttaaggaagaggccgtccgccagatcaccgagcggggctattctattgctgaagtatctgaacggctcggcgtgtcggcgcacagcctatataaatggctccgggctgttaagcctgacaacagtggacagcaggcacaggatttactggatgccagaacagaaattctcaggctgaaagcacagcttaaacgcactgaggaagagcgggatattctgaaaaaggcagcgcggtactttgcaagggagcccgactga

SEQ ID NO: 44524 - protein, 94 aa, Escherichia coli
MGTSRFTPEFKEEAVRQITERGYSIAEVSERLGVSAHSLYKWLRAVKPDNSGQQAQDLLDARTEILRLKAQLKRTEEERDILKKAARYFAREPD

SEQ ID NO: 44525 - DNA, 276 bp, Salmonella typhimurium
  CDS (1)..(276)
atgtcattaaagcatagtgatgaatttaagcgtgatgcagttcgcatagcactcactagtggcttaacacgccgtcaagttgcgtcagatttaagtattgggctttccacgcttgggaaatggatcgcatcaatttccgatgaaactaaaattcctacccaagacactgatcttctgcgtgagaatgaacgtttacgcaaagagaaccgtatccttcgggaggagagggagatattaaaaaaggcagcaatatttttcgcagtacaaaagctgtga

SEQ ID NO: 44526 - protein, 91 aa, Salmonella typhimurium
MSLKHSDEFKRDAVRIALTSGLTRRQVASDLSIGLSTLGKWIASISDETKIPTQDTDLLRENERLRKENRILREEREILKKAAIFFAVQKL

SEQ ID NO: 44527 - DNA, 291 bp, Rhodopirellula baltica SH 1
  CDS (1)..(291)
atggacaaacgtcgaacatttagccgcgaatacaagctggccgcagtcaagaaagtcatcgaacaaggcttgtcgtacaccgctgtcgctaaagacttggggatcggggacagcttgattcgcaagtggaagaagtcttttgacgaagacggaacattccaggccgaagtagttggtagccaatccattgaagccgagctgagacgacttcgcgaagagaatcgtcaactcaagatggaacgcgacattttaaaaaaagcgacggcattcttcgccaaagaaagtcactga

SEQ ID NO: 44528 - protein, 96 aa, Rhodopirellula baltica SH 1
MDKRRTFSREYKLAAVKKVIEQGLSYTAVAKDLGIGDSLIRKWKKSFDEDGTFQAEVVGSQSIEAELRRLREENRQLKMERDILKKATAFFAKESH

SEQ ID NO: 44529 - DNA, 303 bp, Photorhabdus luminescens subsp. laumondii TTO1
  CDS (1)..(303)
atgatgaaaagaagttttagccctgaattcaaactggaatccgcccagttagtccttgatcaaaattacagtgttatggaagccgctaaagcgatgaatgtcagcaaatcagccttagggagctgggttcgtcagttgagacaggagcggcaaggtaaatcttctaaagccatgcccatcacgccggagcaaattgaaatacgtgagctgaaaaagaaactgcaacgtattgaaatggaaaatgaagtattaaaaaaagcttctgcactcttgatgtcggactacttgaacagttctcgttaa

SEQ ID NO: 44530 - protein, 100 aa, Photorhabdus luminescens subsp. laumondii TTO1
MMKRSFSPEFKLESAQLVLDQNYSVMEAAKAMNVSKSALGSWVRQLRQERQGKSSKAMPITPEQIEIRELKKKLQRIEMENEVLKKASALLMSDYLNSSR

SEQ ID NO: 44531 - DNA, 309 bp, Corynebacterium diphtheriae NCTC 13129
  CDS (1)..(309)
gtgaatcaaccgcgtaagaagttcacgccggagtatcggcgtgaagcggcgaatttggtgatcgaatcggatcgccctatcgcgtatgtggccaaggaaatcggtgtttccgcgggcttgctaggcaagtgggtgaaaaacgagcggcaacgccgagggtcatccgacaggatgagcgaggctgatcttcgcgcagaaattcttcgcctgcgccgcaaactggctgaagccaagatcgacaacgagtttttgtcaaaagctgctgctttcttcgctgcgaagcaacacaaacggaaaagttcgagctga

SEQ ID NO: 44532 - protein, 102 aa, Corynebacterium diphtheriae NCTC 13129
MNQPRKKFTPEYRREAANLVIESDRPIAYVAKEIGVSAGLLGKWVKNERQRRGSSDRMSEADLRAEILRLRRKLAEAKIDNEFLSKAAAFFAAKQHKRKSSS

SEQ ID NO: 44533 - DNA, 297 bp, Cupriavidus necator
  CDS (1)..(297)
atgacaagcaagacaaagcgggcgcagtacacgctggaattcaagctggaagcggtacggctggtgaagagcgggcaaagcatggcggtggttagcgcgaccctgggtataagagcgcagacgctgcataactgggtcaaggcggagcgggaaggcaagctgactggggcggggatgaagccggttagtcccgagcagatggagctggcccggcttcgggcggaagtggcgcgcttgaagatggagcgcgatattttaaaaaaagccgcggcatactttgcgaaggagtcggtgtga

SEQ ID NO: 44534 - protein, 98 aa, Cupriavidus necator
MTSKTKRAQYTLEFKLEAVRLVKSGQSMAVVSATLGIRAQTLHNWVKAEREGKLTGAGMKPVSPEQMELARLRAEVARLKMERDILKKAAAYFAKESV

SEQ ID NO: 44535 - DNA, 333 bp, Pseudomonas sp. ND6
  CDS (1)..(333)
atgctcgccacagagaggtgtccgatgaccaagcaacgccgtacctttacccctgagttcaagcgcgaagctgcctgcctggtgctcgatcaaggctacagccatgccgaagcggcccgttcgctcggcttggtcgagtcggcactgcgccgatgggttaatcagcttcagcaggagcgcggcggcgttacgccggccagcaaagcgttgacgccagagcagcaaaaaatccaagagttggaagcccggatcacgcgccttgaacgcgagaaatcgatactaaaaaaggctaccgcgctcttgatgtcggaagatctcgagcgtacgcgctga

SEQ ID NO: 44536 - protein, 110 aa, Pseudomonas sp. ND6
MLATERCPMTKQRRTFTPEFKREAACLVLDQGYSHAEAARSLGLVESALRRWVNQLQQERGGVTPASKALTPEQQKIQELEARITRLEREKSILKKATALLMSEDLERTR

SEQ ID NO: 44537 - DNA, 303 bp, Enterobacteria phage Sf6
  CDS (1)..(303)
atgaaaaaaagaaattttagcgcagagtttaaacgcgaatccgctcaactggttgttgaccagaaatacacggtggcagatgccgccaaagctatggatgttggcctttccacaatgacaagatgggtcaaacaactgcgtgatgagcgtcagggcaaaacaccaaaagcctcccccattaccccggaacaaattgaaatccgtgagctcaggaaaaagctacaacgcattgaaatggagaatgaaatattaaaaaaggctaccgcgctcttgatgtcagactccctgaacagttctcgataa

SEQ ID NO: 44538 - protein, 100 aa, Enterobacteria phage Sf6
MKKRNFSAEFKRESAQLVVDQKYTVADAAKAMDVGLSTMTRWVKQLRDERQGKTPKASPITPEQIEIRELRKKLQRIEMENEILKKATALLMSDSLNSSR

SEQ ID NO: 44539 - DNA, 306 bp, Leptospira interrogans serovar Copenhageni str. Fiocruz L1-130
  CDS (1)..(306)
gtgagaatgaaaggaagaagaaaatattcgccggagtttcgggaacaagcggtaaaccggacgttaaacggatcgtttacaataaaagaagtagcagagtccttaggagttagctactttgtattgagacaatggaaggccgagcatttgaaaaagaaggaaacagagcaaccacttccggataaacagctaaaggaaagcgaagagttgaaaagacttcgtaaagagaatctgagattaaaggatgagaacgcgatcttaaaaaagtttgcggccatgctttcccgcgaacagaatcccgattga

SEQ ID NO: 44540 - protein, 101 aa, Leptospira interrogans serovar Copenhageni str. Fiocruz L1-130
MRMKGRRKYSPEFREQAVNRTLNGSFTIKEVAESLGVSYFVLRQWKAEHLKKKETEQPLPDKQLKESEELKRLRKENLRLKDENAILKKFAAMLSREQNPD

SEQ ID NO: 44541 - DNA, 390 bp, Mycobacterium ulcerans
  CDS (1)..(390)
atggctgcacagccacgacagtcttggtcatcatgcgacctttccggccccgacacaccggggccgatcaggccgcttacacccttaccgcgacagtccctgccagagatacggagaaggttcgatccggagttccgggaaggggcggtacggatcgttcgggagaccggtaagccgatcgcccaggttgctcgagagttgggtgtcaacgcgggcacgctgggtaactgggttgctaaagaccgcgccgaaagggaaggtagccaggggctctcgactgatggcgtggcggagttgaagcggctgcgcagcgaggtagctgagcttcggatggagcgtgatgtcctcaagcgatccgtggtcctgtgggtgaaggaggcgacgagatga

SEQ ID NO: 44542 - protein, 129 aa, Mycobacterium ulcerans
MAAQPRQSWSSCDLSGPDTPGPIRPLTPLPRQSLPEIRRRFDPEFREGAVRIVRETGKPIAQVARELGVNAGTLGNWVAKDRAEREGSQGLSTDGVAELKRLRSEVAELRMERDVLKRSVVLWVKEATR

SEQ ID NO: 44543 - DNA, 309 bp, Pseudomonas syringae pv. maculicola
  CDS (1)..(309)
atgaccaaacaacgccgtaccttttccgctgaattcaaacgcgaggccgcaggcctcgtgctcgatcaaggctatagccacattgaagcctctcgctcgctgggagttgtcgagtctgcaatgcgtcgctgggtcaaccagcttcaacaggagcgcaacggtgttactccacagagcaaagccctgacgcccgagcagcagaaaattcaggagctagaagctcggattgcccgtcttgagcgggagaaatccattttaaaaaaggctaccgcgctcttgatgtcggaagagcacgagcgcatgcgctga

SEQ ID NO: 44544 - protein, 102 aa, Pseudomonas syringae pv. maculicola
MTKQRRTFSAEFKREAAGLVLDQGYSHIEASRSLGVVESAMRRWVNQLQQERNGVTPQSKALTPEQQKIQELEARIARLEREKSILKKATALLMSEEHERMR

SEQ ID NO: 44545 - DNA, 309 bp, Acinetobacter sp. ADP1
  CDS (1)..(309)
ttggagatccaagaaatggccaaacgttttagtcctgaatttaaacagcaagcaattgattatgcactttcaaactcacacgagcctatagctacaatcgcccagaaattaggtgtgggttattcaactttagacaaatggattcgtgaagccaatccagtgggttcaagcaaacgtcaactttcaccagaacaacagcggatcttggaattagagaaagaagtcaaacagctcagggaagccaatgacatcttaaaaaaagcgcatgtgtactttctgacagatcatgccaagaaaagtacacggtaa

SEQ ID NO: 44546 - protein, 102 aa, Acinetobacter sp. ADP1
MEIQEMAKRFSPEFKQQAIDYALSNSHEPIATIAQKLGVGYSTLDKWIREANPVGSSKRQLSPEQQRILELEKEVKQLREANDILKKAHVYFLTDHAKKSTR

SEQ ID NO: 44547 - DNA, 303 bp, Desulfotalea psychrophila LSv54
  CDS (1)..(303)
atggttatacaaaagcgtagaaaatatgatgcagattttaaacgtagtactgttcttttaagtctagaacctggtagaactattagagaaattgcagataatctaggcattcatgtggatttgatctatcaatggagaaaaaaatatgaagagcagggagagatagcgttccctggtaacggtattccagcccttactgctgagcagaaaaagatcaaagcgcttgagaaagaattgaagaatatcactatggagagggacattctaaaaaaagccatggccattttcagcagaacacagtga

SEQ ID NO: 44548 - protein, 100 aa, Desulfotalea psychrophila LSv54
MVIQKRRKYDADFKRSTVLLSLEPGRTIREIADNLGIHVDLIYQWRKKYEEQGEIAFPGNGIPALTAEQKKIKALEKELKNITMERDILKKAMAIFSRTQ

SEQ ID NO: 44549 - DNA, 318 bp, Yersinia pseudotuberculosis IP 32953
  CDS (1)..(318)
atgactcaacctaaacagaccaaacgccgtttttctcctgaattcaaactggaagctattgagcaggtcgttaagtatcagcggtcaaccatcgaggttgcacgcgctctggagctggatcccagccaattgcgtaaatggatacgccagtacaaagaagaagtcagcggggtgacgccggacaatcctgcactgacaccagagcaacgtgaaatccagtcgctcagggcgcagattaaacggctggaaatggaaaaagaaatactaaagcaggcagccgtgttgatgagcgagttccccatcaaatctttgcgttaa

SEQ ID NO: 44550 - protein, 105 aa, Yersinia pseudotuberculosis IP 32953
MTQPKQTKRRFSPEFKLEAIEQVVKYQRSTIEVARALELDPSQLRKWIRQYKEEVSGVTPDNPALTPEQREIQSLRAQIKRLEMEKEILKQAAVLMSEFPIKSLR

SEQ ID NO: 44551 - DNA, 315 bp, Mannheimia succiniciproducens MBEL55E
  CDS (1)..(315)
atgagaagaacatttagcgcagaatataaagctgaagcagtaaaattagtgattgaacgaggatattcggtttctcaagcttgccgagagttaggtgtgggtgaaacagcacttcgtcgctggataagtcaagttcaagcggagcaacaaggttacgttttagctggttcaaagccaattagcccagaacaacaacgaattcgagaacttgaaaatcgtattaaagaacttgaagaagataaggccattttaaaaaaggctacagcgattttaatgtcactcgaaaacaaaaataccaagtcattacgacgttaa

SEQ ID NO: 44552 - protein, 104 aa, Mannheimia succiniciproducens MBEL55E
MRRTFSAEYKAEAVKLVIERGYSVSQACRELGVGETALRRWISQVQAEQQGYVLAGSKPISPEQQRIRELENRIKELEEDKAILKKATAILMSLENKNTKSLRR

SEQ ID NO: 44553 - DNA, 315 bp, Mannheimia succiniciproducens MBEL55E
  CDS (1)..(315)
atgagaagaacatttagcgcagaatataaagctgaagcagtaaaattagtgattgaacgaggatattcggtttctcaagcttgccgagagttaggtgtgggtgaaacagcacttcgtcgctggataagtcaagttcaagcggagcaacaaggttacgttttagctggttcaaagccaattagcccagaacaacaacgaattcgagaacttgaaaatcgtattaaagaacttgaagaagataaggacattttaaaaaaggctacagcgattttaatgtcactcgaaaacaaaaataccaagtcattacgacgttaa

SEQ ID NO: 44554 - protein, 104 aa, Mannheimia succiniciproducens MBEL55E
MRRTFSAEYKAEAVKLVIERGYSVSQACRELGVGETALRRWISQVQAEQQGYVLAGSKPISPEQQRIRELENRIKELEEDKDILKKATAILMSLENKNTKSLRR

SEQ ID NO: 44555 - DNA, 294 bp, Legionella pneumophila subsp. pneumophila str. Philadelphia 1
  CDS (1)..(294)
atgtctataagaagaaaatatacaaaggaatttaaactggatgcgattagtttagtaactgagcaaggatacacatgtccagaagcagcaaggagcttgggaattaattcgaatattttgagtcgctggattcgagaggcagcggagaataatgaaaatgcttttcgtggaaatggaaaattgacggaagagcaacttgaaattcgtcagttacgagaagaagtcagaaggctgacaatggagaaagaaatactaaaaaaagcgacggtcttctttgcgaaagaagcgaaataa

SEQ ID NO: 44556 - protein, 97 aa, Legionella pneumophila subsp. pneumophila str. Philadelphia 1
MSIRRKYTKEFKLDAISLVTEQGYTCPEAARSLGINSNILSRWIREAAENNENAFRGNGKLTEEQLEIRQLREEVRRLTMEKEILKKATVFFAKEAK

SEQ ID NO: 44557 - DNA, 303 bp, Burkholderia pseudomallei K96243
  CDS (1)..(303)
atggtcaggcgtgcgttttccgaggaattcaaggaagaagcgatacgactcgtcgtagagcagggttaccccttttccaaggcgtgtggggcggttggaattggggagacagccctgcgtcgctgggtcgcgcagtggcgggcggcgcatagcttggatgtgcccagtcctgcacaactcagtgcagacgcgcgccggatcaaggagctagaggcccgcgtagccgaactcgaacgggagcgtgaagttttaaaaaaatccacggccttcttcgtcaaggagctcgaacgctcctggaagtga

SEQ ID NO: 44558 - protein, 100 aa, Burkholderia pseudomallei K96243
MVRRAFSEEFKEEAIRLVVEQGYPFSKACGAVGIGETALRRWVAQWRAAHSLDVPSPAQLSADARRIKELEARVAELEREREVLKKSTAFFVKELERSWK

SEQ ID NO: 44559 - DNA, 294 bp, Legionella pneumophila str. Lens
  CDS (1)..(294)
atgtctataagaagaaaatatacaaaggaatttaaactggatgcgattagtttagtaactgagcaaggatacacatgtccagaagcagcaaggagcttgggaattaattcgaatattttgagttgctggattcgagaggcagcggagaataatgaaaatgcttttcgtggaaatggaaaattaacggaagagcaacttgaaattcgtcagttacgagaagaagtcagaaggctgacaatggagaaagaaatactaaaaaaagccacggtcttctttgcgaaagaagcgaaataa

SEQ ID NO: 44560 - protein, 97 aa, Legionella pneumophila str. Lens
MSIRRKYTKEFKLDAISLVTEQGYTCPEAARSLGINSNILSCWIREAAENNENAFRGNGKLTEEQLEIRQLREEVRRLTMEKEILKKATVFFAKEAK

SEQ ID NO: 44561 - DNA, 279 bp, Idiomarina loihiensis L2TR
  CDS (1)..(279)
atgagtaacaaccgataccctgaagaatttaaaatcgaagctgtccggcaaattaccgataaaggttattctgttgctgacgtttcaagacggctcgatgtttccgttcatagtttatatgcctgggttaagaagtacggtccagaagcagaaaaacacgcagctcaaaccgaagagcaggctgaactaaaacgtttaagaaaagagttacagcgtgtcactgaagagcgtgacatattaaaaaaagccgcggcgtacttcgcgaagcagtccgactaa

SEQ ID NO: 44562 - protein, 92 aa, Idiomarina loihiensis L2TR
MSNNRYPEEFKIEAVRQITDKGYSVADVSRRLDVSVHSLYAWVKKYGPEAEKHAAQTEEQAELKRLRKELQRVTEERDILKKAAAYFAKQSD

SEQ ID NO: 44563 - DNA, 300 bp, Desulfitobacterium hafniense DCB-2
  CDS (1)..(300)
atgatgacaagcaagacaaagcgggcgcagtacacgctggaattcaagctggaagcggtacggctggtgaagagcgggcagagcatggcagtggttagcgcgaccctgggcatcagagcgcagacgctgcataactgggtcaaggcggagcgggaaggcaagctgactggtgcgggtatgaagccggtcagcccggagcagatggagctggcccggcttcgggcggaggtggcgcgcttgaagatggagcgcgatattttaaaaaaagccgcagcatactttgcgaaggagtcggtgtga

SEQ ID NO: 44564 - protein, 99 aa, Desulfitobacterium hafniense DCB-2
MMTSKTKRAQYTLEFKLEAVRLVKSGQSMAVVSATLGIRAQTLHNWVKAEREGKLTGAGMKPVSPEQMELARLRAEVARLKMERDILKKAAAYFAKESV

SEQ ID NO: 44565 - DNA, 300 bp, Pseudomonas syringae pv. syringae B728a
  CDS (1)..(300)
atgactaagcccaagacagatcgcgttaaatacacccttgagttcaaacttgaggccgtgcgactggtcgatacaggcctgacgcttgctgccgctgcccgctctctgggtatatccgaccagaccttgttcaactgggtcaaggcgcatcgccaaggcaggctgaccggcgctgacatcaagtctgtcactcccgagcagatggagataagccgtctacgagccgagctggcacgcgtcaagatggagcgcgacattctggaaaaggcgacggcgtacttcgcaaaagcatccagctga

SEQ ID NO: 44566 - protein, 99 aa, Pseudomonas syringae pv. syringae B728a
MTKPKTDRVKYTLEFKLEAVRLVDTGLTLAAAARSLGISDQTLFNWVKAHRQGRLTGADIKSVTPEQMEISRLRAELARVKMERDILEKATAYFAKASS

SEQ ID NO: 44567 - DNA, 300 bp, Psychrobacter sp. 273-4
  CDS (1)..(300)
atgactaagaaaatcagaacctacagtgcagctttcaaagctgaagccgtcaaaaagatagcagacaataacggcaatgtttcagcgactgcaaagcagctaggcatagccatgcagaccctatctaactggcagaacaaagcgaatgaaggcaagcttatcggcactaagcagtatgatcctgaactcatggccattatagaagagaataaacgtcttaaacatgatcttaaagttgctcaggaggagcgagacattctaaaaaaggccacggcgtacttcgcgaatgaggaacgttaa

SEQ ID NO: 44568 - protein, 99 aa, Psychrobacter sp. 273-4
MTKKIRTYSAAFKAEAVKKIADNNGNVSATAKQLGIAMQTLSNWQNKANEGKLIGTKQYDPELMAIIEENKRLKHDLKVAQEERDILKKATAYFANEER

SEQ ID NO: 44569 - DNA, 297 bp, Psychrobacter sp. 273-4
  CDS (1)..(297)
atgaccaagaaaatcagaacctatagtgcagaattcaaagcagaagccgtcaagaagatagcggacaacgatgggaatatttcagcgactgcaaagcagcttggtatcgccatgcagaccttatctaattggcacaataaagccaatcaaggcaaacttgagggaacagctcaatatgatcctgaactcatagcagtgatcgaagaaaacaaacgcctcaaacgacagcttaaagttgccgaggaggaacgagagatcctaaaaaaggcgacggcgtactttgcaaggcacagttag

SEQ ID NO: 44570 - protein, 98 aa, Psychrobacter sp. 273-4
MTKKIRTYSAEFKAEAVKKIADNDGNISATAKQLGIAMQTLSNWHNKANQGKLEGTAQYDPELIAVIEENKRLKRQLKVAEEEREILKKATAYFARHS

SEQ ID NO: 44571 - DNA, 312 bp, Psychrobacter sp. 273-4
  CDS (1)..(312)
atgagccaaaaacgcaaccaatatactcgagaattcaagctagaagccataagcttagtgattgatcacaaccgtagcataactgacgtggcaagctcacttggcattggcaaatccaccttgcagaaatggctgagtcaataccgtcaagaaatgagtggccaagcacctaaagtcggcaatgctttaacggatgaacagcgagagctccaagaactgcgtaaagagaataagcgcttgaggatggagcgcgacatcttaaaaaaggcttccgctctgctggcgttggacaatctaaacgactatcgctaa

SEQ ID NO: 44572 - protein, 103 aa, Psychrobacter sp. 273-4
MSQKRNQYTREFKLEAISLVIDHNRSITDVASSLGIGKSTLQKWLSQYRQEMSGQAPKVGNALTDEQRELQELRKENKRLRMERDILKKASALLALDNLNDYR

SEQ ID NO: 44573 - DNA, 303 bp, Burkholderia fungorum LB400
  CDS (1)..(303)
atgttcaaggtaccgcaccaggtgtacacggcagagttcaaggaagccgccgtgcaacgagtcaaggaggggcaaggcctgagcgccgtatcccgggaattgggtatgtcgacgcagactctgcgcaactggctgaaggcctcggaggccggcaagctcaacggtccgggggcgaaagtcgttacggcggagcaaatggagctctcgcggctgcgagcggagaacaagcgcttgcagatggagctggaaatcgcaaaaaaagcggcggtaggttcaatgagtcgctgcaacagcctcgcgtag

SEQ ID NO: 44574 - protein, 100 aa, Burkholderia fungorum LB400
MFKVPHQVYTAEFKEAAVQRVKEGQGLSAVSRELGMSTQTLRNWLKASEAGKLNGPGAKVVTAEQMELSRLRAENKRLQMELEIAKKAAVGSMSRCNSLA

SEQ ID NO: 44575 - DNA, 297 bp, Burkholderia fungorum LB400
  CDS (1)..(297)
atgacaagcaaggcaaagcgagcgcagtacacgctcgagttcaagctggaagcggtgcgactggtcaaagccgggcaaagcatggcggcggtggcggcgacactgagtgtggttgaacagacgctgtacaactgggtgaaggctgaccgggaaggcaagctgacgggagccggcacgaagcctgtgagtccggagcagatggagctggcgcggctgcgtgccgaagtggctcgcctgaagatggagcgagatattttaaaaaaagcaaccgcgtacttcgccaaggagtcgatgtga

SEQ ID NO: 44576 - protein, 98 aa, Burkholderia fungorum LB400
MTSKAKRAQYTLEFKLEAVRLVKAGQSMAAVAATLSVVEQTLYNWVKADREGKLTGAGTKPVSPEQMELARLRAEVARLKMERDILKKATAYFAKESM

SEQ ID NO: 44577 - DNA, 291 bp, Enterococcus faecium
  CDS (1)..(291)
atgtctaagagaacacgaagaactttttcacaagaattcaagcaacaaatcgtcaatctttacttagctggaaagccacgtgtagaaatcattcgagaatatgaactaacggcttcagcatttgacaaatgggtaaagcaatctaaaacgagtggttcattcaaagaaaaagataatcttacgcctgaacaaaaagaattgttagaactacgtaaaagaaaccagcaattagaaatggaaaatgatattttaaagcaagcagcgctgatattcggacgaagaaacaagtaa

SEQ ID NO: 44578 - protein, 96 aa, Enterococcus faecium
MSKRTRRTFSQEFKQQIVNLYLAGKPRVEIIREYELTASAFDKWVKQSKTSGSFKEKDNLTPEQKELLELRKRNQQLEMENDILKQAALIFGRRNK

SEQ ID NO: 44579 - DNA, 330 bp, Enterococcus faecium
  CDS (1)..(330)
atgtgtagactagaagaaaacataccaggaggaatttttatgtctaagagaacacgaagaactttttcacaagaattcaagcaacaaatcgtcaatctttacttagctggaaagccacgtgtagaaatcattcgagaatatgaactaacggcttcagcatttgacaaatgggtaaagcaatctaaaacgagtggttcattcaaagaaaaagataatcttacgcctgaacaaaaagaattgttagaactacgtaaaagaaaccagcaattagaaatggaaaatgatattttaaagcaagcagcgctgatattcggacgaagagacaagtaa

SEQ ID NO: 44580 - protein, 109 aa, Enterococcus faecium
MCRLEENIPGGIFMSKRTRRTFSQEFKQQIVNLYLAGKPRVEIIREYELTASAFDKWVKQSKTSGSFKEKDNLTPEQKELLELRKRNQQLEMENDILKQAALIFGRRDK

SEQ ID NO: 44581 - DNA, 291 bp, Enterococcus faecium
  CDS (1)..(291)
atgtcaagacgtcaacgaagaacctcttcaaaagaattcaaacaacaaatcgtcgatctctatctcgctggtaagcctcgcgcagaaattattcgagagtatgagcttacgccttcttctttcgataaatggatgaagcaagcacaatcaacgggctcattcaaagaaagagacaacttaacaccagaacaagcagaattgatcgcactaagaaagaaaaataagcaactcgaaatggagaatgatattttaaagcaagcggcgctgatattcggacgaaaagacaagtaa

SEQ ID NO: 44582 - protein, 96 aa, Enterococcus faecium
MSRRQRRTSSKEFKQQIVDLYLAGKPRAEIIREYELTPSSFDKWMKQAQSTGSFKERDNLTPEQAELIALRKKNKQLEMENDILKQAALIFGRKDK

SEQ ID NO: 44583 - DNA, 291 bp, Enterococcus faecium
  CDS (1)..(291)
atgtcaagacgtcaacgaagaacctattcaaaagaattcaaacaacaaatcgtcgatctctatctcgctggtaagcctcgcgcagaaattattcgagagtatgagcttacgccttcttctttcgataaatggatgaagcaagcacaatcaacgggctcattcaaagaaagagacaacttaacaccagaacaagcagaattgatcgcactaagaaagaaaaataagcaactcgaaatggagaatgatattttaaagcaagcggcgctgatattcggacgaaaagacaagtaa

SEQ ID NO: 44584 - protein, 96 aa, Enterococcus faecium
MSRRQRRTYSKEFKQQIVDLYLAGKPRAEIIREYELTPSSFDKWMKQAQSTGSFKERDNLTPEQAELIALRKKNKQLEMENDILKQAALIFGRKDK

SEQ ID NO: 44585 - DNA, 291 bp, Enterococcus faecium
  CDS (1)..(291)
atgtctaagagaacacgaagaactttttcacaagaattcaagcaacaaatcgtcaatctttacttagctggaaagccacgtgtagaaatcattcgagaatatgaactaacggcttcagcatttgacaaatgtgtaaagcaatctaaaacgagtggttcattcaaagaaaaagataatcttacgcctgaacaaaaagaattgttagaactacataaaagaaaccagcaattagaaatggaaaatgatattttaaagcaagcagcgctgatattcggacgaagagacaagtaa

SEQ ID NO: 44586 - protein, 96 aa, Enterococcus faecium
MSKRTRRTFSQEFKQQIVNLYLAGKPRVEIIREYELTASAFDKCVKQSKTSGSFKEKDNLTPEQKELLELHKRNQQLEMENDILKQAALIFGRRDK

SEQ ID NO: 44587 - DNA, 291 bp, Enterococcus faecium
  CDS (1)..(291)
atgccaagacgtcaacgaagaacctattcaaaagaattcaaacaacaaatcgtcgatctctatctcgctggtaagccttgcgcaggaattattcgagagtatgagcttacgccttcttctttcgataaatggatgaagcaagcacaatcaacgggctcattcaaagaaagagacaacttaacaccagaacaagcagaattgatcgcactaagaaagaaaaataagcaactcgaaatggagaatgatattttaaagcaagcggcgctgatattcggacgaaaagacaagtaa

SEQ ID NO: 44588 - protein, 96 aa, Enterococcus faecium
MPRRQRRTYSKEFKQQIVDLYLAGKPCAGIIREYELTPSSFDKWMKQAQSTGSFKERDNLTPEQAELIALRKKNKQLEMENDILKQAALIFGRKDK

SEQ ID NO: 44589 - DNA, 288 bp, Desulfovibrio desulfuricans G20
  CDS (1)..(288)
atgggaagactgatcaagtattcgaaagagttcaaactgtccgccgtcaagctcgttacggagttgggatactcgtgccgcgaagcaggggagcagttggggtgtagttcgtggtccgtccgtgactgggtcaggcaattgcgcgccagcggggacattcccccagagaatgtaacggccgcttctgcacaggatatgaaggcgctccgagaggagaatgcccgccttcgccttgagaacgaaatcctaaaaaaggcagcggcgtactttgccaaggagtccctgtaa

SEQ ID NO: 44590 - protein, 95 aa, Desulfovibrio desulfuricans G20
MGRLIKYSKEFKLSAVKLVTELGYSCREAGEQLGCSSWSVRDWVRQLRASGDIPPENVTAASAQDMKALREENARLRLENEILKKAAAYFAKESL

SEQ ID NO: 44591 - DNA, 306 bp, Polaromonas sp. JS666
  CDS (1)..(306)
atgagcaagaggaaagacggacaggccaggggcaaatacaccctggaattcaagctggaggcggtgcggctggtcaagggcgggcaggccgtgccggtgacggccagggtgctgggcgtgccggtgcagacgctgggcaactgggtgcgcctgagcgagaaaggccagctcaagggcgcaggcgacaagcctgtgtcgcctgagcaaatggagctggcgcggctgcgagcggagaacgcgcggctgcgcatggagcgcgacattttaaaaaaggccacagcgtacttcgccaaggaatcgctgtga

SEQ ID NO: 44592 - protein, 101 aa, Polaromonas sp. JS666
MSKRKDGQARGKYTLEFKLEAVRLVKGGQAVPVTARVLGVPVQTLGNWVRLSEKGQLKGAGDKPVSPEQMELARLRAENARLRMERDILKKATAYFAKESL

SEQ ID NO: 44593 - DNA, 300 bp, Leptospira interrogans
  CDS (1)..(300)
atgaaaggaagaagaaaatattcgccggagtttcgggaacaagcagtaaaccggacgttaaacggatcgtttacaataaaagaagtagcagagtccttaggagttagctactttgtattgagacaatggaaggccgagcatttgaaaaagaaggaaacagagcaaccacttacggataaacagctaaaggaaagcgaagaattgaaaagacttcgtaaagagaatgtgagattaaaggatgaaaacgcgatcttaaaaaagtttgcggccatgctttcccgcgaacagaatcccgattga

SEQ ID NO: 44594 - protein, 99 aa, Leptospira interrogans
MKGRRKYSPEFREQAVNRTLNGSFTIKEVAESLGVSYFVLRQWKAEHLKKKETEQPLTDKQLKESEELKRLRKENVRLKDENAILKKFAAMLSREQNPD

SEQ ID NO: 44595 - DNA, 300 bp, Leptospira interrogans
  CDS (1)..(300)
atgaaaggaagaagaaaatattcgccggagtttcgggaacaagcagtaaaccggacgttaaacggatcgtttacaataaaagaagtagcagagtccttaggagttagctactttgtattgagacaatggaaggccgagcatttgaaaaagaaggaaacagagcaaccacttccggataaacagctaaaggaaagcgaagaattgaaaagacttcgtaaagagaatgtgagattaaaggatgaaaacgcgatcttaaaaaagtttgcggccatgctttcccgcgaacagaatcccgattga

SEQ ID NO: 44596 - protein, 99 aa, Leptospira interrogans
MKGRRKYSPEFREQAVNRTLNGSFTIKEVAESLGVSYFVLRQWKAEHLKKKETEQPLPDKQLKESEELKRLRKENVRLKDENAILKKFAAMLSREQNPD

SEQ ID NO: 44597 - DNA, 291 bp, Enterococcus faecium
  CDS (1)..(291)
atgtctaagagaacacgaagaactttttcacaagaattcaagcaacaaatcgtcaatctttacttagctggaaagccacgtgtagaaatcattcgagaatataaactaacggcttcagcatttgacaaatgggtaaagcaatctaaaacgagtggttcattcaaagaaaaagataatcttacgcctgaacaaaaagaattgttaaaactacgtaaaagaaaccagcaattagaaatggaaaatgatattttaaagcaagcagcgctgatattcggacgaagagacaagtaa

SEQ ID NO: 44598 - protein, 96 aa, Enterococcus faecium
MSKRTRRTFSQEFKQQIVNLYLAGKPRVEIIREYKLTASAFDKWVKQSKTSGSFKEKDNLTPEQKELLKLRKRNQQLEMENDILKQAALIFGRRDK

SEQ ID NO: 44599 - DNA, 369 bp, Escherichia coli
  CDS (1)..(369)
atgaaaaaaagaaatttcagcgcagagtttaaacgcgaatccgctcaactggttgttgaccagaactacacggtggcagatgccgccaaagctatggatgttggcctttccacaatgacaagatgggtcaaacaactgcgtgatgagcgtcagggcaaaacaccaaaagcctctccgataacaccagaacaaatcgaaatacgtgagctgaggaaaaagctacaacgcattgaaatggagaatgaaatattaaaaaaggctactgtagattcaattggtcaacgcaacagttatgtgaaaacatggggttgcggaggttttttgaatgagacgaacatttacagcagaggaaaaagcctctgtttttga

SEQ ID NO: 44600 - protein, 122 aa, Escherichia coli
MKKRNFSAEFKRESAQLVVDQNYTVADAAKAMDVGLSTMTRWVKQLRDERQGKTPKASPITPEQIEIRELRKKLQRIEMENEILKKATVDSIGQRNSYVKTWGCGGFLNETNIYSRGKSLCF

SEQ ID NO: 44601 - DNA, 339 bp, Escherichia coli
  CDS (1)..(339)
atgagcggtaagcgttatcccgaagagtttaaaactgaagcagtcaaacaggttgttgatctcggttattctgttgccagcgttgcaacacgtctcgatatcaccacccacagcctttatgcctggataaagaagtacggtccggattcttccactaataaagaacagtcagatgctcaggccgagatccgccgtctccagaaagagctgaaacgggttaccgacgaacgggacatattaaaaaaagctgctgtagattcaatctgtcaatgcaacacccctttcaattatctctttcggtgttttgaacttcagtgtctttctcggtctgttgtttag

SEQ ID NO: 44602 - protein, 112 aa, Escherichia coli
MSGKRYPEEFKTEAVKQVVDLGYSVASVATRLDITTHSLYAWIKKYGPDSSTNKEQSDAQAEIRRLQKELKRVTDERDILKKAAVDSICQCNTPFNYLFRCFELQCLSRSVV

SEQ ID NO: 44603 - DNA, 348 bp, Escherichia coli
  CDS (1)..(348)
gtgatattctcaccacaacacaaaacaggtgacttaatgaacaagaaaaccaaacgaaccttcacccctgagttcaggctggaatgtgcacagctgattgttgataagggctactcatatcgacaggccagtgaagcgatgaatgtcggttcaaccacgcttgagagctgggtacgccagctcaggcgagagcgccagggtattacgccctctgccacacccattactccagaccagcaacgtatccgcgagctggaaaagcaagttcgccgtctggaggaacaaaatacgatattaaaaaaggctaccgcgctcttaatgtccgactcgctgaacggttcacgatag

SEQ ID NO: 44604 - protein, 115 aa, Escherichia coli
MIFSPQHKTGDLMNKKTKRTFTPEFRLECAQLIVDKGYSYRQASEAMNVGSTTLESWVRQLRRERQGITPSATPITPDQQRIRELEKQVRRLEEQNTILKKATALLMSDSLNGSR

SEQ ID NO: 44605 - DNA, 357 bp, Yersinia enterocolitica
  CDS (1)..(357)
atgagcggtaagcgttatcccgaagagtttaaaactgaagcagtcaaacaggttgttgatcgcggttattctgttgccagcgttgcaacacgtctcgatatcaccacccacagcctttacgcctggataaagaagtacggtccggattcttccactaataaagaacagtcagatgctcaggccgagatccgccgtctccagaaagagctgaaacgggttaccgacgaacgggacatattaaaaaaagccgctgtagattcaattggtcaacgcaacagttatgtgaaaacatggggttgcggaggttttttgaatgagacgaacatttacagcagaggaaaaagcctctgtttttga

SEQ ID NO: 44606 - protein, 118 aa, Yersinia enterocolitica
MSGKRYPEEFKTEAVKQVVDRGYSVASVATRLDITTHSLYAWIKKYGPDSSTNKEQSDAQAEIRRLQKELKRVTDERDILKKAAVDSIGQRNSYVKTWGCGGFLNETNIYSRGKSLCF

SEQ ID NO: 44607 - DNA, 273 bp, Escherichia coli
  CDS (1)..(273)
atgaaaaaaagaaatttcagcgcagagtttaaacgcgaatccgctcaactggttgttgaccagaaatacacggtggcagatgccgcgaaagctatggatgttggcctttccacaatgacaagatgggtcaaacaactgcgtgatgagcgtcagggcaaaacaccaaaagcctctccgataacaccagaacaaatcgaaatacgtaagctgaggaaaaagctacaacgcattgaaatggagaatgaaatattaaaaaggctaccgcgctcttga

SEQ ID NO: 44608 - protein, 90 aa, Escherichia coli
MKKRNFSAEFKRESAQLVVDQKYTVADAAKAMDVGLSTMTRWVKQLRDERQGKTPKASPITPEQIEIRKLRKKLQRIEMENEILKRLPRS

SEQ ID NO: 44609 - DNA, 285 bp, Bacillus halodurans
  CDS (1)..(285)
atgaccaagcgtccgagaagaagctatacaaaagaatttaaggatcaaatcgttcaacttcatgtttctggcaagccccgtgcagaaattatcaaagaatacgagctgacgccttctgcctttgataagtgggttcggcagcaccagaacagtggatcctttgaagaaaaagacaaccgtacacccgaacaggaagagttgattcggctgcggaaagagaatcaaaagcttgccatggagaatgatattttaaagcaagccgcgctgatcataggacgaaagtag

SEQ ID NO: 44610 - protein, 94 aa, Bacillus halodurans
MTKRPRRSYTKEFKDQIVQLHVSGKPRAEIIKEYELTPSAFDKWVRQHQNSGSFEEKDNRTPEQEELIRLRKENQKLAMENDILKQAALIIGRK

SEQ ID NO: 44611 - DNA, 291 bp, Lactococcus lactis
  CDS (1)..(291)
atggcaagaagaaaattcgataaacaatttaaaaattctgcagtaaaactcattcttgaagagggtttctctgttaaagaagtcagccaagagcttgaggttcatgccaatagtctttatcgctgggttcaagaagttgaagaatatggagaaagtgcttttccaggcaatgggacagccctagctaatgcccaacataagattaaattgttagagaaagaaaatcgttatcttcaggaggaacttgaacttctaaaaaagttccgggtcttcttgaagcgaagcaagtaa

SEQ ID NO: 44612 - protein, 96 aa, Lactococcus lactis
MARRKFDKQFKNSAVKLILEEGFSVKEVSQELEVHANSLYRWVQEVEEYGESAFPGNGTALANAQHKIKLLEKENRYLQEELELLKKFRVFLKRSK

SEQ ID NO: 44613 - DNA, 321 bp, Pseudomonas stutzeri
  CDS (1)..(321)
atgaccaaacaacgtcgtacgtttacgcctgagttcaaacgagaggcagccagcttggttctggaccagggctacagccacatcgaagcagcccgttcacttgggctggttgagtcggactcttcgccgatgggtaatcagctccaagcggagcgaaatggagttactccgaccagcaaagcaccgacgcccgagcagcagaaaattcaggaactggaagcgcggatcaaccgcttggagcgggaaaaatcgatcctaaaaaaggctaccgcgttcttgatggccgaggaacacgagcgtttgtgcgtttgcgttgattga

SEQ ID NO: 44614 - protein, 106 aa, Pseudomonas stutzeri
MTKQRRTFTPEFKREAASLVLDQGYSHIEAARSLGLVESDSSPMGNQLQAERNGVTPTSKAPTPEQQKIQELEARINRLEREKSILKKATAFLMAEEHERLCVCVD

SEQ ID NO: 44615 - DNA, 321 bp, Escherichia coli
  CDS (1)..(321)
atgatcaaaactcgtcggactaaacgtaccttttccccggagttcaagcttgaagctttcgagcaggtggtggttaaataccagcgtgatgtcagagaagtcgcgcaggcactcgagctcaaccctgaccatttgcgtaaatggatacggttgtataagcaggaacttcagggtattgagccagctggtaatgctattacccctgaacaacgcgaaattcagcagcttaaagcgcagataaagcgcgttgagatggaaaaagaaatactaaagcaggctgccgtgctgatgagcgaaatccccgggaagctgtcgcgctaa

SEQ ID NO: 44616 - protein, 106 aa, Escherichia coli
MIKTRRTKRTFSPEFKLEAFEQVVVKYQRDVREVAQALELNPDHLRKWIRLYKQELQGIEPAGNAITPEQREIQQLKAQIKRVEMEKEILKQAAVLMSEIPGKLSR

SEQ ID NO: 44617 - DNA, 300 bp, Escherichia coli
  CDS (1)..(300)
atgagcaaagcatttactgctgaatttaaagtcgaagcggcaaaactggtcctggatcagaactacactcacggcgaagcggctaaggcgatgaacgtcagcctctccgccatcaaccgctgggtaaaatcgttacgtatggagcgccaggggaaaacgcccccggggctgcctctgacgcctgagcagactgaactcagggaaatgagaaaacgaatacaacgccttgaaatggagaatgaaatcctaaaaaaggctaccgcgctcttgatgtcggactccctgaacagttcacgataa

SEQ ID NO: 44618 - protein, 99 aa, Escherichia coli
MSKAFTAEFKVEAAKLVLDQNYTHGEAAKAMNVSLSAINRWVKSLRMERQGKTPPGLPLTPEQTELREMRKRIQRLEMENEILKKATALLMSDSLNSSR

SEQ ID NO: 44619 - DNA, 318 bp, Escherichia coli
  CDS (1)..(318)
atgatcaaaactcgttggactaaacgtaccttttccccggagttcaagcttgaagctatcgaacaggtggttaaatacccgcgtgatgtcagagaagtcgcgctggcacttgagctcaatcctgaccatttgcgtaaatggatacggttgtataagcaggaatttcagggtattgagtccgctggtaatgctattactcctgaacaacgcgaaattcagcagcttaaagcgcagataaagcgcgttgagatggcaaaagaaatactaaagcaggctgccgtgctgatgagcgaaatccccgggaagctgccgcgctaa

SEQ ID NO: 44620 - protein, 105 aa, Escherichia coli
MIKTRWTKRTFSPEFKLEAIEQVVKYPRDVREVALALELNPDHLRKWIRLYKQEFQGIESAGNAITPEQREIQQLKAQIKRVEMAKEILKQAAVLMSEIPGKLPR

SEQ ID NO: 44621 - DNA, 303 bp, Escherichia coli
  CDS (1)..(303)
atgaaaaaaagaaatttcagcgcagagtttaaacgcgaatccgctcaactggttgttgaccagaactacacggtggcagatgccgccaaagctatggatatcggcctttccacaatgacaagatgggtcaaacaactgcgtgatgagcgtcagggcaaaacaccaaaagcctctccgataacaccagaacaaatcgaaatacgtgagctgaggaaaaagctacaacgcattgaaatggagaatgaaatattaaaaaaggctaccgcgctcttgatgtcagactccctgaacagttctcgataa

SEQ ID NO: 44622 - protein, 100 aa, Escherichia coli
MKKRNFSAEFKRESAQLVVDQNYTVADAAKAMDIGLSTMTRWVKQLRDERQGKTPKASPITPEQIEIRELRKKLQRIEMENEILKKATALLMSDSLNSSR

SEQ ID NO: 44623 - DNA, 273 bp, Escherichia coli
  CDS (1)..(273)
atgaaaaaaagaaatttcagcgcagagtttaaacgcgaatccgctcaactggttgttgaccagaaatacacggtggcagatgccgcgaaagctatggatgttggcctttccacaatgacaagatgggtcaaacaactgcgtgatgagcgtcagggcaaaacaccaaaagcctctccgataacaccagaacaaatcgaaatacgtaagctgaggaaaaagctacaacgcattgaaatggagaatgaaagattaaaaaggctaccgcgctcttga

SEQ ID NO: 44624 - protein, 90 aa, Escherichia coli
MKKRNFSAEFKRESAQLVVDQKYTVADAAKAMDVGLSTMTRWVKQLRDERQGKTPKASPITPEQIEIRKLRKKLQRIEMENERLKRLPRS

SEQ ID NO: 44625 - DNA, 303 bp, Escherichia coli
  CDS (1)..(303)
atgaaaaaaagaaatttcagcgcagagtttaaacgcgaatccgctcaactggtcgttgaccagaattacaccgtggcagatgcagccagcgctatggatgtcggcctttccacaatgacgcgatgggtgaaacaattacgtgatgagcggcagggaaaaacaccaaaagcctcccctattaccccggaacaaattgaaatccgtgagctcaggaaaaagctacaacgtattgaaatggaaaatgaaatattaaaaaaggctaccgcgctcttgatgtcagactccctgaacagttctcgataa

SEQ ID NO: 44626 - protein, 100 aa, Escherichia coli
MKKRNFSAEFKRESAQLVVDQNYTVADAASAMDVGLSTMTRWVKQLRDERQGKTPKASPITPEQIEIRELRKKLQRIEMENEILKKATALLMSDSLNSSR

SEQ ID NO: 44627 - DNA, 1173 bp, Escherichia coli
  CDS (1)..(1173)
atgaaaaaaagaaatttcagcgcagagtttaaacgcgaatccgctcaactggttgttgaccagaactacacggtggcagatgccgccaaagctatggatatcggcctttccacaatgacaagatgggtcaaacaactgcgtgatgagcgtcagggcaaaacaccaaaagcctctccgataacaccagaacaaatcgaaatacgtgagctgaggaaaaagctacaacgcattgaaatggagaatgaaatattaaaaaaaggctacaaccgcgctcttgatgtcagactccctgaacagttctcgataatcgggaaactcagagcgcattatcctgtggtcacactctgccatgtgttcggggttcatcgcagcagctacagatactggaaaaaccgtcctgaaaaaccagacggcagacgggctgtattacgcagtcaggtacttgagttgcataacatcagccatggttctgccggggcaagaagcatcgccacaatggcaaccctgagaggcctcagaatggggcgctggcttgccggcaggctcatgaaagaactgggactggtcagttgccagcagcctgcgcaccgttataaacgaggtggtcgtgaacatgtcactatcccgaatcaccttgggcggcagttcgcagtgacagagccaaatcaggtatggtgcggcgacgtgacgtacatctggacggggaaacgttgggcataccttgccgttgttctcgacctgtttgcaaggaaaccggtaggttgggcaatgtcgttctctccggacagcagactgaccatcaaagcgctgaaaatggcctgggaaatccgcagtaaaccagccggggtaatgttccacagcgatcagggcagccactatacaagcaggcagttccggcagttactgtggcgttaccagatcaaacagagtatgagccggcgcggaaactgctgggataacagcccaatggaacgcttcttcaggagtctgaaaaacgagtggataccggtgacgggttacatgaacttcagcgatgctgcccatgaaataacggactatatcgttgggtattacaacgcgctcaggccgcacgaatataacggtgggttgccaccaaatgaatcggaaaaccgatactggaaaaactctaaagcggtggccagtttttgttga

SEQ ID NO: 44628 - protein, 390 aa, Escherichia coli
MKKRNFSAEFKRESAQLVVDQNYTVADAAKAMDIGLSTMTRWVKQLRDERQGKTPKASPITPEQIEIRELRKKLQRIEMENEILKKGYNRALDVRLPEQFSIIGKLRAHYPVVTLCHVFGVHRSSYRYWKNRPEKPDGRRAVLRSQVLELHNISHGSAGARSIATMATLRGLRMGRWLAGRLMKELGLVSCQQPAHRYKRGGREHVTIPNHLGRQFAVTEPNQVWCGDVTYIWTGKRWAYLAVVLDLFARKPVGWAMSFSPDSRLTIKALKMAWEIRSKPAGVMFHSDQGSHYTSRQFRQLLWRYQIKQSMSRRGNCWDNSPMERFFRSLKNEWIPVTGYMNFSDAAHEITDYIVGYYNALRPHEYNGGLPPNESENRYWKNSKAVASFC

SEQ ID NO: 44629 - DNA, 306 bp, Escherichia coli
  CDS (1)..(306)
atgaaaaaaagaaatttcagcgcagagtttaaacgcgaatccgctcaactggttgttgaccagaactacacggtggcagatgccgccaaagctatggatatcggcctttccacaatgacaagatgggtcaaacaactgcgtgatgagcgtcagggcaaaacaccaaaagcctctccgataacaccagaacaaatcgaaatacgtgagctgaggaaaaagctacaacgcattgaaatggagaatgaaatattaaaaaaggctacaaccgcgctcttgatgtcagactccctgaacagttctcgataa

SEQ ID NO: 44630 - protein, 101 aa, Escherichia coli
MKKRNFSAEFKRESAQLVVDQNYTVADAAKAMDIGLSTMTRWVKQLRDERQGKTPKASPITPEQIEIRELRKKLQRIEMENEILKKATTALLMSDSLNSSR

SEQ ID NO: 44631 - DNA, 318 bp, Pseudomonas aeruginosa
  CDS (1)..(318)
atgagcagtaagcgcagaggattcgacgccagcttcaagctgcaagtcgttcagatggttagggagcaaggtctggccgttccccagatctgccgggacatggatcttggcgagacggcggttcgccgttgggttcagcagtacgaagcggagctatccgggcagcctggaataggtaagccgctgacacccgagcagcagcggatccgccaactcgaggccgagaatcgtcagctgaagcaggataacgatctgttaaaaaaccgcttccccggcgctccgcgccccattgggttagaaacacgcccactacactga

SEQ ID NO: 44632 - protein, 105 aa, Pseudomonas aeruginosa
MSSKRRGFDASFKLQVVQMVREQGLAVPQICRDMDLGETAVRRWVQQYEAELSGQPGIGKPLTPEQQRIRQLEAENRQLKQDNDLLKNRFPGAPRPIGLETRPLH

SEQ ID NO: 44633 - DNA, 300 bp, Serratia marcescens
  CDS (1)..(300)
atggctaaacatttcacggctgaatttaagctcgaagctgcaaaactggttgtcgaccacggctacacattcgctaaggccgccgaagcggttaatgtcagccattccgctctgactcgctgggtcaataaactcaggcttgaacgacaggggaaaacgccttcggggcttcccctcacccctgagcagctcgagctgcgtgagatgaagaaaaaaatacaacgccttgaaatggaaaacgaaatcctaaaaaaggctacggcgctcttaatgtcggactcactcaacggttcactgtag

SEQ ID NO: 44634 - protein, 99 aa, Serratia marcescens
MAKHFTAEFKLEAAKLVVDHGYTFAKAAEAVNVSHSALTRWVNKLRLERQGKTPSGLPLTPEQLELREMKKKIQRLEMENEILKKATALLMSDSLNGSL

SEQ ID NO: 44635 - DNA, 381 bp, Escherichia coli
  CDS (1)..(381)
atgatcaaaactcgccggactaaacgtatcttttccccggagttcaggcttaaagttatcgaacaggtggttaaataccagcgtgatgtcagagaaatcacgctggcactcgagctcaaccctgaccatttgcgtaaatggatacggttgtataagcaggaacttcagggtattgagcctgctggtaatgctattacccctgaacaacgcgaaattcagcagcttaaagcgcagataaagcgcgttgagatggaaaaagaaatactaaagcaggctgccgtactgatgagcgaaatccccgggaagctatcggctaatcacacggctgaaagcaaagtgaccagtgcgggttctttgtcatttattcggtattcaccgtag

SEQ ID NO: 44636 - protein, 126 aa, Escherichia coli
MIKTRRTKRIFSPEFRLKVIEQVVKYQRDVREITLALELNPDHLRKWIRLYKQELQGIEPAGNAITPEQREIQQLKAQIKRVEMEKEILKQAAVLMSEIPGKLSANHTAESKVTSAGSLSFIRYSP

SEQ ID NO: 44637 - DNA, 285 bp, Pantoea agglomerans
  CDS (1)..(285)
gtgcccattagcggtaagcgttatcccgaagagtttaaaattgaagcagtcaaacaggttgttgatcgtggtcattctgtttccagcgttgcaacacgtctcgatatcaccacccacagcctttacgcctggataaagaagtacggtccggattcttccattaataaagaacagtcagatgctcaggccgagatccgccgtctccagaacgagctgaagcgggttaccgacggacgggacatattaaaaaaagccgcggcgtacttcgcaaagctgtccgactga

SEQ ID NO: 44638 - protein, 94 aa, Pantoea agglomerans
MPISGKRYPEEFKIEAVKQVVDRGHSVSSVATRLDITTHSLYAWIKKYGPDSSINKEQSDAQAEIRRLQNELKRVTDGRDILKKAAAYFAKLSD

SEQ ID NO: 44639 - DNA, 285 bp, Erwinia amylovora
  CDS (1)..(285)
atgggcacaccacgatttacacctgaatttaaagaagaggcggtccgtcagataacggaacgtggctattccgttgctgacgtttccgaccggctgggcgtctccgcgcacagcctttacaagtggctacgcgccataaaacccgataatagcgagcagcatgcccgggatttactggaggccaaaagcgagatcctgaaactacgggcgcagctaaaacgtaccgaagaagaacgggatatcctgaaaaaggccgcgcggtactttgcaagggagcccgactga

SEQ ID NO: 44640 - protein, 94 aa, Erwinia amylovora
MGTPRFTPEFKEEAVRQITERGYSVADVSDRLGVSAHSLYKWLRAIKPDNSEQHARDLLEAKSEILKLRAQLKRTEEERDILKKAARYFAREPD

SEQ ID NO: 44641 - DNA, 303 bp, Shigella dysenteriae
  CDS (1)..(303)
atgagcagaaaaacccaacgttactctaaagagttcaaagccgaagctgtcagaacggttcttgaaaatcaactttcgatcagtgaaggcgcttcccgattatcccttcctgaaggccctttaggacaatgggttaccgccgccagaaaagggctcggtactcctggttcccgcacggtggctgaactggaatctgaaattctgcaactgcgtaaggcgttaaatgaagctcgccttgggcgagatatattaaaaaaagcaacagcgtattttgcacaggagtcgctgaaaaatacgcgttaa

SEQ ID NO: 44642 - protein, 100 aa, Shigella dysenteriae
MSRKTQRYSKEFKAEAVRTVLENQLSISEGASRLSLPEGPLGQWVTAARKGLGTPGSRTVAELESEILQLRKALNEARLGRDILKKATAYFAQESLKNTR

SEQ ID NO: 44643 - DNA, 333 bp, Yersinia enterocolitica
  CDS (1)..(333)
atgagcaacactaacgaggtgagaatgcgaaaaaaatcatttactcatgagtttaaacaagagtgcgtcaacctggttcttcaacataagtacccggtgactcaggctgctgaaacaatgaatattggcctttcaaccttacaacgctggctacggcagtatcgcggagagagccgcggaaatacaccgatagccagtgctataacaccggaacaacgccgaatacaaaaacttgaaaagcaggtgcggcagttacagagcgacaatgacctgttaaaaaaggcttcggccttcttcgccatggaaatgaacaacgacaaaaagtcgcggtaa

SEQ ID NO: 44644 - protein, 110 aa, Yersinia enterocolitica
MSNTNEVRMRKKSFTHEFKQECVNLVLQHKYPVTQAAETMNIGLSTLQRWLRQYRGESRGNTPIASAITPEQRRIQKLEKQVRQLQSDNDLLKKASAFFAMEMNNDKKSR

SEQ ID NO: 44645 - DNA, 333 bp, Yersinia enterocolitica
  CDS (1)..(333)
atgagcaacactaacgaggtgagaatgcgaaaaaaatcatttactcatgagtttaaacaagagtgcgtcaacctggttcttcaacataagtacccggtgactcaggctgctgaaacaatgaatattggcctttcaaccttacaacgctggctacggcagtatcgcggagagagccgcggaaatacaccgatagccagtgctataacaccggaacaacgccgaatacaagaacttgaaaagcaggtgcggcagttacagagcgacaatgacctgttaaaaaaggcttcggccttcttcgccatggaaatgaacaacgacaaaaagtcgcggtaa

SEQ ID NO: 44646 - protein, 110 aa, Yersinia enterocolitica
MSNTNEVRMRKKSFTHEFKQECVNLVLQHKYPVTQAAETMNIGLSTLQRWLRQYRGESRGNTPIASAITPEQRRIQELEKQVRQLQSDNDLLKKASAFFAMEMNNDKKSR

SEQ ID NO: 44647 - DNA, 303 bp, Escherichia coli
  CDS (1)..(303)
gtgatatgctcacctcagaacaacacaggtgctccaatgaaaaaaagaaatttcagcgcagagtttaaacgcgaatccgctcaactggttgttgaccagaaatacacggtggcagatgccgcgaaagctatggatgttggcctttccacaatgacaagatgggtcaaacaactgcgtgatgagcgtcagggcaaaacaccaaaagcctctccgataacaccagaacaaatcgaaatacgtaagctgaggaaaaagctacaacggattgaaatggagaatgaaatattaaaaaggctactgtag

SEQ ID NO: 44648 - protein, 100 aa, Escherichia coli
MICSPQNNTGAPMKKRNFSAEFKRESAQLVVDQKYTVADAAKAMDVGLSTMTRWVKQLRDERQGKTPKASPITPEQIEIRKLRKKLQRIEMENEILKRLL

SEQ ID NO: 44649 - DNA, 303 bp, Shigella sonnei
  CDS (1)..(303)
atgagcagaaaaacccaacgttactctaaagagttcaaagccgaagctgtcagaacggttcctgaaaatcaactttcgatcagtgaaggcgcttcccgattatctcttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcaacagcgtattttgcacaggagtcgctgaaaaatacgcgttaa

SEQ ID NO: 44650 - protein, 100 aa, Shigella sonnei
MSRKTQRYSKEFKAEAVRTVPENQLSISEGASRLSLPEGTLGQWVTAARKGLGTPGSRTVAELESEILQLRKALNEARLERDILKKATAYFAQESLKNTR

SEQ ID NO: 44651 - DNA, 25 bp, Primer
atgatatgctcacctcagaacaaca

SEQ ID NO: 44652 - DNA, 26 bp, Primer
ttaaaaacagaggctttttcctctgc

SEQ ID NO: 44653 - protein, 82 aa, consensus
  MISC_FEATURE (1)..(82): consensus for the disclosure of xaa see table XV
EFKXXXXXXXXXXXXXXXXXXXXXXXXXXXXXXXWXXXXXXXXXXXXXXXXXXXXXXXXXXXXXLXXXXXXXXXEXXILKKA

SEQ ID NO: 44654 - protein, 85 aa, consensus
  MISC_FEATURE (1)..(85): consensus for the disclosure of xaa see table XV
XXXXXXXXXXXXXXXXXXXXXXXXXXXXXXXXXXXXXWXXXXXXXXXXXXXXXXXXXXXXXXXXXXXXXXXXXXXXXXXXXXKXX

SEQ ID NO: 44655 - DNA, 1248 bp, Escherichia coli
  CDS (1)..(1248)
atgcaggatttaatatcccaggttgaagatttagcgggtattgagatcgatcacaccacctcgatggtgatgattttcggtattatttttctgaccgccgtcgtggtgcatattattttgcattgggtggtactgcggaccttcgaaaaacgtgccatcgccagttcacggctttggttgcaaatcattacccagaataaactcttccaccgtttagcttttaccctgcaggggattatcgtcaatattcaggcggtattctggctgcaaaaaggcaccgaagcggcagatattctgactacctgcgcgcagttgtggatcatgatgtatgcgctgctttcagtcttctcgttgctggatgttattttgaatctggcgcagaaattcccggcagcatctcagttaccgctgaaagggatatttcaggggattaaactgatcggcgcgattctggtcggcattttgatgatctcgctgctgattggtcagtcgccagcgattctgatcagcggtcttggtgcaatggctgccgtgctgatgttggtatttaaagatccgattcttggtctggtggcaggtattcagctttccgcgaacgatatgctgaaactgggcgactggctggagatgccgaaatacggcgcggatggcgcggtgatcgatattgggttaaccaccgtcaaagtgcgtaactgggacaataccattaccactattcccacctggtctctggtttctgactcctttaaaaactggagcgggatgtcagcatctggcgggcgacgtattaagcgcagtatcagtattgatgtcaccagtattcgttttcttgatgaagacgaaatgcaacgtctgaataaagcgcatttgttaaagccttatttaaccagccgccatcaggaaattaatgagtggaatcgccagcaaggttctacggagtcggtattaaatctgcgccgaatgaccaatattggaacctttcgtgcctatctgaacgaatatctgcgtaaccatccgcggattcgtaaagatatgaccttaatggtacgccaactggctccaggtgataacggtttaccgctcgagatctacgcgtttactaacaccgtggtgtggctggaatatgaaagcattcaggctgatatattcgatcacatatttgcgattgtcgaagagtttggtctgcgacttcatcagtcgccaaccggcaatgatattcgctctctggcgggtgcatttaagcagtaa

SEQ ID NO: 44656 - protein, 415 aa, Escherichia coli
MQDLISQVEDLAGIEIDHTTSMVMIFGIIFLTAVVVHIILHWVVLRTFEKRAIASSRLWLQIITQNKLFHRLAFTLQGIIVNIQAVFWLQKGTEAADILTTCAQLWIMMYALLSVFSLLDVILNLAQKFPAASQLPLKGIFQGIKLIGAILVGILMISLLIGQSPAILISGLGAMAAVLMLVFKDPILGLVAGIQLSANDMLKLGDWLEMPKYGADGAVIDIGLTTVKVRNWDNTITTIPTWSLVSDSFKNWSGMSASGGRRIKRSISIDVTSIRFLDEDEMQRLNKAHLLKPYLTSRHQEINEWNRQQGSTESVLNLRRMTNIGTFRAYLNEYLRNHPRIRKDMTLMVRQLAPGDNGLPLEIYAFTNTVVWLEYESIQADIFDHIFAIVEEFGLRLHQSPTGNDIRSLAGAFKQ

SEQ ID NO: 44657 - DNA, 1239 bp, Vibrio cholerae O1 biovar eltor str. N16961
  CDS (1)..(1239)
atgcttgaaacattaaccttgtggttacagaagtttgatattgaaattgaacgcgtgatccagcttgcggaagcgctcgggctgatcgcagccatttcgattgccattcatctcgtgttacaccgtggagtgctgctgtggctcaaacgccatacccaccatgagcaaagcgtttggcgcaatgctctgtttaaagagcacctatttagccgcgttgccttactgatccaaggtgtggtgattgcggtgcaaacccagttgtggctaagccctaacacctttgcttacgatgttctgcacaccctaacctcattgtggattgtggtgtttggcatgctggccacttactccgtactcaacgtgctggaactgctgatcagccgaacccaagtgggtaaaaacctgccgacacgcggcattttgcaaagcatcaagctgattgtgtttattatcgcggcgctgtttttcacctcaattttgatcggtaaatcgccagtgattctgctcagcggcttaggtgcgatgaccgccgtctttatgttggtatttaaagacccgatcctcggcttagttgcaggggtacaactttcggccaacaaaatgctctcggtcggtgactggttggaaatgcccaaatatggcgcagatggctctgtgattgatatcagcctaaccacagtcaaagtgcagaactgggataaaaccatcaccaccattccaagctacgccctgatttcagattcctttaaaaactggaaaggcatgcaagagtctggcggtcgccgtatcaaacgcagcattttgattgatgccaccagcgtgcattttttaacagaagaagagaaacaagcgctgaaaaaagcgcaactgcttgagccctacttggtcgagaaagagcaagagatcagcagctacaaccaacaaaaacattgggatttggcctgccgtatcaatggccgccgcctgaccaacatcggcagtttccgcgcttatttagagcgctacctgcgtactcaccccaatattcaccaagatatgacgctgatggtgcgtcagttagcgcccactcacgatggcatttcgctagaggtgtactgctttaccagcaccacagtgtgggtggagtatgagcgtattcagtcggatatttttgatcatatttacgcggtactgcctgagtttgacctgcgcgtctcgcaagcccccacaggcaatgactttcgcgctctgagaggctaa

SEQ ID NO: 44658 - protein, 412 aa, Vibrio cholerae O1 biovar eltor str. N16961
MLETLTLWLQKFDIEIERVIQLAEALGLIAAISIAIHLVLHRGVLLWLKRHTHHEQSVWRNALFKEHLFSRVALLIQGVVIAVQTQLWLSPNTFAYDVLHTLTSLWIVVFGMLATYSVLNVLELLISRTQVGKNLPTRGILQSIKLIVFIIAALFFTSILIGKSPVILLSGLGAMTAVFMLVFKDPILGLVAGVQLSANKMLSVGDWLEMPKYGADGSVIDISLTTVKVQNWDKTITTIPSYALISDSFKNWKGMQESGGRRIKRSILIDATSVHFLTEEEKQALKKAQLLEPYLVEKEQEISSYNQQKHWDLACRINGRRLTNIGSFRAYLERYLRTHPNIHQDMTLMVRQLAPTHDGISLEVYCFTSTTVWVEYERIQSDIFDHIYAVLPEFDLRVSQAPTGNDFRALRG

SEQ ID NO: 44659 - DNA, 1329 bp, Pseudomonas aeruginosa PAO1
  CDS (1)..(1329)
atggactccacatcccttctcgaccagctctccgggtactggtcggcgctcgaccaacaccctatcctgcacgccggcctggccttcggcctgctgctggtgggcgccctgatcctcggccgggtggcccgctacatcgtcctctacgccgccaacctgctcgcccgccagcccgcgctgcactggctcggcgacctgatccgcaacaaggtgttccagcgcctggcgcaaaccacgccctcgctgctggtgcaattcggcctgccgtggatcccggagatgccggacaaggccgcgcacttcctcggcaacctggcactggccttcaccgtgctgttcctgatcctcgccctcaccgcgctgctgaatgccctgctggacatctacgcgcgtaccgagcacgcccgcacccgctcgatcaagggctacgtgcaactggcgaagatcgccgtgttcgtgttcggcgcgatcatcatcgtctcgatcatcatcgaccgctcgccgctcctgctgctgtccggcctcggcgcgatgtcggcggtcctcctgctggtctacaaggacaccctgatgtccttcgtcgccagcgtgcagctcaccagcaacgacatgctgcgagtcggcgactggatcgagatgccgcaggtcggcgccgacggcgacgtggtggacatcaccctgtacaccgtgaaggtgcagaacttcgacaagaccatcgtctcggtgccgacctggcgcctgatgtcggagtcgttcaagaactggcgcggcatgcagcagtccggcggacggcggatcaagcgggcgatctacgtcgactccagccaggtgcgtttcctcgacgagaaggaagagcggcgcctgagccaggtgcgcctgctcaccgaatacatggcccgcaagcagaccgagttgcaggagtggaatgccgccaacggcggggtcgccccgctggccgccaaccgccgccggctgaccaacatcggtacgttccgcgcctacgccctcgcctacctgcagaaccatccggacatccatccgcacatgacctgcatggtccgccagttgcagccgaccgcccagggcatcccgctggagatatactgcttcacccgcaccaccgcctgggtcgactacgagcgcatccagggcgacgtgttcgactacctgctggcggtgatgccggagttcggcctcggcgcctaccagcagcccagcggccaggacctgcgccaggggctgcagggcatgctcgaagggcgtgacgccgaggcccgttcgttcgaggcgttggccgcaccgagccgcagcgacgaagccactgtctga

SEQ ID NO: 44660 - protein, 442 aa, Pseudomonas aeruginosa PAO1
MDSTSLLDQLSGYWSALDQHPILHAGLAFGLLLVGALILGRVARYIVLYAANLLARQPALHWLGDLIRNKVFQRLAQTTPSLLVQFGLPWIPEMPDKAAHFLGNLALAFTVLFLILALTALLNALLDIYARTEHARTRSIKGYVQLAKIAVFVFGAIIIVSIIIDRSPLLLLSGLGAMSAVLLLVYKDTLMSFVASVQLTSNDMLRVGDWIEMPQVGADGDVVDITLYTVKVQNFDKTIVSVPTWRLMSESFKNWRGMQQSGGRRIKRAIYVDSSQVRFLDEKEERRLSQVRLLTEYMARKQTELQEWNAANGGVAPLAANRRRLTNIGTFRAYALAYLQNHPDIHPHMTCMVRQLQPTAQGIPLEIYCFTRTTAWVDYERIQGDVFDYLLAVMPEFGLGAYQQPSGQDLRQGLQGMLEGRDAEARSFEALAAPSRSDEATV

SEQ ID NO: 44661 - DNA, 1248 bp, Salmonella typhimurium LT2
  CDS (1)..(1248)
atgcaggaattgatatcccgggtagaagatttagcgggaattgaaatgaatcacaccacgtcgctggtggtgatatttggtattatttttctgacagcagttgtcgtgcatattattttgcactggatagtactgcgcgctttcgaaaaacgtgccagcgccagttcccgcctgtggctgcaaattattacccagaataaattattccatcgtctggcttttacgctgcaaggcatcattgtcaatattcaggccgcgctctggctacaaaaaggcagtgaggctgcggatatcctgacgacctgcgcgcagttatggattatgacctacgccctgctgtcgttattttccttgctggacgtgattttcaatctatcgcaaaaatggcccgccgcctctcagttaccgctaaaaggaatatttcagggtattaagctcatcggcgcaattatcgtcggcattctgatgatctcactgctgattggccagtcaccagcaattttaatcagcgggctgggcgcgatggccgcggtattaatgctggtctttaaagacccgattcttggcctggttgccggtatccagctttccgccaacgatatgctcaaactgggcgactggctggaaatgccgaaatatggcgcagatggcgcggtcattgatattggcttaaccacggtaaaagtacgcaactgggataataccatcaccaccattcccacctggtcgctggtttccgactcattcaaaaactggagcggcatgtctgcgtccggcggacgccggattaaacgcagcattaatattgacgcgaccagtatccattttctggatgatgatgaaaaacagcggctgttaaccgcgcaactgttaaagccgtaccttaccagccgtcatcaggaaatcgatgaatggaataaacaactggatgcgccggaatcagccttaaatcaccgccgcatgaccaatatcgggacatttcgcgcctatctgaacgaatatttacgccaccatccgcgcatccgtaaagacatgacgctgatggtacgccaactggcgcctgacgatcatggtttgccgatagagatctacgcctttaccaataccgtcgtgtggctggaatatgagagcattcaggccgatattttcgaccatatttttgccgtggtggaagagtttggcttgcgtattcatcagacgccgaccggcagcgatattcgcgcgctgtcagggacattgcggcattaa

SEQ ID NO: 44662 - protein, 415 aa, Salmonella typhimurium LT2
MQELISRVEDLAGIEMNHTTSLVVIFGIIFLTAVVVHIILHWIVLRAFEKRASASSRLWLQIITQNKLFHRLAFTLQGIIVNIQAALWLQKGSEAADILTTCAQLWIMTYALLSLFSLLDVIFNLSQKWPAASQLPLKGIFQGIKLIGAIIVGILMISLLIGQSPAILISGLGAMAAVLMLVFKDPILGLVAGIQLSANDMLKLGDWLEMPKYGADGAVIDIGLTTVKVRNWDNTITTIPTWSLVSDSFKNWSGMSASGGRRIKRSINIDATSIHFLDDDEKQRLLTAQLLKPYLTSRHQEIDEWNKQLDAPESALNHRRMTNIGTFRAYLNEYLRHHPRIRKDMTLMVRQLAPDDHGLPIEIYAFTNTVVWLEYESIQADIFDHIFAVVEEFGLRIHQTPTGSDIRALSGTLRH

SEQ ID NO: 44663 - DNA, 1227 bp, Brucella melitensis 16M
  CDS (1)..(1227)
ttgacggaattcattcttgagcatccctgggctgagacgcttatagctcttggcggtttgtttttttcagctttcattgccaattttttgattaaggcaattctgctgaagatgctcaagcacatcattcagaaaacctcgttcggtcaggatgaggagctgaaaaaccttggtgttatcagccgtctggcgaatatcgttccggcgctgattatcgcatccggcattcttgccgttccggggctgcccgacggcgcattgacgatcattcggaatgtgtcgatttccttcatcattctgacactggcgctggcggtaaattctgcgctgagcgtagtcgacacgctttaccatcgccgcaccgaggcgcgaagccggccgataaagggttatattcaggtcacgaaactggccatatatcttattgcaacggttcttatcatcgcgacattgctggaccgttcgcctgttattctgctttcaggcgtcggcgccatggctgcggttctcattctggtttttcaggataccctgctgtcgcttgtcgccagtatgcagatcgcctcgtcaaatatggtgcgggtgggcgactggatcgaaatgaagaacctggacgcgaatggcgatgtcaccgaaatcgcgctttatacggtcaaggtgcagaatttcgataaaaccattaccaccatccccatccgcaagctcattaccgaaccgatgaagaattatcggggaatgcaggaatcaggcgggcggcgtatcaagcgcgctctttacatcgatcagaacacgattggctttctggatgaggctgaacgcaagcgcctcgcttccatcggtctgctggaagattatctgccccgcaaggaaaaggaaattgccgagtggaatgcgaagcttggagaacgcgctaaaaacccagtcaacacgcgccgtgtgaccaatatcggcacattccgcgcctatgttgaaacctatctgcgcaatcatccggggattcacaaaagcatgacgctgcttgtgcgccagatggatccgacgccggaaggcctgccgcttgaaatatattgttttacgaatacgaccaattgggccgcattcgagcaaattcagtcagatattttcgatcatctctatgccatattgccggaattcgggctgaatgctttccagaaccccagcggcaaggatttccgaagccttctggtcaaggataaagcgccttga

SEQ ID NO: 44664 - protein, 408 aa, Brucella melitensis 16M
MTEFILEHPWAETLIALGGLFFSAFIANFLIKAILLKMLKHIIQKTSFGQDEELKNLGVISRLANIVPALIIASGILAVPGLPDGALTIIRNVSISFIILTLALAVNSALSVVDTLYHRRTEARSRPIKGYIQVTKLAIYLIATVLIIATLLDRSPVILLSGVGAMAAVLILVFQDTLLSLVASMQIASSNMVRVGDWIEMKNLDANGDVTEIALYTVKVQNFDKTITTIPIRKLITEPMKNYRGMQESGGRRIKRALYIDQNTIGFLDEAERKRLASIGLLEDYLPRKEKEIAEWNAKLGERAKNPVNTRRVTNIGTFRAYVETYLRNHPGIHKSMTLLVRQMDPTPEGLPLEIYCFTNTTNWAAFEQIQSDIFDHLYAILPEFGLNAFQNPSGKDFRSLLVKDKAP

SEQ ID NO: 44665 - DNA, 1248 bp, Chlorobium tepidum TLS
  CDS (1)..(1248)
atgctcgactctcttttgctctatatagaatccttcaacgttgaccggtcgatcgccgtacctgtggccacgctgcttgccgttcttgtggccatgctgcttatcgccattgtcgagcttgtcacgaaaaaaattctcctgcgatccatcgatcactttgttgccaaaacagcaagcaacctggacgatctgctggtcagatatggcgtgttcaactggatcgcccacctggtgccgcctctgctcgcataccggatggccggtactgttctgcagttctatcccgctgcggtgccgcaggtaacggatgggctggtcatctattttgccgtggtcgttattctgctgctgctcgccgtgctcgatgtcgtttacgaattctactcggggcacccgattggcatgaagctgccgatcaaaagcatcgtgcaggtaatcaagacggttgtcgtttcgattggcgtggtgattgtcatctcccgcctgctcggccagtctcccgtggttttcatcagcggtatcggcgcgttcacggcggtgctgctgctcattttcaaggattcgattctcggtctcgtggcgggtgtgcagctttcgaccaacgacctggtgcgcatcggcgactggatcacgatgcccaaatacggcgctgatggagaggtgatcgacatttcgctcgtgaccgtgtcggtgcagaacttcgacaagaccatcgtggtgcttccggcctatacgctcatttccgaggggttcaagaactggcgggggatgcaggagtcggacgggcggcggatcaagcgctccttcaatatcgacatgcagagtatccgttttctcgacggcgaactcatgaaaaaaatcgaggcggtccagctgctgaagccttacctgcaggaacgttttcaggagatcaccagccacaaccgggcggtgggcgctgatgaagactcgccggtcaatggccgccgacttaccaatctcggtactttccgcgcctatctccaggcttatgtgcacagccagtccagaatcaacaccgacatgatgatcatgatccggtacctgcaaccggatgccttcggattaccgtgcgagatctactgcttcaccagaacgaaagagtgggcggaatacgaaggggtacaggcggatattttcgatcatattttcgctgtgctgccctggttcgatctcaaggcctatcagctccagggcgcagcggttcctccgccagccgtcacagcgtga

SEQ ID NO: 44666 - protein, 415 aa, Chlorobium tepidum TLS
MLDSLLLYIESFNVDRSIAVPVATLLAVLVAMLLIAIVELVTKKILLRSIDHFVAKTASNLDDLLVRYGVFNWIAHLVPPLLAYRMAGTVLQFYPAAVPQVTDGLVIYFAVVVILLLLAVLDVVYEFYSGHPIGMKLPIKSIVQVIKTVVVSIGVVIVISRLLGQSPVVFISGIGAFTAVLLLIFKDSILGLVAGVQLSTNDLVRIGDWITMPKYGADGEVIDISLVTVSVQNFDKTIVVLPAYTLISEGFKNWRGMQESDGRRIKRSFNIDMQSIRFLDGELMKKIEAVQLLKPYLQERFQEITSHNRAVGADEDSPVNGRRLTNLGTFRAYLQAYVHSQSRINTDMMIMIRYLQPDAFGLPCEIYCFTRTKEWAEYEGVQADIFDHIFAVLPWFDLKAYQLQGAAVPPPAVTA

SEQ ID NO: 44667 - DNA, 1248 bp, Yersinia pestis KIM
  CDS (1)..(1248)
gtgatgcaacaaagaataagccagtggctggaaagattggggatggagttctccgatgtgatgtcattgacgatggtgattgggctaatattattgatttctgtgatgatccatctggtgctacaccgtgtagttctggccgccctccagcgccgtgggcagcaatcgcaacgcatctggcaacaggccatcacaaaacacaaactgttccaacgcgtagcgctactgctgcaagggatcatcatcaatctccaggccgtactgtggttgcaaaacggcagccagacgcaggcagttatcgttaccgccgcgcaggtgtggattatggccttcgctctgctggctctattttctttacttgataccttgctagccctgctccgccagagttcagttgctcatcaattacccctgcgcggtatctgccaagggctgaaactggtggctgcgatatttatcggcatcatgatcgtttcgctgttgatgggccgatcacccctgttgctactcagcggcttaggggccatgacggcagtattgatgttggtgttcaaagacccaatccttggtctggtggccggtattcagctctctgctaacgatatgctaaaaattggcgattggctggaaatgccaaaatacggggctgatggcgcagtgaccgatattggcctgactacagtaaaagtaagaaattgggataacaccgtcacgaccatcccaacttatgcgcttatttccgattccttcaagaactggcgctcaatgtcggaatccggtggccgacgtataaaacgcagcatcaatattgataccaccagcgtacattttctgtcagaacaggaacaacagcgcctcaccctcaacccgctgttacaacactacctcagtgaaaaatcgcaggaactgaaccaatataatcagcagatagccctcgacctcagttcaccactcaatggccgccgcctgactaacattggaacgttgcgcgcctatctggtggcttatctgcgggcacatctggggatccatcagtcgatgacattaatggtgcgccaacttgccccaacacccgagggcttgccgctagaagtttatgcttttaccaacaccacgatatgggcagaatacgaaggtattcaggcagatatttttgaccacatctttgccgtggtgagtgagtttgatctgcgaatccaccaaacaccaagcggtaacgatatgcgcagtatgcttgccaaagtctaa

SEQ ID NO: 44668 - protein, 415 aa, Yersinia pestis KIM
MMQQRISQWLERLGMEFSDVMSLTMVIGLILLISVMIHLVLHRVVLAALQRRGQQSQRIWQQAITKHKLFQRVALLLQGIIINLQAVLWLQNGSQTQAVIVTAAQVWIMAFALLALFSLLDTLLALLRQSSVAHQLPLRGICQGLKLVAAIFIGIMIVSLLMGRSPLLLLSGLGAMTAVLMLVFKDPILGLVAGIQLSANDMLKIGDWLEMPKYGADGAVTDIGLTTVKVRNWDNTVTTIPTYALISDSFKNWRSMSESGGRRIKRSINIDTTSVHFLSEQEQQRLTLNPLLQHYLSEKSQELNQYNQQIALDLSSPLNGRRLTNIGTLRAYLVAYLRAHLGIHQSMTLMVRQLAPTPEGLPLEVYAFTNTTIWAEYEGIQADIFDHIFAVVSEFDLRIHQTPSGNDMRSMLAKV

SEQ ID NO: 44669 - DNA, 1032 bp, Shigella flexneri 2a str. 301
  CDS (1)..(1032)
atgatcgctgaactgtttacaaataatgcgcttaatctggtcattattttcggtagctgcgcagcattgattctgatgagcttttggtttcgccgtggaaatcgtaaaagaaaaggatttttattccatgcggtgcaatttttaatctacaccataattatcagtgctgttggtagcatcagtaattatgttatagaaaactataaactcaaatttatcaccccaggcgttatcgattttatctgtacgtccctgattgcggttattctgacgattaagctatttctgctgattaatcagtttgaaaaacagcagattaaaaaaggtcgcgatatcaccagtgcgcggattatgtcgcgcattatcaaaatcaccattattgtagtgcttgttctgctttatggcgaacatttcggcatgagcctttctggcttgctgacctttggtggtattggtggtctggctgtcggtatggccggtaaagatattctgagtaatttcttttccgggatcatgctctatttcgaccgtcctttcagtattggcgactggatccgttcaccggacagaaatatcgaaggtacagtagcggaaattggctggcgaattaccaaaattacgacctttgataatcgtccattgtacgtaccgaactcgctgttttcgtcgatcagcgtagaaaacccaggacgaatgaccaaccgccgcattaccacgaccattggtttacgttatgaggatgcggcaaaagtgggcgttattgtcgaagccgtacgtgagatgctgaaaaatcacccggccatcgaccagcgacaaaccttactggtttatttcaaccagtttgctgactcgtcattgaatattatggtttattgctttaccaaaaccacggtatgggctgagtggcttgctgcacagcaagacgtttatttgaagattatcgatattgtacagtcacacggcgcggactttgccttccccagccagacgctgtatatggataacattacaccgccggaacaggggcgctaa

SEQ ID NO: 44670 - protein, 343 aa, Shigella flexneri 2a str. 301
MIAELFTNNALNLVIIFGSCAALILMSFWFRRGNRKRKGFLFHAVQFLIYTIIISAVGSISNYVIENYKLKFITPGVIDFICTSLIAVILTIKLFLLINQFEKQQIKKGRDITSARIMSRIIKITIIVVLVLLYGEHFGMSLSGLLTFGGIGGLAVGMAGKDILSNFFSGIMLYFDRPFSIGDWIRSPDRNIEGTVAEIGWRITKITTFDNRPLYVPNSLFSSISVENPGRMTNRRITTTIGLRYEDAAKVGVIVEAVREMLKNHPAIDQRQTLLVYFNQFADSSLNIMVYCFTKTTVWAEWLAAQQDVYLKIIDIVQSHGADFAFPSQTLYMDNITPPEQGR

SEQ ID NO: 44671 - DNA, 1179 bp, Shewanella oneidensis MR-1
  CDS (1)..(1179)
atgctgcttgcttgtgtactggtggcggcaatctcctattttattatgcaccgtggggtgatccgcgcggtcaatatggtgatcctgcgctctagagtgacgtgggacgatgtatttatgcgctacaaagtgctcgaaaagttggcgatgttagtgcccgctatcgtgctcaatctgctggtgcctatcacgttaaccgaacatcccgtactcagcagtttagttgaccgcttactgagcatttggttggtgatcttgatgatccgcgctatctacgcggggctggatgccgtcaatgaaatctctgatatcaatgaggtgagtcgccgcctgccggttaaaagctttgtgcagttgtttaagttgttcctattctttgtcggccttatcgtttgcctttctgtgttggccgatcagtcccccgtgtacttcctcagcggacttggtgtagcaaccggttttgtgatgttagtgttccgcgacacgattttgggttttgtggcggggattcagttagcggcgaaccgtatggtaagcaagggcgactggatccaaatggataagtacggcgccgatggtgcggtggaggaggtgtccttaactacagttaaagtgcgtaactgggataagaccatcaccatgatccccgcctatgccctagtttcggatgcttttcgtaactggcgtggcatgtccgaatcgggcgggcgtcgtattaagcgtgcggtcaatatcgatattaatagcatcaaatttttaactgaaaatgatcggaagcgcctcagtaaaatcaattgcttaaaagagtatttccccgccaagatcagcgagatccaagcgtcgaacgccaaagtgtcagatctggatatgatggtcaatggtcgccatctgaccaacgtaggaaccttccgtgcctatctgcaggaatatctacagcgccacgataaagtgcacaaagatatgaccctaatggtacgccagctagcaccgaccaccgagggtctaccgattgaggtttatatctttaccaatgatacccgctgggctttttatgaggcgatacaagcggatatcttcgaccatatctttgccgtactgcctgagtttggtttacaggccttccaagcgccgacgggcaacgatatccgcagtctcaaatcggttaaggtcgagggttag

SEQ ID NO: 44672 - protein, 392 aa, Shewanella oneidensis MR-1
MLLACVLVAAISYFIMHRGVIRAVNMVILRSRVTWDDVFMRYKVLEKLAMLVPAIVLNLLVPITLTEHPVLSSLVDRLLSIWLVILMIRAIYAGLDAVNEISDINEVSRRLPVKSFVQLFKLFLFFVGLIVCLSVLADQSPVYFLSGLGVATGFVMLVFRDTILGFVAGIQLAANRMVSKGDWIQMDKYGADGAVEEVSLTTVKVRNWDKTITMIPAYALVSDAFRNWRGMSESGGRRIKRAVNIDINSIKFLTENDRKRLSKINCLKEYFPAKISEIQASNAKVSDLDMMVNGRHLTNVGTFRAYLQEYLQRHDKVHKDMTLMVRQLAPTTEGLPIEVYIFTNDTRWAFYEAIQADIFDHIFAVLPEFGLQAFQAPTGNDIRSLKSVKVEG

SEQ ID NO: 44673 - DNA, 1302 bp, Pseudomonas putida KT2440
  CDS (1)..(1302)
atggatatccaacgaatctggcgtgactccctcgacctgtggggcaccctcgaccaacatcccatgctgcacgccgccatcggtctggcggtactgctgctcatctccctggtagtcggccgcctggcgcgcttcctgatactgcacggcgcgcgcctgctggcccgccagcctgcactgaagtggctggacgacctgcgccacaacaaggtgttccaccgcctggcacaaacgaccccgtccctggtgctgcagttcggcctgaagctggtgcctgagctgtccgacaccgctcagcacttcctcggcaatgtcgccctggcctttaccctgttgttcatgaccatggcgctgtcatgcctgctggatgccctgctcgacatctatgcccgcaccgaacacgcccgcacccgctcgatcaagggctacgtgcaactggccaagatgatgttgtggatcttcgcctcgatcatcatcgtcgccaccctgatcgaccgctcgccgctgttgctgctgtccggtctgggtgcgatgtcggcggtattgctgttggtgtacaaggacaccctgctgtcattcgtcgccagcgtgcaactgaccagcaacgacatgctgcatgtcggggactggatcgaaatgccgcaggtaggcgccgatggcgacgtggtggacatcaccttgcacacggtgaaagtacagaacttcgacaagaccatcgtgtccatccccacctggcgcctgatgagcgagtcattccgcaattaccgcggcatgcagcagtccggtggccggcgcatcaagcgcagcctgttcatcgacgccgccggcgtgcgcttcctcacccgcgaagaagaacagcgcctgagccaggtgcagctactgagtgactacctggcgggcaagcgccaggaactgcaaaactggaacgaggcgctggggccggtggcggacctgtcggccaaccgccgcaagctgaccaacatcggcaccttccgcgcgtttgccctggcctatctgaagaaccatcccaacgtgcaccccaacatgacctgcatggtgcggcagatgcagaccaccgccgaaggcgtgccgctggagatctactgcttcaccaccaccacggtgtgggcggattacgagcgcatccagggggatatcttcgactacctgctggcggtgttgccggagttcggcttgagcctgtatcagcagccgagtggcaatgacatgcgcgtggggttggccgggcgtacggcggcggagccgatgccgcgacaccttgaagaaatgagcgaggcctga

SEQ ID NO: 44674 - protein, 433 aa, Pseudomonas putida KT2440
MDIQRIWRDSLDLWGTLDQHPMLHAAIGLAVLLLISLVVGRLARFLILHGARLLARQPALKWLDDLRHNKVFHRLAQTTPSLVLQFGLKLVPELSDTAQHFLGNVALAFTLLFMTMALSCLLDALLDIYARTEHARTRSIKGYVQLAKMMLWIFASIIIVATLIDRSPLLLLSGLGAMSAVLLLVYKDTLLSFVASVQLTSNDMLHVGDWIEMPQVGADGDVVDITLHTVKVQNFDKTIVSIPTWRLMSESFRNYRGMQQSGGRRIKRSLFIDAAGVRFLTREEEQRLSQVQLLSDYLAGKRQELQNWNEALGPVADLSANRRKLTNIGTFRAFALAYLKNHPNVHPNMTCMVRQMQTTAEGVPLEIYCFTTTTVWADYERIQGDIFDYLLAVLPEFGLSLYQQPSGNDMRVGLAGRTAAEPMPRHLEEMSEA

SEQ ID NO: 44675 - DNA, 1311 bp, Pseudomonas syringae pv. tomato str. DC3000
  CDS (1)..(1311)
atggatattcaatcgctttggcttcgtactcaggaactatggggcatgctcgaccagcatccgtgggtgcgcaccgggctggcgctgatcctgttgctgaccaccgcgctggtgctcggccgcgtggcgcgctttgtggtgctgtacaccgtcaggatgctcggtcgtcagccgtcgttgcactggatcaacgattttcgccataacaaggttttccaccgactggcgcaaatggtgccttcgctggttgtccagttcgggctcaacctggtgcccggcctgaccgccacgggcaagaacgtcatcggcaacctggccatggcgttcaccattctgttcatgaccctggccatcggcgcactgctcaacgccctgctggacatctacgcccgcaccgagcacgcccgcacccgctcgatcaaaggctacgtgcaactgtcgaagatgattctgtatgtgttcgccgcgatcatcatcgtcgccacactgatcgaccgttcgccgctgttgctgctgtccggcctcggcgccatgtcggcggtcattctgttggtctacaaagacaccctgctgtcgttcgtcgccagcgtacagctgaccagcaacgacatgctgcgcgtcggcgactggatcgaaatgccgcaagtgggcgccgatggcgacgtggtggacatcaccctgcataccgtgaaggtgcagaacttcgacaaaaccatcgtctccatcccgacctggcgcttgatgtccgagtcgttccgcaactggcgcggcatgcagcaatccggcggacggcgcatcaaacgcagcctattcatcgacgccagcggcgtgcgcttcgtacgcgacgatgaagaacaacaactcatgcaaatccacctgctcaccgactacatcggccgcaaacaagccgaactgctggcctggaacgaagcgcaaggcaacgtcgcccaaatgtccgccaaccgccgacgcatgaccaacatcggcaccttccgcgcctacgccctggcgtacctgaaaagccatgtggacatcaactccggcatgacctgcatggtccgccagctggagccgacttcgcagggcatcccgctggaaatctactgcttcacgcgtactacggtgtgggtggattacgagcggatacagggggatattttcgactatctgactacggtgatgccggagttcgggttgagtttgtatcagcagccgagtggggcggatatgcgggttgggttgcgggggcagtccgaccggggcgggaatgcgcagacggcagagacgtttcctacagaacgtcaaggctga

SEQ ID NO: 44676 - protein, 436 aa, Pseudomonas syringae pv. tomato str. DC3000
MDIQSLWLRTQELWGMLDQHPWVRTGLALILLLTTALVLGRVARFVVLYTVRMLGRQPSLHWINDFRHNKVFHRLAQMVPSLVVQFGLNLVPGLTATGKNVIGNLAMAFTILFMTLAIGALLNALLDIYARTEHARTRSIKGYVQLSKMILYVFAAIIIVATLIDRSPLLLLSGLGAMSAVILLVYKDTLLSFVASVQLTSNDMLRVGDWIEMPQVGADGDVVDITLHTVKVQNFDKTIVSIPTWRLMSESFRNWRGMQQSGGRRIKRSLFIDASGVRFVRDDEEQQLMQIHLLTDYIGRKQAELLAWNEAQGNVAQMSANRRRMTNIGTFRAYALAYLKSHVDINSGMTCMVRQLEPTSQGIPLEIYCFTRTTVWVDYERIQGDIFDYLTTVMPEFGLSLYQQPSGADMRVGLRGQSDRGGNAQTAETFPTERQG

SEQ ID NO: 44677 - DNA, 1098 bp, Vibrio parahaemolyticus RIMD 2210633
  CDS (1)..(1098)
atgtcacagtggtttaccgatttacaaaactatgtacaagcgcatagtcaggattggagcggaagtgttctttttatcacgttagccagttttatcgcatggatcgcttggcgagtgatccgttcacgtcttgcaattcttgtcgagaaaaccccttttcattgggataacatgttgcttgatgcgctcaaagcgccagtgagcacactcatttggtgttggcctgctacggtgtcactcggcatcattttagaaagcgaactgaatgacaagatcaattggctgagcacgctcaagctgattcttattatcagcgtcttcgtatggaccgtcatgcgactgatcaccaatatcgaagatttcgttctggaacagaaaaaccgagacgaaaccaccgttcaagccatcgcgaaagttgggcgcttattcatcatcactatcggcgtattaaccatcatgcaggcatttggcttgtctctgtctggtctgctgacgtttggtggtgtgggtggcttaatcgtaggtcttgctgcaaaagatttgctgtcgaacttcttcggtggtttgatgatttacttcgatcgtccattcaaagtaggcgattggattcgctctccagatcgtcaaatcgagggcaccgtagaacgcattggttggcgcatgaccagcatccgcacgtttgataaacgcccactttatgtgcctaactccgtgtttagcaacatcgtggttgaaaacccttcccgaatgctaaaccgtcgaatctacgaagtggtgggcttgcgttacgatgatgccgacaaagtgccagaaatcatcaccgcagtgcgcgaaatgttaaagaatcacaaagatatcgatacgcgccaaaccttgattgtgaactttgatacctttggcccatcatcgttgaacttctttatctacaccttcacgaaaaccgtgaactgggtgagataccacgaagtgaaacaagacgtcttattgaaagtcgtcggcatcattaaagagcacaacgcagatatcgcgttcccaactcaaacactgaagctcgacccgattcaaatggcgaaaaaccaagaagacagcggtttttaa

SEQ ID NO: 44678 - protein, 365 aa, Vibrio parahaemolyticus RIMD 2210633
MSQWFTDLQNYVQAHSQDWSGSVLFITLASFIAWIAWRVIRSRLAILVEKTPFHWDNMLLDALKAPVSTLIWCWPATVSLGIILESELNDKINWLSTLKLILIISVFVWTVMRLITNIEDFVLEQKNRDETTVQAIAKVGRLFIITIGVLTIMQAFGLSLSGLLTFGGVGGLIVGLAAKDLLSNFFGGLMIYFDRPFKVGDWIRSPDRQIEGTVERIGWRMTSIRTFDKRPLYVPNSVFSNIVVENPSRMLNRRIYEVVGLRYDDADKVPEIITAVREMLKNHKDIDTRQTLIVNFDTFGPSSLNFFIYTFTKTVNWVRYHEVKQDVLLKVVGIIKEHNADIAFPTQTLKLDPIQMAKNQEDSGF

SEQ ID NO: 44679 - DNA, 1176 bp, Bacteroides thetaiotaomicron VPI-5482
  CDS (1)..(1176)
atgttagtagtcgatttaggaaaatggatgaacaaaatcctgatagattgggggatagatgcgaaggttgccgatcgttttgatgaaacaattattgctatactgatgatagccattgctgtaggggtggactatctttgtcaggcaattctagtgggaggaatgaggcagtatacccgcaggaaaccgcatctttggaatacattgctgatgaaacgtaaagtgtttcataatctgattcatacgattcccgccatccttgtctatgccctgttgccgatggctttcatgcgtggcaaggaactgctggttatttcgcagaaggcttgtgccatttatatcatcttttctttgctgctggctatcaatgggattctgctgatgatcatggatatttacgatggaaaggagacaatgaagaaccggccgatgaaaggattcattcaagtacttcaggtacttttgttttttatcggggggattgtgattatctctatccttgtaaataaatcgcctgccagtctgtttgcgggactgggtgcttcggcagccatcctgatgctggtattcaaggattccattttgggatttgtggcaggtattcagctttctgccaatgatatggtgcgtccgggagactggatcacgcttccttccggtgccgcgaatggtacggtgcaggagattacgcttaacacggtcaagattcagaactttgataatacgatttctacggttccgccttatacgctggttagcagtccttttcagaactggcgtggcatgaaggattccggtgggcggcgggtgatgaagaatattacactggacctgacgacactccagttttgtacgccggagatgctcgaccgttatcggaaagagattccactcatggcggattatcagccggaggaaggagtggtgcccaccaattcacaggtttaccgggtgtatatcgagcggtatctttgcagtctgccggtggtgaatcaggatttggatttgattatcagtcagaaagaggctaccatgtacggagttcctattcaggtttatttcttttcccgcaataaggtgtggaaagagtacgagcggattcagtcggatatcttcgaccatttgctggcgatggtgccgaagttcgacttgaaggtataccagtattctgactaa

SEQ ID NO: 44680 - protein, 391 aa, Bacteroides thetaiotaomicron VPI-5482
MLVVDLGKWMNKILIDWGIDAKVADRFDETIIAILMIAIAVGVDYLCQAILVGGMRQYTRRKPHLWNTLLMKRKVFHNLIHTIPAILVYALLPMAFMRGKELLVISQKACAIYIIFSLLLAINGILLMIMDIYDGKETMKNRPMKGFIQVLQVLLFFIGGIVIISILVNKSPASLFAGLGASAAILMLVFKDSILGFVAGIQLSANDMVRPGDWITLPSGAANGTVQEITLNTVKIQNFDNTISTVPPYTLVSSPFQNWRGMKDSGGRRVMKNITLDLTTLQFCTPEMLDRYRKEIPLMADYQPEEGVVPTNSQVYRVYIERYLCSLPVVNQDLDLIISQKEATMYGVPIQVYFFSRNKVWKEYERIQSDIFDHLLAMVPKFDLKVYQYSD

SEQ ID NO: 44681 - DNA, 1332 bp, Bacteroides thetaiotaomicron VPI-5482
  CDS (1)..(1332)
atgaaagaagtgattgatacagtgagtgtggcattggcaaatggagatacggagaatgttggcaatgtcgtgatgcaggaggtcaaccgtacgttgctctcggcaggtgtggatgaagtatgggcggacaaaatagataatctgatcgtattgctgtttattatcggaatagccttgttggctaacataatctgccgtaaaatcattttacgggtggtagccaagttggtgaagcagaccaaagctacctgggacgacattgtattcaaccataaagtgatggtgaatgtcagccggatggtagcgcctatcctgatttatatcgccattcctatcgcattccccgagcatgcggattctgatttgctcgattttctgaggcgtctctgtctgatatatatcattgccgtttttcttcgtttcatcagcgctttgtttacggctgtctatcaagtctacagtgagcgggagcagtatcgggacaaaccgttgaaaggacttttgcagacggcgcaagtgattcttttctttataggagccatcattattataagcattctgatcaatcagagcccgatggtcttgctgaccggattgggagcgtctgccgctattctgatgttggttttcaaagatagtatcatgggatttgtatccggtattcagctttctgccaacaatatgctgaaggtgggcgactggatcaccatgccgaaatatggtgcggacggtacagtgatagaagtaacgctgaataccgtgaaggtgcgtaatttcgataatacgattacgaccattcctccttacctgctgatcagcgattcttttcagaactggcagggaatgcaggagtccggcggacgccgggtgaagcgttccattaatatcgatatgacaagcgtgcgcttttgtactcccgaaatgctggaaaaatatcgcaagatacagttgctggcaaattacgtagatgaaacggagaaagtggtagaagaatataataaggagcatgatattgataattccgtgttggtgaacgggcggaggcagaccaatctgggagtttttcgtgcctatctgaccaattatttgcgaagcctgcccactgttaatcaggatatgacctgtatggtacgccagcttcagcctacagaaaccggcattccgctggaactttatttcttttctgccaacaaagtatgggttgcttacgaaggcatacaggcagacgtgttcgaccatgtacttgccatcattccggagttcggcctgcgcgtctttcagaatccgtcgggtgaagacctgcgacggataggagtgaagatagaacactga

SEQ ID NO: 44682 - protein, 443 aa, Bacteroides thetaiotaomicron VPI-5482
MKEVIDTVSVALANGDTENVGNVVMQEVNRTLLSAGVDEVWADKIDNLIVLLFIIGIALLANIICRKIILRVVAKLVKQTKATWDDIVFNHKVMVNVSRMVAPILIYIAIPIAFPEHADSDLLDFLRRLCLIYIIAVFLRFISALFTAVYQVYSEREQYRDKPLKGLLQTAQVILFFIGAIIIISILINQSPMVLLTGLGASAAILMLVFKDSIMGFVSGIQLSANNMLKVGDWITMPKYGADGTVIEVTLNTVKVRNFDNTITTIPPYLLISDSFQNWQGMQESGGRRVKRSINIDMTSVRFCTPEMLEKYRKIQLLANYVDETEKVVEEYNKEHDIDNSVLVNGRRQTNLGVFRAYLTNYLRSLPTVNQDMTCMVRQLQPTETGIPLELYFFSANKVWVAYEGIQADVFDHVLAIIPEFGLRVFQNPSGEDLRRIGVKIEH

SEQ ID NO: 44683 - DNA, 1152 bp, Coxiella burnetii RSA 493
  CDS (1)..(1152)
gtgagtccgttattaaatacccataattccattattaaaatcgtccttcttcttattatcggcagcattgccagctttttagaatggttgctttaccgtcgattattgcctcgattccagcgacggcagcgggtttggttgcaagcttttttacaagcgctgcatcaaccgttgcaggtttacatctgggtcatcattcttagttttgtcgcttctatcctggcaacattattttttttcaacggcggttttacggatgccttatcctcaacccgtctgattttcactttggttgttattttttggtttgccatgcggtttattcgctatctagaagatggaatgacgcatcaagcccgtcaaaaagtgggtaaggttagcgatgaaactagcgtacatgccatcgcccaactaacgcgcgtcgttattattgccttcgttttgttaatgttattgcaaacgatcggtattaagatatcggcgttattagcttttggtggcgtgggcgtggctgttattggttttgcagcaaaggatacgttgggtaatttttttggcggcatgatgatttactgggatcgccccttttccgtgggagattggattcgatcgcccgatcgacaaatcgaaggcactgtcgaaaacattggctggcgattgacgcgaattcggacatttgataagcgctcgctttatgttcctaatggaattttatccaatgtggctgttgaaaacccttcacgaatgacaaatcgacgtctcaaaattattgtcggcgtgcgttattcggacgccagcaaaattatggatttagccaaagcgattgaagaaatgttgcgaaacgatcctgaaattgatgtaacccaaactttatttgttaatttattcgagttcgccccttcttcgttaaatatgatggtgtacactttcacaaaaacaacggagtgggtaaagtttcaagccattcagcaaaaaataatgttaaaaattataaatatcattaccacttatggcgctgagtgtgctttccctacgcaaacaattcacgtcccggaagggttattagtaaaaaaagaaaaaggagaaaatgataatgaatatgctgatcgaggcaacgaaaaagagcgacgaggttcagatgattttacctga

SEQ ID NO: 44684 - protein, 383 aa, Coxiella burnetii RSA 493
MSPLLNTHNSIIKIVLLLIIGSIASFLEWLLYRRLLPRFQRRQRVWLQAFLQALHQPLQVYIWVIILSFVASILATLFFFNGGFTDALSSTRLIFTLVVIFWFAMRFIRYLEDGMTHQARQKVGKVSDETSVHAIAQLTRVVIIAFVLLMLLQTIGIKISALLAFGGVGVAVIGFAAKDTLGNFFGGMMIYWDRPFSVGDWIRSPDRQIEGTVENIGWRLTRIRTFDKRSLYVPNGILSNVAVENPSRMTNRRLKIIVGVRYSDASKIMDLAKAIEEMLRNDPEIDVTQTLFVNLFEFAPSSLNMMVYTFTKTTEWVKFQAIQQKIMLKIINIITTYGAECAFPTQTIHVPEGLLVKKEKGENDNEYADRGNEKERRGSDDFT

SEQ ID NO: 44685 - DNA, 1347 bp, Bordetella bronchiseptica RB50
  CDS (1)..(1347)
gtgctgccgaaggaattggagaacgtggtcgccacgctggacaactatgtgccggacacggcatggggccagacgctggtcggcatcggcgtgctggtgctgacggcgctgttcgtccaatgggtggtggcgcgcgtcgtgctgtatttcgcccaccggctgctggtgctgagcggccgcgaggactgggaccgcgccctgagccgccgccgcgcctaccagaacttctggtacgcggtgccgttcgcggtggtctccatgggcatagaactggtgccgcatgccgagcgcgcggtcaccgtcgtgggccggctgtcgcacgccggggcctggatctgcgtgttcgtggccttcagcggcgtgctcagcgcctggcaggatacctattcggccaccacgcgggcgcagacgcgctcgatcaagggctatatccagatcggcaagctgatcctgtgcgcggtgggggcggtgctggtgctctccatcctgctggaccgctcgccgctgtggatgatctccggcctgggcgcgctgtcggcggtgctgctgctggtgttcaaggacacgctgctgtcgctggtggccagcacccagctcacgtccaacgacatgctgcgcatcggcgactggatcgagatgccgcaggccaacgccgacggcttcgtcaaggacatcgcgctgcataccgtcaaggtgcagaactgggacaacacggtgaccaccgtgcccacctacaagctgttttccgaaagctaccgcaactaccgccacatgttcgagtcgggcgggcggcgcatcaagcgcaccttgcggctggacgcggccagcgtgcgcttcatgaacgaggaagagggcggacggctcaagcgcttcgtgctgctgcgcgactacctgcaggccaaggaggacgcgctgctggaggccaaccgccaactgggcgaactggccgaggtgccggccaaccgccgccgcctgaccaacatcggcaccttccgcggctatgcgctggcctacctgcgccagcaccccgaggtgcgccaggacatggccatgatggtgcgcatgatggagccgcagcccaacggcatcccgatcgagatctattgcttcacggccatcaccgcctgggtcgagtacgagcgcatccagggcgacatcttcgaccatctgctggccatcctgcccgagctggggctgcggctgttccaggagccctccggctcggacctgggcaacctggccggcggcatgcgcgaggcggccctgcacgagttccggcgcgagcaggtggccgcgggcgaggcgccgctggcgctgcgcggcgacggcgccgcgcccgtgcgataa

SEQ ID NO: 44686 - protein, 448 aa, Bordetella bronchiseptica RB50
MLPKELENVVATLDNYVPDTAWGQTLVGIGVLVLTALFVQWVVARVVLYFAHRLLVLSGREDWDRALSRRRAYQNFWYAVPFAVVSMGIELVPHAERAVTVVGRLSHAGAWICVFVAFSGVLSAWQDTYSATTRAQTRSIKGYIQIGKLILCAVGAVLVLSILLDRSPLWMISGLGALSAVLLLVFKDTLLSLVASTQLTSNDMLRIGDWIEMPQANADGFVKDIALHTVKVQNWDNTVTTVPTYKLFSESYRNYRHMFESGGRRIKRTLRLDAASVRFMNEEEGGRLKRFVLLRDYLQAKEDALLEANRQLGELAEVPANRRRLTNIGTFRGYALAYLRQHPEVRQDMAMMVRMMEPQPNGIPIEIYCFTAITAWVEYERIQGDIFDHLLAILPELGLRLFQEPSGSDLGNLAGGMREAALHEFRREQVAAGEAPLALRGDGAAPVR

SEQ ID NO: 44687 - DNA, 1104 bp, Vibrio vulnificus YJ016
  CDS (1)..(1104)
atgaatgattggttaattgagctgcaacgggcactctttagtaatcacaaggattggttcggcagtgtcctgtttattacaggttgcagcgccatcgcatggatcgtctggcgcgtcgtcgcatcgcgcttgcatcagttggcagagaaaacccgacttcactgggatgatcttctactagaagcttttagaacccctatcagcacttttatctggctttggccaggaaccatctctcttggcattatcgtccaaagccaaaccggccaaagcttagcttggcttggcactgcgaaactcatcatggtgatttcgctgctggtttggattgtcatgcgctttgtcaatcgcgcagaagagtatgttttggcggctcaaagctacgacgagaccacagtgcaagccactgctaaggtggcgaggttatttattcttaccatcggcacgctgaccatgatgcaggtgtttggcctgagtttgtctggcttgttaaccttcggtggcgtgggtggtttgatcgtcggtttagcggccaaagaccttctttcaaacttctttggtggtttgatgatctactttgaccgtccattcaaagtgggggattgggtacgctctccggatcgccaaattgaaggcaccgttgagcgcatcggttggcggatgaccattattcgcacttttgataaacgccctctgtatgtaccaaattcggtgtttagcaatattgtggtggaaaacccttcgcgcatgctcaatcgtcgtatttacgaaaccattggtgtccgttatgacgattgcaataagctacctcacatcattgagcaagtgcgcgagatgctgaaacatcaccccgatatcgatgccgaacagaccttgatcgtgaactttaacagctttggttcttcgtcacttaacttcttcgtctacaccttcaccaaaacagtgaactgggtggaataccacggtgtgaagcaagatgtgctactcaaagtgatggagattgttcaaaaaaatggggcggatattgccttcccgactcaaacattgaagtttgaccccgttcaagccgggctggtggaatccaatcgctctcaatcggagtaa

SEQ ID NO: 44688 - protein, 367 aa, Vibrio vulnificus YJ016
MNDWLIELQRALFSNHKDWFGSVLFITGCSAIAWIVWRVVASRLHQLAEKTRLHWDDLLLEAFRTPISTFIWLWPGTISLGIIVQSQTGQSLAWLGTAKLIMVISLLVWIVMRFVNRAEEYVLAAQSYDETTVQATAKVARLFILTIGTLTMMQVFGLSLSGLLTFGGVGGLIVGLAAKDLLSNFFGGLMIYFDRPFKVGDWVRSPDRQIEGTVERIGWRMTIIRTFDKRPLYVPNSVFSNIVVENPSRMLNRRIYETIGVRYDDCNKLPHIIEQVREMLKHHPDIDAEQTLIVNFNSFGSSSLNFFVYTFTKTVNWVEYHGVKQDVLLKVMEIVQKNGADIAFPTQTLKFDPVQAGLVESNRSQSE

SEQ ID NO: 44689 - DNA, 1863 bp, Rhodopseudomonas palustris CGA009
  CDS (1)..(1863)
gtgttgctggtcacccgagaccacagagatggcccatttcgtgattatcggtgcggccgaagcattttgccccgggattgcagggcgccgccggagagggtggagcccaagtggacgattcgtcctgatcctgcgcccgtccgttcaagaggagcgattttgacgtcatctgcacgcgcgttgtttcgagccctgatcctggtcgcgaccatgacccttgtggtcgcgagttctgccttcgcccagatccccggtaccaacggcaacggagcggcacccgcacaaccggcggcgccgaccgacccgcttggccgcgagacgccggccggcatggtggcaggcttcatcgccgccgccgccgagcagaactacgaacgcgccgcgatgtatctcgacctcagccaggaaaaagacgcctggggcccgagcgtcgcacagcagctccagcgcatcctcgaccgtggcggcgtggtgttttcgcggctgcggctgagcaccgaaccgcagggcgaccaggatgacagcctgccgcccgagcaagagaagttcggcatggtgcgcaccgaccacggtacggtggatctgatcgcgcagcgcgtcgaaggcaaggacggcgtcaagatctggctggtttccgcccgcacggtttccgaactgcctgagctgtcccgtaccgtggtgtcgagctcggtcgacaagctcctgccctatgcgctgcgcgacgaatatcgcttcgccggcgtaccgatcggccactggatcgcggtgatcgtgctggcgttcgtgtgcttcggcgcggtctggctgatcaccggcgcgatcggcttcatcatcctcaggttgcggcgctcgaccggcgactcgcggatcaggcgcgtgctcgaagcctcggcgctgccggtgcggctgttgcttaccgcctgggcgctgcggatcgcgatgacgctcgccggcgtcgccatcgtggcgcggcagcatctgtccggcgccatcgaactgctcggctgggtcgcgctgtcgtggatcatttggcgggtcgtggactcgctggcggcgttcgcgatcgatcgcatgacgttgcgcggccggctgtcgatgctgtcggcggtcaccttcatccgccgcagcgtcaagttcgtgatcatcgcgtttgcgatcatcgtcggcttcaacgctctcggctacaacgtcaccgccggcctcgccgccctcggcatcggcggtatcgcgatcgctctgggtgcgcagaagaccatcgaacatctggtcggcagcctgactctggtcaccgaccagccgatgcgggtcggcgatttctgcaagttcggcgacacttccggcaccatcgaggacatcgggatgcgatcgacccgtgttcgcaccctcgatcgcaccgtcgtgacggtgccgaacggcgcgcttgcggcgctgcagatcgaaaatttcagccgccgcgacaagttctggtttcacccgattctggagctgcgttacgagacctcctccgagcagatccgcacgttgctgacgtcgctgcgggaaatgctgctcgaccatccggacgtcgataacgatccggcacgggtgcggttgatcgggctggctccggccgccctcaaggtcgagatcttcgcctatgtgcacgcggtcgacggcgacaccttcctggaagtgcaggaagatctgatgctgaagatcctggagctggtcgaagcggccgggacaggctttgcagccggctcgcagactgtctatgtggcgcgcgccaaaggcgccgcccagcggcagggcggcgacgaagatgcgccgggcaccggatcggacggtgccaaggtgaggggcgggatcccggagcgggtctag

SEQ ID NO: 44690 - protein, 620 aa, Rhodopseudomonas palustris CGA009
MLLVTRDHRDGPFRDYRCGRSILPRDCRAPPERVEPKWTIRPDPAPVRSRGAILTSSARALFRALILVATMTLVVASSAFAQIPGTNGNGAAPAQPAAPTDPLGRETPAGMVAGFIAAAAEQNYERAAMYLDLSQEKDAWGPSVAQQLQRILDRGGVVFSRLRLSTEPQGDQDDSLPPEQEKFGMVRTDHGTVDLIAQRVEGKDGVKIWLVSARTVSELPELSRTVVSSSVDKLLPYALRDEYRFAGVPIGHWIAVIVLAFVCFGAVWLITGAIGFIILRLRRSTGDSRIRRVLEASALPVRLLLTAWALRIAMTLAGVAIVARQHLSGAIELLGWVALSWIIWRVVDSLAAFAIDRMTLRGRLSMLSAVTFIRRSVKFVIIAFAIIVGFNALGYNVTAGLAALGIGGIAIALGAQKTIEHLVGSLTLVTDQPMRVGDFCKFGDTSGTIEDIGMRSTRVRTLDRTVVTVPNGALAALQIENFSRRDKFWFHPILELRYETSSEQIRTLLTSLREMLLDHPDVDNDPARVRLIGLAPAALKVEIFAYVHAVDGDTFLEVQEDLMLKILELVEAAGTGFAAGSQTVYVARAKGAAQRQGGDEDAPGTGSDGAKVRGGIPERV

SEQ ID NO: 44691 - DNA, 1221 bp, Treponema denticola ATCC 35405
  CDS (1)..(1221)
atgcaaaatttattgggtaatgttcaaaaatggctttcggaagattctgtgagaggcgatattttttggctgtttgccgttttgattgtttcttttattcttcataaagtgttaaaaaaaatactgtcaggaacggtaaaaaaaatactgtcccgcattacagccaaaacgaagagtaaacttgatgattatatttttgataaaattcatatagaacgtgcttcgcttattatatatatttttgcctttaattttttgtcgctaaaattaagttttggagccgggcttatgcaaaaacttgcaagccttatttcgatatggataataataagacttttgcacggcctcttggacgggcttacagcctataccgaaaatgaacctcgatttgcgggaaagccataccgcagttatgttcaggtttttatcttaattgtttatattgcaggctttatcatcgctgcaggaacaatcagcggaaagtccccatggtctcttttaagcggaataggagctatgacggctgttcttcttttggtattccgcgagacgattctttcttttgtggcaagcctccagatttcttcctacgatttggttcgccgcggggactggatttcggttcctaaatatgatgccgacggagatgttaccgaggtcgccttacatacgataaaaattcaaaactgggataagactatttccgttttaccgacaagcgacctaatgcaaagcggttttaaaaactggcggggtatgcaggaaaccggaggaagacgcatcaagcgttcaatctttttggacgtttcttccgtaaaatttatggatgaagaactgagacgcagggtagggaagatagagcttttaaaatcctactttgccgaagttgaaagttccgacataagtgcccaatacggcagcgatacggaacatcccttaaacgatagaaggctcaccaatatcggaacctttaggatgtacgttacgcgctatcttcaaagccttgatactttaagaaaggatttgacatttttggtgcggcagcttgaaccgggagctacaggcgttcccatggagatttatgtttttactgcaaccaccgactggggagaatacgaaaagatccaagccgatatttttgaccatctttttgcgtccgtccacgaattcgatcttagaattttccaatatcctgtaggcggctttttaccaaacaagtaa

SEQ ID NO: 44692 - protein, 406 aa, Treponema denticola ATCC 35405
MQNLLGNVQKWLSEDSVRGDIFWLFAVLIVSFILHKVLKKILSGTVKKILSRITAKTKSKLDDYIFDKIHIERASLIIYIFAFNFLSLKLSFGAGLMQKLASLISIWIIIRLLHGLLDGLTAYTENEPRFAGKPYRSYVQVFILIVYIAGFIIAAGTISGKSPWSLLSGIGAMTAVLLLVFRETILSFVASLQISSYDLVRRGDWISVPKYDADGDVTEVALHTIKIQNWDKTISVLPTSDLMQSGFKNWRGMQETGGRRIKRSIFLDVSSVKFMDEELRRRVGKIELLKSYFAEVESSDISAQYGSDTEHPLNDRRLTNIGTFRMYVTRYLQSLDTLRKDLTFLVRQLEPGATGVPMEIYVFTATTDWGEYEKIQADIFDHLFASVHEFDLRIFQYPVGGFLPNK

SEQ ID NO: 44693 - DNA, 1218 bp, Bartonella henselae str. Houston-1
  CDS (1)..(1218)
gtgataaaatttcttgttcaatatccatggttagagacgatttcttggctgattattcttattcttattgcacttttcattaattttttagcacgaaaatcactcattcacggagtaaaaactcttggttcttttcttcccaagaagacaactaatgatattagaaacgccattcaattcatggctaatattgtttcagcctttatgctttcaattggtgttaattttatacctacattgcccaaaacattcagcaccatcatcagcaatgttgctaacgccttaatcattttttttgttgtcctcacaatttctgctcttctcaatgtcattaataccctttacgaacaaagaccagcagcacgggtaaaaccaataaaaggttacattcaaatcgcgaaaattgcactttttactgtcgcagttgttttaatgatagccaccttgattgaccgctcacctcttattctcttctctggtcttggtgcaatggcagctgtcctcatgttgatttttcaagatacgctgctttctctcgttgcaggcatccaaatttcatctaccgatatgatacgtgtcggcgattggattgaagttcccaatctcggtgcagatggtgatgtcattgaaattgctcttcacactgtcaaagttcaaaatttcgataacacaatcacttcagtgcctatccgtaaactcgtgaccgatccatttaagaattggcgtggaatgcaagaagcaggtggacgacgcatcaaacgttctctcttcattgaccaatcaagcatccgctttcacacagaaaaagaacaaaagtatctttctcgttttaatttgttagaagattattttacacaaaaaataccagaaattacagaatggaacgctcgattagaaaaaaatcatgatgttttagccaacactcgccgtttaactaacattgggactttccgtgcttatattgttgcttacctacagaaaaatcaaagcatcgcacaaaatatgacacttatggcacgacaattacctccaacagaaaatggtttacctttggaaatctattgctttaccaacacaacagtttggttggaatatgaacaaattcaatgtgatatttttgaccacctctattccattcttcctaattttggtctaaagatttttcaaaatccaagcggctatgattttaatcatttattagaaaagaaagcaaagtaa

SEQ ID NO: 44694 - protein, 405 aa, Bartonella henselae str. Houston-1
MIKFLVQYPWLETISWLIILILIALFINFLARKSLIHGVKTLGSFLPKKTTNDIRNAIQFMANIVSAFMLSIGVNFIPTLPKTFSTIISNVANALIIFFVVLTISALLNVINTLYEQRPAARVKPIKGYIQIAKIALFTVAVVLMIATLIDRSPLILFSGLGAMAAVLMLIFQDTLLSLVAGIQISSTDMIRVGDWIEVPNLGADGDVIEIALHTVKVQNFDNTITSVPIRKLVTDPFKNWRGMQEAGGRRIKRSLFIDQSSIRFHTEKEQKYLSRFNLLEDYFTQKIPEITEWNARLEKNHDVLANTRRLTNIGTFRAYIVAYLQKNQSIAQNMTLMARQLPPTENGLPLEIYCFTNTTVWLEYEQIQCDIFDHLYSILPNFGLKIFQNPSGYDFNHLLEKKAK

SEQ ID NO: 44695 - DNA, 1281 bp, Acinetobacter sp. ADP1
  CDS (1)..(1281)
atgaaaggtgtagaggttttggattttttaaaattcattcatgatgtggaaagatggattgaccaatatccatggcttgagatgctcacttccctatctattttaattttattggcgattttagctaatttcatagcaaagcaaatcgttgtacggggaatacgaaaagcaattagtaagattaagttcttaaaccagtctatttttgctcaacatagtgtcatcaaacgaatcgcaaatattgttcctgcgattgtcattatgaatggtattactaccgttccacatttatctgaaaaatttattatttttacccaaatgggtgctcaggcatttatcttcttaaccattgccctagcaattagtgaatttctcaatatttttaatctggtttaccaacgaaatccaaattctaaaaacaaaccgattaagggctatttacagcttgttaagctgatgatttttattgtctgcgctttaatggtattgggtactttcctgaaaaaggatgtctttaccttactggcaggttttggtgcgatggccacagttctaatgttggtgtttcaaaataccatattatcgttggtggccagcgtacaaatttcatcctatgacatggtacgtataggtgattggattgaaatgccttcactgaatgcagatggcgatgtcattgatatgtcattacataccgtcactgtacaaaatttcgataagacttttaccactatcccaaccaataagctcattaccgatacctttaaaaattggcgtggcatgagtcaagcgggttgcagacgtattaaacgctctttatttattgatcaaagcagtgttcattttatgtctgaaactgagcaggaaaagttgaaaaatttcattcttttgaatcagtatcttgatcttaaaaaatcagaaatcacctcgtttaatcatcaattaagtaatcaatctttatacaatcagcgccgtctgactaatttaggaacgtttcgtgcttacattgagttttatttgagacaacatagtggaattgcacaaaatcaatcgcttatggttcgtcagttgcagcctacaagcgaaggtttacccttagaaatctacgcatttaccaataccacagcatgggtcgcctatgaggctattcaatctgatatttttgatcatttattggcaattattccagagtttggactaaaaatttaccaagcaccctctggggcagattttaaattattatctagttcgattgtctcagaagaaaatacaaatttataa

SEQ ID NO: 44696 - protein, 426 aa, Acinetobacter sp. ADP1
MKGVEVLDFLKFIHDVERWIDQYPWLEMLTSLSILILLAILANFIAKQIVVRGIRKAISKIKFLNQSIFAQHSVIKRIANIVPAIVIMNGITTVPHLSEKFIIFTQMGAQAFIFLTIALAISEFLNIFNLVYQRNPNSKNKPIKGYLQLVKLMIFIVCALMVLGTFLKKDVFTLLAGFGAMATVLMLVFQNTILSLVASVQISSYDMVRIGDWIEMPSLNADGDVIDMSLHTVTVQNFDKTFTTIPTNKLITDTFKNWRGMSQAGCRRIKRSLFIDQSSVHFMSETEQEKLKNFILLNQYLDLKKSEITSFNHQLSNQSLYNQRRLTNLGTFRAYIEFYLRQHSGIAQNQSLMVRQLQPTSEGLPLEIYAFTNTTAWVAYEAIQSDIFDHLLAIIPEFGLKIYQAPSGADFKLLSSSIVSEENTNL

SEQ ID NO: 44697 - DNA, 1275 bp, Erwinia carotovora subsp. atroseptica SCRI1043
  CDS (1)..(1275)
atgcaacaaaacctcgagctgtggttgagagaagcagatatacaacacgctggcatcattgcattactgattgttcttggactgatattgctcatttctgccgtcattcacctgattctgcatcaggttgtgctgaaaagaatggttctgcgctcactcaataaaccaggaaagacagaaggccacgggtggaagcaggctctgacgcaacacaacttgtttaatcggctggccttcttgctacaaggggtgatcctcaatattcaagtctttgtgtggcttcccgcgcaaagtgaaacccgtgaagcgctcatcatctgctcccaagtgtggattatgatttttgcgctgctgtctctcttctcgctactcgatgtgctgctcaatgtctccgcccggaccaaagtcgcggcacagttgccgctgcgcggtatcttccagagcctgaaactgatcgccactatcgtcattagcatcatggtggtgtcattgctcatcgggaaatcaccgctgattctgattagtggtttaggtgcgatggccgccgtactgatgttggtgttcaaagatccgatcatggggctagtcgctggcatccagctttccgccaacgatatgctgacgctgggagactggctcgaaatgccgaaatacggcgctgacggtgccgtcatcgacatcgggctgacgacggtaaaagtgaaaaactgggacaataccgtcaccaccattcccacttactcactggtgtccgattccttcaaaaactggcgttcgatgtcggaatctggtggacgacgcatcaagcgcagcatcaatatcgataccaccagtgtgcatttcatgacggaagacgaacagtcgcgattgctgcgcagcaagctactgtcagcttatattcagaacaagaagagcgagttagagcagcacaattcgcaatccgattctgacctgacatcaccgctgaacggccgtcgtctgacgaatttgggtacgttccgtgcctaccttcaggtttacctgcgcacccatccagggattcataaagggatgacgctgatggtgcgacaacttgaaccaacgtctgaaggggtaccgctggaaatttacgcgtttaccaacaccaccgcctgggttgattacgaaagcatacaatctgacattttcgaccatatctttgcgatcttaccggagttcgatctccgcattcaccaagctccgaccggccacgatatgcggataatggcgcggcaaatgaccgttccgaaagcatag

SEQ ID NO: 44698 - protein, 424 aa, Erwinia carotovora subsp. atroseptica SCRI1043
MQQNLELWLREADIQHAGIIALLIVLGLILLISAVIHLILHQVVLKRMVLRSLNKPGKTEGHGWKQALTQHNLFNRLAFLLQGVILNIQVFVWLPAQSETREALIICSQVWIMIFALLSLFSLLDVLLNVSARTKVAAQLPLRGIFQSLKLIATIVISIMVVSLLIGKSPLILISGLGAMAAVLMLVFKDPIMGLVAGIQLSANDMLTLGDWLEMPKYGADGAVIDIGLTTVKVKNWDNTVTTIPTYSLVSDSFKNWRSMSESGGRRIKRSINIDTTSVHFMTEDEQSRLLRSKLLSAYIQNKKSELEQHNSQSDSDLTSPLNGRRLTNLGTFRAYLQVYLRTHPGIHKGMTLMVRQLEPTSEGVPLEIYAFTNTTAWVDYESIQSDIFDHIFAILPEFDLRIHQAPTGHDMRIMARQMTVPKA

SEQ ID NO: 44699 - DNA, 1251 bp, Desulfotalea psychrophila LSv54
  CDS (1)..(1251)
atgcttaatattgttatgagctggattcaggtagttgttttggatgagggagtggctaagagtatcgctactgttcttcttcttctggccctttccttggttgctgtggcggcaaattacctgagcaaaaaaattatttctaattatgtcagcaaaattgttaataggacgaagtatcgctgggatagtattatgtataagaggggcgtcttccgccgcttgtctcatctggtgccaattgttattatcagcattggttcaaaactgctcttccctgcggaggactattcaggtcttttgctttttatctataagattaatttcctctactttattctgacctgtgcccttatcgtccatggccttctcgccgctgtggttgatatctatcagacatataagatggctaggttacggccaattaatagctatatccaggtcttgcaaatcattgtctgggtcttggccgccgtagcctctgtctcggttgttctggacagggcccttggggggctttttcttggcatgggtggaatgatggccattattcttttggtctttaaggattctatccttggccttgtggctggggtgcagattacggcaaacgatatgttgcgtctcgatgattggctggatatgcccagtcgcggtgccaacggtgatgttgttgagataaacttgaataccgttaaggtgagaaactgggataaaaccatcactaccattcccacccatcttttgaccagtgaatcgtttattaactggcggggaatgactgagtcgggcgggcgccggattaagcgctccatctccatagatatgaacactattaagttttcttcagagcaggagctggaggcctttatgaaggttgatcttctgcaggactatatggggcaaaagcttaaagagatgaagatgagcctggaagcggacaatgtcgatctggatgccctggccgatgggaaaagccttaccaatattggtaccttcagggcctatctggaggcctatctgcatgcccatcccaaggttcatcaggacatgacctttttggtgagacatcttgatccgggagccccgggcttgcccattgagatttatgttttcagtaatgatcaggagtgggcaaattacgaggccattcaggcagagatctttgagcatgtcctctcggtcatgccgacctttggtttgagggtgtttcaaaatccaacgggagccgatttcgaaaagatcgtgcgttaa

SEQ ID NO: 44700 - protein, 416 aa, Desulfotalea psychrophila LSv54
MLNIVMSWIQVVVLDEGVAKSIATVLLLLALSLVAVAANYLSKKIISNYVSKIVNRTKYRWDSIMYKRGVFRRLSHLVPIVIISIGSKLLFPAEDYSGLLLFIYKINFLYFILTCALIVHGLLAAVVDIYQTYKMARLRPINSYIQVLQIIVWVLAAVASVSVVLDRALGGLFLGMGGMMAIILLVFKDSILGLVAGVQITANDMLRLDDWLDMPSRGANGDVVEINLNTVKVRNWDKTITTIPTHLLTSESFINWRGMTESGGRRIKRSISIDMNTIKFSSEQELEAFMKVDLLQDYMGQKLKEMKMSLEADNVDLDALADGKSLTNIGTFRAYLEAYLHAHPKVHQDMTFLVRHLDPGAPGLPIEIYVFSNDQEWANYEAIQAEIFEHVLSVMPTFGLRVFQNPTGADFEKIVR

SEQ ID NO: 44701 - DNA, 1167 bp, Rickettsia typhi str. Wilmington
  CDS (1)..(1167)
atgcaatatttaatggatctatatcatacctcaagtactgaattagtattattgcttgttatgttagcatctcttatgccagtgatatttctaattaaaagattaatttttattcctataaaaaattatttaacgagacatcattacgatgattctgaaaggatactaaaaaaatatccaatatttcgttatttattacatactttattagcattttactttttatgttggagcaatatttttcatcctacttcttttaaagcgcatgtattacttggaatcaaagataccgtagtaatcttatatactagtatatctgtaacgatgttattattaacgcttatagatgcttttgcagatttatatcataataagatcaagaacattaccaaaaatgcaccacttagtttatattttcaaatattaaaaattattgtcatagttatcgcagtaattataactatttcatatatattaaatatatcgctgagtaaattcttaacaagtttaggtgcagccgcagctctgttaacatttgttttcaaagataccgttttaggattacttgcaagtttgcaactaactactcaaaaaattattaatattggagacttagtacgtgtaggtgaaattgaagggatagttgaaaaaattactatttctgtagtaacaattaggaattctgatcaatctatttctacagttcctacttatagccttttaaattctaatgtaactaattatagaggaattactgaatcaggcgcaagaagaataaagagagtattcaatattaatatggcaactattaatttctgtgatactactcttttaaaagaactaaaaaaatctccttatatatcaaaggatgtaatagataaaattactcttgataaagaagagcaagatttaactaatattaaactattcaaattatatattcaagaatatctaaaaaacaatccaaaagtttatactgaaggttttacttttctagtaagacaacttgaacctaccatcactggtctacctatagaaatatatatcttcgttaaagaaatgaatttagtaaattatgagcatatacaggacaatatttccgaacatttaatttctatactccctgaatttaaattaaaaatatttcagaatgtaggagtagtataa

SEQ ID NO: 44702 - protein, 388 aa, Rickettsia typhi str. Wilmington
MQYLMDLYHTSSTELVLLLVMLASLMPVIFLIKRLIFIPIKNYLTRHHYDDSERILKKYPIFRYLLHTLLAFYFLCWSNIFHPTSFKAHVLLGIKDTVVILYTSISVTMLLLTLIDAFADLYHNKIKNITKNAPLSLYFQILKIIVIVIAVIITISYILNISLSKFLTSLGAAAALLTFVFKDTVLGLLASLQLTTQKIINIGDLVRVGEIEGIVEKITISVVTIRNSDQSISTVPTYSLLNSNVTNYRGITESGARRIKRVFNINMATINFCDTTLLKELKKSPYISKDVIDKITLDKEEQDLTNIKLFKLYIQEYLKNNPKVYTEGFTFLVRQLEPTITGLPIEIYIFVKEMNLVNYEHIQDNISEHLISILPEFKLKIFQNVGVV

SEQ ID NO: 44703 - DNA, 1248 bp, Bacteroides fragilis YCH46
  CDS (1)..(1248)
atggaacagataaccgaaaaaataaatgacttattcgtttcctggggatttgactccagtgaagtaggtcccattatgacactggtactgattattggcattgcctttttagccgatcttatttgtcgtaacattcttttaagagtagttgccaaactagtgaaaaagaccaaagcaacctgggatgatattgtgttcgaccgtaaagttttgatttacctcagtcatcttgtcccccccatcattatttatgtgttgattcctttggcaattccgaatgtaagtgccctcgattttatccgtcgtatctgcatgatttatatcattgcggtttttctgcgttttatcagtgcatttctgtcggctgtttatcatgtatacagtgagcgagaacagtttcgtgatcgaccattgaaaggtttgttgcaaacagcacaagtgatactatttttcattggaggaattgttgttatcagtgtattgatagataaatctccgatggtattgctcaccgggcttggtgcttcggctgccatcctgatgttggtgtttaaagacagtatcatgggatttgtgtccggcattcaactttctgcaaataatatgctgaaagtaggtgactggattgctatgcccaaatacggagccgacggtacggtgattgaagtgacgctcaataccgtgaaggtgcgcaattgggacaataccatcactaccatccctccctatctgctggtcagcgattcttttcagaattggcggggtatgcaagagtccggtggacggcgtgtgaagcgttctatcaatatcgatatgaacagtgtaagattctgtacccccgaaatgttggctaaatataagaaaatccaattgttgaccgattatgtggagcagaccgagcaggtggtgaaagagtataataaagaacatcacatagacaactctatcttggtcaatgggcgacgccagaccaatctcggagtattccgtgcctatctgaccaactacttgaaaagtcttcccgatgtcaataagaacctcacttgtatggtacggtatcttcagcccaccgaacaaggtattccggtcgaactttactttttttctgctgtgaaagagtgggtaccttacgaaggaattcaggccgatgtattcgatcatctgcttgccattgttccggaatttggtttgcgcgtattccagaatcctacgggagaagattttcgggagtggaatagaagaaattaa

SEQ ID NO: 44704 - protein, 415 aa, Bacteroides fragilis YCH46
MEQITEKINDLFVSWGFDSSEVGPIMTLVLIIGIAFLADLICRNILLRVVAKLVKKTKATWDDIVFDRKVLIYLSHLVPPIIIYVLIPLAIPNVSALDFIRRICMIYIIAVFLRFISAFLSAVYHVYSEREQFRDRPLKGLLQTAQVILFFIGGIVVISVLIDKSPMVLLTGLGASAAILMLVFKDSIMGFVSGIQLSANNMLKVGDWIAMPKYGADGTVIEVTLNTVKVRNWDNTITTIPPYLLVSDSFQNWRGMQESGGRRVKRSINIDMNSVRFCTPEMLAKYKKIQLLTDYVEQTEQVVKEYNKEHHIDNSILVNGRRQTNLGVFRAYLTNYLKSLPDVNKNLTCMVRYLQPTEQGIPVELYFFSAVKEWVPYEGIQADVFDHLLAIVPEFGLRVFQNPTGEDFREWNRRN

SEQ ID NO: 44705 - DNA, 1170 bp, Bacteroides fragilis YCH46
  CDS (1)..(1170)
atgatagatttaggaagctggatgaacaaaatccttatcggttggggggtagaccctaaaattgcaaatacttttgatgaaacgattattgccatcctgatgatttttatagcggtcggactggattatctttgtcaggccatttttgtaggcgggatgaagcgtctggcacggaagacctcttataaatgggatacattgatggtcaaacataaagttattcatcacctgatccatatccttcccggtatcctgatgtatatgcttcttcctatggcgttcgtacatggaaaaacgctgctgctggtttcgcagaagatctgtgttatttacatgatttttgctttgttgctggctctcaacagtagtctgttgatgttgttggatatactcagtgctaaggagaagttgaaagatcggccgatgaagggctttatccaggtattgcaggtacttgttttctttatcggaggcattgtgattgtggctatcattgtcgataagtctcctgctacattatttgcgggattaggtgcatccgctgccatcctgatgttggtttttaaagacagtattctgggcttcgtggcaggtatacagttatcggctaatgatatgatacgtcccggtgactgggtgactatcccttcgactaatgccaatgggattgtagaagaaataaccctaaacacggtgaagatacagaatttcgataataccatttctactgtccctccctattcactggtcaacggttcgtttcagaactggcggggaatgacggaatccggagggcgtcgggtgatgaagagtatctttcttgacctgactacattgaaattctgtactcccgaaatgcttgatacttttcggaaggagatacctttgctggccgattatcagccggaggaaggagtgattcccactaactcgcaggtgttcagggtgtatgtagaacgttatctttgcagcctgcccgtggtcaatcaggatcttgacttgattatcagtcaaaaagaagctacggaatatggagtacctattcaaatttacttcttttcccgcaataaaatctggaaagaatacgaacgtatccagtccgatatctttgatcacttttttgcgatgataccgaagtttgaactaaaggtatatcaatattcggattga

SEQ ID NO: 44706 - protein, 389 aa, Bacteroides fragilis YCH46
MIDLGSWMNKILIGWGVDPKIANTFDETIIAILMIFIAVGLDYLCQAIFVGGMKRLARKTSYKWDTLMVKHKVIHHLIHILPGILMYMLLPMAFVHGKTLLLVSQKICVIYMIFALLLALNSSLLMLLDILSAKEKLKDRPMKGFIQVLQVLVFFIGGIVIVAIIVDKSPATLFAGLGASAAILMLVFKDSILGFVAGIQLSANDMIRPGDWVTIPSTNANGIVEEITLNTVKIQNFDNTISTVPPYSLVNGSFQNWRGMTESGGRRVMKSIFLDLTTLKFCTPEMLDTFRKEIPLLADYQPEEGVIPTNSQVFRVYVERYLCSLPVVNQDLDLIISQKEATEYGVPIQIYFFSRNKIWKEYERIQSDIFDHFFAMIPKFELKVYQYSD

SEQ ID NO: 44707 - DNA, 1098 bp, Photobacterium profundum SS9
  CDS (1)..(1098)
atgacaagatttattcaatggtggtcatcccttgaacaaggtgtgaatcacgactggatgtataacgtgggtctgttactcgcgttaagtgcaattttatggggtggatggctacttgttacccgccgtctttctttgattgccgaaaacacccgcttaatttgggatgatgcactggtaagtgcggttcgtcgtcctgtcagttggcttatctggttatggcctgccgtattatcgcttggcattgtgattgataacactacaagctaccccactacctttcttgctgttgttcgccatttaatcgtagtttggaccttcgtctggatactgttacgcctgatcagtaatgtcgaagccggtatattacctaaagcgaaagataccaccaccatcaatgctatttctaagatactgcgtttgatcgtaatggtcattggtggcttagtgatgatgcagaacctaggtttgagtttgtcgggtgtgctgaccttcggtggtgtggggggcttaattgtcggtatggccgcaaaagatatgctggctaacttcttcggtgccatgatgttgtatctggatcgccctttcaaagtgggtgattgggtacgcagcccagatcgtcaaattgaaggtacggttgagcgcatcggctttagaatgacggttattcgcacatttgataagcgaccgctgtatgtgcctaattctgtctttagctctatcgtggttgaaaacccttcacgtatgacgaaccgtcgaattaaacaaagtgtcgggttacgttatgaagatgcggctgtggtgggcaaagtggcgtctgatataaaagccatgctattaaatcatgccgatattgatagtaaccaaaccatgatcgtttgttttgatacgtatggtgcatcgtcattgaatatattggtgtacacctttaccaaaaccgttaattgggttgaatatcaagaagtacagcaagatgtgatgctgaaaatcgtggatattgtgcatcgtaacggtgctgactttgcgtttccaaccacaacgttacacatgcacgatgccgatattacaatgaatagcagccagcctaatttagcctag

SEQ ID NO: 44708 - protein, 365 aa, Photobacterium profundum SS9
MTRFIQWWSSLEQGVNHDWMYNVGLLLALSAILWGGWLLVTRRLSLIAENTRLIWDDALVSAVRRPVSWLIWLWPAVLSLGIVIDNTTSYPTTFLAVVRHLIVVWTFVWILLRLISNVEAGILPKAKDTTTINAISKILRLIVMVIGGLVMMQNLGLSLSGVLTFGGVGGLIVGMAAKDMLANFFGAMMLYLDRPFKVGDWVRSPDRQIEGTVERIGFRMTVIRTFDKRPLYVPNSVFSSIVVENPSRMTNRRIKQSVGLRYEDAAVVGKVASDIKAMLLNHADIDSNQTMIVCFDTYGASSLNILVYTFTKTVNWVEYQEVQQDVMLKIVDIVHRNGADFAFPTTTLHMHDADITMNSSQPNLA

SEQ ID NO: 44709 - DNA, 1272 bp, Idiomarina loihiensis L2TR
  CDS (1)..(1272)
atgatggaactggattacccgcagtggtttcatgattgggcggcaacccaaccctgggcctacacaattggagcctgctttttccttgttatagcggtttggttgtctcagcttgtgaccaaacacgttttactgcgtggtatttcccgtctgctgtctcaaacccagttaggcagtgacccgggtataggcattcgcgttattgtcagccgcctggctcaggttgttcctgcgttagtgctgtccggcggtatttatctggtaccggatttaccggaaaccgccaccaccatcatacgcaacatcagtattgcgtacctcatcctgactctggcgcgttcgtttagcgcggccatgactagcgttaacgaaatatacagtcggcagcctgacgcgcatacaaagccaataaagggttatctgcaaattgcgaagatagtggtctatgtggtggcgactattctcattattgcctcattgctggaccgctctccggttattctgctatcaggaattggtgccatgggtgcggttgccatgctggtatttcaggacaccattctgtcactggttgccagtattcagctctcatctaatgacatgcttcgtgtcggcgactggattgaaatgccccagttaaacgctgacggcgatgtcattgatgtggcactgcatacggttagggttcaaaactgggataaaaccattacgaacattcccaccaaacgtcttatttccgagtcgtttaaaaactggcggggcatgcaggaaagcggtggacgccgtataaaacgagcgttatacattgaccagaacagtattcactttttgtccgctgagcagaagaaaaagctgaaacgtttctcgctacttagcgattatctggaacaaaaagaaaaagatatatctgaatggaacgcgggtctggaaaagaaaggcttcgaccctataaacggacgtcaggtaaccaatattggtacctttcgcgcctacgtgaaacagtacctcaagcagcgacccgacatacacgaaggaatgacactgatggttcgtcagttaaacccggggcctcagggtttgcccattgaagtgtactgctttagtaacgataccgcgtgggaaatctacgaaggtattcagtccgacatttttgatcacttgtttgccatactgccacaatttgacttacaggtttttcaggaaacctcagggcaggacgttcgttcagcagtacaagcgctggagcttaaacccaaaagtgatgatgaataa

SEQ ID NO: 44710 - protein, 423 aa, Idiomarina loihiensis L2TR
MMELDYPQWFHDWAATQPWAYTIGACFFLVIAVWLSQLVTKHVLLRGISRLLSQTQLGSDPGIGIRVIVSRLAQVVPALVLSGGIYLVPDLPETATTIIRNISIAYLILTLARSFSAAMTSVNEIYSRQPDAHTKPIKGYLQIAKIVVYVVATILIIASLLDRSPVILLSGIGAMGAVAMLVFQDTILSLVASIQLSSNDMLRVGDWIEMPQLNADGDVIDVALHTVRVQNWDKTITNIPTKRLISESFKNWRGMQESGGRRIKRALYIDQNSIHFLSAEQKKKLKRFSLLSDYLEQKEKDISEWNAGLEKKGFDPINGRQVTNIGTFRAYVKQYLKQRPDIHEGMTLMVRQLNPGPQGLPIEVYCFSNDTAWEIYEGIQSDIFDHLFAILPQFDLQVFQETSGQDVRSAVQALELKPKSDDE

SEQ ID NO: 44711 - DNA, 1236 bp, Idiomarina loihiensis L2TR
  CDS (1)..(1236)
atggacttcgagtttgtaaaagagtggctacaaaaattcggtcttcagagcaacctggaggaactgagtctggctatcagttcgttattagttctaattggttgttacattacctatgccatagcgcgttggcttatcgatcatgccatagagcacttgttaaaaagggcgcccgagcggtggtataaatcgctggttaacagtggcctttttaagcgttgcgcaaacttagccccggttatcctgatacacagtttcataccaattctgtttatcaataactttgaaagttggcagtcccctctgcgaacggttgtgggtgtttatctgacctgggttattaccagtattctgacagccctggccaacgtcgtttccattgcctatgactatacttataaagcacgtgaggtccccattaccggagtcattcaggtcataaaactgatactggtactcatggcgattctcatcactattgccatcattatgaacaagtcgcctatgtacttgctaagtggtttcggcgccatgaccgccattcttatggtggttttcagggataccctaatgggctttgttgccggagtgcaattggcgaccaaccgtatggttgctattggtgactggattgagctgactgatcacggggttgatggtacggttcaggaagtcggcctaatttccgtgcaagttgagaactgggataaaaccattgtttacttgcccacttatgtattaatacacgagtcgtttaaaaactggcagggaatgatcaatacaggtgggcggcgcatgagacgttcactaatgattgatttggacagctctaaaattctgtcgaacgaacagttagaagaacttgctaaaaaacattttaatcagtccgctgacgactggttaaatgccaatgaactcgacaaaccggtaagtaacttaactgtattccgggtatttactgacaattatctaaggaaccacaaacaggtaagagaagatctgactattatggctcgccttatgcagcctacagcagcagggttaccgctggaaatttatgcgttttgtaaacaaacggactggatgaaatacgaagcggtacaaagctcaattatcgagtatttatacagtgtgatgccagactttggactgaagaattatcagtacttgaataacaaccacgccttctctgaaaacaaagaaggcgcttattgtgactataaaccggagtcctga

SEQ ID NO: 44712 - protein, 411 aa, Idiomarina loihiensis L2TR
MDFEFVKEWLQKFGLQSNLEELSLAISSLLVLIGCYITYAIARWLIDHAIEHLLKRAPERWYKSLVNSGLFKRCANLAPVILIHSFIPILFINNFESWQSPLRTVVGVYLTWVITSILTALANVVSIAYDYTYKAREVPITGVIQVIKLILVLMAILITIAIIMNKSPMYLLSGFGAMTAILMVVFRDTLMGFVAGVQLATNRMVAIGDWIELTDHGVDGTVQEVGLISVQVENWDKTIVYLPTYVLIHESFKNWQGMINTGGRRMRRSLMIDLDSSKILSNEQLEELAKKHFNQSADDWLNANELDKPVSNLTVFRVFTDNYLRNHKQVREDLTIMARLMQPTAAGLPLEIYAFCKQTDWMKYEAVQSSIIEYLYSVMPDFGLKNYQYLNNNHAFSENKEGAYCDYKPES

SEQ ID NO: 44713 - DNA, 1257 bp, Azoarcus sp. EbN1
  CDS (1)..(1257)
atgtccaacgaactcgccctggctgccgcctggctcgagcgctacccggttacctacaccgtgttcgcgatctccgcgctgctcgcaggtgcctggatcgcccactggatcacccgccacatcgtgctgcgcggcctgcggcgcctgctgcaggcgacgtcgctgaaaggtgatcccgcagttgcgcagatgttcgccgtcacgcctctgtccagcctgatcccggcgctgatcgtgttcgccggcgtggggatggtgcccgatctgtccgtggctgcggtgaccgtggtgcgcaatgtgtgcgctgcgctcatcatcctcatgctggcgagggcaatcggtagcgcgctcgaactgctcaatgcgttctacatgcgccggcccgacgcgcatcggcgcccgatcaagggttatctcgaagtcgtgaagatcgcgatctatgtgatcgcggcgatcctgatggtggctgcattggtggatcgctcgccgctgatcctgctgtccggtctcggtgcgatggcggcagtgctgatgctgatcttccaggacacgctgctgtcgctggtcgcgagcgtgcagatctcgacgaacgacatgctgcgcgtcggcgactggatcgagatgccgcaattcaatgccgacggcgacgtgatcgacatcgcgctgcacacggtgaaggtgcagaactgggacaagacgatcaccaccatcccgaccaagcgcctgatcagcgactcgttcaggaactggcgcggcatgcgcgagtcgggcggacgccgcatcaagcgcagcctgtacctcgaccagcagagcgtgcgcttcctgaccgacgaggagcgccgccgtctcgatcgcttcgccctgctcgacggctatctgccggccaaggaggcagagctcgacgcctggaatcgtgcgctcaagggcgggtcgcgcgatgttgtgaaccggcgccgggtgaccaacatcgggacgttccgcgcctatgtcgagcgttatctgcggcatcatccgggcgtccatccgggcatgacgctgatggtgcggcagctcgccccgacgtccgacggtctgccgctggaggtgtattgcttcgcgaatacgatcgcgtgggtgaattacgaggcgatccagtccgacatcttcgaccatctcctggcgatcgtgcccgagttcggcctgcgggtgttccagcatccgggcggcgccgacatgcgtgcgctcgtcgcgccctcgtaccccgtgcgcgcggcctga

SEQ ID NO: 44714 - protein, 418 aa, Azoarcus sp. EbN1
MSNELALAAAWLERYPVTYTVFAISALLAGAWIAHWITRHIVLRGLRRLLQATSLKGDPAVAQMFAVTPLSSLIPALIVFAGVGMVPDLSVAAVTVVRNVCAALIILMLARAIGSALELLNAFYMRRPDAHRRPIKGYLEVVKIAIYVIAAILMVAALVDRSPLILLSGLGAMAAVLMLIFQDTLLSLVASVQISTNDMLRVGDWIEMPQFNADGDVIDIALHTVKVQNWDKTITTIPTKRLISDSFRNWRGMRESGGRRIKRSLYLDQQSVRFLTDEERRRLDRFALLDGYLPAKEAELDAWNRALKGGSRDVVNRRRVTNIGTFRAYVERYLRHHPGVHPGMTLMVRQLAPTSDGLPLEVYCFANTIAWVNYEAIQSDIFDHLLAIVPEFGLRVFQHPGGADMRALVAPSYPVRAA

SEQ ID NO: 44715 - DNA, 1191 bp, Francisella tularensis subsp. tularensis Schu 4
  CDS (1)..(1191)
atgtcgttactaaaaaaatactattttgatattattaataaccatggattttctgtagctttaagctgtttaactattattctaatagtactattattatcatttatcattaatagattatcatcgaaatatatagttttgattgctaaaaaattctttgataaaagtaattccatgctaggaaaatacctattagaatataagttttttgttaagttatctcatattattccaggtatatttgcctatgttataataggttttgctactgataatgattatctttggacacaacatttagtcactggtttacagttattattacaaatttatataactgttactataatttcatttttagtatgttttgtagatgctctttttgactaccttgagaatcttgcttattttaaaaatcattcattacgtagctatgctcaagtaatcaagattatcttatacataataggctttatcttagtagtatcgttattgttaaataaatcacctattgcctttttaacgggattaggagcattatcagcagttcttatgttggtctttaaggatacaatattaggctttgtaaccaatgttcaagttgccgctcttgatttagtaagagttggagattggattactatcccatctgctaatgttgatggtactgttatggatgtatctattaatacagtaaaaatccgtaattttgataaaactatatcgatgataccaacttatacactaactactcatagtgtccaaaattggcgtggtatggtagaaaccggaggtcgtcgtattaagcgctcgataaatatagatatagatacgataaaattctgtgatcaagagcttctagaaagactaggcaaagaaactcttttagcggattttatcaaagctaaagctaatgaaaaacttactaatattagtctatttcgtgcttatattgaaaactatctgagaaatcagcctaagatacatttaggtttgacatttttaattagggagcttcagccgacacagtttggcttacctgttgagttatatatatttacaaatgacactaactgggttaactatgagaaaattcaagctgatatttttgattatgtatttgctagtttacatatgtttgacttaaaagctttccaagctattactggtagaattaataatcaattttaa

SEQ ID NO: 44716 - protein, 396 aa, Francisella tularensis subsp. tularensis Schu 4
MSLLKKYYFDIINNHGFSVALSCLTIILIVLLLSFIINRLSSKYIVLIAKKFFDKSNSMLGKYLLEYKFFVKLSHIIPGIFAYVIIGFATDNDYLWTQHLVTGLQLLLQIYITVTIISFLVCFVDALFDYLENLAYFKNHSLRSYAQVIKIILYIIGFILVVSLLLNKSPIAFLTGLGALSAVLMLVFKDTILGFVTNVQVAALDLVRVGDWITIPSANVDGTVMDVSINTVKIRNFDKTISMIPTYTLTTHSVQNWRGMVETGGRRIKRSINIDIDTIKFCDQELLERLGKETLLADFIKAKANEKLTNISLFRAYIENYLRNQPKIHLGLTFLIRELQPTQFGLPVELYIFTNDTNWVNYEKIQADIFDYVFASLHMFDLKAFQAITGRINNQF

SEQ ID NO: 44717 - DNA, 1332 bp, Xylella fastidiosa Ann-1
  CDS (1)..(1332)
atgtacattgaagggggctgtgattttggagtgatgatgttcaatgccagcattgcgattacctggacccatttgcatgatgtcttggcatcttatccttgggtctaccgtgtattagcaacaatcatgttgttgttggctgcttggtttgctaattgggtgacgaagcgggttttgctacgtggtgtgcagcgtgtgctgcgtagcagtgtgcttgctggcgaggagggcggctacggcatgcgtttgggtgtcatcccgcgcttggctaatgtggttccagcattggtgttgtctctgggagtggccgcggtgcctgatgtgccactggtggtggtcgcagtggtgcgcaatgtttgtacggcttttatcgtattgaccgtggcattggcgttggctcgtttgatggatttggcgaatcaagtgtatgagcgccgtcccgatgcgcagcacaagccaatcaagagttatgtacagctgctgaaaattgtgctcggtttgtttacggctgtactgatgatttcagtattgatagacaagtcgccgctgatccttctttctggtctgggcgccatgatggctgtgttgattttggtctttcaggacacgttgttgtcgttggtcgccagtgtgacgattaattccaacgatatggtgcgggtgggtgattggatcgaaatgccacagcagggcgctgatggggatgtgattgatattgcgctgcatacgatcaaggtccagaactgggacaaaacgattactgcaattccaatcaagcgattgatcactgattcgttcaagaactggcgtggaatgcatgagagtggtgggcgccggatcaagcggtcgctatttctggatcagtgcagtgtacgttttcttgatgattctgaaattgcaaggatgcgtgagttcagcatattgcgtgattacattgatgcaaagtgccagagtttggctgagtggaatgtggcgctgtcaagtcaaggtgttgcttcagtcaatgctcgccgtattaccaatcttgggacatttcgcgcttatgtggagcattatctgcgtgccagcccgcatgtgcaccaggagatgacgttgttagtacggcaattgcaaccaacggatcttgggctgcctttggagatctactgttttacaaataacacggattgggtggcttacgagcaaattcaatcggacattttcgatcatctgttggcgttgttgccgcagtttgggttgagggtttttcagagttccagtgacaccatgttgatggaaacggcgcaacgtttgagtgctatatcggctgcgttaacggggcgtgcgcattga

SEQ ID NO: 44718 - protein, 443 aa, Xylella fastidiosa Ann-1
MYIEGGCDFGVMMFNASIAITWTHLHDVLASYPWVYRVLATIMLLLAAWFANWVTKRVLLRGVQRVLRSSVLAGEEGGYGMRLGVIPRLANVVPALVLSLGVAAVPDVPLVVVAVVRNVCTAFIVLTVALALARLMDLANQVYERRPDAQHKPIKSYVQLLKIVLGLFTAVLMISVLIDKSPLILLSGLGAMMAVLILVFQDTLLSLVASVTINSNDMVRVGDWIEMPQQGADGDVIDIALHTIKVQNWDKTITAIPIKRLITDSFKNWRGMHESGGRRIKRSLFLDQCSVRFLDDSEIARMREFSILRDYIDAKCQSLAEWNVALSSQGVASVNARRITNLGTFRAYVEHYLRASPHVHQEMTLLVRQLQPTDLGLPLEIYCFTNNTDWVAYEQIQSDIFDHLLALLPQFGLRVFQSSSDTMLMETAQRLSAISAALTGRAH

SEQ ID NO: 44719 - DNA, 1152 bp, Rickettsia sibirica 246
  CDS (1)..(1152)
atggatctatatcatacctcaagtactgagttagtattattgtttgttatgttagtatctcttataccggtgatatttctaattaaaagattaatttttattccggtaaaaaattatttaactagacatcattatgatgattatgaaaggataaaaaaatatcctatatttcgttatttattacatactttattagcactttactttgtatgttggggaaagatttttcatcctacttcttttaaagcacatgtattactgggaatcaaagatactatagtaatcttatatactggtatatctgtgacgatgttattattaacgcttatagatgcttttgcggatctgtatcacaatagaatcaaagccgttacaaaaaatgcaccgcttggcttatattttcaaatattaaaaattattatcatagttattgcagcaatggtaactatttcatatatattaaatatttcgcttagtacattcttaacaagcttaggtgcagccgcagctcttttaacatttgttttcaaagataccgttttaggattacttgcaagcttgcaactaactactcaagaaattattaatattggagactgggtacgtataggcgcaattgaaggaacagttgaaaaaattactatttccgtagtaacaattaggaattttgaccaatctatttccacagttcctacttacagcattttaaattctaacgtaactaattatagaggaattagtgaatcaggagcaagaaggataaagagagtatttaatattaatatggcaactattaacttctgtgatgctactattttacaagcactaaaaaaatctccttatatatcaaaggatgtaatagataaaatcactcttgataaagaagagaaagatttaaccaacattaaactattcaaattatatattcaggaatatctaaaaaataatccagcagtttataccgaagggtttacttttctagtaagacagcttgaacctacgattaatgggttgcctatagaaatatatatctttgttaaagaagtaaatttagtaggttatgaaaatatacaggacaatatttctgaacatttcatttctatacttcctgaatttaaattaaaaatatttcagaatgtaggagtggtataa

SEQ ID NO: 44720 - protein, 383 aa, Rickettsia sibirica 246
MDLYHTSSTELVLLFVMLVSLIPVIFLIKRLIFIPVKNYLTRHHYDDYERIKKYPIFRYLLHTLLALYFVCWGKIFHPTSFKAHVLLGIKDTIVILYTGISVTMLLLTLIDAFADLYHNRIKAVTKNAPLGLYFQILKIIIIVIAAMVTISYILNISLSTFLTSLGAAAALLTFVFKDTVLGLLASLQLTTQEIINIGDWVRIGAIEGTVEKITISVVTIRNFDQSISTVPTYSILNSNVTNYRGISESGARRIKRVFNINMATINFCDATILQALKKSPYISKDVIDKITLDKEEKDLTNIKLFKLYIQEYLKNNPAVYTEGFTFLVRQLEPTINGLPIEIYIFVKEVNLVGYENIQDNISEHFISILPEFKLKIFQNVGVV

SEQ ID NO: 44721 - DNA, 1953 bp, Psychrobacter sp. 273-4
  CDS (1)..(1953)
atgaggtttgttttgtttattaagcgtcgtctgagtactactgccgtgccatctttatcgatgtcattgatgaaattaccattaatcgtgatgactctacttgtcgctatggcactcagtgtcatctcgcagcctagtgcgttggcagctgaggcgagcatactgggtgtgggtggtactaaaactgaggaaggggatggcacatcgatacctgattcattcggacgcgatacgcctcgacataccgttcaaggatttattgcagcattgggtgaaaatgattatctgctcgccagtaactatctcaatctatctaaagctgataatccaaccactgtcgtccgtcagtttaagcaagcactcgatgcaggtggtcgttttcaggctgatttgcagattaataacacgcctgaaggcaatttaaccgatcaactaccgccaagccaagaaaatgtcggtgtcatcaaagtcagtgatacaagcattcctttgctacttgaaagagtggtgtcgcaagaaggcgagcaatactggcagttttctactgatacgctcagctcaataccagaggcaatagagaactataagccgactttggtttctcgttataccattgattcactagaaggtaaaaagctctttggttatcagttggctgatttggttgcagctttggcgataactgtcagtagttttttattcacctacatcgtcgtatggctactgtatcatttattggaaatcacttaccctcgtgtccgtgatgtgccgctgccattgccagataaagttatattgccgctagcggtggtgattatggcgctgattttgtctgaggtgatggtttatgctggggtgtcagtgaccctgcgcgagccggtcaaccgcttcgctgagattgcttcgtgggtggcaataacgtggttgttattacgcattatcgatgccttatttacccgtgcagtgaatttaagctataagaaaaactatactgaacgggtctcgattttgggactattacgcaaagtcgtcaaagcgctattattgatatttgcagtcatcgtcactttcggtaacttgggctttgacttaacgactggtattgctgcattaggggtagggggtttagccttagcattaggtgcgcaaaagaccatcgaaaacttagtcggcagtgtggtagtggtggcagattcgcctgtgcgtatcggtgactattgtaaatttggtacgtatgagggcaccgtcatcgatattggtattcgctcatcgcgcgtgcgtaccttgacccgtactatcgtcacggtacctaacggtgatttttcatcaatgcaaattgaaaactttacctcacgtgacatgtttcgctttttacatcaactatatatcaagcgtaccgctgatattaatgttgtgtttaagatggtaaaacacttggatgagtttttggataagcatgaattgaccaatcaagaatggaatcaagtcaatatcttagagttgcgtcaagatagttatattattcagctacaagcctatatcaatgccactggtatcatcgaattctatgaaaaacaagaccggttattcgttgatttgttaatgcaagttaggcaatatgatgtagagcatgctttgccaacacagcagctgattgtcaagcaaccagagcttcaggctcaattagaaaatgaaaatgaagaaggcgagaccgttgatcataaagatgacaaaaaaattgctactgataacaagtcaaaagtcgttcatttaaacaaagatagtgatgctgttgatacggaaaatgaaaataagcagccagagcctgaaccaaaaagggatttgttagacagtagatataaagctattcataaaagcagcggtcatacgttagctcgattaaaattcaaacaggtaaaaaatagctttagattcccaagagcaaaaaagtaa

SEQ ID NO: 44722 - protein, 650 aa, Psychrobacter sp. 273-4
MRFVLFIKRRLSTTAVPSLSMSLMKLPLIVMTLLVAMALSVISQPSALAAEASILGVGGTKTEEGDGTSIPDSFGRDTPRHTVQGFIAALGENDYLLASNYLNLSKADNPTTVVRQFKQALDAGGRFQADLQINNTPEGNLTDQLPPSQENVGVIKVSDTSIPLLLERVVSQEGEQYWQFSTDTLSSIPEAIENYKPTLVSRYTIDSLEGKKLFGYQLADLVAALAITVSSFLFTYIVVWLLYHLLEITYPRVRDVPLPLPDKVILPLAVVIMALILSEVMVYAGVSVTLREPVNRFAEIASWVAITWLLLRIIDALFTRAVNLSYKKNYTERVSILGLLRKVVKALLLIFAVIVTFGNLGFDLTTGIAALGVGGLALALGAQKTIENLVGSVVVVADSPVRIGDYCKFGTYEGTVIDIGIRSSRVRTLTRTIVTVPNGDFSSMQIENFTSRDMFRFLHQLYIKRTADINVVFKMVKHLDEFLDKHELTNQEWNQVNILELRQDSYIIQLQAYINATGIIEFYEKQDRLFVDLLMQVRQYDVEHALPTQQLIVKQPELQAQLENENEEGETVDHKDDKKIATDNKSKVVHLNKDSDAVDTENENKQPEPEPKRDLLDSRYKAIHKSSGHTLARLKFKQVKNSFRFPRAKK

SEQ ID NO: 44723 - DNA, 1104 bp, Crocosphaera watsonii WH 8501
  CDS (1)..(1104)
atgaacttttcctttaatatcactatacaagatgttatcaaaatggttggtcccttgctggccattctctgtgggtttattctaggaattgtctttgaaaagcgagtgattaaaaatatacaaaaacttgctgctaaaactcactggaaatacgacacaattatcattgattccattcaaggatttagtattctctggttttcgttgggaggggtagcagttgctacaaacatttatcccattcctccagctattcagcttattatcaataagtttctcattgctacatttctcgcttcagcaacccttattgtttctcgtttattagtagggttactaaaagcttataccactaatgaacaaggaatttctcccttaacctccttatttgaattactcaccaaagttgttatttatagtcttggtgttttaatcatattacaatccattggtattcaaataacccctttattaactgcattgggagtgggtggtgtctctcttggtttagcgttgcaaagtcccttaacaaacttgatatctggggttagtattgttatgtcaggaaaggtacaaccagggaactatattcgcttagcgagtggagaaagtggttatgttgttgatgtggaattaaaatatactgtcttacaagaaataaccgataatttattagttcttcctaactctaaaatactctcaggaagtttcaaaaactttagcttacctaataaattttttgtccttcctgttaccctagatgtggactataatagtgatttagagactgtagaaagaataaccttagaagtagcaaatagccttttagaaaacagagttatagaatatgaatctctggaagaatccaacgaagaagatcttaacaaaccgtttattcgttataatcaatttgattactttagcattaatctcactatttacttgaccatttatgaacaagaattttttgaacatttagaaataagacatcagtttttaaaagaacttcataaacggtataaagcagaagttattgaaattccttttccgatccaatcaggttatttacctcctaaaaaagtagatgatacttacgctaattag

SEQ ID NO: 44724 - protein, 367 aa, Crocosphaera watsonii WH 8501
MNFSFNITIQDVIKMVGPLLAILCGFILGIVFEKRVIKNIQKLAAKTHWKYDTIIIDSIQGFSILWFSLGGVAVATNIYPIPPAIQLIINKFLIATFLASATLIVSRLLVGLLKAYTTNEQGISPLTSLFELLTKVVIYSLGVLIILQSIGIQITPLLTALGVGGVSLGLALQSPLTNLISGVSIVMSGKVQPGNYIRLASGESGYVVDVELKYTVLQEITDNLLVLPNSKILSGSFKNFSLPNKFFVLPVTLDVDYNSDLETVERITLEVANSLLENRVIEYESLEESNEEDLNKPFIRYNQFDYFSINLTIYLTIYEQEFFEHLEIRHQFLKELHKRYKAEVIEIPFPIQSGYLPPKKVDDTYAN

SEQ ID NO: 44725 - DNA, 1251 bp, Burkholderia cepacia R18194
  CDS (1)..(1251)
atgaccctgaacgaatcctggtttgcgccgctcgtcggcatcctcatcctgctcgccgccgccggcgcgatcaccgccgtcgtccatttcctgctgttccgcgtggtcgcgcggctcgcacggctttccgccacgcgcgtcgacgacgcgctgttcgagttcggcgcgttcaaatggctgaaccgcatcgtcccgttcgtcgtgatcaagctcgggctcggcgcggtgcccggcatccccgagacggccgccgaggccgccgacaaggtgctgttcgcgctgatcgtgttcctcgtgacgatgacggtcagcgcgacgctgtccgcactcgaacacacgcatcgcacgtaccagcgcgaccaacacgaccagccgcacctgtcgctgaaaggcgcgatgcagctcgtcaagctcgtgatgttcatcacggccgcgctggtcgtgatcggcgacgcgaccggcaagcagatcggcctgctgctgtccggcatcggcgcgatgtccgcggtgctgatgctgatcttcaaggacacgctgctcggcctcgtcgcgggcgtgcagctgtcgtcgaacgacatgctgcggatcggcgactggatcacgatgccgtcggccggcgcggacggcaccgtgatcgacatcacgctgaacaccgtcaaggtcgcgaacttcgatcacacgatcatcacggtgccgacgtggaaactgatcaccgagagctaccagaactggcgcgggatgaccgaagcgggcgggcgccgcatcaagcgcgcgctgttcgtcgacgcgacgagcgtgcgctttctctcaaacgacgagatcgaacggctcgaacgcctgacgctgctgaaggactatctcgaggacaaggtcgacgcgatcgagcaatggaacggcacgctcggcgcggccggcgactgcccggcgaaccgccgccagctgacgaacctcggtacgttccgcgcgtatgtcgcgaactacctgaaaggccatccgcgcatccgccgcgacatgacctgcatggcgcggcaactgccgctcacggccgaaggcattccgctcgaactgtactgcttcaccgacacgacgacgtgggtcgactacgaggccatccagtccgacctgttcgatcacctgatcgcggtgttgccggaattcgggctgcgcgtgtaccagcacccgtcgggcttcgacatgcggcagatggtcggcgccgcgcaagccgggctgcaggcgccgcacgcgggttga

SEQ ID NO: 44726 - protein, 416 aa, Burkholderia cepacia R18194
MTLNESWFAPLVGILILLAAAGAITAVVHFLLFRVVARLARLSATRVDDALFEFGAFKWLNRIVPFVVIKLGLGAVPGIPETAAEAADKVLFALIVFLVTMTVSATLSALEHTHRTYQRDQHDQPHLSLKGAMQLVKLVMFITAALVVIGDATGKQIGLLLSGIGAMSAVLMLIFKDTLLGLVAGVQLSSNDMLRIGDWITMPSAGADGTVIDITLNTVKVANFDHTIITVPTWKLITESYQNWRGMTEAGGRRIKRALFVDATSVRFLSNDEIERLERLTLLKDYLEDKVDAIEQWNGTLGAAGDCPANRRQLTNLGTFRAYVANYLKGHPRIRRDMTCMARQLPLTAEGIPLELYCFTDTTTWVDYEAIQSDLFDHLIAVLPEFGLRVYQHPSGFDMRQMVGAAQAGLQAPHAG

SEQ ID NO: 44727 - DNA, 1344 bp, Ralstonia metallidurans CH34
  CDS (1)..(1344)
atgactttcgacgccctgcttgaactgttcgagcaacgcatcccggcccacccgtgggcacagatcaccttgtacgtcctggcgctggtcctgctggccggcatcgcgcaatggctcgtggcgcgcgtggtcggccgggtggtctatcgcgtattgagtctttccggccacggcaactgggccggggcgctgctgcaccaccggacctatcgccggctgggctacgcggtattcctggccgtggtcacggtcggcatcagccaggtgccgaacctgggtaagttctcggcggccatcgagcggctggctcatgccggcacctggatcagcgtgttcctgatgctgtctggcgtgctcgatgcgtggcagaccgtgttttccggcagccgcagcgcgcagacgcattcgatcaagggctacatccaggtggcccagctcgcgctgtggctggtctgcggtgtgctggtgctgtcgatcctgatcgaccgctcgccgctctggatgctgtccggtatcggcgcgctatctgcggtgctgctgctcgtgttcaaggacacgctgctgtccctggtggccagcacgcagctcacctcgaacgacatgctgcgcattggcgactggatcgaaatgccccagtccaatgccgatggtttcgtcatggacgtggcgctgcatacggtcaaggtcaagaattgggacaacaccgtgacgacggtgccaacctacaagctgttctcggagagctaccgcaactaccggcacatgttcgagtccggcgcgcgccgcatcaaacggacgctccggatcgatgccaccagcgtgcggttcctggacgaggaggaggtcagggcgctgatgcggttcaagctgctgcatgactatctcgaggtcaagcaggaggaggtcgatcgggccaaccgggagatcctgcgtgccgacacagacccggtcaaccgccgtcggctgaccaacctgggcacgttccgcgcctatggcatcgccttcctgcgcgcgcatccggaaattcatcacgatctgctgctgaacctgcggatgatggaatccgactcgcagggcattccgatcgagatttactgctttaccacgctcacgaactggacggactacgaacgtatccagggcgatatcttcgaccacctgttcgcgattctgccggagctgggtttgcgggtgtatcaggcgccgtcaggcgcggacctgagcgggctgcgcagcggtgcgacgatggccgaccagcacgccgcactggccgtggccgccgcggactcggggatgcgccagccgccatcggccccgacggatcgggccgacagggtggcttag

SEQ ID NO: 44728 - protein, 447 aa, Ralstonia metallidurans CH34
MTFDALLELFEQRIPAHPWAQITLYVLALVLLAGIAQWLVARVVGRVVYRVLSLSGHGNWAGALLHHRTYRRLGYAVFLAVVTVGISQVPNLGKFSAAIERLAHAGTWISVFLMLSGVLDAWQTVFSGSRSAQTHSIKGYIQVAQLALWLVCGVLVLSILIDRSPLWMLSGIGALSAVLLLVFKDTLLSLVASTQLTSNDMLRIGDWIEMPQSNADGFVMDVALHTVKVKNWDNTVTTVPTYKLFSESYRNYRHMFESGARRIKRTLRIDATSVRFLDEEEVRALMRFKLLHDYLEVKQEEVDRANREILRADTDPVNRRRLTNLGTFRAYGIAFLRAHPEIHHDLLLNLRMMESDSQGIPIEIYCFTTLTNWTDYERIQGDIFDHLFAILPELGLRVYQAPSGADLSGLRSGATMADQHAALAVAAADSGMRQPPSAPTDRADRVA

SEQ ID NO: 44729 - DNA, 1110 bp, Microbulbifer degradans 2-40
  CDS (1)..(1110)
atggacgcttttaaatctacgctgcaagagtggttaggggagctagcaggcaaagaaaacctttggattgcagaggtttttattgttgtgttttgcacccttattgttgcgctagtagtaagtacctttttaaacaagctcaagaaaaagtcgctgttaaccaaaaccctttgggatgatgcgttttttcattctttggcagcgccagcaaaatggtttgtatgggtacttggcttaacaactgcagcaacaattgcctcaaagcactccgagtcggccattttagaggccattgccacggttcgccacgtaggctatatcgtaattgttacttggtttgtaacggggtttatctccaaagcagaaaaaaacttaattgaccctgaatacagtcgtcagcctatggatagaaccacggctatggcgctgggtaaattattgcgtatatcggtaattattaccgcgatgttggtggcgttgcagtcgctgggctacagtatttcgggcgtgttagcctttggtggcattggcggtatagcggtaggttttgcggcgaaagacctacttgccaacttttttggcgggttaatggtgtacttagatcgaccatttgctgttggcgattggattcgttcgccagataaaaatatagaaggcgtagtagaagatataggttggcgtcaaacgcgtattcgtactttcgataagcgcccactgtacgtacccaatgcaacctttactcaaatttcagtagaaaatccatcgcgtatgcagcacaggcgcatctacgaaaccgtgggtattcgctacgacgacgccactaaaatggcgggtattgtggctgatgtaaaagcgatgctggtagagcatgaggcgattgatcacaataatacgcttattgttaatttcaacggttttgcttcttcatcgctggattttttcatctattgttttacgcacacaacagattggattgaatttcacgaaattaaacaagacgtgctgttgaaagtgctaaaaattattgaaaagcatgaggctgaatgtgcattcccaacctcaacgctacatgttcccgatggaatacaattaatgcaggcggaaaactaa

SEQ ID NO: 44730 - protein, 369 aa, Microbulbifer degradans 2-40
MDAFKSTLQEWLGELAGKENLWIAEVFIVVFCTLIVALVVSTFLNKLKKKSLLTKTLWDDAFFHSLAAPAKWFVWVLGLTTAATIASKHSESAILEAIATVRHVGYIVIVTWFVTGFISKAEKNLIDPEYSRQPMDRTTAMALGKLLRISVIITAMLVALQSLGYSISGVLAFGGIGGIAVGFAAKDLLANFFGGLMVYLDRPFAVGDWIRSPDKNIEGVVEDIGWRQTRIRTFDKRPLYVPNATFTQISVENPSRMQHRRIYETVGIRYDDATKMAGIVADVKAMLVEHEAIDHNNTLIVNFNGFASSSLDFFIYCFTHTTDWIEFHEIKQDVLLKVLKIIEKHEAECAFPTSTLHVPDGIQLMQAEN

SEQ ID NO: 44731 - DNA, 1155 bp, Rickettsia akari str. Hartford
  CDS (1)..(1155)
atggatctatatcataccgcaagtactgagttagtattattgtttgttatgttagtatctcttataccggtgatatttctaattaaaagattaatttttatccctgtacaaaattatttaactagacatcatgattataagtatgaaaggatactaaaaaaatatcctatatttcgttatttattacatactttattagcactttactttgtaggttggggaaatattttccatattacttcttttaaagcacatgtattacttggaatcaaagatattatagtaatcttatatactagtatatcagtgacgatgttattattaacgcttatagatgcttttgcagatctgtatcacgataggatcaaagttgttgcaaaaaatgcaccgcttagcttatattttcaaatattgaaaattattgttgtagttattgcagtaatggtaactatttcatatatgttaaatatttcgcttagtacattcttaacaagtttaggtgcagccgcagctcttttaacatttgttttcaaagataccgttttagggttacttgcaagtttgcaattaactactcaagaaattattaatattggagactgggtacgtataggaaaaattgagggaacagttgaaaaaattactatttccgtagtaacaattaggaattttgatcaatctatttctacagttcctacttacagcattttaaattctaatgtaactaattatagaggaattagtgaatcaggagcacgaagggtaaagagagtatttaatattaatatggcaactattaacttctgtgatgcgactattttaaaagaactaaaaaaatctcctcatatatcaaaggatgtaatagataaaatcactattgataaagaacagaaagatttaacaaacattaagctgttcaaattatatattcaggaatatctaaaaaataatccggcagtttatactgaaggatttacttttttagtaagacaacttgaacctacaattaccgggttgcctatagaaatatatatattcattaaagaagtgaatttagtaggttatgaaaatatacaagacaatatttctgaacatttaatttctatacttcctgaatttaaattaaaaatatttcagaatataggagtggtataa

SEQ ID NO: 44732 - protein, 384 aa, Rickettsia akari str. Hartford
MDLYHTASTELVLLFVMLVSLIPVIFLIKRLIFIPVQNYLTRHHDYKYERILKKYPIFRYLLHTLLALYFVGWGNIFHITSFKAHVLLGIKDIIVILYTSISVTMLLLTLIDAFADLYHDRIKVVAKNAPLSLYFQILKIIVVVIAVMVTISYMLNISLSTFLTSLGAAAALLTFVFKDTVLGLLASLQLTTQEIINIGDWVRIGKIEGTVEKITISVVTIRNFDQSISTVPTYSILNSNVTNYRGISESGARRVKRVFNINMATINFCDATILKELKKSPHISKDVIDKITIDKEQKDLTNIKLFKLYIQEYLKNNPAVYTEGFTFLVRQLEPTITGLPIEIYIFIKEVNLVGYENIQDNISEHLISILPEFKLKIFQNIGVV

SEQ ID NO: 44733 - DNA, 1188 bp, Methylobacillus flagellatus KT
  CDS (1)..(1188)
atgtgcgttgtgctgttgatcgcaggcgcctgggttgcgaactggatcgtcaaacatatcctggtgcgcggtttgcacaaggtgttacgttctgccaatgttggacaggctattgcaagaagccgcgtggtcgctaggctctcgaatatcgtccctgccttgatcatttcggtgggcatcgcctggattcctgggctgccggaagcgctggtgacggtagtgcgcaatgtggcgcatggtttcattgtactgacgataggcctggcaattgctggcatgctggatattgtgaatgatgtctggcaacagcggccagacgcccaccgcaagccgatcaaggggtatgtgcaggtggtgaagctggtgatctatatcattgcagccatcttggtggtcgcgacgctgatggatcgttcccccgtgattctgttatccggtatcggcgccatggcagcggtgctcatgctgattttccaggataccctcttgtcgctggtggccagcgtgcagattacttccaatgacattatccgcgtgggtgactgggtggagatgccgcagctcaatgcggatggggatgtgatcgatattgcgctgcatacggtcaaggtgcagaactgggataagaccatcacgacaattcccaccaagcgctttatcaccgattcgttcaagaactggcgtggcatgttcgagtccggggggcgccgcatcaagcgcagtattttcatcgatcagaacagtattcatttcctgaccaatgaagaattggcgcatttgcgccaattcagtctgctggatgattatttgaaaaagaagcaggatgagctggatgagtggaacagggcgttgggagagaagggcaagcagccgatcaatacgcgccgcgtgaccaatatcggcacattccgtgcctatgtcgaacaatatttgaaaaaccacccgcgtgtaaaccagaacatgaccatggtcgtacgccagcagaacttgtcagccgagggcatcccgctggaaatatggtgttttaccaatacgacggtatgggtgcagtacgaggctatccaggctgatatcttcgaccatttgttggcgatcctgccggagtttggcttgcgtgtattccagaatccgagcggagcggatttccaggctttgcgtccatcacccgctcgatccggagacagttga

SEQ ID NO: 44734 - protein, 395 aa, Methylobacillus flagellatus KT
MCVVLLIAGAWVANWIVKHILVRGLHKVLRSANVGQAIARSRVVARLSNIVPALIISVGIAWIPGLPEALVTVVRNVAHGFIVLTIGLAIAGMLDIVNDVWQQRPDAHRKPIKGYVQVVKLVIYIIAAILVVATLMDRSPVILLSGIGAMAAVLMLIFQDTLLSLVASVQITSNDIIRVGDWVEMPQLNADGDVIDIALHTVKVQNWDKTITTIPTKRFITDSFKNWRGMFESGGRRIKRSIFIDQNSIHFLTNEELAHLRQFSLLDDYLKKKQDELDEWNRALGEKGKQPINTRRVTNIGTFRAYVEQYLKNHPRVNQNMTMVVRQQNLSAEGIPLEIWCFTNTTVWVQYEAIQADIFDHLLAILPEFGLRVFQNPSGADFQALRPSPARSGDS

SEQ ID NO: 44735 - DNA, 25 bp, Primer
atgcaggatttaatatcccaggttg

SEQ ID NO: 44736 - DNA, 23 bp, Primer
ttactgcttaaatgcacccgcca

SEQ ID NO: 44737 - protein, 220 aa, consensus
  MISC_FEATURE (1)..(220): consensus for the disclosure of xaa see table XV
SXXXXXXXXGXXXXXXXLXXXDXXXXXXXXXXXXXXXXXXXGDWXXXXXXXXXGXVXXXXXXXXXXXXXDXXXXXXPXXXXXXXXXXNXXXXXXXXXRXXXRXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXYXFXXXXXWXXYXXIQXD

SEQ ID NO: 44738 - protein, 112 aa, consensus
  MISC_FEATURE (1)..(112): consensus for the disclosure of xaa see table XV
XXXXXXXXXXXXXXXXXXXGXXXXXXXXXXXXXXXXXXXXXXXXXXXXXXXGDXXXXXXXXXXGXVXXXXXXXXXXXXXXXXXXXXPXXXXXXXXXXNXXXXXXXXXXXXXX

SEQ ID NO: 44739 - protein, 68 aa, consensus
  MISC_FEATURE (1)..(68): consensus for the disclosure of xaa see table XV
XXXXXXXXXXXLXXXXXXXXXXXXXXXXXXXXXXXXXXXXXYXFXXXXXXXXXXXXXXXXXXXXXXXX

SEQ ID NO: 44740 - DNA, 258 bp, Escherichia coli
  CDS (1)..(258)
atgcaaaccgttatttttggtcgttcgggttgcccttactgtgtgcgtgcaaaagatctggctgagaaattgagcaatgaacgcgatgattttcagtatcagtatgtagatattcgtgcggaagggatcactaaagaagatctacaacaaaaggcaggtaaacccgtagaaaccgtgccgcagatttttgtcgatcagcaacatatcggcggctataccgattttgctgcatgggtgaaagaaaatctggacgcctga

SEQ ID NO: 44741 - protein, 85 aa, Escherichia coli
MQTVIFGRSGCPYCVRAKDLAEKLSNERDDFQYQYVDIRAEGITKEDLQQKAGKPVETVPQIFVDQQHIGGYTDFAAWVKENLDA

SEQ ID NO: 44742 - DNA, 264 bp, Vibrio fischeri ES114
  CDS (1)..(264)
atgtttgttgttatttttggtcgtcctggttgtccattctgtgttcgagctaaagagcacgctgaaacgctaactgaaaaacgtgatgattttaaattccgctacgttgatattcacgctgaaggtatctcaaaagcagacttagaaaagacagtaggtaaaccagttgaaacggttcctcaaatctttatcgatgaaaaacatattggcggctgtactgaatttgaagcgtacgcaaaagaaaatttaggtctttttgattaa

SEQ ID NO: 44743 - protein, 87 aa, Vibrio fischeri ES114
MFVVIFGRPGCPFCVRAKEHAETLTEKRDDFKFRYVDIHAEGISKADLEKTVGKPVETVPQIFIDEKHIGGCTEFEAYAKENLGLFD

SEQ ID NO: 44744 - DNA, 288 bp, Vibrio fischeri ES114
  CDS (1)..(288)
atgttaaatactcatcaaacgatcattttttcaaaaacagtatgtcctttttgtgttaaagcaaaagcaattttggacgataaaggcattgaatataaagtattaaccttagatgaagatctaacaaaagaagaaatggttgctttaattcaagaaaaagaaaacattacagtgaataccgttcctcaaatttaccttgaccgtaaatatatcggtggacatgacgatttagtggcgttttttgagcgtcaagacaccgacatggatttaggtgattttgaactgtag

SEQ ID NO: 44745 - protein, 95 aa, Vibrio fischeri ES114
MLNTHQTIIFSKTVCPFCVKAKAILDDKGIEYKVLTLDEDLTKEEMVALIQEKENITVNTVPQIYLDRKYIGGHDDLVAFFERQDTDMDLGDFEL

SEQ ID NO: 44746 - DNA, 318 bp, Danio rerio
  CDS (1)..(318)
atggcagagtttgttaaagcgcaaattaaggacggcaaaggagttgtgttttgtaaaccgacctgcagttattgcatactcgcaaaggatgttttgtcgaagtataaatttaaagctggacattttgagttgatcgatattagcgcacgcgctgacatgggcagcatacaggactatctgcaacagatcacgggcgcgcgcactgttcctcgagttttcataggagaagattgtgttggaggaggaagtgatgttgagggtcttgaccgttctggaaaactggaaggcatgttgcaggccatcggatgtctgcagtga

SEQ ID NO: 44747 - protein, 105 aa, Danio rerio
MAEFVKAQIKDGKGVVFCKPTCSYCILAKDVLSKYKFKAGHFELIDISARADMGSIQDYLQQITGARTVPRVFIGEDCVGGGSDVEGLDRSGKLEGMLQAIGCLQ

SEQ ID NO: 44748 - DNA, 393 bp, Arabidopsis thaliana; identical to SEQ ID NO: 6900
  CDS (1)..(393)

SEQ ID NO: 44749 - protein, 130 aa, Arabidopsis thaliana; identical to SEQ ID NO: 6901

SEQ ID NO: 44750 - DNA, 264 bp, Pasteurella multocida subsp. multocida str. Pm70
  CDS (1)..(264)
atgttcgtcgtcatctttgggcgcgcaggttgcccgtattgtgtacgtgctaaaaacttagccgacaaattaaaacaaagcttaccagatttcgattatcgctatgtcgatatcgttgcagaaggcatttctaaagcggatttatccaaatcagttgggaaacccgttgaaaccgtaccacaaatttttattgatgaaaaaccgattggtggctgtacagattttgaagccttaatgaaggcacaattcaatattgttgcgtaa

SEQ ID NO: 44751 - protein, 87 aa, Pasteurella multocida subsp. multocida str. Pm70
MFVVIFGRAGCPYCVRAKNLADKLKQSLPDFDYRYVDIVAEGISKADLSKSVGKPVETVPQIFIDEKPIGGCTDFEALMKAQFNIVA

SEQ ID NO: 44752 - DNA, 309 bp, Rickettsia conorii str. Malish 7
  CDS (1)..(309)
atgaataaagctatattacacacaattattgtttatactctcgctagttgtccttattgtataaaagctaaagcattgcttgatgagaaaaatgttgcttatgaggaaattgaagtaagtaactttactcaggaagagaaagaaaaatttattaagaaatccggtggaaaaaagaccgtcccgcagatatttatagataatatgcatgttggcggttgtgatgctctgtttgatcttgaaaaagagggaaggttagataagctgttagaaaatcagccaaagacgacttcacctgctgccggagcgtaa

SEQ ID NO: 44753 - protein, 102 aa, Rickettsia conorii str. Malish 7
MNKAILHTIIVYTLASCPYCIKAKALLDEKNVAYEEIEVSNFTQEEKEKFIKKSGGKKTVPQIFIDNMHVGGCDALFDLEKEGRLDKLLENQPKTTSPAAGA

SEQ ID NO: 44754 - DNA, 252 bp, Escherichia coli K12
  CDS (1)..(252)
atggccaatgttgaaatctataccaaagaaacctgcccgtattgccatcgtgcaaaagcactgctgagcagcaagggcgtgagtttccaggagctgccgatcgatggcaacgccgccaagcgtgaagagatgatcaaacgcagcggtcgcaccacggttccccagatttttattgacgcacagcacattggcggctgtgatgacttgtatgcattggatgcacgtggtggactggatcccctgctgaaataa

SEQ ID NO: 44755 - protein, 83 aa, Escherichia coli K12
MANVEIYTKETCPYCHRAKALLSSKGVSFQELPIDGNAAKREEMIKRSGRTTVPQIFIDAQHIGGCDDLYALDARGGLDPLLK

SEQ ID NO: 44756 - DNA, 255 bp, Caulobacter crescentus CB15
  CDS (1)..(255)
atggccaaggtcaccatctacacccgccccttctgcccctactgctcgcgcgccgtggcgctgctgaccgacaagggcgccgacttcaccgagatcgaggccggcatggatccggccctgcgccaggaaatgatgcagcgctcgggtcgcaacaccttcccgcagatcttcgtgggcgagcagcacatcggcggctgcgacgacatgatggccctggaagatcagggcaagctggacagccttctgtcggcatga

SEQ ID NO: 44757 - protein, 84 aa, Caulobacter crescentus CB15
MAKVTIYTRPFCPYCSRAVALLTDKGADFTEIEAGMDPALRQEMMQRSGRNTFPQIFVGEQHIGGCDDMMALEDQGKLDSLLSA

SEQ ID NO: 44758 - DNA, 252 bp, Salmonella typhimurium LT2
  CDS (1)..(252)
atggccaatattgaaatctacaccaaagcaacctgcccgttttgccatcgtgcaaaggcgctgttaaacagcaagggcgtgagtttccaggaaattgcgattgacggcgacgccgtgaagcgtgaagagatgatcaaacgtagtggccgaacgacggttccgcaaatttttattgatgcacagcacattggcggttgtgacgacttgtatgcgctggatgcgcgtggtggactggatccgctgttgcgttaa

SEQ ID NO: 44759 - protein, 83 aa, Salmonella typhimurium LT2
MANIEIYTKATCPFCHRAKALLNSKGVSFQEIAIDGDAVKREEMIKRSGRTTVPQIFIDAQHIGGCDDLYALDARGGLDPLLR

SEQ ID NO: 44760 - DNA, 258 bp, Ralstonia solanacearum GMI1000
  CDS (1)..(258)
atggcccacgtcgtcatgtacagcacgaccgtctgcccctattgcgtggcggcggagaagctcctgaagcagcgcggcgtcgcgcatatcgaaaagatcctgatcgatcgcgagcccggcaggcgcgaagagatgatgacgcgcaccaaccgccggaccgtgccgcagatctacatcgatgaccgccatatcggtggcttcgacgacctctcggcgctcgaccgcgaaggcgggctggagccgctgctggcggcctga

SEQ ID NO: 44761 - protein, 85 aa, Ralstonia solanacearum GMI1000
MAHVVMYSTTVCPYCVAAEKLLKQRGVAHIEKILIDREPGRREEMMTRTNRRTVPQIYIDDRHIGGFDDLSALDREGGLEPLLAA

SEQ ID NO: 44762 - DNA, 246 bp, Salmonella enterica subsp. enterica serovar Typhi str. CT18
  CDS (1)..(246)
atgaaggtcgttatctacggacgcgataattgctcatactgcaaacgagcggtcgagctggcgaagcagctgcgcggccacggctttggtgattacgaatacatcgatattgtgtctgctgggatcgacaaagagaagttgagctacctggttagcaagccggtggaaaccataccgcaggtgttcgtaaatggtgagtctatcgggggttatgaggaatttgcggcgttggtgagtacgctataa

SEQ ID NO: 44763 - protein, 81 aa, Salmonella enterica subsp. enterica serovar Typhi str. CT18
MKVVIYGRDNCSYCKRAVELAKQLRGHGFGDYEYIDIVSAGIDKEKLSYLVSKPVETIPQVFVNGESIGGYEEFAALVSTL

SEQ ID NO: 44764 - DNA, 264 bp, Yersinia pestis KIM
  CDS (1)..(264)
atgtttgctgtgatttttggacgtcctgagtgcccttactgtgtccgtgccaaagagttagctgagaaactggcatctgagcgtgacgattttaaattccgttatgtcgacattcatgccgaaggcatttccaaagctgatctggaaaaaacggtcggtaaaccggttgaaaccgtgccacaaatctttattgatgaaaaacacattggcggctgtactgatttcgaagcctacgccaaagaacatttgagcctgtataagtaa

SEQ ID NO: 44765 - protein, 87 aa, Yersinia pestis KIM
MFAVIFGRPECPYCVRAKELAEKLASERDDFKFRYVDIHAEGISKADLEKTVGKPVETVPQIFIDEKHIGGCTDFEAYAKEHLSLYK

SEQ ID NO: 44766 - DNA, 267 bp, Brucella suis 1330
  CDS (1)..(267)
atggttgacgtcatcatctatacccgccccggctgcccctattgcgcacgggcaaaggcgcttctggcccgaaagggtgccgagttcaatgaaatcgatgcctcggcaacgccggaattgcgcgctgaaatgcaagagcgctccgggcgcaataccttcccgcagatttttatcggctcggttcatgtcggcggctgcgacgatctttatgcactggaagacgagggcaagctcgatagcctgctgaaaaccggcaaacttatttag

SEQ ID NO: 44767 - protein, 88 aa, Brucella suis 1330
MVDVIIYTRPGCPYCARAKALLARKGAEFNEIDASATPELRAEMQERSGRNTFPQIFIGSVHVGGCDDLYALEDEGKLDSLLKTGKLI

SEQ ID NO: 44768 - DNA, 252 bp, Shigella flexneri 2a str. 301
  CDS (1)..(252)
atggccaatgttgaaatctataccaaagaaacctgcccgtattgccatcgtgcaaaagcactgctgagcagcaagggcgtgagtttccaggagttgccgatcgatggcaatgccgccaagcgtgaagagatgatcaaacgcagcggttgcaccacggttccccagatttttattgacgcacagcacattggcggctgtgatgacttgtatgcattggatgcacgtggtggactggatcccctgctgaaataa

SEQ ID NO: 44769 - protein, 83 aa, Shigella flexneri 2a str. 301
MANVEIYTKETCPYCHRAKALLSSKGVSFQELPIDGNAAKREEMIKRSGCTTVPQIFIDAQHIGGCDDLYALDARGGLDPLLK

SEQ ID NO: 44770 - DNA, 261 bp, Shewanella oneidensis MR-1
  CDS (1)..(261)
atgtacgttgttatttttggccgtcctggctgtccttattgtgtgcgcgcagtacaactgtcagaacaactcgttgaaaaacgtgatgactttaaatttagatatgtagatatccacgctgaagggatttctaaagcggatctcgaaaaaaccgtcggtaagccagttgaaactgtgccacagattttcgtggatgaaaaacacgttggcggctgcaccgatttcgaacaatatgttcgtgataacaatctattaggttaa

SEQ ID NO: 44771 - protein, 86 aa, Shewanella oneidensis MR-1
MYVVIFGRPGCPYCVRAVQLSEQLVEKRDDFKFRYVDIHAEGISKADLEKTVGKPVETVPQIFVDEKHVGGCTDFEQYVRDNNLLG

SEQ ID NO: 44772 - DNA, 255 bp, Pseudomonas putida KT2440
  CDS (1)..(255)
atgaagcctgtcatcgtctactccagcgactactgcccctactgcatgcgcgccaagtacctgctcgagagcaagggcgtggccttcgaggaaatcaaggtcgacggcaagccgcaggttcgcgccgagatgagtcagaaagccggccgcacgtcggtgccgcagatctggatcggcagcacccatgtcggtggatgcgatgacctctatgccctggagcgcgcgggcaagctcgacgcgttgctggcggcctga

SEQ ID NO: 44773 - protein, 84 aa, Pseudomonas putida KT2440
MKPVIVYSSDYCPYCMRAKYLLESKGVAFEEIKVDGKPQVRAEMSQKAGRTSVPQIWIGSTHVGGCDDLYALERAGKLDALLAA

SEQ ID NO: 44774 - DNA, 252 bp, Pseudomonas syringae pv. tomato str. DC3000
  CDS (1)..(252)
atggctcaagtcatcgtctattccagcgactactgcccgtattgcatacgtgccaagcagctgttgcagagcaagagcgtggccttcgaagaaatccgggtcgacggcaagccgcaattgcgcgccgaaatgaccaagaaggccggtcgtacttctgtaccgcagatctggatcggcccgacccacgtgggcggctgcgatgacctgtttgctctggaacgtgccggcaagcttgatgccctgctggcctga

SEQ ID NO: 44775 - protein, 83 aa, Pseudomonas syringae pv. tomato str. DC3000
MAQVIVYSSDYCPYCIRAKQLLQSKSVAFEEIRVDGKPQLRAEMTKKAGRTSVPQIWIGPTHVGGCDDLFALERAGKLDALLA

SEQ ID NO: 44776 - DNA, 258 bp, Nitrosomonas europaea ATCC 19718
  CDS (1)..(258)
atgcccaagattgtaatgtatgtctccgggtactgtccttattgcactatggcggagaagttgctgcgtgcgagaggggtcgaggagatcgaaaaaatcagggtggatctgcaaccggggctgcgtgccgagatgatgcagcgtaccggacggcgaaccgttccgcagatttatatcggcccggtgcatgtcggggggtacgacgatctggcaatgctggaccgccagggggaactgagcggattgctggctggctaa

SEQ ID NO: 44777 - protein, 85 aa, Nitrosomonas europaea ATCC 19718
MPKIVMYVSGYCPYCTMAEKLLRARGVEEIEKIRVDLQPGLRAEMMQRTGRRTVPQIYIGPVHVGGYDDLAMLDRQGELSGLLAG

SEQ ID NO: 44778 - DNA, 234 bp, Wigglesworthia glossinidia endosymbiont of Glossina brevipalpis
  CDS (1)..(234)
atgaaaaatgtagaaatttatattaaaagtacatgttctttttgtgtaaaagcaaaaaatttattaaaacaaaataatataaaatttaaagaaatttttgtggaaaacagtacagctaatttatcaaaaatgataaaaagaagcaaaaaaacaactgtccctcaaatatttattaataaagtacatataggagggtatgaagatttgattatatttttaaaaaaaaatatataa

SEQ ID NO: 44779 - protein, 77 aa, Wigglesworthia glossinidia endosymbiont of Glossina brevipalpis
MKNVEIYIKSTCSFCVKAKNLLKQNNIKFKEIFVENSTANLSKMIKRSKKTTVPQIFINKVHIGGYEDLIIFLKKNI

SEQ ID NO: 44780 - DNA, 264 bp, Haemophilus ducreyi 35000HP
  CDS (1)..(264)
atgttggtggaaatttatggttgtttaagttgcctatattgtgttcgagctaaacaattagcagaaaaaatggcaattgaattggctgattttgagtttaaatttattgatatgattgcagaaggcatttcaaagcaggatttagccgttcgtgttggcaaagcggtggatacggtaccacaaattttcttagatgatcaagctgttggcggttgtactgaattccagcagttagtaaaacaaaaatttgatattgaattataa

SEQ ID NO: 44781 - protein, 87 aa, Haemophilus ducreyi 35000HP
MLVEIYGCLSCLYCVRAKQLAEKMAIELADFEFKFIDMIAEGISKQDLAVRVGKAVDTVPQIFLDDQAVGGCTEFQQLVKQKFDIEL

SEQ ID NO: 44782 - DNA, 1803 bp, Danio rerio
  CDS (1)..(1803)
atgccgcccatagagaatgacgcgggtcgagagcagatccgatcgaaaatcaaagaactgatcgattccagtgcagttgtggtgtttagcaaaagcttctgtccgttttgtgtcaaggtgaaggatctctttaaagagctgaatgtcaagtataacaccatagagctggatctgatggaggatgggacaaactaccaggacttgttgcatgagatgaccggccagaaaaccgttcctaatgtcttcatcaacaagaaacacatcggaggctgtgacaacaccatgaaggcacacaaagatggcgtcctgcagaagctgttgggcgaagggagtgaagtgtacgattatgacctcatcgtcatcggcggtggatcaggtggtctggcctgttcaaaggaagcagcaaccttgggtaaaaaggtgatggttctggattatgttgttccaacaccacagggcacagcctggggtctgggcggcacatgtgtgaatgtgggctgtattcctaagaaactgatgcaccaaacagcactgctgggcacagccatggaggacgctcgcaagtttggatgggagttcgctgaacaggtgacacacaactgggaaacaatgaagactgcagtgaataactacattgggtcactgaactggggctacagggtttccctaagggacaaaaacgtcaactatgtcaacgcttatgctgagtttgtggagccgcacaagatcaaggccacaaacaagcgtggcaaagagacgttctacaccgcggctcagtttgtcctggcgactggagaaaggcctcgttacctgggcatcccgggagacaaagagttctgcatcaccagtgatgatctgttctctttgccctactgtcctgggaagactcttgtggtgggagcctcttatgtggctctggagtgtggtggctttctggctggtttggggctggatgtgaccatcatggttcgctctattctgctgcgaggctttgatcaggacatggctgaccgtgcaggagaatacatggagacacacggggtcaaattcctcaggaagtttgttcccactaagatcgagcagctggaagctggaactcctggccgaattaaagtgactgctaagtcaacagagagtgaggaagtcttcgaaggagaatacaacactgtgttgatagcagtgggccgtgacgcctgtacaggaaagatcggtctggacaaggcgggagttaaaatcaatgagaagaacgggaaggttccagtgaatgatgaggagcaaaccaacgttcctcacatctatgccattggagacattctggagggaaagtgggagctcacgccggtggccatacaggctggtaaactgctggcccgcagactgtacgcaggagcaaccatgaagtgtgattatgtgaacgtccccaccactgtcttcactcctatggaatacggcagctgtggacacccagaggaaaaggccatccagatgtacggacaggaaaaccttgaggtttatcacagtctgttctggcctctggagtttaccgttcccggacgggacaataacaagtgctacgccaagatcatctgcaataaactggacaatctgcgtgtgattggcttccactatctgggtcctaatgctggcgaggtcacgcagggattcggagctgctatgaagtgtggaataaccaaagatcagctggacaacaccatcggcattcaccccacctgtgctgagatcttcaccactatggaggtcaccaagagctccggcggagacatcactcaatccggctgctga

SEQ ID NO: 44783 - protein, 600 aa, Danio rerio
MPPIENDAGREQIRSKIKELIDSSAVVVFSKSFCPFCVKVKDLFKELNVKYNTIELDLMEDGTNYQDLLHEMTGQKTVPNVFINKKHIGGCDNTMKAHKDGVLQKLLGEGSEVYDYDLIVIGGGSGGLACSKEAATLGKKVMVLDYVVPTPQGTAWGLGGTCVNVGCIPKKLMHQTALLGTAMEDARKFGWEFAEQVTHNWETMKTAVNNYIGSLNWGYRVSLRDKNVNYVNAYAEFVEPHKIKATNKRGKETFYTAAQFVLATGERPRYLGIPGDKEFCITSDDLFSLPYCPGKTLVVGASYVALECGGFLAGLGLDVTIMVRSILLRGFDQDMADRAGEYMETHGVKFLRKFVPTKIEQLEAGTPGRIKVTAKSTESEEVFEGEYNTVLIAVGRDACTGKIGLDKAGVKINEKNGKVPVNDEEQTNVPHIYAIGDILEGKWELTPVAIQAGKLLARRLYAGATMKCDYVNVPTTVFTPMEYGSCGHPEEKAIQMYGQENLEVYHSLFWPLEFTVPGRDNNKCYAKIICNKLDNLRVIGFHYLGPNAGEVTQGFGAAMKCGITKDQLDNTIGIHPTCAEIFTTMEVTKSSGGDITQSGC

SEQ ID NO: 44784 - DNA, 261 bp, Photorhabdus luminescens subsp. laumondii TTO1
  CDS (1)..(261)
atgtttactgtgattttcggtcgtcctggctgcccgtactgtgtccgcgcgaaagagctggcggaacgactgaaagagcagcgtgatgactttgacttccgttatgttgatattcacgcagaaggtatcactaaagctgatctggaaaaaacagttggtaaaccggtagaaactgtcccgcaaatttttgttgatgagaaacatatcggtggctgcactgacttcgaagcgtacgtaaaagaacaccaattgctacaataa

SEQ ID NO: 44785 - protein, 86 aa, Photorhabdus luminescens subsp. laumondii TTO1
MFTVIFGRPGCPYCVRAKELAERLKEQRDDFDFRYVDIHAEGITKADLEKTVGKPVETVPQIFVDEKHIGGCTDFEAYVKEHQLLQ

SEQ ID NO: 44786 - DNA, 264 bp, Vibrio vulnificus YJ016
  CDS (1)..(264)
atgttcgtagttatttttggtcgtccggcatgcccttactgtgttcgtgctaaagaacacgcagaaactcttaaagcaaagcgcgacgatttcaactaccgttacgtagacatccaagcggaaggcatttctaaagctgacctagaaaaaaccgttggcaaacccgttgaaacggttccacaaatcttcatcgatcaacagcacatcggtggttgtgatgacttcgaagcttacgcaaaagagcatcttggtctgttcgattaa

SEQ ID NO: 44787 - protein, 87 aa, Vibrio vulnificus YJ016
MFVVIFGRPACPYCVRAKEHAETLKAKRDDFNYRYVDIQAEGISKADLEKTVGKPVETVPQIFIDQQHIGGCDDFEAYAKEHLGLFD

SEQ ID NO: 44788 - DNA, 339 bp, Wolbachia endosymbiont of Drosophila melanogaster
  CDS (1)..(339)
gtgaaaaatgttgtgatatatgtaaagaagggctgtccatactgcataaggggaaaggatttactagataaaaaaggtgtgaagtatgaagaaattgatgtgctcaaaaactcagatctatttaacgacataaaatcaaagtataacgttagaacagttccacagatttttatcaacgataagcacattggggggtgtgacaaattgatggatcttgaaaaagaaggaaagttggatgatatgctaaataataatgacaatcacactgatgtcacaacctacacaaacagcaatgatgaatgtggagagtgtgttataccacatgatgattttatgtaa

SEQ ID NO: 44789 - protein, 112 aa, Wolbachia endosymbiont of Drosophila melanogaster
MKNVVIYVKKGCPYCIRGKDLLDKKGVKYEEIDVLKNSDLFNDIKSKYNVRTVPQIFINDKHIGGCDKLMDLEKEGKLDDMLNNNDNHTDVTTYTNSNDECGECVIPHDDFM

SEQ ID NO: 44790 - DNA, 330 bp, Neurospora crassa; identical to SEQ ID NO: 6934
  CDS (1)..(330)

SEQ ID NO: 44791 - protein, 109 aa, Neurospora crassa; identical to SEQ ID NO: 6935

SEQ ID NO: 44792 - DNA, 309 bp, Magnaporthe grisea 70-15
  CDS (1)..(309)
atgtctgaagcagcaaagcaaaaggctcaaaagctcattgacgagaacgccgttatggtgttcagcaagtcatactgcccctactgcaccgccaccaagtcgaagctcaaggatataggcgcaaagtacaacgtcctcgagctggaccagattgatgacggcagcgccatccaggatgcacttcaggagatcaccggccagcgctcggttcccaacattttcatcggccagaagcacattggcggcaactcggacttccaggcactcggcaactcggaaagcttgatcaaggcggcaggtgctttgtga

SEQ ID NO: 44793 - protein, 102 aa, Magnaporthe grisea 70-15
MSEAAKQKAQKLIDENAVMVFSKSYCPYCTATKSKLKDIGAKYNVLELDQIDDGSAIQDALQEITGQRSVPNIFIGQKHIGGNSDFQALGNSESLIKAAGAL

SEQ ID NO: 44794 - DNA, 321 bp, Gibberella zeae PH-1
  CDS (1)..(321)
atgtctcaagcatctaccaaggttcagcagcttatcgacaacaactctgttgttgtcttctccaagtcttactgcccctactgcaagcagaccaagaagactctggatgatttgaacaccgagtacgagctccttgagctcgacgaagttgccgatggctctgctctccaggacgctctcgagaagatctctggccagcgtaccgtccccaacgtctacatcaagcagcagcacattggtggtaactcagacctccagagcctgaactctggcggaaagctcaagaaccttctcaaggaggccaatgccttgaaggcgtaa

SEQ ID NO: 44795 - protein, 106 aa, Gibberella zeae PH-1
MSQASTKVQQLIDNNSVVVFSKSYCPYCKQTKKTLDDLNTEYELLELDEVADGSALQDALEKISGQRTVPNVYIKQQHIGGNSDLQSLNSGGKLKNLLKEANALKA

SEQ ID NO: 44796 - DNA, 309 bp, Ustilago maydis 521
  CDS (1)..(309)
atggcggctaaacaggcagctgaaaagctcatctcggagcacctcgtggcggtcttcagcaagagctattgtccttactgctcacaggccaagagtgtcatagaaaagctcggtctggacaagagcaaagtcggaattctcgagctcgaccagatgggttccgaaggcagcgacatccaggcttacctcctcgacaagaccagccagcgtacggtccccaacatctttatcaaccagaaacacctcggtggctgctccgacctgctcgacgctcagaagagtggaaagctccaacagctcctccagtag

SEQ ID NO: 44797 - protein, 102 aa, Ustilago maydis 521
MAAKQAAEKLISEHLVAVFSKSYCPYCSQAKSVIEKLGLDKSKVGILELDQMGSEGSDIQAYLLDKTSQRTVPNIFINQKHLGGCSDLLDAQKSGKLQQLLQ

SEQ ID NO: 44798 - DNA, 309 bp, Aspergillus nidulans FGSC A4
  CDS (1)..(309)
atgtcttccgcaaaggtcaaggcccagcaaatcattgatgagaacggcgttgtcgtcttctccaagtcctactgcccctactgcaaggccagcaagagcctcctgagcgaactgggcgccaaatactacgcgcttgagctggataccatcgatgacggagctgacctccagaacgcccttgaggaaatcagcggccagcgcaccgttcccaacatctacattgccaaaaagcacattggtggaaactcggacctccagggtatcaagaaggatctgcccgcgctgttaaaggatgctggagctctgtaa

SEQ ID NO: 44799 - protein, 102 aa, Aspergillus nidulans FGSC A4
MSSAKVKAQQIIDENGVVVFSKSYCPYCKASKSLLSELGAKYYALELDTIDDGADLQNALEEISGQRTVPNIYIAKKHIGGNSDLQGIKKDLPALLKDAGAL

SEQ ID NO: 44800 - DNA, 342 bp, Debaryomyces hansenii CBS767
  CDS (1)..(342)
atgttcgaatatattaagtcatggttcgtttcacctccagtatcgcctgtaataaaggctgaagttcaaaatttaattgatagtaataaaatcttaattttcctgaagtcatattgtccatactgtgattccaccaaagacttaatcaagtccataacgtccgactttaaagtggttgagttgaatacttcggctaatggtagaacgatacaagatgctttacgtgaaatgacaggacaaaacactgttccaaatatttttatcaataggaaacatatcggtggcaattcagatctccaggctttacaaggagccggcaaacttaagtcattagttaactaa

SEQ ID NO: 44801 - protein, 113 aa, Debaryomyces hansenii CBS767
MFEYIKSWFVSPPVSPVIKAEVQNLIDSNKILIFLKSYCPYCDSTKDLIKSITSDFKVVELNTSANGRTIQDALREMTGQNTVPNIFINRKHIGGNSDLQALQGAGKLKSLVN

SEQ ID NO: 44802 - DNA, 258 bp, Bartonella quintana str. Toulouse
  CDS (1)..(258)
atgaaagaggtaacactttatacacgtcctaactgtccttattgcgcgaaagctcgtgatttgcttgataaaaaaggcgtgaaatatacagatattgatgcatcaactgttttgcgcgaagaaatggtgcagcgcgcaaatgggcggaatacatttccacaaatttttataggtgattatcatgtcggtggttgtgatgatctctacgctttaaatgctaagggagagcttaattctttgctgcaaagcgtggaatag

SEQ ID NO: 44803 - protein, 85 aa, Bartonella quintana str. Toulouse
MKEVTLYTRPNCPYCAKARDLLDKKGVKYTDIDASTVLREEMVQRANGRNTFPQIFIGDYHVGGCDDLYALNAKGELNSLLQSVE

SEQ ID NO: 44804 - DNA, 258 bp, Acinetobacter sp. ADP1
  CDS (1)..(258)
atggcggcaaatatcaccatttattcgaccacggtgtgtccgtattgcattcgtgcaaaacaactacttgagcgcaaaggcgttaaatataaagaaatcaatctgtccaatgaagcaccagaagtacgtgttgaattaatgcaacgcacccatcaccgtacagtgcctcaaatttttatcaatgaccagtttattggcggttttgatcagctttatgctttagagcgtgatggtaaactcgacgaattattggcttaa

SEQ ID NO: 44805 - protein, 85 aa, Acinetobacter sp. ADP1
MAANITIYSTTVCPYCIRAKQLLERKGVKYKEINLSNEAPEVRVELMQRTHHRTVPQIFINDQFIGGFDQLYALERDGKLDELLA

SEQ ID NO: 44806 - DNA, 267 bp, Erwinia carotovora subsp. atroseptica SCRI1043
  CDS (1)..(267)
atgttcgctgtaattttcgggcgccctgcttgcccttattgtgtacgtgcgaaagaactggcagagaaactggccgagcaacgtgatgacttcagcttccgctatgtagacattcacgccgaaggcatttcgaaagaagatttgtccaagacggtaggaaaaccggttgaaactgtaccgcagattttcctggatgaaaaacacatcggcggctgcactgattttgaagcttatgccaaagagcatctggcgctgttccagtcataa

SEQ ID NO: 44807 - protein, 88 aa, Erwinia carotovora subsp. atroseptica SCRI1043
MFAVIFGRPACPYCVRAKELAEKLAEQRDDFSFRYVDIHAEGISKEDLSKTVGKPVETVPQIFLDEKHIGGCTDFEAYAKEHLALFQS

SEQ ID NO: 44808 - DNA, 315 bp, Rickettsia typhi str. Wilmington
  CDS (1)..(315)
atgaataaatctatattacacacaattattatttatactctagctagttgtccttattgcataaaagctaaagcgttgcttgataagaaaaatgttatttatgaggaaattgaagtaagtaattttacgcaagaagagaaagaagcatttattaagaaatccggtggaaaaaatactgttccacagatctttatagataatatgcatgttggcgggtgtgatgatttatttaatcttgaacaagatgggaggttagataaattgttagaaactcagcctaagaataagaattctttgaccgtttctggggcgtaa

SEQ ID NO: 44809 - protein, 104 aa, Rickettsia typhi str. Wilmington
MNKSILHTIIIYTLASCPYCIKAKALLDKKNVIYEEIEVSNFTQEEKEAFIKKSGGKNTVPQIFIDNMHVGGCDDLFNLEQDGRLDKLLETQPKNKNSLTVSGA

SEQ ID NO: 44810 - DNA, 264 bp, Mannheimia succiniciproducens MBEL55E
  CDS (1)..(264)
atgttcgtagttatttttggtcgccctggttgcccatattgtgtacgtgctaaaaacttagcagaaaaattaaaaaacagcttagatgatttcgactatcgttatgttgatattattgccgagggcatcagcaaagcggatttatcaaaatccgtcggcaaagaagtggaaaccgtgccgcaaatctttattgatgaaaaaccaatcggcggttgcacggattttgaagctctaatgaaagaacaatttaatattgttgcataa

SEQ ID NO: 44811 - protein, 87 aa, Mannheimia succiniciproducens MBEL55E
MFVVIFGRPGCPYCVRAKNLAEKLKNSLDDFDYRYVDIIAEGISKADLSKSVGKEVETVPQIFIDEKPIGGCTDFEALMKEQFNIVA

SEQ ID NO: 44812 - DNA, 255 bp, Legionella pneumophila subsp. pneumophila str. Philadelphia 1
  CDS (1)..(255)
atgaatgaagtcatactctacactacaggctattgtccttattgcatcaaagcaaaagaactactagatagaaaaaaggttatctataccgaaatccgcgtcgatttacagcctgaattacgtgaagaaatgatacaaaaaagtggccggcgtacagtgcctcaaattttcattaatggccaggcaattggtggctgcgatgatttatatgccctggaagcccagggaacattaaatgaacttttaaaaaaatag

SEQ ID NO: 44813 - protein, 84 aa, Legionella pneumophila subsp. pneumophila str. Philadelphia 1
MNEVILYTTGYCPYCIKAKELLDRKKVIYTEIRVDLQPELREEMIQKSGRRTVPQIFINGQAIGGCDDLYALEAQGTLNELLKK

SEQ ID NO: 44814 - DNA, 255 bp, Legionella pneumophila str. Lens
  CDS (1)..(255)
atgaatgaagtcatactctacactacaggctattgtccttattgcatcaaagcaaaagaactactagatagaaaaaaggttatctataccgaaatccgcgtcgatttaaagcctgaattacgtgaagaaatgatacaaaaaagtggccggcgtacagtgcctcaaattttcattaatggccaggcaattggtggctgcgatgatttatatgcactggaagcccagggaacattaaatgaacttttaaaaaaatag

SEQ ID NO: 44815 - protein, 84 aa, Legionella pneumophila str. Lens
MNEVILYTTGYCPYCIKAKELLDRKKVIYTEIRVDLKPELREEMIQKSGRRTVPQIFINGQAIGGCDDLYALEAQGTLNELLKK

SEQ ID NO: 44816 - DNA, 279 bp, Photobacterium profundum SS9
  CDS (1)..(279)
ttgaggagagatattatgttcgttgttatttttggtcgtcctggttgcccattctgtgttcgtgcaaaagaccttgctgaaaaactaaaagaagagcgcgacgattttaatttccgttacgtagacattcatgcggaaggcatcagtaaatctgacctagaaaaaacggttggtaaacctgttgaaacagttcctcaaatttttgttgaccaagaccacgttggtggctacacagaatttgaagcatacgcaaaagaaaacctaagcctttttcaataa

SEQ ID NO: 44817 - protein, 92 aa, Photobacterium profundum SS9
MRRDIMFVVIFGRPGCPFCVRAKDLAEKLKEERDDFNFRYVDIHAEGISKSDLEKTVGKPVETVPQIFVDQDHVGGYTEFEAYAKENLSLFQ

SEQ ID NO: 44818 - DNA, 243 bp, Anaplasma marginale str. St. Maries
  CDS (1)..(243)
atgcgggaggtcctcatatatacaaaggtcccctgcccctattgtactagggcaaaggctttgttcaacaaaaaaaatgtaccctttaaggagattgacatcaccgataacccggaggctatgcgtgagatggtagagcgctcggggaggaggactgtgccgcagatttttattgacggcaagagcataggcggttgtgatgatctatacgccctgtacgaatccggggagttggaactctag

SEQ ID NO: 44819 - protein, 80 aa, Anaplasma marginale str. St. Maries
MREVLIYTKVPCPYCTRAKALFNKKNVPFKEIDITDNPEAMREMVERSGRRTVPQIFIDGKSIGGCDDLYALYESGELEL

SEQ ID NO: 44820 - DNA, 267 bp, Idiomarina loihiensis L2TR
  CDS (1)..(267)
atgtttacagtcatttttggacgtccgggttgtcctttttgtgttcgtgccgtagaagttgcggataaattaaaagccgatatggaagattttgattatcgctatgtcgacattcacgctgaaggcatcagcaaagctgacctggaaaaaacggtaggcaagccggtacaaacggttcctcaaatttttgtcgacgaacaacacgttggcggcttcacagaatttgaagcctacgcaaaagaaaacttagggctttacactgcataa

SEQ ID NO: 44821 - protein, 88 aa, Idiomarina loihiensis L2TR
MFTVIFGRPGCPFCVRAVEVADKLKADMEDFDYRYVDIHAEGISKADLEKTVGKPVQTVPQIFVDEQHVGGFTEFEAYAKENLGLYTA

SEQ ID NO: 44822 - DNA, 261 bp, Francisella tularensis subsp. tularensis Schu 4
  CDS (1)..(261)
atgaaagtaaaaatatatactagaaatggttgtccatattgtgtttgggcaaaacaatggttcgaagaaaataatatagcttttgatgaaactataattgatgattatgctcaacgttctaagttttatgatgaaatgaatcaaagtggcaaagttatcttccctatttcaactgtgccacaaatattcatagatgatgaacatataggtggctttacagagcttaaggctaatgctgataaaattttaaacaaaaaatag

SEQ ID NO: 44823 - protein, 86 aa, Francisella tularensis subsp. tularensis Schu 4
MKVKIYTRNGCPYCVWAKQWFEENNIAFDETIIDDYAQRSKFYDEMNQSGKVIFPISTVPQIFIDDEHIGGFTELKANADKILNKK

SEQ ID NO: 44824 - DNA, 264 bp, Synechococcus elongatus PCC 6301
  CDS (1)..(264)
gtggccaacgtcgaaatttacacttggagcgcttgccccttctgtgttcgggcgaaagcgctgctcactcgcaagggtgtggcgtttcaggaatacgtgattgacggagacgaagcagcacgagcagtcatggctcagcgtgcgaacggtcgccggagtgtgccgcaaattttcattgatgaccagcacatcggtggttgcgacgacctgcatgccctcgatcgccaaggtggtcttgatccgctattgggtcttagcgcgtga

SEQ ID NO: 44825 - protein, 87 aa, Synechococcus elongatus PCC 6301
MANVEIYTWSACPFCVRAKALLTRKGVAFQEYVIDGDEAARAVMAQRANGRRSVPQIFIDDQHIGGCDDLHALDRQGGLDPLLGLSA

SEQ ID NO: 44826 - DNA, 288 bp, Ehrlichia ruminantium str. Welgevonden
  CDS (1)..(288)
atgatatccacaaacacgtggttaaacattataggatatgcagtgacaaaggttataatatatactaaagacttttgttcttattgtactaaagcaaaggctttattcaatagaaaaaatataccatttgaagaaattaatataacaggcaacagtacccttaaagatgaaatgatacaaaaatccaatggtatgaaaaccttacctcaaatatttattaatgatgtacacataggtgggtgtgatgacttatatagactatatgaatctggtcaattaaagttatag

SEQ ID NO: 44827 - protein, 95 aa, Ehrlichia ruminantium str. Welgevonden
MISTNTWLNIIGYAVTKVIIYTKDFCSYCTKAKALFNRKNIPFEEINITGNSTLKDEMIQKSNGMKTLPQIFINDVHIGGCDDLYRLYESGQLKL

SEQ ID NO: 44828 - DNA, 255 bp, Azotobacter vinelandii
  CDS (1)..(255)
atgccgcacatcgtcatctataccagcgcctggtgcccctactgcatacgggccaagcaactgctggacaggaaaggcgtcgcctaccgggagatcggtgtcgacggcaaaccggagctgcgcgccgagatgacccgcaaggccggacgcacctcggttccgcaaatctggatcggcgatacccacgtgggtgggtgtgacgatctccatgccctggagcgcgcgggccgcctggacgcgctgctcgaggattga

SEQ ID NO: 44829 - protein, 84 aa, Azotobacter vinelandii
MPHIVIYTSAWCPYCIRAKQLLDRKGVAYREIGVDGKPELRAEMTRKAGRTSVPQIWIGDTHVGGCDDLHALERAGRLDALLED

SEQ ID NO: 44830 - DNA, 252 bp, Pseudomonas syringae pv. syringae B728a
  CDS (1)..(252)
atggctcaagtcatcgtctattccagcgactactgcccgtattgcatacgtgccaaacagcttctgcagagcaagagcgtggccttcgaggaaatccgggtcgacggcaagccgcagctgcgtgccgaaatgacccagaaggccggtcgtacttccgtaccgcaaatctggatcggttcgacccacgtgggcggctgcgatgacctgttcgctctggagcgtgccggcaagctcgatgcgctgctggcctga

SEQ ID NO: 44831 - protein, 83 aa, Pseudomonas syringae pv. syringae B728a
MAQVIVYSSDYCPYCIRAKQLLQSKSVAFEEIRVDGKPQLRAEMTQKAGRTSVPQIWIGSTHVGGCDDLFALERAGKLDALLA

SEQ ID NO: 44832 - DNA, 264 bp, Actinobacillus pleuropneumoniae serovar 1 str. 4074
  CDS (1)..(264)
atgttcgtagaaatttatggtcgtatgacttgcccgtactgcacacgtgcgaaagcgttagcggaaaaaatgaaaggcgaattagctgatttcgattttaaatttatcgatatgattgctgaaggcatttcaaaagaagatttagaaccgcgtgtcggcaaaccggttgcaactgtgccgcaaattttcttagataacgttcacgttggcggttgtactgatttccaagcgttagtgaaagaaaaatttggtattgaagtttaa

SEQ ID NO: 44833 - protein, 87 aa, Actinobacillus pleuropneumoniae serovar 1 str. 4074
MFVEIYGRMTCPYCTRAKALAEKMKGELADFDFKFIDMIAEGISKEDLEPRVGKPVATVPQIFLDNVHVGGCTDFQALVKEKFGIEV

SEQ ID NO: 44834 - DNA, 258 bp, Ralstonia eutropha JMP134
  CDS (1)..(258)
atggcccgcgtcgtcatgtacagcacgcaggtgtgcccttattgcgtgatggctgagcgcttgctcaagtccaagggcgtcgagacgatcgagaaggtcctgatcgaccgtgaacccggcaagcgcgaggaaatgatgtcgcgcaccggtcgccgcaccgtgccccagatctatatcggcgacacccacgttggcggtttcgacgatctctccgcgctggaccgccagggcggactgacgccgctgctggccgcctga

SEQ ID NO: 44835 - protein, 85 aa, Ralstonia eutropha JMP134
MARVVMYSTQVCPYCVMAERLLKSKGVETIEKVLIDREPGKREEMMSRTGRRTVPQIYIGDTHVGGFDDLSALDRQGGLTPLLAA

SEQ ID NO: 44836 - DNA, 246 bp, Ehrlichia canis str. Jake
  CDS (1)..(246)
atgacaaaagttataatatatactaaagacccctgcccttattgtactaaagcaaaagctttattcaacaaaaaaaacattctctttaaagaaattgacgttacaaataatagtacattgctagaagaaatgatacaaaaatccaatggcatgagaacattacctcaaatatttatcaatgatcagcacataggtggttgtgatgacttatacaggttgtatgaatcaggcaagttagaattataa

SEQ ID NO: 44837 - protein, 81 aa, Ehrlichia canis str. Jake
MTKVIIYTKDPCPYCTKAKALFNKKNILFKEIDVTNNSTLLEEMIQKSNGMRTLPQIFINDQHIGGCDDLYRLYESGKLEL

SEQ ID NO: 44838 - DNA, 261 bp, Burkholderia cepacia R1808
  CDS (1)..(261)
atgaacaaggttctgatgtacagcacgcaggtgtgtccgtattgcatgcaggccgagcgtctgctgaagctgcgcggcgtcgagcagatcgaaaaggtgctgatcgaccgcgatccggcccgccgcgaggagatgatgacgcgcacgggccgccgcacagtgccgcagatctacatcggcgacacccacgtcggcggttacgacgatctgtcgaagctcgatcgcgaaggcggcctgttgccgcttctgcaagcggcctga

SEQ ID NO: 44839 - protein, 86 aa, Burkholderia cepacia R1808
MNKVLMYSTQVCPYCMQAERLLKLRGVEQIEKVLIDRDPARREEMMTRTGRRTVPQIYIGDTHVGGYDDLSKLDREGGLLPLLQAA

SEQ ID NO: 44840 - DNA, 267 bp, Rhodospirillum rubrum
  CDS (1)..(267)
atggttgccgttgagattttcaccaccccgagctgtccctattgtcggcgcgccaaggcgctgctgggcgacaagggggtggcctatcgcgagatcgatgtgtcgggcgatccccggttgcgcgaggagatgacccggcgggccggcgggcgcagcaccgttccgcagatcttcatcgacggccgggccttgggcggctgcgatgacatccacgcccttgaccgcctgggcaagcttgatggtcttctgtcgggaagcgcgccatga

SEQ ID NO: 44841 - protein, 88 aa, Rhodospirillum rubrum
MVAVEIFTTPSCPYCRRAKALLGDKGVAYREIDVSGDPRLREEMTRRAGGRSTVPQIFIDGRALGGCDDIHALDRLGKLDGLLSGSAP

SEQ ID NO: 44842 - DNA, 258 bp, Ralstonia metallidurans CH34
  CDS (1)..(258)
atggcccgcgtcgtcatgtacagcacggtggtgtgcccctactgccagatggcagagcgtctgctcaagcagcggggcgtcgaggcgatcgagaaaatcctgatcgaccgcgaacccggcaagcgcgaggaaatgatgactcgcaccggccgccggaccgtgccgcagatctatatcgacgagacacacgtgggtggattcgacgacttgtccgcgctggaccgtcagggcggcctggtgccgctgctggcggcctga

SEQ ID NO: 44843 - protein, 85 aa, Ralstonia metallidurans CH34
MARVVMYSTVVCPYCQMAERLLKQRGVEAIEKILIDREPGKREEMMTRTGRRTVPQIYIDETHVGGFDDLSALDRQGGLVPLLAA

SEQ ID NO: 44844 - DNA, 243 bp, Novosphingobium aromaticivorans DSM 12444
  CDS (1)..(243)
atgtacaccaagtggggctgcccctactgctttcgcgccaagcaactgctggacggcaagggcgtatcctacgaggaaatcgacgtgacgatgggcgggccgaagaagaccgagatgctcgagcgcgcgccagggcacaccaccgttccctcgatcttcatcgacggcctccacgtgggcggttccgatgacctcgccgcgctcaacgcgcagggcaagctggacatgatgctgggcctgtga

SEQ ID NO: 44845 - protein, 80 aa, Novosphingobium aromaticivorans DSM 12444
MYTKWGCPYCFRAKQLLDGKGVSYEEIDVTMGGPKKTEMLERAPGHTTVPSIFIDGLHVGGSDDLAALNAQGKLDMMLGL

SEQ ID NO: 44846 - DNA, 261 bp, Trichodesmium erythraeum IMS101
  CDS (1)..(261)
atgtctgttaacatagaaatttatacctggtcaagttgtccgttttgcatcagtgctaaagcactgttagataaaaagcaagtaaactatcaggaataccctatagatggcgatgatatagaacgagaaaaaatggcctgtagagctaatggccgtaattctttgccccaaatctttatcgatgaggaacatatagggggttgtgatgatttatatggactggaagctcaagggaaactagaccgactcttgaagaaatag

SEQ ID NO: 44847 - protein, 86 aa, Trichodesmium erythraeum IMS101
MSVNIEIYTWSSCPFCISAKALLDKKQVNYQEYPIDGDDIEREKMACRANGRNSLPQIFIDEEHIGGCDDLYGLEAQGKLDRLLKK

SEQ ID NO: 44848 - DNA, 294 bp, Rickettsia akari str. Hartford
  CDS (1)..(294)
atgaataaagctatattacacacaattattatttatactctcgtgagttgtccttattgcataaaagctaaagcattgcttgatgagcaaaatattgcttatgaggaaattgaagtaagtaatttgactcaggcagagaaagaaaaatttattaagaaatccggtggtaaaggaactgttccacagatatttatagataatatgcatgttggcgggtgtgatgatttatttgatcttgaaaaagaggggaggctagataagttgctggaagggcaaccgaagaagagtatttaa

SEQ ID NO: 44849 - protein, 97 aa, Rickettsia akari str. Hartford
MNKAILHTIIIYTLVSCPYCIKAKALLDEQNIAYEEIEVSNLTQAEKEKFIKKSGGKGTVPQIFIDNMHVGGCDDLFDLEKEGRLDKLLEGQPKKSI

SEQ ID NO: 44850 - DNA, 315 bp, Fritillaria agrestis
  CDS (1)..(315)
atggctctcgcgaaggcaaaggatctcgtcgcctccaaccccgtcgtcgtcttcagcaagtcatactgtccctactgtatccgggttaaggagttgctggtgaagttgaaggcaacttacaaagtgattgaattggatctggaaagtgatggatcggcaatacaagctgcactagctgagtggaccggacaaaggacggtgccaaatgttttcatcggtgggaagcatatcggtggctgtgataagactatggagctgtacaactctggcaagctgcagccgttgttggtggaggctggggctcttgctgcttag

SEQ ID NO: 44851 - protein, 104 aa, Fritillaria agrestis; identical to SEQ ID NO: 6937

SEQ ID NO: 44852 - DNA, 411 bp, Oryza sativa
  CDS (1)..(411)
atggcggcgctgctgggccggaggttcgggatggcggcggcggcgctcatcgccctcgcggcgctcggatccgccgcctcggggacggcgtccaagtcgtccttcgtgaaatccaccgtcaaagcccacgacgtcgtcatattctccaagtcatactgcccgtactgtagaagagccaaagctgtgttcaaggaacttgaactgaagaaggagccgtatgttgtggagcttgatcaacgagaggatggttgggagattcaggatgccttatctgacatggttggcaggcgaactgttcctcaagtttttgtccatgggaagcacctgggtggctctgatgatactgttgaagcatatgagagtggcaagctagccaaacttttgaacattgatgtcaaagaagatctttga

SEQ ID NO: 44853 - protein, 136 aa, Oryza sativa
MAALLGRRFGMAAAALIALAALGSAASGTASKSSFVKSTVKAHDVVIFSKSYCPYCRRAKAVFKELELKKEPYVVELDQREDGWEIQDALSDMVGRRTVPQVFVHGKHLGGSDDTVEAYESGKLAKLLNIDVKEDL

SEQ ID NO: 44854 - DNA, 420 bp, Populus tremula x Populus tremuloides; identical to SEQ ID NO: 6960
  CDS (1)..(420)

SEQ ID NO: 44855 - protein, 139 aa, Populus tremula x Populus tremuloides; identical to SEQ ID NO: 6961

SEQ ID NO: 44856 - DNA, 342 bp, Deschampsia antarctica
  CDS (1)..(342)
atggcgctcgccaaggccaaggaaatcgccgcctcttctcccgtcgtcgtcttcagcaagtcttactgcccttactgcacacgggtaaagcaattgttcacaaagctaggagcaagtttcaaggctattgagctagatgtggaaggtgatggagctgatatgcagtcagcccttgctcaatggactggacagaagaccgttccaaatgtcttcatcaatgggaaacacatcggtggttgtgatgatacccttgcactggagaagtcagggaagctggtgcctctgctgagggaggccggagcaatctctggttctgcttcgaaggaaaccatgactgcttag

SEQ ID NO: 44857 - protein, 113 aa, Deschampsia antarctica; identical to SEQ ID NO: 6967

SEQ ID NO: 44858 - DNA, 264 bp, Salmonella typhimurium
  CDS (1)..(264)
atgtttactgttatttttggccgcccagggtgcccttattgcgtgcgtgcaaaagagttggcggaaaaactgagcaaagaacgcgacgatttcaactaccgctatattgatatccatgccgaaggcattactaaagcggatttggaaaaaaccgtaggtaaacctgtagaaaccgtaccgcagatttttgtcgatcaaaaacatatcggcggctgtacggattttgaagcatgggcaaaagaaaatctgaatcttttcgcctga

SEQ ID NO: 44859 - protein, 87 aa, Salmonella typhimurium
MFTVIFGRPGCPYCVRAKELAEKLSKERDDFNYRYIDIHAEGITKADLEKTVGKPVETVPQIFVDQKHIGGCTDFEAWAKENLNLFA

SEQ ID NO: 44860 - DNA, 306 bp, Schizosaccharomyces pombe
  CDS (1)..(306)
atgtctagtgttgaatcatttgttgactctgccgttgctgacaacgatgttgttgtttttgccaagtcttactgcccttactgccatgctactgaaaaggtgatcgctgataagaaaattaaggctcaggtataccagattgaccttatgaacaacggtgatgagattcaatcttacttattgaagaagaccggtcaacgtaccgtacccaatatctttattcaccaaaagcatgttggtggtaactcggatttccaagcattattcaagaagggcgagctcgactctctttttaatactgcctaa

SEQ ID NO: 44861 - protein, 101 aa, Schizosaccharomyces pombe; identical to SEQ ID NO: 6925

SEQ ID NO: 44862 - DNA, 264 bp, Haemophilus influenzae
  CDS (1)..(264)
atgttcgttgttatttttggtcgtcctggctgcccttactgtgtacgagcaaaaaaccttgctgaaaaattaaaaggcgaagttgctgattttgactatcgttatgtggatattcacgcagaaggcattactaaagaagatttatcaaaatctgttggtaaaccagtagaaaccgtaccacaaatctttattgatgaaaaaccaattggtggttgcactgattttgaagcattaatgaaagaacaatttggtatcgttgcttaa

SEQ ID NO: 44863 - protein, 87 aa, Haemophilus influenzae
MFVVIFGRPGCPYCVRAKNLAEKLKGEVADFDYRYVDIHAEGITKEDLSKSVGKPVETVPQIFIDEKPIGGCTDFEALMKEQFGIVA

SEQ ID NO: 44864 - DNA, 255 bp, Pseudomonas aeruginosa
  CDS (1)..(255)
atgccgcccgtcgtgatctacaccaccgcctggtgtccgtactgcatccgcgccaagcagttgctgcaacgcaagggcgtggacttccaggagatcgcctgcgacggcaagcccgaactgcgcgccgagctggcacgcaaggcgggatcgaccaccgtgccgcagatctggatcggcgagacccatgtcggcggctgcgacgaccttcatgcactggagcgcgccggcaagctggacgcgctgctgtctgcctga

SEQ ID NO: 44865 - protein, 84 aa, Pseudomonas aeruginosa
MPPVVIYTTAWCPYCIRAKQLLQRKGVDFQEIACDGKPELRAELARKAGSTTVPQIWIGETHVGGCDDLHALERAGKLDALLSA

SEQ ID NO: 44866 - DNA, 288 bp, Rickettsia prowazekii
  CDS (1)..(288)
atgaataaatctatattacacacaattattatttatactctagctagttgtccttattgtataaaggctaaagcattgcttgataagaaaaatgttatttatgaggaaattgaagtaagtaatcttacgcaagaagagaaagaaaaatttattaagaaatctggtggtaaaagcactgttccacagatctttatagataatatgcatgttggcgggtgtgatgatttatttaatcttgaaaaagaggggaggttagataagttgttagaacatcagcctaagaattaa

SEQ ID NO: 44867 - protein, 95 aa, Rickettsia prowazekii
MNKSILHTIIIYTLASCPYCIKAKALLDKKNVIYEEIEVSNLTQEEKEKFIKKSGGKSTVPQIFIDNMHVGGCDDLFNLEKEGRLDKLLEHQPKN

SEQ ID NO: 44868 - DNA, 264 bp, Vibrio cholerae
  CDS (1)..(264)
atgtttgtggtcatttttggtcgtcctggctgtccttactgtgttcgtgccaaagagcatgctgaaacattgaaagcaaagcgtgatgattttaactatcgctatgttgatatccacgccgaaggcatcactaaagccgatctagaaaaaaccatcggcaagccagtcgaaaccgttccacagattttcatcgatgaacaacacatcggcggctgcacagacttcgaagcgtacgcaaaagagaatctaggtctatttgactaa

SEQ ID NO: 44869 - protein, 87 aa, Vibrio cholerae
MFVVIFGRPGCPYCVRAKEHAETLKAKRDDFNYRYVDIHAEGITKADLEKTIGKPVETVPQIFIDEQHIGGCTDFEAYAKENLGLFD

SEQ ID NO: 44870 - DNA, 25 bp, Primer
atgcaaaccgttatttttggtcgtt

SEQ ID NO: 44871 - DNA, 25 bp, Primer
ttaggcgtccagattttctttcacc

SEQ ID NO: 44872 - protein, 64 aa, consensus
  MISC_FEATURE (1)..(64): consensus for the disclosure of xaa see table XV
CPYCXXAKXXXXXXXXXXXXXXXXXXXXXXXXXXXXXXXXXXXXXXXTVPQIFXXXXHXGGXXD

SEQ ID NO: 44873 - protein, 73 aa, consensus
  MISC_FEATURE (1)..(73): consensus for the disclosure of xaa see table XV
XXXXXXCXXCXXXXXXXXXXXXXXXXXXXXXXXXXXXXXXXXXXXXXXXXXXXXXXXXPXXXXXXXXXGGXXX

SEQ ID NO: 44874 - DNA, 1023 bp, Escherichia coli
  CDS (1)..(1023)
atgaaaaaagtgttattgataatcttgttattgctggtggtactgggtatcgccgctggtgtgggcgtctggaaggttcgccatcttgccgacagcaaattgcttatcaaagaagagacgatatttaccctgaagccagggaccggacgtctggcgctcggtgaacagctttatgccgataagatcatcaatcgtccacgggtttttcaatggctgctgcgtatcgaaccggatctttctcactttaaagccgggacttaccgctttacaccgcagatgaccgtgcgcgagatgctgaaattgctggaaagcggtaaagaagcacagttccctctgcgactggtagaagggatgcgtctgagcgattacctcaagcaattgcgtgaggccccgtatatcaagcatacgctgagcgatgataagtacgccaccgtagcgcaggcacttgaactggaaaacccggagtggattgaaggttggttctggccagacacctggatgtataccgccaataccaccgatgtcgcgttactcaagcgagcgcacaagaaaatggtgaaagcggtcgatagcgcctgggaagggcgtgcggacggtctgccttataaagataaaaaccagttggtgacgatggcatcaattatcgaaaaagaaaccgccgttgccagtgaacgcgataaggttgcctcagtatttatcaaccgtttacgcattggtatgcgcctgcagaccgacccgaccgtgatttacgggatgggagagcgttataatggcaaactttctcgtgcagacctggaaacgccgacagcgtataacacctataccattaccggtctgccgccaggtgcgatagcgacgccgggggcggattcgctgaaggctgctgcgcatccggcaaaaacgccgtatctctattttgtggccgatggtaaaggtggtcacacgtttaataccaatcttgccagtcataacaagtctgtgcaggattatctgaaagtgcttaaggaaaaaaatgcgcagtaa

SEQ ID NO: 44875 - protein, 340 aa, Escherichia coli
MKKVLLIILLLLVVLGIAAGVGVWKVRHLADSKLLIKEETIFTLKPGTGRLALGEQLYADKIINRPRVFQWLLRIEPDLSHFKAGTYRFTPQMTVREMLKLLESGKEAQFPLRLVEGMRLSDYLKQLREAPYIKHTLSDDKYATVAQALELENPEWIEGWFWPDTWMYTANTTDVALLKRAHKKMVKAVDSAWEGRADGLPYKDKNQLVTMASIIEKETAVASERDKVASVFINRLRIGMRLQTDPTVIYGMGERYNGKLSRADLETPTAYNTYTITGLPPGAIATPGADSLKAAAHPAKTPYLYFVADGKGGHTFNTNLASHNKSVQDYLKVLKEKNAQ

SEQ ID NO: 44876 - DNA, 1128 bp, Mesorhizobium loti MAFF303099
  CDS (1)..(1128)
gtgttcatgaacttcgtcatctccctggtgatgctgatggttcttgccgcgggcgcagcactttacttcggcaagcaggaattcatcgaacccggtccttcggccaatggcgacacctttctggtcaagccgaacaccggcgtccaggacatcgccgaccagcttgagcgccgtggactgatcagcgacgcccgcgtcttccgccttggcgtgcgtgctttcggcaacgattccgcgctcaaggccggcgaatacgagatcaagccccgggcatccatgcgcgacatcatggagcttttgaaaagcggcaagtcggtgatgtattccctgaccattccggaagggctgacggtcgagcaggccctgcagcgtatcgccgatgaacccgccttgagcggcgacatgccggcgacaacgcccccggagggcagccttgccaccgacacgctgcgcttcacgcgcggtgcgacgcgccagcagatgatcgacaagctggtggccgatcagaagaaactggtcgacgaggtctggcagcggcgtgcgccggatctgccgctggccaatatcgaagactttgtcaccctggcctcgatcgtcgagaaggaaaccggcaagggtgacgagcgttcgcgcgtcgccgccgtcttcctcaaccgcttggccaagggcatgcgcctgcaatccgatccgaccatcatctatggtctgttcggcggcaagggaaagcccgcggaccgcccgatctaccagtcggacatccagaagcagacgccttacaatacctatgtgatcagcggcctgccgccgacgcccatcgccaatccgggccgtgcagcacttgaggccgtggccaatccatcgaagaccgacgatctctattttgtcgccgacggtgcaggcggtcacgtctttgccgcgacgctcgacgagcacaatgagaacgtcgcccgttatcgtgcgctgcagaagaagcaggccgatgacgcggccaaggccgccgctgccgctggtacaaacggcaatgccgacaagcctgctaccgacaaaccagctgccgacaagcctgccgacggcagcaccgggggcgacaatggcgacgccggcggcgacgcgggcgatgcccagtag

SEQ ID NO: 44877 - protein, 375 aa, Mesorhizobium loti MAFF303099
MFMNFVISLVMLMVLAAGAALYFGKQEFIEPGPSANGDTFLVKPNTGVQDIADQLERRGLISDARVFRLGVRAFGNDSALKAGEYEIKPRASMRDIMELLKSGKSVMYSLTIPEGLTVEQALQRIADEPALSGDMPATTPPEGSLATDTLRFTRGATRQQMIDKLVADQKKLVDEVWQRRAPDLPLANIEDFVTLASIVEKETGKGDERSRVAAVFLNRLAKGMRLQSDPTIIYGLFGGKGKPADRPIYQSDIQKQTPYNTYVISGLPPTPIANPGRAALEAVANPSKTDDLYFVADGAGGHVFAATLDEHNENVARYRALQKKQADDAAKAAAAAGTNGNADKPATDKPAADKPADGSTGGDNGDAGGDAGDAQ

SEQ ID NO: 44878 - DNA, 990 bp, Helicobacter pylori 26695
  CDS (1)..(990)
atgacgactaaaagagtgaatactgccacaaacaagataatgacattaaatactttcttggatacatgttttcttttattcatcagtattcttttttatttaagtataccaatttatcctaacaaagtggtggttgtcccgcaaggttcgctcaaaaaagtgtttttttctttaaaagagcaaggcgtggatatgaacgctttggatttgctttttttacgcctgatgggcatgcctaaaaaaggttatattgatatgggcgatggggctttaaggaagggggattttttagtccgtttgattaaggcaaaagcggcacaaaaaagtgcgactctaatccctggggaaagccgctattttttcacgcaaattttgagcgagacttaccaactagaaacaagcgatctcaatcaggcttatgaaagcatcgctccacgattgaatggcgaagtgatagaagatggggtgatatggccagacacttatcatttgcctttaggggaggacgcttttaaaatcatgcaaactttgattggtcaatccatgaaaaaacacgaagccttaagcaaacaatggcttggatactaccataaagaagagtggtttgaaaaaatcattctcgcttctattgtgcaaaaagaagccgctaatgttgaagaaatgcccttgattgcgagcgtgatttttaaccgcttgaaaaaaggcatgcctttacaaatggatggggctttgaattatcaggaattttcacacgctaaagtaaccaaagagcgcattaaaaccgataacaccccctacaatacctataaatttaagggtttgcctaaaaatcctgtagggagcgtgagcctagaagcgattagagccgtgatcttccctaaaaaaacggatttcttgtattttgtgaaaatgccggataaaaaacatgctttcagcgcgacttataaagagcatttaaaaaacattaatctttctaataatcatttttaa

SEQ ID NO: 44879 - protein, 329 aa, Helicobacter pylori 26695
MTTKRVNTATNKIMTLNTFLDTCFLLFISILFYLSIPIYPNKVVVVPQGSLKKVFFSLKEQGVDMNALDLLFLRLMGMPKKGYIDMGDGALRKGDFLVRLIKAKAAQKSATLIPGESRYFFTQILSETYQLETSDLNQAYESIAPRLNGEVIEDGVIWPDTYHLPLGEDAFKIMQTLIGQSMKKHEALSKQWLGYYHKEEWFEKIILASIVQKEAANVEEMPLIASVIFNRLKKGMPLQMDGALNYQEFSHAKVTKERIKTDNTPYNTYKFKGLPKNPVGSVSLEAIRAVIFPKKTDFLYFVKMPDKKHAFSATYKEHLKNINLSNNHF

SEQ ID NO: 44880 - DNA, 1032 bp, Borrelia burgdorferi B31
  CDS (1)..(1032)
gtgcttattaaaattgggaaagtgtttattctttttttctttttgggatctattttgtcaatttttatatattttttaaatttatcttctttggcaaatggcttagtttatgaatttaatattgaaaaaggttggggagttaaaaaaatagctaaagaattgaaaaaacaaaaattaattaaatccgagctgcttcttgtttttatttcatatattttaggtagtgataaacaatttaaagaggggaaatatttaataaatggcgatctttctacatttgaaatatataaagagtttttaaagggatcttctaacgtaaatattgatgttacaatacccgaagggtatactagcagaagaattgctttaaagcttaaggaattttctgttattgatgatgttcaagattttctttttttaatcaacaaaaaatcatttatttatgagcttgggcttgattatgactctcttgaaggatttttatttccagatacttataaattttataagggtatagaaataaagaatgtagttcgcatgtttgttgataattttttgaataagcttaagtctataggcgttgttcttagcgattattcaagtaaggagctttacaatagggtaataatagcatctattgttgaacgtgaatatagggttaaaagtgaagccccaataatgtcttcggttttttataatagaataaaatctggtatggcattacaatcctgtgctactattgaatatgttattacagaggagctaggacgaagccatcctaagagaatttatttttcagatttagagatagattctccttataatacatatattaataaaggatatcctcctactccaatttcaaatgctggtattatttcgctgcaagcagcttttttcccaaaaaatacgcaatatttattttttgttgtaaaagactctaagttgggcacacatcaattttcatcagaatattcttcacatcttttaggggcaaaagattatattaaaaattttattactaaggattaa

SEQ ID NO: 44881 - protein, 343 aa, Borrelia burgdorferi B31
MLIKIGKVFILFFFLGSILSIFIYFLNLSSLANGLVYEFNIEKGWGVKKIAKELKKQKLIKSELLLVFISYILGSDKQFKEGKYLINGDLSTFEIYKEFLKGSSNVNIDVTIPEGYTSRRIALKLKEFSVIDDVQDFLFLINKKSFIYELGLDYDSLEGFLFPDTYKFYKGIEIKNVVRMFVDNFLNKLKSIGVVLSDYSSKELYNRVIIASIVEREYRVKSEAPIMSSVFYNRIKSGMALQSCATIEYVITEELGRSHPKRIYFSDLEIDSPYNTYINKGYPPTPISNAGIISLQAAFFPKNTQYLFFVVKDSKLGTHQFSSEYSSHLLGAKDYIKNFITKD

SEQ ID NO: 44882 - DNA, 981 bp, Aquifex aeolicus VF5
  CDS (1)..(981)
ttgaggcgttttttaatcctcctgtacgtgttccttgtaagttcagttctcggctttatagcctttgagatattcacacccctttacgttccaaagaaaaccgttgaaataaagtacgggactcccgttccggaaatagcccagattttagaagaaaataaagttataaagaacaagtactactttctcatactccacgcctttaagaggggaaagctggaagcgggcgagtacgagtttgaagggtggttgagcacgtacgacgtttacaaaatccttgaagagggaaaggcaaaactctacaaggttactgtaaaggaaggttacgacgtatttgacatagcaaaagttctggaagaaaacggaatttgtaaagaagaagactttttgaagtacgccctttcggaagaggttgcgaggaagtataacttgagcgtgccctccatggagggttttctctttccggatacatattacctttccaggaatatgcaccccttaaaggttatagacattatgtacaaaaacttcctcgaaaaaacggaagaaatgagaatggaactgaggaaaaagcacatatctctggaaacctgggtaacggttgcctcaatggtcgaaaaggaaacccacctggatgaagaaaaaccccttatagcagcggtgatatacaacaggctgaaaaaaggaatgaagctccagatagaccctaccgttatatacgttgcgaaaagaagaggtatatggaagggggaactctacaagagtctttataaaatagacgacccttacaacacttacatgtactacggacttccgccgggaccaatatctaaccccggactttcttcactaagggcagcgctctaccctgcgaaggtaaattacctgtactttgtagcaaaacccggatacaagggacacctttttgctgaaacttaccttgaacacctcaggaatatgagaagggtaggaagacgctaa

SEQ ID NO: 44883 - protein, 326 aa, Aquifex aeolicus VF5
MRRFLILLYVFLVSSVLGFIAFEIFTPLYVPKKTVEIKYGTPVPEIAQILEENKVIKNKYYFLILHAFKRGKLEAGEYEFEGWLSTYDVYKILEEGKAKLYKVTVKEGYDVFDIAKVLEENGICKEEDFLKYALSEEVARKYNLSVPSMEGFLFPDTYYLSRNMHPLKVIDIMYKNFLEKTEEMRMELRKKHISLETWVTVASMVEKETHLDEEKPLIAAVIYNRLKKGMKLQIDPTVIYVAKRRGIWKGELYKSLYKIDDPYNTYMYYGLPPGPISNPGLSSLRAALYPAKVNYLYFVAKPGYKGHLFAETYLEHLRNMRRVGRR

SEQ ID NO: 44884 - DNA, 1035 bp, Treponema pallidum subsp. pallidum str. Nichols
  CDS (1)..(1035)
gtgagtatccggaccttttcttttactcccagcgttcggctgaggcgcattgttctctggggcagtttgttctgtgcgggtgttctttgtctgctgtgtctgtgtcttttagttggccttgccccggtgcgtccttttgtgaaaaaggagcatatgttcactgtgcagtccggtgtgggcgcgcggaaggtcattcacgaactgaggaacgcacggctcattcgatccgagtgggctgcgcggttgtacgtgttcgcgcgcgcgcttaattttaaggcgggtagctacgcagtttctcctgcaatgagtgcggtgcgcattttaactatgctcgacgatgtcgaacaacaacgctttatcaaggtcaccgtccccgagggactgacggtaaagaaaattgctgcactgttgcaagacgctacagtggtaagtgcagcggcgtttgtggaagcttgcacgagcgctgcattgcgaacgcgctataagatccctgctccttcagtggagggttttctctatcctgatacgtatttttttagttaccaggaacgcgcggccaatgtggtgggaaccatgatcgaaaactttctggccaagactagccagttgccgtcgtttcctggtgatccggttgcgcgatttaaaaccgtcatactcgcttcaatcgtggaacgcgagtaccgcgtggcttctgaggcagcacgcatcgcaggtgttttttataaccggatgaaggtaaacatgggactgcaatcttgcgcgacagtcgaatatgtcattactgaaattgaggggaaagcgcaccccgagcgcttgttctttaaagaccttgaaatagacagtccatttaatacgtacaaatgtgctgggctgcccccagctcctatctcaaatcctgggctcaccgcgttgaatgctgcgctgcatcctgaagtgcatgactttttctattttaggctcaccgatccgcagcgggcacgcacacgttcaccaagacgttggacgagcatgatcaagctgggctcatgctgctaa

SEQ ID NO: 44885 - protein, 344 aa, Treponema pallidum subsp. pallidum str. Nichols
MSIRTFSFTPSVRLRRIVLWGSLFCAGVLCLLCLCLLVGLAPVRPFVKKEHMFTVQSGVGARKVIHELRNARLIRSEWAARLYVFARALNFKAGSYAVSPAMSAVRILTMLDDVEQQRFIKVTVPEGLTVKKIAALLQDATVVSAAAFVEACTSAALRTRYKIPAPSVEGFLYPDTYFFSYQERAANVVGTMIENFLAKTSQLPSFPGDPVARFKTVILASIVEREYRVASEAARIAGVFYNRMKVNMGLQSCATVEYVITEIEGKAHPERLFFKDLEIDSPFNTYKCAGLPPAPISNPGLTALNAALHPEVHDFFYFRLTDPQRARTRSPRRWTSMIKLGSCC

SEQ ID NO: 44886 - DNA, 1149 bp, Bacillus halodurans C-125
  CDS (1)..(1149)
atgtctgattccaacgaaaaggctcgaaattctgttttcgaagagcggctcgctcaagcgaaaatggctcgaaagatcgtgtttttttctgttctaggattggtccttatattattaattgtgataggtagtgggtacctatatgtgaaaaatgcgttaagtcctatggatcaagaaaataatgaagaaattgaagttacgattcctatcggatcaacaaccactcaaattgggtcaattcttgaagattcaggactcattcgaaattcgacattttttcgctattatgtaaggtataaaaatgaatctggatttcaagcaggggaatatgttctgtcgccgtcgatgacgatggatgaaataatctatgaattgaaggatggacgtatgcttgaagatcctgcgctcgtttttacaattccagaagggttatggttagaacaagtcgttaagctgattgcggagcatacagatcatgaagtggatgatattatggaaacgatcaatgatcctgactatttaaaccaactgattgatcaatatacgattttaacagatgacattctcgatgaagaggttcgtcatccgctggaagggtatcttttcccagcacgatacgattttatagaggaaaagcctgagatagagacgattattgaagcgatgatttcacgaatggaaaatgtactcatgaaacattccgacatgctagaggatagcgaatattcggtgcatgagattttaactttggcctcgatcattgagcgtgaagcgcaaaaatcagaggatcgataccttatttcaggcgtcctatataatcgacttgaggaagacatgatgttacaagtagacccaacggtagcgtatgctttaggtgaacatcgctacatgacttcacatgcagatcttgaggttgattccccttacaacacatatcgatataaaggtattcctgttggaccaattgggaatcctggggaagactcgatcgtagcagctctagatccagaggacacaaattatttattcttctatgctcgttataacggagaggtcatttacaatgaaacctatgaggctcataatgaaactcatcagaaataccgtcatgaatgggttgaagcacaggaagagcaagaggaatcgtaa

SEQ ID NO: 44887 - protein, 382 aa, Bacillus halodurans C-125
MSDSNEKARNSVFEERLAQAKMARKIVFFSVLGLVLILLIVIGSGYLYVKNALSPMDQENNEEIEVTIPIGSTTTQIGSILEDSGLIRNSTFFRYYVRYKNESGFQAGEYVLSPSMTMDEIIYELKDGRMLEDPALVFTIPEGLWLEQVVKLIAEHTDHEVDDIMETINDPDYLNQLIDQYTILTDDILDEEVRHPLEGYLFPARYDFIEEKPEIETIIEAMISRMENVLMKHSDMLEDSEYSVHEILTLASIIEREAQKSEDRYLISGVLYNRLEEDMMLQVDPTVAYALGEHRYMTSHADLEVDSPYNTYRYKGIPVGPIGNPGEDSIVAALDPEDTNYLFFYARYNGEVIYNETYEAHNETHQKYRHEWVEAQEEQEES

SEQ ID NO: 44888 - DNA, 1047 bp, Pasteurella multocida subsp. multocida str. Pm70
  CDS (1)..(1047)
atgaaaaaatggcttacttcgtttttcctgctcattctcgtggggttagggattctgtttgttgcttaccaacatattcaacaatttatggacacgccggtcaacgtcaaagcgaatcagcttttaaccgtcgaacgcggcaccacaggcaataaacttgctacgcttttagaacaagagaagatcctcgataacgccaatttgctcccttacttgcttaaattaaatccccaactcaataaaatcaaagcgggaacgtattcaatgcaaggggtcaataccgtcgcagatttgattcatgtactcaatcaaggtaaagaagcccaattcagcattcaatttattgaaggtgataactttgcgaattggcgaaaaaatttggaaaaagcaccgcacttagtacaaaccttaaaaggcaaaacggaagccgacatttttgcgttattagagctacctcacgacgtaaaacaaattcaagagtggaaaaaagtggaaggctggctttatccagacacttaccactacacgcccaattctacggatcttgcattacttaaacgtgcgtcagagcggatgaaaaaggttctggcacaagcatgggaaaaacgagatgctgatttaccccttgcgaatgcttatgagatgctcattctagcctctattgtggaaaaagaaaccgcgattgaagcggaacgcggtaaagttgcctccgtgtttgtcaatcgtttaaaacaaaatatgcgcttacaaacggatcccactgtgatttatggtatgggcgaaaaatatgatggcaatatccgtaaaaaagatttagaaaccccaactgcgtataatacttacatcattaacggtttaccgccaacccccattgcgatgccgagtgaaagtgccttattcgcggtggcaaaaccagaaaaaactgattatttatactttgttgccgatggttctggtggacataaattcagcaaaacgctggctgaacacaatcgtgccgtacaacagtatttacgctggtatcgtagtcaaaaaaatggaaattaa

SEQ ID NO: 44889 - protein, 348 aa, Pasteurella multocida subsp. multocida str. Pm70
MKKWLTSFFLLILVGLGILFVAYQHIQQFMDTPVNVKANQLLTVERGTTGNKLATLLEQEKILDNANLLPYLLKLNPQLNKIKAGTYSMQGVNTVADLIHVLNQGKEAQFSIQFIEGDNFANWRKNLEKAPHLVQTLKGKTEADIFALLELPHDVKQIQEWKKVEGWLYPDTYHYTPNSTDLALLKRASERMKKVLAQAWEKRDADLPLANAYEMLILASIVEKETAIEAERGKVASVFVNRLKQNMRLQTDPTVIYGMGEKYDGNIRKKDLETPTAYNTYIINGLPPTPIAMPSESALFAVAKPEKTDYLYFVADGSGGHKFSKTLAEHNRAVQQYLRWYRSQKNGN

SEQ ID NO: 44890 - DNA, 1653 bp, Lactococcus lactis subsp. lactis Il1403
  CDS (1)..(1653)
ttggtggacaaagaaacaactgaattttctcgaggaagttttaaagaaaaaatacttcgccaacttgaagaaaatgcagcgaaacaagcagaaactaagttcccagaccctgaagatttcgaacgtcccagcaggagtgactcagaagaacctgagcgaaaaatcgaaccaaggaaagttgatcttgaacctttcaaacttcccgtctttgattttccagcagcggatgaaaacgaagaagaaccttttgtagaaaatgaaaacctttcagaagaaggcgattcattgcgtaaaaatttagatggagtggtttctgaggaaattcaaaaccaagatattcctcctcaattttcaagaagtgaatcaaaagttcaagatgaaaagattgaacaagaacaattttcagaaaaaaaagaatcagaaaaaatggttaaacatcaaccttcaagaagaaccaacagttcttctaaaaaaacttcttctatcaagaaaaacaagaataagaacaaaaataagaaaaagaaaaaagtaacagcaggaaaaatcattgctgtgattgttgttcttttagttttagttgttggaggaactggttggtatggctataactttgtaaaatctggcattcaacctttggattctaagaatgcaacagctaagtcaatcaatattcctgctggttcaagtagtaagcaaattggtgaaattttgcaaagacaatccattattaaaaatggaatggtttttcagtattatacaaaatttaaaaattattcagagtttaaaagcggctattataatcttgcaccaaacatgagcttatctacaattgctggtaaacttgaagaaggcggaacagaaaaacctgttgctccaactttaggtaaaattttagttcctgaaggctatacgctaacacaaattgctaaagctgtgacagttaatagtggaagcaatgaaaagaatgcaaaaacgccattttctgaagcagacttcatgaaaaccgttcaagacccaacctttatcgctaaaatggttaaggcttatcctaaactgttcgcaagcttgccaacaaaagattcaggaatcaaatatcagttagaaggttacttgttcccagcgacttatgattacacaaaatcatcgacagttgaatcagtcattgaaaatatgattcaagcagccaatactcagctcactccttactatgatacaattgctcaaaagaatttgactgtcaatgaagttttgagtttagcagctttggttgaaaaagaagccaacaatgatgatgatcgacgaaatgttgctggaaccttctataatcgtatgaatgctggaatgactttgggttctaatctgtcaattctttatgccgaaggtaaacttggtgaaaaaacaagtctttcagaggatgctaatattgacaccaacctagattcgccatataatttgtatgcaaatactggatttggccctggtcctgttgatagtccaagtttatcatctattaaagcagtacttgatcctgctcaaaatgactacttatactttgttgctgacgtaacaacagggaaagtttattttgctaaaaacttagatgaacaaaatgcaaatgttcaaaaatatgtgaatgataagataagtagctaa

SEQ ID NO: 44891 - protein, 550 aa, Lactococcus lactis subsp. lactis Il1403
MVDKETTEFSRGSFKEKILRQLEENAAKQAETKFPDPEDFERPSRSDSEEPERKIEPRKVDLEPFKLPVFDFPAADENEEEPFVENENLSEEGDSLRKNLDGVVSEEIQNQDIPPQFSRSESKVQDEKIEQEQFSEKKESEKMVKHQPSRRTNSSSKKTSSIKKNKNKNKNKKKKKVTAGKIIAVIVVLLVLVVGGTGWYGYNFVKSGIQPLDSKNATAKSINIPAGSSSKQIGEILQRQSIIKNGMVFQYYTKFKNYSEFKSGYYNLAPNMSLSTIAGKLEEGGTEKPVAPTLGKILVPEGYTLTQIAKAVTVNSGSNEKNAKTPFSEADFMKTVQDPTFIAKMVKAYPKLFASLPTKDSGIKYQLEGYLFPATYDYTKSSTVESVIENMIQAANTQLTPYYDTIAQKNLTVNEVLSLAALVEKEANNDDDRRNVAGTFYNRMNAGMTLGSNLSILYAEGKLGEKTSLSEDANIDTNLDSPYNLYANTGFGPGPVDSPSLSSIKAVLDPAQNDYLYFVADVTTGKVYFAKNLDEQNANVQKYVNDKISS

SEQ ID NO: 44892 - DNA, 996 bp, Neisseria meningitidis MC58
  CDS (1)..(996)
atgttgagaaaattgttgaaatggtctgccgtttttttgaccgtgtcggcagccgttttcgccgcgctgctttttgttcctaaggataacggcagggcataccgaatcaaaattgccaaaaaccagggtatttcgtcggtcggcaggaaacttgccgaagaccgcatcgtgttcagcaggcatgttttgacggcggcggcctacgttttgggtgtgcacaacaggctgcatacggggacgtacagattgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagtttttccccgacagctacgaaatcgatgcgggcggcagtgatttgcagatttaccaaaccgcctacaaggcgatgcaacgccgcctgaatgaggcatgggaaagcaggcaggacgggctgccttataaaaacccttatgaaatgctgattatggcgagcctggtcgaaaaggaaacagggcatgaagccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctacacgcgcggcggtctgccgccaaccccgattgcgctgcccggcaaggcggcactcgatgccgccgcccatccgtccggcgaaaaatacctgtatttcgtgtccaaaatggacggcacgggcttgagccagttcagccatgatttgaccgaacacaatgccgccgtccgcaaatatattttgaaaaaataa

SEQ ID NO: 44893 - protein, 331 aa, Neisseria meningitidis MC58
MLRKLLKWSAVFLTVSAAVFAALLFVPKDNGRAYRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWESRQDGLPYKNPYEMLIMASLVEKETGHEADRDHVASVFVNRLKIGMRLQTDPSVIYGMGAAYKGKIRKADLRRDTPYNTYTRGGLPPTPIALPGKAALDAAAHPSGEKYLYFVSKMDGTGLSQFSHDLTEHNAAVRKYILKK

SEQ ID NO: 44894 - DNA, 996 bp, Neisseria meningitidis Z2491
  CDS (1)..(996)
atgttgagaaaattgttgaaatggtctgccgtttttttgaccgtatcggcagccgttttcgccgcgctgcttttcgtccctaaagacaacggcagggcatacaggattaaaattgccaaaaaccagggtatttcgtcggtcggcaggaaacttgccgaagaccgcatcgtgttcagcaggcatgttttgacggcggcggcctacgttttgggtgtgcacaacaggctgcatacggggacgtacagactgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcgaacacgacaccaaaggctggagcaatgaaaaactgatggcggaagttgcccctgatgccttcagcggcaatcctgaagggcagtttttccccgacagctacgaaatcgatgcgggcggcagcgatttacggatttaccaaatcgcctacaaggcgatgcaacgccgactgaatgaggcatgggaaagcaggcaggacgggctgccttataaaaacccttatgaaatgctgattatggcgagcctgatcgaaaaggaaacagggcatgaagccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctacacgcgcggcggtctgccgccaaccccgatcgcgctgcccggcaaggcggcactcgatgccgccgcccatccgtccggtgaaaaatacctgtatttcgtgtccaaaatggacggtacgggcttgagccagttcagccatgatttgaccgaacacaacgccgccgttcgcaaatatattttgaaaaaataa

SEQ ID NO: 44895 - protein, 331 aa, Neisseria meningitidis Z2491
MLRKLLKWSAVFLTVSAAVFAALLFVPKDNGRAYRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIEHDTKGWSNEKLMAEVAPDAFSGNPEGQFFPDSYEIDAGGSDLRIYQIAYKAMQRRLNEAWESRQDGLPYKNPYEMLIMASLIEKETGHEADRDHVASVFVNRLKIGMRLQTDPSVIYGMGAAYKGKIRKADLRRDTPYNTYTRGGLPPTPIALPGKAALDAAAHPSGEKYLYFVSKMDGTGLSQFSHDLTEHNAAVRKYILKK

SEQ ID NO: 44896 - DNA, 1032 bp, Deinococcus radiodurans R1
  CDS (1)..(1032)
atgacgaccctgaattcccgccgtggcctgccgctctgggccaaactgctgctcggcttgatcgtgctgggcctgctggccgtgctcggcgcctttgcctatttccgcagcctcttcggcccggcgggcggcgccccctacacgctggaagtcacgcccggcgagaccgtgccgcaaatcgcccgcgaactcgaaaacaagaagatcgtcaaaaacgcccgcatcctgcgctacgccatgcagcaaagcggcgcggcggcgcggctcaaggaaggcgcctacgacctcaacggtcagatgacggtggatgaggtcgtcaagacgctggacggccccgcccgcgttccggtggtcaacgtgaccgtgcccgagggccggcgcatcaaggacctgcccgagattttccagaaggcgggcttcgacgcggcggccatcacggcggcgctcaacgacgcgtcgctcagccgctacgcccggggcaagcagaagaacctcgaaggcttcgtgtttcccgccacctacgagttccgccccaaggacagcgccactgacgtggtgaagaagatggtggagcgcatggaaaccgagttcacgccgggcaacgtcgccaaggcgaaggcgctcggcctcgacgtgcgcgactgggtgacgctggcgagcatggtgcaggccgaggccgccaacaacgaagagatgccggtcattgccggggtcttcctcaaccgcctgcgcgacggcattccgctcggcagcgaccccaccgtggcctatgggctgggcaaggacctgccggaactcgaccgctcggcgggggacttcaaggtggatacgccttattccacctacacccgccaggggttgcccgctggccccatcaacaaccccggcgaggccgcgctcctgagcatcgtcaacccgcagcgcaaaatggcggatgggcgcgacgccctgtacttcctgcacgcgggcggcaaaatctacgtgaaccacacgtatgcggagcacctgcgcgacaacgaccgctaccgctga

SEQ ID NO: 44897 - protein, 343 aa, Deinococcus radiodurans R1
MTTLNSRRGLPLWAKLLLGLIVLGLLAVLGAFAYFRSLFGPAGGAPYTLEVTPGETVPQIARELENKKIVKNARILRYAMQQSGAAARLKEGAYDLNGQMTVDEVVKTLDGPARVPVVNVTVPEGRRIKDLPEIFQKAGFDAAAITAALNDASLSRYARGKQKNLEGFVFPATYEFRPKDSATDVVKKMVERMETEFTPGNVAKAKALGLDVRDWVTLASMVQAEAANNEEMPVIAGVFLNRLRDGIPLGSDPTVAYGLGKDLPELDRSAGDFKVDTPYSTYTRQGLPAGPINNPGEAALLSIVNPQRKMADGRDALYFLHAGGKIYVNHTYAEHLRDNDRYR

SEQ ID NO: 44898 - DNA, 1254 bp, Mycobacterium tuberculosis CDC1551
  CDS (1)..(1254)
atgcctgacggtggccaccgccaccgcgcccagccggtgtcggtaagaccgaaccggcaccgcaggacccgagtcagccgcgctcagcgccgacacgcccaacaaatccgccggcgacggcgcgtcgccggcggatttgccctgagcctgctcgtcgtggtggtggtggtggccgtcgtcgtcggcgccaagttgtggcagaccatgttgggcttcggtaacgactacaccggtcccggcaagcgagacatcgtgattcagatcagggccggtgactcgaccacggcggtcggggagacgctgctcaaacacggtgtagtggccaccgtccgagcattcgtcgatgccgcgcacggcaacaccgcgatttcctcgatccaacccgggttctatcggatgcgaaccgagatttcggcggcttccgctgtcgcgcggcttaccgatccgcacaaccgggtggggaagttggtcataccggaagggcgtcagctcgacgacaccaccgacatgaagaccaacgtggtgaatcctggcatattcgcgctgatctcccgtgccacctgtgtggatctcgacggtacccaacgctgcgtctcggtggccgacctccgcgcggcggcgagcaggagcacgccgacgatgctgtcagtgccgcgctgggcggttgggccggtgatggagctgggcactgaccatcgccggatcgaggggctgatcgcaccggggaccttcaacatcgacccgtcggcatcggctgaaaccatcttggcgaccttgatcagcgccggcgccgtggagtacatgaaatccgggttggtagacaccgcaaagtcgctgggcctgtcgccctatgacattctcgtggtggcctcgctggtgcagcaggaagccaacacccaggatttcccgaaggtggcccgggtcatctacaaccggctgcacgaacaccgcacgttggagttcgactcgaccgtgaactatccgctggatcgccgtgaggtggccaccagcgacaccgaccgtgcccagcgcacaccgtggaacacctacatggcccaggggctgccggccaccgcgatctgttcgcccggcgtcgacgcgctgcgcgccgccgagcatccagtacctggcgactggctgtacttcgtcaccatcgattcccagggcacgacgctgttcaccagggactatcagcagcatctggcgaacatcgagctggccaaacacaacggtgtcctcgacagcgcgcgatga

SEQ ID NO: 44899 - protein, 417 aa, Mycobacterium tuberculosis CDC1551
MPDGGHRHRAQPVSVRPNRHRRTRVSRAQRRHAQQIRRRRRVAGGFALSLLVVVVVVAVVVGAKLWQTMLGFGNDYTGPGKRDIVIQIRAGDSTTAVGETLLKHGVVATVRAFVDAAHGNTAISSIQPGFYRMRTEISAASAVARLTDPHNRVGKLVIPEGRQLDDTTDMKTNVVNPGIFALISRATCVDLDGTQRCVSVADLRAAASRSTPTMLSVPRWAVGPVMELGTDHRRIEGLIAPGTFNIDPSASAETILATLISAGAVEYMKSGLVDTAKSLGLSPYDILVVASLVQQEANTQDFPKVARVIYNRLHEHRTLEFDSTVNYPLDRREVATSDTDRAQRTPWNTYMAQGLPATAICSPGVDALRAAEHPVPGDWLYFVTIDSQGTTLFTRDYQQHLANIELAKHNGVLDSAR

SEQ ID NO: 44900 - DNA, 1656 bp, Streptococcus pneumoniae TIGR4
  CDS (1)..(1656)
ttgagtgaaaagtcaagagaagaagagaaattaagctttaaagagcagattctgagagatttagaaaaagtaaaaggctatgatgaagttctgaaagaagatgaggcagtagttcgcactcctgcaaatgaaccttcaactgaagaactcatggctgattccttgtcaacggtagaggagattatgagaaaagctcctaccgtgcctactcacccaagtcaaggtgtaccagcttctccagcagatgagattcaaagagaaactcctggtgttccaagtcatccaagtcaagatgtaccttcttctccagcggaagaaagtggatcaagaccaggtccaggtcctgttagacctaagaaacttgaaagagaatacaatgaaaccccaacaagggtagctgtttcctatacgacggcagagaaaaaagcagaacaagcaggtccagaaacacctacgcctgctacagaaacagtggatatcatcagagatacatcacgtcgtagccgtagagaaggagcaaaacccgttaagcctaagaaagagaagaagtcacatgtgaaagcttttgtgatttcattccttgtattccttgccttgctctcagcaggtggttactttggttaccagtacgtgctagattccttattacctatcgatgctaattctaagaaatatgtgacggttggaattccagaaggttcaaacgttcaagaaatcggtacgacgcttgaaaaagctggtttggtaaagcatggtctgatttttagtttttatgccaagtataaaaattataccgacttgaaagcaggttactacaatttgcaaaagagtatgagtacagaagacttactcaaagagttgcaaaaaggtggaacagatgaaccgcaagaacctgtacttgcgactttgacaattccagaaggttataccttggatcagattgctcaagctgtgggtcaattgcaaggtgacttcaaagagtctttgacagcggaggctttcttggctaaagttcaagatgagacgtttatcagtcaagcagtagcgaaatatcctactttactggaaagtttgcctgtaaaagacagcggtgcgcgttatcgtttggaaggataccttttcccagctacatactctatcaaggaaagcacaactattgagagcttgattgatgagatgttagctgctatggataagaacctatctccttactatagtactatcaaatctaaaaacttgactgtcaatgagttgttgaccattgcttccttggtcgaaaaagaaggtgccaagacagaagatcgtaagctcattgcaggtgtattctacaatcgtttgaatcgtgatatgccacttcaaagtaatattgcaatcttgtatgcccaaggaaaactggggcaaaatatcagtctagctgaggatgttgcgattgataccaacattgattcaccttataatgtttataaaaatgtaggtctcatgcctggtccagtcgatagtccaagtctggatgcgattgagtcaagcatcaatcaaactaagagcgataacctctactttgtagcagatgtcacagaaggcaaggtctactatgctaacaatcaagaagaccacgaccgcaatgtcgctgaacatgtcaacagcaaattaaactaa

SEQ ID NO: 44901 - protein, 551 aa, Streptococcus pneumoniae TIGR4
MSEKSREEEKLSFKEQILRDLEKVKGYDEVLKEDEAVVRTPANEPSTEELMADSLSTVEEIMRKAPTVPTHPSQGVPASPADEIQRETPGVPSHPSQDVPSSPAEESGSRPGPGPVRPKKLEREYNETPTRVAVSYTTAEKKAEQAGPETPTPATETVDIIRDTSRRSRREGAKPVKPKKEKKSHVKAFVISFLVFLALLSAGGYFGYQYVLDSLLPIDANSKKYVTVGIPEGSNVQEIGTTLEKAGLVKHGLIFSFYAKYKNYTDLKAGYYNLQKSMSTEDLLKELQKGGTDEPQEPVLATLTIPEGYTLDQIAQAVGQLQGDFKESLTAEAFLAKVQDETFISQAVAKYPTLLESLPVKDSGARYRLEGYLFPATYSIKESTTIESLIDEMLAAMDKNLSPYYSTIKSKNLTVNELLTIASLVEKEGAKTEDRKLIAGVFYNRLNRDMPLQSNIAILYAQGKLGQNISLAEDVAIDTNIDSPYNVYKNVGLMPGPVDSPSLDAIESSINQTKSDNLYFVADVTEGKVYYANNQEDHDRNVAEHVNSKLN

SEQ ID NO: 44902 - DNA, 1020 bp, Clostridium acetobutylicum ATCC 824
  CDS (1)..(1020)
atgaaagtacaaactattttaaagaagaaagtttatatatttctgtttttaatcctagtattaatttgtgcatcagctgcatattttaagcatgctatgaattacccttttaaaattaaaaacgatgttagttttcaagtaaataatggtgataatccatattctgttatgaacagattagataaacagaatatgattaagaataaactatttataaaagcttacattaaatataataaagttcccggtgatataaagccgggactttattcaataaaaaaaggggaatcttcaaagaagttttttcaagatatagctgaaggaaacttttctagtgactatgttaaggttactatacctgaaggatatgatatagaggagattgctaatttatttgataaaaagggattaataaatagagatgaatttataaatgcttgcaagaattatagtatacctaagtacataaaaaatgacgacaacagaaagtataagcttgaggggtacctttttccggatacctatgaatttaaaaaaggtacaaagggaaaagatattattgatactatgattaagagatttgatgaagtatttaaacaagcacaaaaggacactggcaagagtggaagcgatgtggaccaaacaataataatggcgtcagttgttgaaagagaagcagaagtagataaggatagaccagttatagcttccgtattttttaacagactaaaaattaaaatgaagctgcagtcttgtgccacagttgagtatgcacttggtcatcacaaaaataaattgtccaatgcagatttaaagacaaaatcaaattacaatacctatttaatagacggtatgccggaaggaccaatatgttctccaggtaaagaatctattaaagctgcgttaaatccttccagcacaaactatatttattttgtttcgaataatgatggaactcacttctttacaagtgattataatgagtttttaaaggttaagaaaaaaactcaaggattttaa

SEQ ID NO: 44903 - protein, 339 aa, Clostridium acetobutylicum ATCC 824
MKVQTILKKKVYIFLFLILVLICASAAYFKHAMNYPFKIKNDVSFQVNNGDNPYSVMNRLDKQNMIKNKLFIKAYIKYNKVPGDIKPGLYSIKKGESSKKFFQDIAEGNFSSDYVKVTIPEGYDIEEIANLFDKKGLINRDEFINACKNYSIPKYIKNDDNRKYKLEGYLFPDTYEFKKGTKGKDIIDTMIKRFDEVFKQAQKDTGKSGSDVDQTIIMASVVEREAEVDKDRPVIASVFFNRLKIKMKLQSCATVEYALGHHKNKLSNADLKTKSNYNTYLIDGMPEGPICSPGKESIKAALNPSSTNYIYFVSNNDGTHFFTSDYNEFLKVKKKTQGF

SEQ ID NO: 44904 - DNA, 1221 bp, Agrobacterium tumefaciens str. C58
  CDS (1)..(1221)
gtgagcgatacgaatcagaacagccagggaccatcaggacaaaacggcgcgggcgaaggcaatcgcggcccgatcatcccaaagtccccgaccgaggcgctgcggccggaaaaagtgccggcgccgccgaagcgttcccgcaaggcccatggccagctggtgatcttcctgaattttctgatgacgcttgccgttgccgtctgcgtgctggccattgccgccttctattacatgatcaatgcgtttcaggagcccggtccgctcgaaacgaacacccatttcaccgtccgcaacggtgctggcctcatcgagatcgccaataatctcgaacgcaacgacatcatctccaacgcccgcgttttccgcctcatgaccggcagctatctgcagaaggatcagacgctgaaaaccggcgaatatgagatcaaggccggcgcatcgatgaaggacatcatgctgctgctcgaatccggcaaatcgatcctttattccgtatcgctgccggaaggcctgaccgtaaagcagatgttcgcgcgccttgccgcggacgaggtgctggatggcgaactgcccgcgacgctgccacccgaaggcagcctgcgcccggatacctatcgtttcacccgcggcaccaagcgcgaagaaatcatcagccagatgagtgcggcgcaggacaagctgatcgacatggtctgggagcggcgcgatcccgacctgccgatcaagaccatcgaggaattcgtcacgctcgcctcgatcgtcgagaaggaaaccggtaaggatgacgaacgcgcccatgtcgcctccgtcttctataaccgcctgaagaagggcatgcgcctgcaatccgatccgacgatcatctacggtctgttcggtggcgacggaaagccgtccgaccggccgatctaccagtcggacctgcagaagcagacgccgttcaatacctatgtcatcaagggcctgccgccatcgcccatcgccaatccgggacgggcagcacttgaggcagtcgccaatccatggcgcacggatgacctttatttcgtggccgacggcaccggcggccacgtctttgccaagacgcttgaagagcacaacgccaatgtccgccgctggcgcaagatcgaagccgaaaaggctgcttccggcggcaatcccgatgtggtcgtggatggtcaacccggcggcgccgaggcggaaaaacctgccaacaactga

SEQ ID NO: 44905 - protein, 406 aa, Agrobacterium tumefaciens str. C58
MSDTNQNSQGPSGQNGAGEGNRGPIIPKSPTEALRPEKVPAPPKRSRKAHGQLVIFLNFLMTLAVAVCVLAIAAFYYMINAFQEPGPLETNTHFTVRNGAGLIEIANNLERNDIISNARVFRLMTGSYLQKDQTLKTGEYEIKAGASMKDIMLLLESGKSILYSVSLPEGLTVKQMFARLAADEVLDGELPATLPPEGSLRPDTYRFTRGTKREEIISQMSAAQDKLIDMVWERRDPDLPIKTIEEFVTLASIVEKETGKDDERAHVASVFYNRLKKGMRLQSDPTIIYGLFGGDGKPSDRPIYQSDLQKQTPFNTYVIKGLPPSPIANPGRAALEAVANPWRTDDLYFVADGTGGHVFAKTLEEHNANVRRWRKIEAEKAASGGNPDVVVDGQPGGAEAEKPANN

SEQ ID NO: 44906 - DNA, 1020 bp, Rickettsia conorii str. Malish 7
  CDS (1)..(1020)
atgttaaataacctattaaaaactaaactttttttagttatagtatctctaactatatttattactttgctaaattttagtatattttatatttttgtgccgggtgatcttactcaaaataaaacgataattattgaacctaaattatccgtaaatcaaatagttacaaaactttattctaatgaagtaatcaaatatccaagaatttttaaggtaattgctaaaatttattctataaaaagacctcttaaaagtggtgaatatgtgtttactcgtaatatatcgcctctgcaaactttaagaatattagcaagcggtaaatctataatacacaagataattgtcccggaaggtacggtagttagtgaggttataaagaaaattaatgaagaaagtcgattacttggagaaataaaagggataatacctgaaggttttttaatgccttccacgtattttttttcttacggtgatcaaaaagagcagataattgatcacatgagaaatttaatgtctgctaatttagataaagtaatgcaaaatcttgcaccggattctccattaaaaactagacttgaggtattaacgctagcttcgataattgaaaaagaagccggctcaaatgcagaaaagcctattatagcagcagtattcattaatcgtttaaagaaaaatatgaagctacaagccgattcgactactatatatgctttgactgaaggaaaatttaaattagcaagagctttaacaaaaaaagatttattgcaagaactaccctataatacttattatataaaaggtttaccacccggtccgatttcttgtccgtcgttaaaatctttagaagcagtggtaaaatctgctaaaacggatgcattattttttgtagttgacggtaaaggcgggcataatttttctaacaatcttaatgatcataatagatttgttgaaacttatcgaaaaagtttgattaaagtacctgagccggcaattgatcctgaaaaaccatctactcgatga

SEQ ID NO: 44907 - protein, 339 aa, Rickettsia conorii str. Malish 7
MLNNLLKTKLFLVIVSLTIFITLLNFSIFYIFVPGDLTQNKTIIIEPKLSVNQIVTKLYSNEVIKYPRIFKVIAKIYSIKRPLKSGEYVFTRNISPLQTLRILASGKSIIHKIIVPEGTVVSEVIKKINEESRLLGEIKGIIPEGFLMPSTYFFSYGDQKEQIIDHMRNLMSANLDKVMQNLAPDSPLKTRLEVLTLASIIEKEAGSNAEKPIIAAVFINRLKKNMKLQADSTTIYALTEGKFKLARALTKKDLLQELPYNTYYIKGLPPGPISCPSLKSLEAVVKSAKTDALFFVVDGKGGHNFSNNLNDHNRFVETYRKSLIKVPEPAIDPEKPSTR

SEQ ID NO: 44908 - DNA, 1083 bp, Bacillus subtilis subsp. subtilis str. 168
  CDS (1)..(1083)
atgtatatcaatcagcaaaaaaaatcgttttttaataaaaaaagaatcatactgtcttccattgttgtgctgtttctcatcattggcggggcatttttatatgggaaatcattgcttgaacctgttgaaaaagacagtaaaacgacagttaatattaacattccgagcggttcgtctgtttcagccatcgcatcgatattaaagaaaaatgatgtcataaaaagcgagaaggcgtttcagtactatgtgaaatataaaggtgcttccgggtttcaggccggattctaccatctgaataaaggtatggatttagatgccattattcagaagctgacaagcggggctacaggttacgcttttcaaatcacagtgactgagggagcacagctgacccaaatcgcggctgctattgctgatgaaacaaaatactctaaaaaacaagtcatagcgaagctggacgatgaaacatttatcaatcagctgaagaaagaattcccggacactgtgacaaatgatgttttcaataaaaacattaagcacccgcttgaagggtacctattcccggctacatacccttttaacgatccggacacatcacttgaagacattatcaaggcaatgattaagcagacaaattcttatgtggaaacatataaatcagaaatgaagaaaaacaaagtttctgtgcataagctgctgacaatggcttctttgatagaagaagaagcgactgaaaaagccgaccgccataaaattgcgagcgtcttttataaccgcctgaaaaagaaaatgccgctccaaacagatccgaccgtcctgtacgcggcaggcaagcataaagatcgggttctttataaggatctggaaatcgattcaccatacaatacgtataaaaacacagggctgacgccagggccgattgccaatgccggcatgtcatcatgggaagcagcgctgcatccggataaaacggactatctgtatttcttggccaaatcaaatggtgaggtcgtatttacaaaaacgctaaaagagcataataaagcaaaagaaaaatacatttcctcaaaaaatgagaaataa

SEQ ID NO: 44909 - protein, 360 aa, Bacillus subtilis subsp. subtilis str. 168
MYINQQKKSFFNKKRIILSSIVVLFLIIGGAFLYGKSLLEPVEKDSKTTVNINIPSGSSVSAIASILKKNDVIKSEKAFQYYVKYKGASGFQAGFYHLNKGMDLDAIIQKLTSGATGYAFQITVTEGAQLTQIAAAIADETKYSKKQVIAKLDDETFINQLKKEFPDTVTNDVFNKNIKHPLEGYLFPATYPFNDPDTSLEDIIKAMIKQTNSYVETYKSEMKKNKVSVHKLLTMASLIEEEATEKADRHKIASVFYNRLKKKMPLQTDPTVLYAAGKHKDRVLYKDLEIDSPYNTYKNTGLTPGPIANAGMSSWEAALHPDKTDYLYFLAKSNGEVVFTKTLKEHNKAKEKYISSKNEK

SEQ ID NO: 44910 - DNA, 1101 bp, Caulobacter crescentus CB15
  CDS (1)..(1101)
gtgagcaaaacgtcgccgccccgcgcccgtgctcccaagggagcgggctcccgccgtgagacggccaccgccggccgtcgcatgatgagggccctgctcggggccgccgccacgctggtcgtggtcggcatggtcgccctgttgggcgcggcctgggtctataacggacctggccccgcggcgaagggggacgacaagaccaccgttgtcctgcgcaagggcgccagcctgcccgagatcgcctccagcctggagcggggcggcgtgatccgttcctcgtcgatcttcatgaccgccgccaaggttaccggcgcggcgcggacgctgaaggccggcgagtatgagttcaacagccgcgcttcgatggcccaggtgctggacgccgtccgccgcggccggattgtccgtcactggatcaccatccccgagggcctgacctcggacatggtcatggacatcctcaacaagtctgcggtgctgacggggagcgccgccacgccgcctgaaggcgcgatcctgcccgagacctacgaagtgcaacgcggcgaggaccgcgcggccgtcctgcagcgcatgatggacgatcgcgatgcggtgctgaacgccctgtgggccgatcgtgcgtcgaacctgcccttttcgaccaaggaagaggccgtcatcctggcctcgatcgtggaaaaggagacgggcctggccgaggagcggccgcgcgtcgccgccgtgttcgtcaaccgcctgcggaccggtatgcgcctgggctccgacccgaccatcatctacggcatctcgcggggacgcccgctggggcgcggcatcttcctgtcggaactgcgccgcctgacgccctacaacacctatctgatcgacggcctgccgccgacgcccatcgccaatccgggacgtgcggccctggcggcggtgatgaacccgcccaagagcgaagatctctacttcgtcgccgacggcaccggcgggcacgtgttcgcccggacgctggaagagcacaacgccaatgtcgtcaagtggcgtcagatcgagcgtgaacgcgcgggcaaggcgccggccaagccggccgctgcgccgctggccgggggctga

SEQ ID NO: 44911 - protein, 366 aa, Caulobacter crescentus CB15
MSKTSPPRARAPKGAGSRRETATAGRRMMRALLGAAATLVVVGMVALLGAAWVYNGPGPAAKGDDKTTVVLRKGASLPEIASSLERGGVIRSSSIFMTAAKVTGAARTLKAGEYEFNSRASMAQVLDAVRRGRIVRHWITIPEGLTSDMVMDILNKSAVLTGSAATPPEGAILPETYEVQRGEDRAAVLQRMMDDRDAVLNALWADRASNLPFSTKEEAVILASIVEKETGLAEERPRVAAVFVNRLRTGMRLGSDPTIIYGISRGRPLGRGIFLSELRRLTPYNTYLIDGLPPTPIANPGRAALAAVMNPPKSEDLYFVADGTGGHVFARTLEEHNANVVKWRQIERERAGKAPAKPAAAPLAGG

SEQ ID NO: 44912 - DNA, 1023 bp, Salmonella typhimurium LT2
  CDS (1)..(1023)
atgaaaaaattgtcaggcgttttccttctgctgttggttgtgctgggtattgccgtgggcgtggggatgtggaaagttcgccatctggcgaacagcacgttacttattaaagacgagactatctttacgctcaaggcgggaacggggcggctggcgcttggtgaccagctttatgatgaaaaaatcattaatcgcccccgggtatttcagtggctgctgcgcgtggagcctgagttatcacactttaaagcgggaacttaccgttttacgacggggatgaccgtacgggagatgcttgagttgctggagagcggcaaagaagcgcaattcccgttgcggtttgtggaagggatgcgccttagcgactacctgaaacagctacgagaggcgccgtatattcgccatacattgccggatgatgactacgccactgtcgctcaggcattaaagcttgcgcacccggaatgggtagaagggtggttctggcctgatacctggatgtataccgccaacaccagcgatgtcgctattctcaagcgagcgcatcaaaagatggtgaaagctgtcgatactgtctggaaaggtcgggccgaggggctgccttataaagatcagaaccaactggtgacaatggcctcgattattgaaaaagagacggctgtcgccagcgaacgcgatcaggtggcctcagtctttattaatcgcctgagaatcggtatgcgccttcagaccgatcccaccgtgatttacgggatggggacgagttataatggtaacttgtcgcgtgcggatctggaaaagccgacggcttataacacgtataccataaccgggctgccgccaggaccgattgcatcgcccagcgaagcgtcattgcaggcggcggcgcatccggcgaaaacgccgtatctctattttgtggccgacggtaaaggcggtcacacatttaacaccaatcttgccagccataatcggtcagtgcaggagtacctgaaagtgcttaaggaaaaaaatgggcagtaa

SEQ ID NO: 44913 - protein, 340 aa, Salmonella typhimurium LT2
MKKLSGVFLLLLVVLGIAVGVGMWKVRHLANSTLLIKDETIFTLKAGTGRLALGDQLYDEKIINRPRVFQWLLRVEPELSHFKAGTYRFTTGMTVREMLELLESGKEAQFPLRFVEGMRLSDYLKQLREAPYIRHTLPDDDYATVAQALKLAHPEWVEGWFWPDTWMYTANTSDVAILKRAHQKMVKAVDTVWKGRAEGLPYKDQNQLVTMASIIEKETAVASERDQVASVFINRLRIGMRLQTDPTVIYGMGTSYNGNLSRADLEKPTAYNTYTITGLPPGPIASPSEASLQAAAHPAKTPYLYFVADGKGGHTFNTNLASHNRSVQEYLKVLKEKNGQ

SEQ ID NO: 44914 - DNA, 1071 bp, Listeria innocua Clip11262
  CDS (1)..(1071)
atgaagaatacaaaaggtaagaaaattacaattattatttctattatcattctaattttagtaatcgcaacttttgcagggtattattatgtgaagtcacagctagagccaagagatgaagcaagcaaagagaagatcgctgttgaaattccagcaggatctagtatttcagatatatctactattttagaagataaaaaagtcattaataacgcttctattttctctttttatgtaaaatacaataatgatacgaatttaaaagctgggaattatgaattcacgcaagctatgaacacagatcaaatcgtgaagaaaatgcaagaaggaaagactgtcgcaccggcaaaactagtcattccagaaggatatacactcgatcaaattgctgatagaatcgtcgcttatcaacctaaattaaaaaaagccgatgttcttaaaataatggataatccagagtttgttgcttctattattaaagcattcccagagactgtcacaaatgatgttttgaataaatctataaaacatccgttagaaggctatttatatccagcgacatatacttttaaaggctcggatgtatcagctgaaacgataattaaagaaatggtgaaagcaacagacgttaatattgctaagtaccgcgacgaactaacgaaacaaaaaatgtccgtgcataaattcctaacaatgtcttccattattgaaaaagaagcaactgccgatgtggatcgcaaaatgattgctagcgttttttataatcgtttagcaaaagatatgcgtttacaaactgatcctactgttctttatgcgcttggtgaacataaaagcaaaacaacctataaagatttagaagtagattcgccgtataacacatacaaaaacaatggactgccaccaggaccgatttctaatagcggtgacacatctatggaagcagctctttacccagaaaaaagtgattatctatactttttagcgaatacgaaaactggtaaagtttatttctctaaaacattagaagagcacaataaactaaaagaagagcatattacgaaaaataattaa

SEQ ID NO: 44915 - protein, 356 aa, Listeria innocua Clip11262
MKNTKGKKITIIISIIILILVIATFAGYYYVKSQLEPRDEASKEKIAVEIPAGSSISDISTILEDKKVINNASIFSFYVKYNNDTNLKAGNYEFTQAMNTDQIVKKMQEGKTVAPAKLVIPEGYTLDQIADRIVAYQPKLKKADVLKIMDNPEFVASIIKAFPETVTNDVLNKSIKHPLEGYLYPATYTFKGSDVSAETIIKEMVKATDVNIAKYRDELTKQKMSVHKFLTMSSIIEKEATADVDRKMIASVFYNRLAKDMRLQTDPTVLYALGEHKSKTTYKDLEVDSPYNTYKNNGLPPGPISNSGDTSMEAALYPEKSDYLYFLANTKTGKVYFSKTLEEHNKLKEEHITKNN

SEQ ID NO: 44916 - DNA, 1134 bp, Ralstonia solanacearum GMI1000
  CDS (1)..(1134)
atggtatgcaggcggccggagattgacccggtattatatggggctgttcggcgtgcatctggggcgcgctcaaccctctttcaagtgcgggcaagaccggcggaagccggttccgtgggcaacatccgaatttcgatgctttcttttctcaagcgcttgctgttgctggcgatcctggtcgggctggccgccgcgggcggcgtggtgtggtgggcccggcagccggtgagcctgtcggcgtcgccgctggaagtggtgatcaagcccaactcgagcgtactctcggtcgcgcggcagctcgagcacggcggcgtggacgtgcagccgcagctgttttcgctggtggcgcgcgccatgggcaaggcgaccagcctgaaggcgggcggctatgagctggaagccggcgcgaccccgctgtcgatcctcgacaagatggcacgcggcgaggtcacgcactacgtcgtcaccgtcatcgagggctggagcatgcgccagatgcgcgcggcggtggacgccgagccggcgctgcggcacgagaccgccggcctgccggacaccgagctgatgcgccggatcggcgcgaccgaggccacgccggagggcctgttcttccccgacacctacctgttcgcgcgcggcagcagcgacgtcgacctgttccgccatgcctaccaggccatgcagaagcgcctggccgaggcgtgggccaggcgcgcgccgggcctgccgtacaagacgccctacgaggcgctgaccatggcctccatcatcgagaaggaaaccggccagaagcgggaccgcccgatggtggcatcggtgttcgtcaaccggctgcgcaagaacatgctgctgcagaccgacccgaccgtcatctacggcatcggcgccggcttcgacggcaacctgcgcaaacgcgacctgcagaccgacacgccgtacaacacctacacccgcatcggcctgccgcccacgccgatcgcgctgccgggcatggcctcgctggacgcggcgatgaatccggcgccgtccgatgcgctgtacttcgtcgcgcgcggcgacggcaccagccagttctcgaccaacctcacggaccacaaccgggccgtcaacaaataccagcgcggccaaccatga

SEQ ID NO: 44917 - protein, 377 aa, Ralstonia solanacearum GMI1000
MVCRRPEIDPVLYGAVRRASGARSTLFQVRARPAEAGSVGNIRISMLSFLKRLLLLAILVGLAAAGGVVWWARQPVSLSASPLEVVIKPNSSVLSVARQLEHGGVDVQPQLFSLVARAMGKATSLKAGGYELEAGATPLSILDKMARGEVTHYVVTVIEGWSMRQMRAAVDAEPALRHETAGLPDTELMRRIGATEATPEGLFFPDTYLFARGSSDVDLFRHAYQAMQKRLAEAWARRAPGLPYKTPYEALTMASIIEKETGQKRDRPMVASVFVNRLRKNMLLQTDPTVIYGIGAGFDGNLRKRDLQTDTPYNTYTRIGLPPTPIALPGMASLDAAMNPAPSDALYFVARGDGTSQFSTNLTDHNRAVNKYQRGQP

SEQ ID NO: 44918 - DNA, 1029 bp, Clostridium perfringens str. 13
  CDS (1)..(1029)
gtgaaaaggctaaaaaactctaaaagtatggttttgatatccatattcataattttacttgtgattaacttagctgtatttgtagttaaatataactccataaagcgaagccctttacaatctaataaagctgatataacctttaaagttaaagaaggagagtcactaaatggactttttgaacgattaaacaatgaaaatgtacttagaagttcctttttttctaagatatatataaagtttaataacgtagaagaaagtataaaaccaggtacatatactgtgaatagtgacataagttttaatgattttttaagtgtactaactgatgggaaagtatcagattataaggtaacatttccagagggatacactgtagaggatatagctaagaaattggaagaatctaaggtatgcacaaaagatgagtttttaaaagtagtaaaagagtatccattaccatcttatataaaacctaataatgaaagaaaatatgagttagaaggatttttatttccagacacatatgctattcctaaaggcacaacaccaaaacaaataattgaaatgatgcttaacaggtttgaaggggtaattagtgagatacaaagtgaactaggcattactattccaaaggaagagtatgagaaatatgtaatagtagcttcaatggttgaaaaagaggctagggatgatagtgagcgtgcagaaatagcatctgttatatataacagactacaaaaaggtatgcctttacaaatcgatgctacagttttatatgctttaggagagcataaagatactgtactttataaagacttaaaagtggattcaccatataatacatataagattaaaggacttccagtggggccaatatgtaatcctggaaaaccttcgctttgggctgccataaaaccagctaaaacagactacatatattatttattgaatccatcaaataataagcactattttactaataattacgaagatttcctagctaagaagaaagaatttggatactaa

SEQ ID NO: 44919 - protein, 342 aa, Clostridium perfringens str. 13
MKRLKNSKSMVLISIFIILLVINLAVFVVKYNSIKRSPLQSNKADITFKVKEGESLNGLFERLNNENVLRSSFFSKIYIKFNNVEESIKPGTYTVNSDISFNDFLSVLTDGKVSDYKVTFPEGYTVEDIAKKLEESKVCTKDEFLKVVKEYPLPSYIKPNNERKYELEGFLFPDTYAIPKGTTPKQIIEMMLNRFEGVISEIQSELGITIPKEEYEKYVIVASMVEKEARDDSERAEIASVIYNRLQKGMPLQIDATVLYALGEHKDTVLYKDLKVDSPYNTYKIKGLPVGPICNPGKPSLWAAIKPAKTDYIYYLLNPSNNKHYFTNNYEDFLAKKKEFGY

SEQ ID NO: 44920 - DNA, 933 bp, Fusobacterium nucleatum subsp. nucleatum ATCC 25586
  CDS (1)..(933)
gtgaaaaaattatttgctattatttttataataattttaattttagcaggaacaactgtctaccaattcagtaaaaaagataaatataatttagttttagaaatagataaagataaacctttaaaagaatctttatcagctctacctatatcaaataatccattttttaaattatatttaaaatttagaaatgatgggaaggacataaaagcaggtaactatgaattaagaggaaaattcaatataatagaacttgtttctatgcttgaaagtggtaaatctaaggtatttaagtttacaataatagagggaaatactgtaaaaaatgttgtagataaattggttgccaatgaaaaaggaagtagagaaaattttgaaaaagcatttaaagaaatagattttccttatccaactcctgataataattttgaaggttatctataccctgaaacttatttcatacctgagtcttatgatgaaaaagctatacttaatgtatttttaaaagaattcttaaagaaattcccagtggaaaactaccctgataaagatgaattttatcaaaaacttataatggcttctatacttgaaagagaagccgctgttgaaagtgaaaaacctcttatggcatctgttttctataatagaattgccaaaaatatgactttatctgcagattcaacagtcaattttgtttttaactatgaaaagaaaagaatatactataaggatttagaggttgattctccctataatacatataaaaataagggacttcctcctggacctatttgtaatccaactgttagttctgttaatgctgcatataacccagcagatactgaatacttattctttgttacaaaaggtggaggagaacattttttcagtaaaacatataaggaacatttagattttcaaaaaaataaataa

SEQ ID NO: 44921 - protein, 310 aa, Fusobacterium nucleatum subsp. nucleatum ATCC 25586
MKKLFAIIFIIILILAGTTVYQFSKKDKYNLVLEIDKDKPLKESLSALPISNNPFFKLYLKFRNDGKDIKAGNYELRGKFNIIELVSMLESGKSKVFKFTIIEGNTVKNVVDKLVANEKGSRENFEKAFKEIDFPYPTPDNNFEGYLYPETYFIPESYDEKAILNVFLKEFLKKFPVENYPDKDEFYQKLIMASILEREAAVESEKPLMASVFYNRIAKNMTLSADSTVNFVFNYEKKRIYYKDLEVDSPYNTYKNKGLPPGPICNPTVSSVNAAYNPADTEYLFFVTKGGGEHFFSKTYKEHLDFQKNK

SEQ ID NO: 44922 - DNA, 1569 bp, Streptococcus pyogenes MGAS8232
  CDS (1)..(1569)
ttgaccgattttaaggataaagaccaacaagatcagcagcgaagctttaaagagcagattcttgctgagttggaaaaagcaaatcaaatcagaaaagaaaaagaggaagaactttttcaaaaagagttggaagctaaagaagcagctaggagaacggcccagctatatgctgaatataaaagacaagatgcttttcaaaaagagtctatagcacataacaataagacagccaaacactttcaagctataaaagatgcggtaatgacttcagaagcgattaaaccgactttactttctgaaaaagaaaactcatctttaaaaacgacaagtaagagagtcgtgcaggcaaatgagcttcaagagactgcctctaaagaatctcaagtaccgttaactattgagaaaggtcattcagtgagacgaaaattaagcaaacgccaacagactgagcgagctgctaaaaagatttcaaccgttttgattagctctattattataacccttttggctgttactctagcaggagcaggctatgtttatagtgctttaaatcctgttgataaaaatagtgatgcctttgttcaagttgagataccatctgggtcaggcaataaattgattggtcaaattcttcaaaaaaaaggtttaatcaagaatagcactgtttttagtttttatacaaaatttaaaaactttacaaattttcagagcgggtattacaatctgcaaaaaagtatgagtctagaagaaattgctagtgctttacaagaaggtggtacagcagaacctaccaagccatctcttgggaagatcttgattccagaaggatacacgattaaacaaatagctaaagctgttgagcataatagcaagggaaagaccaaaaaagctaaaacaccttttaacgagaaggattttttggatttagtcacggatgaggcttttattcaagatatggtaaaaagatatccaaaattattagcaactatcccaactaaagaaaaagctatttaccgtttggaaggttaccttttcccagcaacctataactattacaaagaaactactatgagagaacttgtagaggacatgctggcagctatggatgctactttggtaccctattatgataaaattgctgctagtggtaagacagtcaacgaggtattgaccttggcctctttggttgaaaaagaaggttcaacagacgatgacagacgtcaaattgcaagtgtcttttataaccgccttaatagcggaatggcactacaatctaatatagctattttgtatgcgatggggaaacttggtgagaaaacaaccttggctgaggatgctactattgacaccaccattaattctccttataatatttataccaatacaggtctgatgcctggtccagttgctagctcgggggtttctgcaattgaagcaaccctaaatccagcctcaacggattatttatactttgtggccaatgtccatactggtgaagtttactatgcaaaaacatttgaagagcactctgcaaatgttgaaaaatatgtgaatagtcaaattcagtaa

SEQ ID NO: 44923 - protein, 522 aa, Streptococcus pyogenes MGAS8232
MTDFKDKDQQDQQRSFKEQILAELEKANQIRKEKEEELFQKELEAKEAARRTAQLYAEYKRQDAFQKESIAHNNKTAKHFQAIKDAVMTSEAIKPTLLSEKENSSLKTTSKRVVQANELQETASKESQVPLTIEKGHSVRRKLSKRQQTERAAKKISTVLISSIIITLLAVTLAGAGYVYSALNPVDKNSDAFVQVEIPSGSGNKLIGQILQKKGLIKNSTVFSFYTKFKNFTNFQSGYYNLQKSMSLEEIASALQEGGTAEPTKPSLGKILIPEGYTIKQIAKAVEHNSKGKTKKAKTPFNEKDFLDLVTDEAFIQDMVKRYPKLLATIPTKEKAIYRLEGYLFPATYNYYKETTMRELVEDMLAAMDATLVPYYDKIAASGKTVNEVLTLASLVEKEGSTDDDRRQIASVFYNRLNSGMALQSNIAILYAMGKLGEKTTLAEDATIDTTINSPYNIYTNTGLMPGPVASSGVSAIEATLNPASTDYLYFVANVHTGEVYYAKTFEEHSANVEKYVNSQIQ

SEQ ID NO: 44924 - DNA, 1047 bp, Thermoanaerobacter tengcongensis MB4
  CDS (1)..(1047)
atgaataaagtcgaaacaaaaggtaaaagcaaattttttatacttgtgatagttttaatttttctttttgtttctgcttctttttattatcaaagcctttttaagcctgtgtctacaagggcatcagaggaagtggttgtgaatatacccagtggctattctactcaccagatagcaaagcttttgaaagaaaaaaatttgattaaaaatgagtggttttttgtatggcgggcaaaaatattaaaagcagatggtaagctgaaggctggaaaatatttattaagtcagaatatgacagttgaccagattattgaaaaaatagcagcaggaaaatctgaaatggatgtttttaaagtcacaattcccgaagggtatactgttaaagatatagcgaaaaaattggctcaaatagggcttgtcgatgagaaaaaatttttagaagtagcgcagaatggcgattttgaatatagtttcttaaaaaacataccgagagataggcccaatagattagaaggttaccttttccccgatacctattttattcctgtaaatgctgacgaaaaagagataataaacatgatgttaaaaaggtttgaagaagtgtacaacactgtaatcaaagacaacgctcaaagaatggggatgactcccgatgagattgtgattgttgcatcaattgtagaaaaagaagctgtgttggacagggaaaggtctattatcgcaggagttatttacaacaggctgaagaaaaagatgaagctggagctttgtcctactgttgaatacgctttaggaactcataaggaagtgctttcatatcaggacttaaaagtcgattctccttataatacctatgaacattacgggcttcctattggacctatttgcaatcccggacttaaatccattgaggctgctttaaatccttctaaacatgactattattattttgtggccagaggagatggaacacacatctttagcagaacttatcaggagcatttaaaagctcaaagagaagtggaaagggagcaaaataaaaagtga

SEQ ID NO: 44925 - protein, 348 aa, Thermoanaerobacter tengcongensis MB4
MNKVETKGKSKFFILVIVLIFLFVSASFYYQSLFKPVSTRASEEVVVNIPSGYSTHQIAKLLKEKNLIKNEWFFVWRAKILKADGKLKAGKYLLSQNMTVDQIIEKIAAGKSEMDVFKVTIPEGYTVKDIAKKLAQIGLVDEKKFLEVAQNGDFEYSFLKNIPRDRPNRLEGYLFPDTYFIPVNADEKEIINMMLKRFEEVYNTVIKDNAQRMGMTPDEIVIVASIVEKEAVLDRERSIIAGVIYNRLKKKMKLELCPTVEYALGTHKEVLSYQDLKVDSPYNTYEHYGLPIGPICNPGLKSIEAALNPSKHDYYYFVARGDGTHIFSRTYQEHLKAQREVEREQNKK

SEQ ID NO: 44926 - DNA, 1749 bp, Streptomyces coelicolor A3(2)
  CDS (1)..(1749)
atgactgagtatggccggggcccaggctccgaaccgtggcatccggaggacccgttgtacggggacggcggatggggcggacagcaggcccaggcgggtcagcagtccccctacggcggccagccgcagcagtatccggagcagcaggcgcagcagggttacggcgactggagcaacggcggccaggcgtcgtacggcgacgggcagccccagtacgaccagtacgcccaccagcaccccgaaccgcagtacgacccgtacggtcagcagcagtacgaccagcaccagtacggtcagcagcagtacgaccagcagtacgcaccccaggcccagccgcagcagggctacgacaacggcggctggggcggcggcgcacacccccaggcgcagtacccggccgacccgtccgacccctacggacagcaggccggcggctacggcgccgagcagcccgacttctacggcacccccgaggcgtacccgccgccggagccgcccacccgcaggcgcgccgagcccgagccgcagcgcaccgactgggaccccggaccggacgagggggagcacgccttcttcgccggcggggacgcggacggggacgacgacgcgccgggcgacggccgcgaaagccgggaggagcgcagaaccagggggggcggcaagcccaagaagcgccgcagcggatgcgcctgtctggtggtctgcctggtactcggcggcggcgtggcaggcatcgggtatttcggctaccagttttaccaggatcgtttcggcgcggccccggacttcgcgggcggcggcaacggcgagcaggtgaccgtcaccatccccaagggcgcgggcggttccacgatcggccaggaactcaagcggcagggcgtggtgaagagcgtcgacgcgttcatctccgcccagcagagcaacccccgcggcaagagcatccaggacggcgtgtacacgctgcagaaggagatgtcggccgagagcgcggtcgaactcctgctcagcccgaagagccgcagcaacctgatcatcgccgagggcaggcgcaacgccgacgtctacaagctcatcgacaaacgcctcgaggtgaaggcgggcaccaccgccgaggtcgccaagtccgagtacaagagcctcggcctgcccgactgggcgctgaaccacaaggacgtcaaggaccccctggagggcttcctctacccgtccagctactcggcggccaaggggcagaagcccgcggacgtgctcaagcagatggtggcacgtgccaacgagcagtacgagaagatcggcctggagcagaaggcggagggactcggcctcgaaggcccgtgggagctgctcaccgccgcgagcctggtgcaggccgaggggaagacgcacgaagacttccgcaagatggccgaggtcatctacaacaggctcaagaccgacaacaccgagacgaaccagaagctccagttcgactcgaccttcaactacctcatgggccagagcaagatccacatcagcgagtccgagatcaacaccaacccggacccgtacaacacctactaccaccggggcctgccgcccggacccatcagcaaccccggcgaagaggccctgcaagcggcgctcaaccccaccgaggagggctggatctacttcgtggccaccgacggcgtgaagaagaccgagttcgccaagacccacgacgagttcctgaagctgaaggacaagttcgatgccagctccggcaactga

SEQ ID NO: 44927 - protein, 582 aa, Streptomyces coelicolor A3(2)
MTEYGRGPGSEPWHPEDPLYGDGGWGGQQAQAGQQSPYGGQPQQYPEQQAQQGYGDWSNGGQASYGDGQPQYDQYAHQHPEPQYDPYGQQQYDQHQYGQQQYDQQYAPQAQPQQGYDNGGWGGGAHPQAQYPADPSDPYGQQAGGYGAEQPDFYGTPEAYPPPEPPTRRRAEPEPQRTDWDPGPDEGEHAFFAGGDADGDDDAPGDGRESREERRTRGGGKPKKRRSGCACLVVCLVLGGGVAGIGYFGYQFYQDRFGAAPDFAGGGNGEQVTVTIPKGAGGSTIGQELKRQGVVKSVDAFISAQQSNPRGKSIQDGVYTLQKEMSAESAVELLLSPKSRSNLIIAEGRRNADVYKLIDKRLEVKAGTTAEVAKSEYKSLGLPDWALNHKDVKDPLEGFLYPSSYSAAKGQKPADVLKQMVARANEQYEKIGLEQKAEGLGLEGPWELLTAASLVQAEGKTHEDFRKMAEVIYNRLKTDNTETNQKLQFDSTFNYLMGQSKIHISESEINTNPDPYNTYYHRGLPPGPISNPGEEALQAALNPTEEGWIYFVATDGVKKTEFAKTHDEFLKLKDKFDASSGN

SEQ ID NO: 44928 - DNA, 1074 bp, Xanthomonas axonopodis pv. citri str. 306
  CDS (1)..(1074)
gtgggtgtggcggtgactggcaaacgcggatgtctggccgtgctgggtacggtagtgctgctcgtagcgctgctggcgattgccgccgtggtggcgtggcggcattacctgcacttcgccgatacccccgtgcctgcgagcgcgcccagcgtggtgattgcgcccggcgattcgctcaaggctacattgcgcaagctgcgcgctgccggcctggcgcagggcaccgagctggaatggcagctgctggcgcgccaggtcgatgcggccggcaagctcaaggtgggcgagtacgcgctgtcgccagcgctgtcgccgcgcgaactgctgacgcgcatgcgccaggggcgggtgatccagtaccgcttcacgatcgtggaaggctggaattttcgtcagctgcgcgccgcactggcgaccgccacgccgctgcaacattccatcgatgcgctggacgatgcggcactgatggcccggctgggagttgccaggcagcatccggaagggcgcttcctgccggaaacctatgtgtaccagcgtggcgacagcgatatcgatgtactcaagcgcgcgcatgcggccatggacaaggcattggcgcaggcctgggagcagcgcgccccgaacctgccactcgcctcgccggagcaggcattgatcctggcctcgatcatcgaaaaagaaacggccctggcctccgagcgcccgctcatcgccggggtgttcctgcgccgcttgcagctgggcatgaagctgcagaccgaccccaccgtgatctacggcatcggcagcagctacgacggcaatatccgtcgccgcgacctgaccaccgatacgccgtacaacacctacacccgtaccggcctgacgccgacgccgatcgccatgccgggccgcgaggcgctgctggcggcggtgcggccggcgcccggcgaggcgctgtatttcgtggcggtgggcgatggcaccggggcgcacgcgttctcggccacgttggccgaacataacgcagcggtggcgcgctatctgcagcgccgccggctgccgagcacgccgcagacggagcctatgccatga

SEQ ID NO: 44929 - protein, 357 aa, Xanthomonas axonopodis pv. citri str. 306
MGVAVTGKRGCLAVLGTVVLLVALLAIAAVVAWRHYLHFADTPVPASAPSVVIAPGDSLKATLRKLRAAGLAQGTELEWQLLARQVDAAGKLKVGEYALSPALSPRELLTRMRQGRVIQYRFTIVEGWNFRQLRAALATATPLQHSIDALDDAALMARLGVARQHPEGRFLPETYVYQRGDSDIDVLKRAHAAMDKALAQAWEQRAPNLPLASPEQALILASIIEKETALASERPLIAGVFLRRLQLGMKLQTDPTVIYGIGSSYDGNIRRRDLTTDTPYNTYTRTGLTPTPIAMPGREALLAAVRPAPGEALYFVAVGDGTGAHAFSATLAEHNAAVARYLQRRRLPSTPQTEPMP

SEQ ID NO: 44930 - DNA, 1047 bp, Chlorobium tepidum TLS
  CDS (1)..(1047)
atgcctcctagaaaagccccctttcgcgcaaccgcaccaagggttatattgctggccattgcggctgtcgtggtgacgcttttgttcgtacccggcatcaactccatgtcgccgaaggaagagcctgccaggatcgctgtccaccggggagagggattccgccgcattgtcgaaaagctgcacgatgccggggtgattcgcttccgctggccactgctggccgccggggcgcttgttccgccgctgcacaagatcaagccgggcagatataccatctccggcaaccactcggtctttggcctgctgtggtatctccattcgcgcccccaggacgaagtgcgggtcatgatcccgaacggcgtcgagcagcgcaaaatcgcccggatcatagccgccaacctcgatatcgactcgaccgcattcattgcagcctcacgcgatccgcgcctgctcgcctcgctcggcatcaaaggcgagagcaccgagggctatctttttcccggcacgtacaacttcgcctgggccagcacgccgaaggaggtgatcacctttctcacaagaaggtttcgcgcgttctactccgacagcctgaagcaggaggcgaaacaggcgggcctcgatgaacatcaactgctcacgctggcctcaatcgtagaggccgaaacgccactcgatgaggaaaaaccggtcatcgccagcgtctatctgaaccgtctgaagaaaaacatgcgtttgcaggctgatcccacggtgcaatacgccattccgggcgagagtcggccactccactacaaggatctcgctatcgactcgccgtacaacacctaccggcacgcaggactgcctccggggccaatctgcaatcccggtgcggcgtcgattcgcgcggtgctgagtccggcgaacaccggttacctgtacttcgtcgcgaccggccaggggggccacgctttcgccaccacacttgccgaacatgcccggaacgtccagcgctacagggccgccagaaaagagcagcaaaagaaccccggcggcggcacgccttga

SEQ ID NO: 44931 - protein, 348 aa, Chlorobium tepidum TLS
MPPRKAPFRATAPRVILLAIAAVVVTLLFVPGINSMSPKEEPARIAVHRGEGFRRIVEKLHDAGVIRFRWPLLAAGALVPPLHKIKPGRYTISGNHSVFGLLWYLHSRPQDEVRVMIPNGVEQRKIARIIAANLDIDSTAFIAASRDPRLLASLGIKGESTEGYLFPGTYNFAWASTPKEVITFLTRRFRAFYSDSLKQEAKQAGLDEHQLLTLASIVEAETPLDEEKPVIASVYLNRLKKNMRLQADPTVQYAIPGESRPLHYKDLAIDSPYNTYRHAGLPPGPICNPGAASIRAVLSPANTGYLYFVATGQGGHAFATTLAEHARNVQRYRAARKEQQKNPGGGTP

SEQ ID NO: 44932 - DNA, 1119 bp, Oceanobacillus iheyensis HTE831
  CDS (1)..(1119)
gtgtcgaataaagaaaagcagggtggtttcttttataatatgaaaaaaagagcggaagaggcttctactgttagaaaaattgtatccataataattatcgcaatggtactcatattaattattggtggaatttcaggatatttatatattaatagttctttaaaacctgttgaccctgatagtgatgaagaaattgctgtagaaattcctatgggctcttctacttcagtgattgctaatacgctagaagagaatggcattataaaagatgcaagagtttttcgtttctacacgaagttcaataatattactgaatttcaagcgggagaatatacttttacaccatccatggattttaatgaaattattgagtcactgcaaacaggtagagttgttatggaagcaacgcatagaataacaattcccgaaggtttatcagtggaccagattgcagagatttatagtgagaacttaagctttacaaaagaagaatttcttgaaagaattaacgatgaagcatatatagaagaattaattgaaaagtatccggatatattaacggaagaaatattacaagaagatttacgaacgccattagaaggatatttatttgcgtctacctatgatttttatgaagaggacccaagtattgatactattatcgaaaaaatgcttcaacaaacgcaaaccgtatataatcgttatcgtgaacaggtggaatcaacagaatttacgatacatgaagcaattacctttgcgagtattattgaaaaagaaacagcaacagaagaacagcgtccacaaattgcgggagttttttacaatcgcatagagaatgaaatgaaattacaaacggatcctacagtcatctatgcactaggtgaacatcaggaagtagttacatttgaagatttagagatagagtcaccttataacacctatcttgttgaaggacttcctgtaggacctatttctaactttgcggaaaactcattaaaagccgtagtcgaaccagaggaatctgactacttatatttccttcatgattcagaaggaaatctccatttcgcagaggattttgaacagcatgtggaaaatagagaagaatatattaattaa

SEQ ID NO: 44933 - protein, 372 aa, Oceanobacillus iheyensis HTE831
MSNKEKQGGFFYNMKKRAEEASTVRKIVSIIIIAMVLILIIGGISGYLYINSSLKPVDPDSDEEIAVEIPMGSSTSVIANTLEENGIIKDARVFRFYTKFNNITEFQAGEYTFTPSMDFNEIIESLQTGRVVMEATHRITIPEGLSVDQIAEIYSENLSFTKEEFLERINDEAYIEELIEKYPDILTEEILQEDLRTPLEGYLFASTYDFYEEDPSIDTIIEKMLQQTQTVYNRYREQVESTEFTIHEAITFASIIEKETATEEQRPQIAGVFYNRIENEMKLQTDPTVIYALGEHQEVVTFEDLEIESPYNTYLVEGLPVGPISNFAENSLKAVVEPEESDYLYFLHDSEGNLHFAEDFEQHVENREEYIN

SEQ ID NO: 44934 - DNA, 1182 bp, Bifidobacterium longum NCC2705
  CDS (1)..(1182)
atgaccgatgattttaacgagttctttgatgacaacacgcattgggtcgaacaggggtcagaaccaatgcgcggggccgagccgccagaaccgccgaaatcccgcagggagatgcgcaagcgacgtgcacagcgcaggcgcaagcgtatcagtggcattatcatcgctatcgccatcgtcgccctgcttatcggcggcggctatttcggcgtaaccaagctcatcgcatggcgcgacagccggagcaaccagtcgacggccatcgcggactatccgggaccgggctatggcgaggtcgaattcaccgtgagcgagggccaaggcgcggcggagatcgccgataatctgctcaaggccgaagtcatcaagtctactgccgcgttcaccagcgtggtcaacgccaatagcacgacactctatccgggaacgttcacattgaagaagcatatggccgcatccaaagtgatcgacgttctctccgacaccaaccaggcggcgggcttcctcgaggttcgtcccggtgaacgtgccaccgatgtgttcgccaacgccgcgaagctttccggcattgcccaaagcgaattcgacacgattatcaagaacaagggtaaggatattctgcccaatgaagcgggcggtagctttgagggatggctggagccgggaacctacaacgtcaagagcatgaagagcgcttcggaaatcctcaaggccatggtcgataagcgtatcgccaagttggatgaattgggcgtgccggccggcagtgaccgcgaacgggtgatgatcatcgcctctatcgccgaggccgaggtcaacaaagccgattactacggcaaagtgacgcgagtcatcgagaaccgtttggagcagggcatgtcgttgggcatggattccaccgtggcctatggcaataacgtcaagcccgcgcaggtgaccaccgagatgacccaagacgagtccaacccgtacaacacgtacaagatctccggcctgccgcctacgccgatcagcaatcccggcgataacgccattcaagcggcactgcaccccgaaggcggcaattggctgtacttctgcacggtcaatctggacaccggcgaaaccaagttcgccgcaaccgccgatgaacatgaccagaacgtggccgaactacgcaagtggcaagccgaaaaccagtag

SEQ ID NO: 44935 - protein, 393 aa, Bifidobacterium longum NCC2705
MTDDFNEFFDDNTHWVEQGSEPMRGAEPPEPPKSRREMRKRRAQRRRKRISGIIIAIAIVALLIGGGYFGVTKLIAWRDSRSNQSTAIADYPGPGYGEVEFTVSEGQGAAEIADNLLKAEVIKSTAAFTSVVNANSTTLYPGTFTLKKHMAASKVIDVLSDTNQAAGFLEVRPGERATDVFANAAKLSGIAQSEFDTIIKNKGKDILPNEAGGSFEGWLEPGTYNVKSMKSASEILKAMVDKRIAKLDELGVPAGSDRERVMIIASIAEAEVNKADYYGKVTRVIENRLEQGMSLGMDSTVAYGNNVKPAQVTTEMTQDESNPYNTYKISGLPPTPISNPGDNAIQAALHPEGGNWLYFCTVNLDTGETKFAATADEHDQNVAELRKWQAENQ

SEQ ID NO: 44936 - DNA, 1239 bp, Brucella suis 1330
  CDS (1)..(1239)
gtgaattcagaggagaaacccggaaccaatcctgctgaacagcagtccgtatccgagcctcagaacgaggctgtgccaaccgcgccggaaaaggctgcggaacctaagccttttgtgccgaaatccgcttccgaagccttgcgcccggaacccggcacaccgccgccccgcaatcgctcgcgccatgcgcgcagccagatcgtcgttttcatgaacttcatgctgtcgcttgtcgtgctggttttgcttggcgcgtcggcattgttctatttcggcaaattacagtttgatgcgcagggcccgctcacggcggaaacgacctttctcgtcaagcgcggcgctggcattgccgaagtgagcaacggtcttgaaagccgcgatatcgtcagcgatgcgcgcattttccgctatggcatgcgcacgctcgggcatgaaaacgacctgaaggcgggcgaatatgccattcccgtcggggcgtcgatgcgcgacgtgatgaacatcctcatcagcggcaaatccatcatgtatcccttcaccgtgccggaaggcctgacggtcaagcaggtgttcgaccgcatcgccgccgacccgatcctcattggcgacatgccgaaggaaatgccgccggaaggctcgctcttcaccgatacgctgaatttcacccgcggcaccacgcgttccgagataattgaccgcatgatcgcctcgcagaagaaactggtggacgacctttgggcaaagcgcaggcctgacctgccggttcgggacaagaacgaatttgtgacgcttgcctccatcgtggagaaggaaaccggcattgcttccgagcgtccgcatgtggcttcggtcttcgtcaaccgtctgaacaaggggatgcgtctccagtcggacccgacgatcatctatgggcttttcggcggcgcaggcaaaccgtcagaccgcccgatattcaagtcggatatcgaaaagcccacgccttacaacacctatatcatcaatggtttgccgccgacacctattgccaatccgggcaaggcggcgcttgcggcggtcgccaatccgctccagaccgacgacctctattttgttgcgggcggcacgggcggccatgtattctcggcgaccctgaaggggcacaatgacaatgtgcgcaagtggcgggccgcagaacagcaaaagaatatcgggcagcagaaagatacatccggcggctccggcaaacccgataccgggcagtag

SEQ ID NO: 44937 - protein, 412 aa, Brucella suis 1330
MNSEEKPGTNPAEQQSVSEPQNEAVPTAPEKAAEPKPFVPKSASEALRPEPGTPPPRNRSRHARSQIVVFMNFMLSLVVLVLLGASALFYFGKLQFDAQGPLTAETTFLVKRGAGIAEVSNGLESRDIVSDARIFRYGMRTLGHENDLKAGEYAIPVGASMRDVMNILISGKSIMYPFTVPEGLTVKQVFDRIAADPILIGDMPKEMPPEGSLFTDTLNFTRGTTRSEIIDRMIASQKKLVDDLWAKRRPDLPVRDKNEFVTLASIVEKETGIASERPHVASVFVNRLNKGMRLQSDPTIIYGLFGGAGKPSDRPIFKSDIEKPTPYNTYIINGLPPTPIANPGKAALAAVANPLQTDDLYFVAGGTGGHVFSATLKGHNDNVRKWRAAEQQKNIGQQKDTSGGSGKPDTGQ

SEQ ID NO: 44938 - DNA, 1017 bp, Leptospira interrogans serovar Lai str. 56601
  CDS (1)..(1017)
atgaatattaaaaagtttttgattttctccggatttgttattggagttctgcttttaattgcgaccgttactttttttatcgtggacgaactcaaaggaggtgcggtcggatctggtcagaataaaatggaacttcttatcgaatccggggatacttccgggaaaattgtagaaacgttatccacacatggaatgatcaagtcttccaaatattttctttatttagtacggtttactcgtagcgctggtaagatcaaacaagggctttatgagattaacgatggaatggattctagaaaaattctacaagtgattacggaaggaaaagttaaactcgtaaactttacgattccagaaggttataacaatagacagatcggagatttactcgtttctaaaaaaatcatttccaaacgtcaggatttcttactggctgccagtgaaccacaattattgagagagtttaaaattccatctacttccgcagagggttatctttttccggagacgtacagcgttccgatcaattatccagttgataaaatcgttcgaatgatgattaaaagattttacgttcgaattacaaagatagaaaaatctaaaaatctttctcctttagaacttcataaatttataattcttgcttctgtagtagaacgagaggcgaaacgaaacgaggaaagacctcttatggcgggagtatttaacaatcgtctaaaaagggatatgcctttggaatcttgcgcaacaattcaatatctttttgataaacctcatagcaggatttttgaaaaggatctcaagatcgtatctccgtataacacatatcttaataaaggatttcctcccggaccgatttctaatcctggttttccggcgttggaagcggctttttatcctaaggaaaccgattatctgttttttcttttaaaaggggacggttatcactatttcgcaaaatctctgaaagaacacttagaagccaagaaaaagtacatagatgtactttacgattga

SEQ ID NO: 44939 - protein, 338 aa, Leptospira interrogans serovar Lai str. 56601
MNIKKFLIFSGFVIGVLLLIATVTFFIVDELKGGAVGSGQNKMELLIESGDTSGKIVETLSTHGMIKSSKYFLYLVRFTRSAGKIKQGLYEINDGMDSRKILQVITEGKVKLVNFTIPEGYNNRQIGDLLVSKKIISKRQDFLLAASEPQLLREFKIPSTSAEGYLFPETYSVPINYPVDKIVRMMIKRFYVRITKIEKSKNLSPLELHKFIILASVVEREAKRNEERPLMAGVFNNRLKRDMPLESCATIQYLFDKPHSRIFEKDLKIVSPYNTYLNKGFPPGPISNPGFPALEAAFYPKETDYLFFLLKGDGYHYFAKSLKEHLEAKKKYIDVLYD

SEQ ID NO: 44940 - DNA, 1011 bp, Shewanella oneidensis MR-1
  CDS (1)..(1011)
atgaaaaaactcattctgatcgcaagctctaccttattggccttgctgaccttagcttgcttagttggttattggggttaccgtacgattattgattacagccaaacgcctctagtcttaaccgaagccaaagaattaaccattgcccgtggtacgagtgtccaccagttggcacagcagctagaaaccgatggcgtgatccaagataaatggaaactcaaatggctgctcaaattacgccctgagctggccaagatccgcaccggtctttatgagatgaccccttcgcagacgcttgccgatctactcaatgatttagtcaatggcaaggtgaaaatctttagcgtgacactcgttgaaggcaaaaccattgcggagtgggaacaacaactcgcaaacgcgccccatttacaattgacctcagaggttttcagtgccgtattgatggatcagggggatgattcggcgttgccggaaggcaagtttttccctgatacttatcactacaccgcagacagtgatgctagggaactgcttacccaaagttacaaaatgatggagcaggagctcgccaaagcgtgggcggagcgagtgcccggtttacccctaaaatcgcgttatcagatgctgatcttggcttcgattgttgaaaaggaaactggccaagcctttgagcgcgatcaaatcgccggtgtctttatcaatagactgaatcttgggatgaagttgcaaaccgatcccacggtgatttacggtatgggagacagatttaaaggcaatatcactcgcaaggatttagtcgaagatacgccgtttaatacctaccgaattttcggtttaccaccaacgccgattgctgctccgagcaaggcctcattacaggctgtatcgaaacccgccaaggtcagttatttgtattttgtgtcgcgtaacgacggcacccatgtgttttcaaccaccttggaagagcataaccgcgccgtggatatttatcagagaaagaaaaaatga

SEQ ID NO: 44941 - protein, 336 aa, Shewanella oneidensis MR-1
MKKLILIASSTLLALLTLACLVGYWGYRTIIDYSQTPLVLTEAKELTIARGTSVHQLAQQLETDGVIQDKWKLKWLLKLRPELAKIRTGLYEMTPSQTLADLLNDLVNGKVKIFSVTLVEGKTIAEWEQQLANAPHLQLTSEVFSAVLMDQGDDSALPEGKFFPDTYHYTADSDARELLTQSYKMMEQELAKAWAERVPGLPLKSRYQMLILASIVEKETGQAFERDQIAGVFINRLNLGMKLQTDPTVIYGMGDRFKGNITRKDLVEDTPFNTYRIFGLPPTPIAAPSKASLQAVSKPAKVSYLYFVSRNDGTHVFSTTLEEHNRAVDIYQRKKK

SEQ ID NO: 44942 - DNA, 1191 bp, Corynebacterium efficiens YS-314
  CDS (1)..(1191)
atgagcaacaagaccagcggttcagcccggaaccgacggatggagcccgtatacgtgaagcgacgccagcggttcctcgcggtgaccatcgccgcgctgattctcctcatcggagctgtcatctacatcggtgtcgccacctctgaccgcggtggcggcaccaccgacttcgagggcaccggcaatggtgtggttcaactcgtggagatccccgaggggtcctccatgtcggaactgggccccgaactcgaggagcggggcatcgtggccaccaacgcggccttccagaccgccgccgccggcaaccccgacgccggcagtatccagcccggtttctaccgcctccaggaggagatgagtgccgccgccgcggtggcggcactgctcgatcccaacaatcaggtggatctggtggacatccacggtggtgccaccctcatggatgtcgcggtggtcggcggggacacccgcccgggcatctattcccagatcgcccaggtcacgtgcaccgaggggtccaccaactgcatcaccgtggaggatctgcagaccgtggctgccaccgcggacccggccaccctcggcgtgccggagtgggctgtgggtccggtggagtcccggggcaacgacccgaagcgactggagggactcatcatgcccggccagtacgtggtcaaccccaccgccgatgcgcagggcatcctcaccgacctgatcacccgttcggctgcgaagttcgaggagacagatatcgtcacccgggctcagggcatcaacctcaccccctatgaactgctgaccgccgcctccctcatcgaacgtgaggccccggccggggacttcgacaaggtcgcccgcgtgatcctcaaccgcctggaggagccgatgcgtctgcagttcgactccaccgtcaactatggcctgccggaggtcgaggtggccaccaccgaccaggaccgcgaaaccgtcaccccgtggaacacctatgccatggacggactgcccgagaccccgatcgccgcggtgtcgatggaggctctccaggcgatggagaacccggccgagggcaactggctgtacttcgtcacggtggacaccgatggcaccaccgtgttcaacgacaccttcgaacagcaccaggaggacaccatgcgcgccatcaacagcggtgtcctagacagtaaccgctag

SEQ ID NO: 44943 - protein, 396 aa, Corynebacterium efficiens YS-314
MSNKTSGSARNRRMEPVYVKRRQRFLAVTIAALILLIGAVIYIGVATSDRGGGTTDFEGTGNGVVQLVEIPEGSSMSELGPELEERGIVATNAAFQTAAAGNPDAGSIQPGFYRLQEEMSAAAAVAALLDPNNQVDLVDIHGGATLMDVAVVGGDTRPGIYSQIAQVTCTEGSTNCITVEDLQTVAATADPATLGVPEWAVGPVESRGNDPKRLEGLIMPGQYVVNPTADAQGILTDLITRSAAKFEETDIVTRAQGINLTPYELLTAASLIEREAPAGDFDKVARVILNRLEEPMRLQFDSTVNYGLPEVEVATTDQDRETVTPWNTYAMDGLPETPIAAVSMEALQAMENPAEGNWLYFVTVDTDGTTVFNDTFEQHQEDTMRAINSGVLDSNR

SEQ ID NO: 44944 - DNA, 1266 bp, Pseudomonas putida KT2440
  CDS (1)..(1266)
ttgcccgtacgttactggaaacctgaattcgtgagacgtaaattcctgctgttgctggaaatgggcttgatccttgccggcctggcgtttggctggtcggcctggaaggtcaactcggtcctggagcagcccctgcacatcacgcaggaacgcctgctggatgtgcccaatggcactaaccccaaccgcatgttctacagcatgcaaagggaagggttgctcgacgacgctgtctggttgcgtttgtactggcgcttcaacatggccggcacccccctgcacaccggcgagtaccgtcttacccctggcatgaccgtcgagcaattgttcgacgcctggcgccgtgccgacgtggtgcagtacaacctcaccctggtcgaaggctggaccttccgccaggtgcgtgcggccgtggccaagcatgaaaagatcaagcataccctggagggcttgtcggatgccgaggtcatggacaagctcggccataccggtgtgttccccgaaggccgcttcttccccgacacctaccgcttcgtgcggggtatgagcgatgtcgagttgctgcagcaggcctacatgcgtctggacgaggtgctggccaaggagtgggccgagcgttccaccgacctgccgtatcgtgacccgtaccaggcgctgatcatggcctccctggtagaaaaggaaaccggcattccgcaggagcgcgggcagatcgccggcgtgttcgtgcggcgcatgcgcctgggtatgatgctgcagaccgacccgacggttatctatggcatgggtgagcgctacaacggcaggatcacccgcgcggacctgcgcgagcctacgccttacaacacctacaccatgaccggcctgccgccgaccccgatcgccatggtcggccgcgaggcgattcacgcggcgctgaacccgtccaatggcaccagtctttacttcgtcgcccgcggcgatggcagccatgtgttttccgacgacctcgacgaccacaattcggcagtgcgcgagttccagctcaagcgccggtcggactaccgctccagccccgcgccgcagcaagaggccaagccaggtgccgatgatgccgaacaggcatcgggcgccgacgatgcgcagcgccctgagcccccagcagcggacccgtcagcaacggatgagccaactgcgcagccagcccccgatgaagcgcccgcgcaggatgcccctgccggcggtgcacaagcggccgagcggccgacgcctgacgaacaacattaa

SEQ ID NO: 44945 - protein, 421 aa, Pseudomonas putida KT2440
MPVRYWKPEFVRRKFLLLLEMGLILAGLAFGWSAWKVNSVLEQPLHITQERLLDVPNGTNPNRMFYSMQREGLLDDAVWLRLYWRFNMAGTPLHTGEYRLTPGMTVEQLFDAWRRADVVQYNLTLVEGWTFRQVRAAVAKHEKIKHTLEGLSDAEVMDKLGHTGVFPEGRFFPDTYRFVRGMSDVELLQQAYMRLDEVLAKEWAERSTDLPYRDPYQALIMASLVEKETGIPQERGQIAGVFVRRMRLGMMLQTDPTVIYGMGERYNGRITRADLREPTPYNTYTMTGLPPTPIAMVGREAIHAALNPSNGTSLYFVARGDGSHVFSDDLDDHNSAVREFQLKRRSDYRSSPAPQQEAKPGADDAEQASGADDAQRPEPPAADPSATDEPTAQPAPDEAPAQDAPAGGAQAAERPTPDEQH

SEQ ID NO: 44946 - DNA, 1278 bp, Bradyrhizobium japonicum USDA 110
  CDS (1)..(1278)
atgagtgaaaggccgcccatttcgccccggagtccgcgggcagcgctcgagcccgagcaggtcccgccgccgccgaagcgatcggaccgcgcgcgcaatcccttcgtgatcgtcggcaacgccatcatcacgctgctcttgatctccatgatcggggcgggcgccgtctattactacggccggcaggtgctcgaagcgccgggtccgctcaaggaagacaagatcgtcaacatcccgcagcgcgccggcaagcgcgacatcgccgagacgctgaaccgggaaggcgtgaccgacgtcaacccgtgggtgttcatcgcaagcgtagccgcgctgaaggcgagctcggacctcaagcccggcgagtattcgttccagaagaacgcatccctgcgcgacgtcatcgccaccatcgtcgaaggcaaggtggtgcagcatgccgtcacgattccggaaggcctgacctccgagcagatcgtggcacggctctccgacaacgatatcttcaccggcagcgtgcgcgagctgccgcgcgagggcacgctcttgcccgagacctacaagttcccgcgcggcaccacgcgcgagcaggtgatccagcgcatgcagcaggcgcacaagcgcgtgctgaccgagatctgggagcgtcgcagccaggacattccggtcaagactccggagcagctggtgacgctggcctcgatcgtcgagaaagagaccggcaagccggacgagcgcagccgcgtcgctgccgtgttcgtcaatcgcctgaagcagaagatcaagctccagtccgatccgaccatcatctatggcctcgtcggcggcaagggcacgctgggccgcccgatcaagcgcagcgagatcacgcagccctcgccctacaacacctatgtgatcgaaggcctgccgccgggcccgatctccaatcccggccgcgcctcgctcgaagccgccgccaacccggcccgcacccgcgacctctatttcgtcgccgacggcaccggcgggcatgccttcaccgagacctacgacgcgcaccagaaaaacgtcgccaagctgcgcgcgatggagaagcagatccagaacgacacggtcgagccggccgaggacgcgcagccgccggcggcggcagcgcccggcgctgccgacacgccgaccgcgaccacgccggcacggccgaaccagcagaagaagccgccggctgctcctcgccccgctggtcccgctcctgcccggcagggcgcggtgcaaccctcgccgccggtgatccagcgctag

SEQ ID NO: 44947 - protein, 425 aa, Bradyrhizobium japonicum USDA 110
MSERPPISPRSPRAALEPEQVPPPPKRSDRARNPFVIVGNAIITLLLISMIGAGAVYYYGRQVLEAPGPLKEDKIVNIPQRAGKRDIAETLNREGVTDVNPWVFIASVAALKASSDLKPGEYSFQKNASLRDVIATIVEGKVVQHAVTIPEGLTSEQIVARLSDNDIFTGSVRELPREGTLLPETYKFPRGTTREQVIQRMQQAHKRVLTEIWERRSQDIPVKTPEQLVTLASIVEKETGKPDERSRVAAVFVNRLKQKIKLQSDPTIIYGLVGGKGTLGRPIKRSEITQPSPYNTYVIEGLPPGPISNPGRASLEAAANPARTRDLYFVADGTGGHAFTETYDAHQKNVAKLRAMEKQIQNDTVEPAEDAQPPAAAAPGAADTPTATTPARPNQQKKPPAAPRPAGPAPARQGAVQPSPPVIQR

SEQ ID NO: 44948 - DNA, 1068 bp, Xylella fastidiosa Temecula1
  CDS (1)..(1068)
gtgctggtggcaccgatgatgttggtgttgatcgttttactgggactcattgcacggcctgatttaaagcattatgtgccaggctggaagtattacgagcattatcagcattttgcgcataccccgctcagtgcgagcgcgtctagtgtggagattgcacgtggtgattctctgcatacggtcttgcttaaattacgtaaggctggggttcaaagcggtagtgacttggagtggcaactattggcatatcaggtaggtgctgccggtaatttgaagttcggcgattacgcattggcgcctgcggtttctccacatgatttgctacagcgtatgcgtcatggcaagggtgagcattaccgcttcactatcgttgagggttggaacattcgtcagctgcgtgctgcgttgcgccaagctactcctttggtgcatcgtgcaggcatgctggatgatgcgacattaatggctcaattgggtttcccgggtgaacatccggaagggcgttttttgcctgagacctatttgtaccaacgtggagacagcgacttggacgttttgcgtcgtgcccatgcagcgatgcaaaaggcgcttgccgagacgtgggcggcgcgtgatccggcactgaagttgcatactcctgatgaggcgctgattcttgcttcgattgtggagaaagaaagtggcttgtctaccgagcggccgaagattgctggagtgtttctgcaccgcattgcgcgagggatgcgattacaggcagattcgacggtgatctatgggctgggcagcatctacgacggtaatatccgcaagcgtgatttaaagacccccaccccctataacacttacgtccacaccggattgacgccgactccaatttcaatgcctggccaggatgcattgcgtgctgtgacgcgtcctgcagtgggcgacgcgctgtattttgttgcccttggcgatgggagtggcggacatacgttttcctcatcactgcagcagcataacgcggcggtggcgcgttacttgcaacgccttcgtgaacgcgaaagcaaaacgaaggagcggcaatga

SEQ ID NO: 44949 - protein, 355 aa, Xylella fastidiosa Temecula1
MLVAPMMLVLIVLLGLIARPDLKHYVPGWKYYEHYQHFAHTPLSASASSVEIARGDSLHTVLLKLRKAGVQSGSDLEWQLLAYQVGAAGNLKFGDYALAPAVSPHDLLQRMRHGKGEHYRFTIVEGWNIRQLRAALRQATPLVHRAGMLDDATLMAQLGFPGEHPEGRFLPETYLYQRGDSDLDVLRRAHAAMQKALAETWAARDPALKLHTPDEALILASIVEKESGLSTERPKIAGVFLHRIARGMRLQADSTVIYGLGSIYDGNIRKRDLKTPTPYNTYVHTGLTPTPISMPGQDALRAVTRPAVGDALYFVALGDGSGGHTFSSSLQQHNAAVARYLQRLRERESKTKERQ

SEQ ID NO: 44950 - DNA, 1020 bp, Clostridium tetani E88
  CDS (1)..(1020)
atgggaaaaaggaaaaaaatggggataataatacctgtggtcttttgtataatagctttatctattataggaaccgttacttactataaaaatattataaaacacccttttaaagttaaggatgaaagcttcaaaattgtggtagaagagggcagtggtatttacactgttcttaataccatgaaaaataataaaaatgtaaaaaatgtatggttgataaaaaagtatttaaaggataataacatgcttttaaatataaatccaggaacatatatagtaaaatcagatgctaccatagacgaatttattgaacagttaaataagggcatagatgaggatactattaaagtaactattcctgaaggatatgatatcaataaaatagcattattactagaacaaaaaggaataataaaaagggaagatttcattaaaaaatgtagtgaatatgaaaaacctaaatatataaagaatataaataagagaaaatatgtattagagggttatctatttccagatacctataatttaaaaaaagatatggatggggagaaagtaatttctacaatgtataatagatttgaaaaagttgctgaggacttaaaaaataaatataaaataaaagatgaagaattagataaaataattaccttagcatctattgtagaaaaagaagcagaagttaatgtagaaagaggaaaggttgcctctgtatttcataatagggtaaaaaaaggtatgaaaatggaatcctgtgctacggtattatacgctatgggaaagcataaagaaaagctctattataaagatttagaaataaattctccttataatacatataagaccattgggttacctccaggtcctatatgtaatccaggaattgaatccattgaggcaacaataaagccagaggaaacaaattatttatattttgtttctaataatgatggcactcatttttttacagataactatgctgaatttttaaaagtcaagaaaactacccaaggagattag

SEQ ID NO: 44951 - protein, 339 aa, Clostridium tetani E88
MGKRKKMGIIIPVVFCIIALSIIGTVTYYKNIIKHPFKVKDESFKIVVEEGSGIYTVLNTMKNNKNVKNVWLIKKYLKDNNMLLNINPGTYIVKSDATIDEFIEQLNKGIDEDTIKVTIPEGYDINKIALLLEQKGIIKREDFIKKCSEYEKPKYIKNINKRKYVLEGYLFPDTYNLKKDMDGEKVISTMYNRFEKVAEDLKNKYKIKDEELDKIITLASIVEKEAEVNVERGKVASVFHNRVKKGMKMESCATVLYAMGKHKEKLYYKDLEINSPYNTYKTIGLPPGPICNPGIESIEATIKPEETNYLYFVSNNDGTHFFTDNYAEFLKVKKTTQGD

SEQ ID NO: 44952 - DNA, 1206 bp, Lactobacillus plantarum WCFS1
  CDS (1)..(1206)
atggaggggcgagtcttgaataacaaccaggataaccaagatcagaaggatcaaaacgattcacaagatcgtggggtaaatgaacctaatcgttcagaacaaaaacagcggaaatcattttcgaaacacgttattggtggcgttgttggtattttagtcgtacttttaattattgtgggggtattgggttatcgatattttgataatgcgacgcaaccatatgacagtagcgacaatcgcgtcgttcaagttgatatcccgtacggtgctaatggtaagaaaattgccgatattttacagcgcgaaaaggtgatcaagagtggttttgtctttgaatactggacgaaagcacacaacttatcaaactttcacgcgggctactatcagttgaagccttcgatgtcacttgctcaaatcgcgaaggccttgaataaaggtggttcatcggaaccggttcagagttctagtggtaaagtcctaatcgttgaaggtagtcagattaagacgattgcgaagacggttcaaaaacaaactgatttcacgtcggcagaatttctagccttaatgaaggatcaaacattcatcaaatcattggccaagaagtatccacaattgttgaattcagcgatgagtgctaagcaagttcgctatcgtttagaaggctatttgttcccggcaacttatgttgttggtaagaaaacaactttgaaacaattagtaacgcagatggtttcgaagactaatgatgagcttgaaccatactacgcgcaaattaagaagtcgaagatgtccgtgcaagaagtaatgaccttagcgtccttagttgaacgtgaaggcagtacgacgaaagatcggcggttgattgctggcgtcttcttgaatcggttagatgctaagtggcgcttggattctgatatttcagtgttctatgcgatcaattctaacaagtcaacgttaacgaataaagatttgcagactgattcaccgtataacttacggttgaacttaggctacggccccggaccgttcaacagtcctagtttaacatcgatcaaggcagtcttagatcctgcacaacggagcaagggttacatgtatttcgtagcagatttgaagactggtgatgtctattatgcaaaggatgctgcgggtcacgcggcaaacatcaagaaggtttcgaagcacaacgaagccgctgaaaaataa

SEQ ID NO: 44953 - protein, 401 aa, Lactobacillus plantarum WCFS1
MEGRVLNNNQDNQDQKDQNDSQDRGVNEPNRSEQKQRKSFSKHVIGGVVGILVVLLIIVGVLGYRYFDNATQPYDSSDNRVVQVDIPYGANGKKIADILQREKVIKSGFVFEYWTKAHNLSNFHAGYYQLKPSMSLAQIAKALNKGGSSEPVQSSSGKVLIVEGSQIKTIAKTVQKQTDFTSAEFLALMKDQTFIKSLAKKYPQLLNSAMSAKQVRYRLEGYLFPATYVVGKKTTLKQLVTQMVSKTNDELEPYYAQIKKSKMSVQEVMTLASLVEREGSTTKDRRLIAGVFLNRLDAKWRLDSDISVFYAINSNKSTLTNKDLQTDSPYNLRLNLGYGPGPFNSPSLTSIKAVLDPAQRSKGYMYFVADLKTGDVYYAKDAAGHAANIKKVSKHNEAAEK

SEQ ID NO: 44954 - DNA, 1002 bp, Tropheryma whipplei TW08/27
  CDS (1)..(1002)
atgctcttgaaaatactctccctttctcttgctgctctattcctgtttatcgcagccgtgttcgttattaatgtttcaagtgtgcaacgcgctggtgatattgtgcaggttactgtcccatccggtacttctggtgcgaaaattgcagatattctggcacagaatagtgttatcggtgataaacgaggttttattgacttattagttgcccaaaaagtttctcttcgtgccggagtgtacaggttaaaaagaggtatgtcaccccgggaggctctgcttgcaatgcttaatccagaaaatcggactagcaatacggttgtcattattgagggtgcaactttgacaggaatctttagtgctttgtcaaaaaaaacaggtataccgattgtcgaatttgaaaaagttgcatcagatttgagtaattttcctgatcttccgaggcaggcctcttccgttgaaggttttttatttcccgctacatatgacatagaagaaggggcaactgcaaaatctttgctgcttgctatgtacaaaagaatgtgggcagagattaggacccttggaattccgtctgagaatgtgtggcgtactgtggttcttgcggctcttattcagaaagagggaattccgtctgattttgcgcgcgtatctcgcgtttttgtaaataggctcgagcggggcatgaatcttcagtctgatgcaacggtcttgtatggcctaaaactttctggacaagtggtgacaactgatgaacaaagggaagataagggtaatccatacaatacatacgtacatgcaggtcttccccccggggctatctcaaatcctggtgcttcggcactcaaggctgcaatatatcccgcgccgggaaaatggcttttttttgttacatggaacgaatgcaccggcgagacaattttttctgaaacattttctgagcatcaaaaaggggttgacaaatggcttagatggcgcaaaaatcacccggatggtaagtgctga

SEQ ID NO: 44955 - protein, 333 aa, Tropheryma whipplei TW08/27
MLLKILSLSLAALFLFIAAVFVINVSSVQRAGDIVQVTVPSGTSGAKIADILAQNSVIGDKRGFIDLLVAQKVSLRAGVYRLKRGMSPREALLAMLNPENRTSNTVVIIEGATLTGIFSALSKKTGIPIVEFEKVASDLSNFPDLPRQASSVEGFLFPATYDIEEGATAKSLLLAMYKRMWAEIRTLGIPSENVWRTVVLAALIQKEGIPSDFARVSRVFVNRLERGMNLQSDATVLYGLKLSGQVVTTDEQREDKGNPYNTYVHAGLPPGAISNPGASALKAAIYPAPGKWLFFVTWNECTGETIFSETFSEHQKGVDKWLRWRKNHPDGKC

SEQ ID NO: 44956 - DNA, 1140 bp, Pseudomonas syringae pv. tomato str. DC3000
  CDS (1)..(1140)
gtgatccgaaaattattggtgttgctggaaaccgccatcgttctggcggtcctgctgctcggctttgctttctggcagcagaaagaggcgctgaaccagccgctcaaggtggctcaggagcaattgctcgatgttccggctggctccacgcccaccggcgttctcaaccgcttgcaagccgatggcgtgatcaaggacgctttctggctgcgcctgtactggcgtttcaacctttcggggcagcccctgcacagcggtgaataccgcatgctgccgggcatggacgtcaacgccctgttcgatgtctggaagcgcaaggaagtcgtgcagtacagcctgacgctggttgaaggctggaatttccgtcaggttcgcgctgcgctggccaagcaggccaagctcgatcaaacgctcgcggggctgtccgacagtgagttgatggcgaaaatcggccaccccgacgtgttccctgaaggccgcttcttcccagacacctaccgctacgtgcgcggcatgaccgatgccgaattgctcaaacaagcctataaccgcctggaagaagtgctggatgaggagtggcaggcaagatcgtcagaagcgccttattccaatccttatcaagccctgatcatggcgtcgatggtcgagaaggaaaccggtgtgcctcaggagcgcgggcagattgcaggcgtattcgtgcgccgcttgaagctgggcatgcaactgcagaccgacccgaccgtgatctatggcatgggcgagcgctacaacggcaagttgacccgcgccaatctcagagagcccacgccctacaatacctacgtaatagccggtatgccgccgacaccgatttcgctggtggggcgcgaggccattcatgctgcgctcaacccggtggcgggcagcagcctgtatttcgtcgccaagggtgacggcagccatgtgttttctgacgatcttgatgcgcacaattcggctgtgcgtgattatcagctcaagcgccgtgccgattaccgctcgagccccgcgcctgctgcggcaccggctccgacaggggaacctgccgccgattcgcctgcttcaccacccgagcccgagactgcaccggatgccccgcagtccgagccggatacgcaataa

SEQ ID NO: 44957 - protein, 379 aa, Pseudomonas syringae pv. tomato str. DC3000
MIRKLLVLLETAIVLAVLLLGFAFWQQKEALNQPLKVAQEQLLDVPAGSTPTGVLNRLQADGVIKDAFWLRLYWRFNLSGQPLHSGEYRMLPGMDVNALFDVWKRKEVVQYSLTLVEGWNFRQVRAALAKQAKLDQTLAGLSDSELMAKIGHPDVFPEGRFFPDTYRYVRGMTDAELLKQAYNRLEEVLDEEWQARSSEAPYSNPYQALIMASMVEKETGVPQERGQIAGVFVRRLKLGMQLQTDPTVIYGMGERYNGKLTRANLREPTPYNTYVIAGMPPTPISLVGREAIHAALNPVAGSSLYFVAKGDGSHVFSDDLDAHNSAVRDYQLKRRADYRSSPAPAAAPAPTGEPAADSPASPPEPETAPDAPQSEPDTQ

SEQ ID NO: 44958 - DNA, 1017 bp, Vibrio parahaemolyticus RIMD 2210633
  CDS (1)..(1017)
gtgattaaaaaactgttggcttttgttgtgctgatcgctgtgataagcgcagcagggtttttttacgttgtttcacaaacaaagcaatacgttaactcgccaattttaattgagcaacctcaactgttcactgtcgaaaacggcacaagctttcatcgtgtaatgcgcgatttggtgaaagagaacatcgtaaaagcgtctgattacactcgcttaatgccccatctttacccagagcttcttcaagtgcgagccggcacttaccaactcgagccaaatgtatcgctttacgaggcgttagagctactcaatacaggcaaagaacatcaatttgccatcacgtttgttgaaggtagtcgtttttctgagtggttagagcaacttcaaagcgcaccgtatgttcaacacgacctttcagggttgtcagaaaaagagatggcacagaagcttggtattgaacgtgataagcttgaaggcttgtttttggctgaaacgtaccactacaccgctggtgcgagcgaaagtcagttgctaaagcgtgcacattccaagttaaataaaatactggatgcgaactgggacgctcgtcaggagaagctgcctctcaaagacaagtatgaagcgctgatccttgcctctattatcgaaaaagaaacggcgattgattcagaacgcgaacgtgttgcttctgtgtttgttaaccgtttgaataaacgtatgcgacttcaaacggatccgaccgttatctacggaatgggggatgcttacgatggtaacatccgtaagaaagacctacgcaccccaacaccatacaatacctacgttattaatggtttgccgccgacacctattgcaatggccggagaagcctctatcgaagctgcactaaacccagaaagcagtgattacttatattttgtagcaagtgggacgggcggacacgttttctcgaaatcacttgctgagcacaatcgtgctgttcgagcctatttaagagaactaagaaagaacaaatga

SEQ ID NO: 44959 - protein, 338 aa, Vibrio parahaemolyticus RIMD 2210633
MIKKLLAFVVLIAVISAAGFFYVVSQTKQYVNSPILIEQPQLFTVENGTSFHRVMRDLVKENIVKASDYTRLMPHLYPELLQVRAGTYQLEPNVSLYEALELLNTGKEHQFAITFVEGSRFSEWLEQLQSAPYVQHDLSGLSEKEMAQKLGIERDKLEGLFLAETYHYTAGASESQLLKRAHSKLNKILDANWDARQEKLPLKDKYEALILASIIEKETAIDSERERVASVFVNRLNKRMRLQTDPTVIYGMGDAYDGNIRKKDLRTPTPYNTYVINGLPPTPIAMAGEASIEAALNPESSDYLYFVASGTGGHVFSKSLAEHNRAVRAYLRELRKNK

SEQ ID NO: 44960 - DNA, 1038 bp, Bacteroides thetaiotaomicron VPI-5482
  CDS (1)..(1038)
atgaaaaagaaaacaagaaatatcttattatccgttctgaccggagctctccttctttgcgccattgccggaggaacagtctattattatctctttgctcctcagtttcatccctccaaaaccgtctatgtatatgtagaccgggatgacacggcagattcaatctacaataagatcagacaaaccggtcatgtcaacaaattcaccggatttcaatggatggcgaaatatagaaaattcgaccagaatatacataccggacgttatgccatccgccccaacgaaaacgtataccatgtattcagccgcttcttcagaggttatcaggaaccgatgaatctcactatcggaagcatacggacactagaccggctggcgcgaagcatcggcaagcaactgatgatcgactccgccgagatagcccgccaactattcgattccgcttttcagaccgaaatggggtatacgccggtcaccatgccctgtcttttcatccccgagacctatcaggtatattgggatatgagtgtcgacgacttcttcaaacgtatgcagacagaacacaaacgattctggaatgacgaacgtcttgcccaggcaaccgctatcggcatgacaccggaagaagtctgcaccctcgcctccattgttgaagaagaaaccaacaacaacgaagaaaagccgatggtagccggactatacatcaaccgcctgcacacaggtatgcccctgcaggcagaccctaccatcaagttcgctttacaggatttcgggctgcgacgcatcaccaatgagcatctgaaagtcaactcgccctacaacacttatatcaacagtggtttacctccgggacctatccgcatcccctctaaaaagggcttggacagtgtattaaactacacgaaacacaattacatttacatgtgtgcgaaagaagatttttcaggtactcacaatttcgcatccaattatgccgaccacatggcaaatgcaagaaaatattggaaagcacttaatgaaagaaagattttcaagtaa

SEQ ID NO: 44961 - protein, 345 aa, Bacteroides thetaiotaomicron VPI-5482
MKKKTRNILLSVLTGALLLCAIAGGTVYYYLFAPQFHPSKTVYVYVDRDDTADSIYNKIRQTGHVNKFTGFQWMAKYRKFDQNIHTGRYAIRPNENVYHVFSRFFRGYQEPMNLTIGSIRTLDRLARSIGKQLMIDSAEIARQLFDSAFQTEMGYTPVTMPCLFIPETYQVYWDMSVDDFFKRMQTEHKRFWNDERLAQATAIGMTPEEVCTLASIVEEETNNNEEKPMVAGLYINRLHTGMPLQADPTIKFALQDFGLRRITNEHLKVNSPYNTYINSGLPPGPIRIPSKKGLDSVLNYTKHNYIYMCAKEDFSGTHNFASNYADHMANARKYWKALNERKIFK

SEQ ID NO: 44962 - DNA, 1386 bp, Enterococcus faecalis V583
  CDS (1)..(1386)
ttggctaatgataaccaaaataaccaagatcccaaatcttcgcttagagatcaagtaactgggtctttaaatggtagaaatgatggcgatcaacctgattcctctgaaaaaaatgataggtcaccccaaccttcatctgatgaatcacaagaaacagcgagccgcacaacacaaacacgtgcaggttctagagctgctcgaagacgtgggaaagacaagacaacacagacagtcgaagagccaaccccgattgaaacagacgaaaagccaacaaatacaaaaaaacaaacacgtaaaaaagaagatcgtttagtcggtcgtatcgtgttaattgtagtttctgtattagttttaatgatggcaatctttgggtttactttttataaatatgtagatgctgggctacagccactagacaagaacaataagaagcttgttcaagtgcatatcccagaaggatcttctaataagcaaattgctgcggttttagaagaaagcaacgtcattaaaagcggaatggtttttaactactacgtaaaatttaaaaacttaacagattttcaagcgggctattatcaaatgtctccaagcatgacactcgatgaaattggtgaaatgctaaaagaaggaggtacgccagaaccaactaaaattgcagatggcaaagtaacgattcctgaaggctacgatatagataaaattggcgaagctattgaaaaaaatacagatttcaagaaagcagatttcattgcattaatgaaaaacgaagacttcttcaatcaaatgaaagctaagtatcctgatttacttgaaagtgctgcaactgcagaaggtgttcgttatcgcttagaaggctatttgttcccggcaacttatgattactacaaaaaagcaacacttcctgaatttgtcgaacaaatgattgctaaaatgaacacagtaatggaacaatatacgccgacaattcatgcaaagaatttaaccaatcagcaagtcttaacgttagcttcattggttgaaaaagaaggagtcaaagaagcagaccgcaaacaaattgcgcaagtattctttaaccgcttggctgccgatatgccaatccaatcagatatttctattttgtatgctctaggagaacacaaagaaactgtaacgtatgctgacttggaagtggactcgtcttataacttgtataaaaatactggttatggaccaggaccattagatagcccaagtgaggagtcaattaaagcagtcttgaatccgacaccaagtgactatttatactttgtagcagatatttctacaggaaaagtctacttctcaaaaacatatgaagaacatcaagtattagtagatcagtatgtcaataattcaagtagtgaataa

SEQ ID NO: 44963 - protein, 461 aa, Enterococcus faecalis V583
MANDNQNNQDPKSSLRDQVTGSLNGRNDGDQPDSSEKNDRSPQPSSDESQETASRTTQTRAGSRAARRRGKDKTTQTVEEPTPIETDEKPTNTKKQTRKKEDRLVGRIVLIVVSVLVLMMAIFGFTFYKYVDAGLQPLDKNNKKLVQVHIPEGSSNKQIAAVLEESNVIKSGMVFNYYVKFKNLTDFQAGYYQMSPSMTLDEIGEMLKEGGTPEPTKIADGKVTIPEGYDIDKIGEAIEKNTDFKKADFIALMKNEDFFNQMKAKYPDLLESAATAEGVRYRLEGYLFPATYDYYKKATLPEFVEQMIAKMNTVMEQYTPTIHAKNLTNQQVLTLASLVEKEGVKEADRKQIAQVFFNRLAADMPIQSDISILYALGEHKETVTYADLEVDSSYNLYKNTGYGPGPLDSPSEESIKAVLNPTPSDYLYFVADISTGKVYFSKTYEEHQVLVDQYVNNSSSE

SEQ ID NO: 44964 - DNA, 1113 bp, Coxiella burnetii RSA 493
  CDS (1)..(1113)
atgtcattcttcaaaaagattatcctttttattggcgctattgtggtgatgattttaggaatgtggtttgccatcgtctggcaccgctttattcatacgccccttcaaagcgacaaagcgatacagcaggtaagcactattaaagtcccaccaggcaccggcattcactacctagcaaaaagtttgcatgaacaaggattactgcaaaatcctcaattcttcatttggctagcgcgcctgaaaggtgatgcccctttattaaaagcaggcgagtatgagattacgccgacgatgacgccgttggaattgttaaggaatgtagtagcaggcaaagtaaagcagcgcagcattacctttattgaaggttggacgtttcgtgaaatgaagcagaccttagaagaaaatccctacattcaccataccattgaccggctaagtgatcaaaaaattctggcaaaactgggttgcaccaaccttcgtcccgagggactttttttccccgacacttattcttttacgtggggagacaacgatatcaaaatacttcgtcaagcctatcagcgtatgcagacaattttaaacgaagcctggcaacaacgcgcagacaatttaccttacaaaaatccttatcaagcattaattttggcctcgcttgtcgaaaaggaaacggcgttgcccaaagagcgtcctaaaatcgccggcgttattttacgccgtttaaaaaaaggaatgccgttacaagtagaccctactgttttatacggcctggggcgtccttatggtagccctattacgaaggaagacttagtttctaattcaccctataatacctaccagcattacggtttacctcccactcccattgatatgccatcgcgtgcatcgattctagctgcccttaagccagaatcgggcgatgcgttatactatgtggcgcggggcgatggcagtcatattttttcggcgacgtataaagaacacaaagaagctattaaaaaagtatttagaagatggagaaaaacatgggaattgaacgcggccgtttcatttcttttgaaggaattgaaggagtggggaagacaaccgcacttaattgggtgcgggagcaattag

SEQ ID NO: 44965 - protein, 370 aa, Coxiella burnetii RSA 493
MSFFKKIILFIGAIVVMILGMWFAIVWHRFIHTPLQSDKAIQQVSTIKVPPGTGIHYLAKSLHEQGLLQNPQFFIWLARLKGDAPLLKAGEYEITPTMTPLELLRNVVAGKVKQRSITFIEGWTFREMKQTLEENPYIHHTIDRLSDQKILAKLGCTNLRPEGLFFPDTYSFTWGDNDIKILRQAYQRMQTILNEAWQQRADNLPYKNPYQALILASLVEKETALPKERPKIAGVILRRLKKGMPLQVDPTVLYGLGRPYGSPITKEDLVSNSPYNTYQHYGLPPTPIDMPSRASILAALKPESGDALYYVARGDGSHIFSATYKEHKEAIKKVFRRWRKTWELNAAVSFLLKELKEWGRQPHLIGCGSN

SEQ ID NO: 44966 - DNA, 1818 bp, Streptomyces avermitilis MA-4680
  CDS (1)..(1818)
atgactgagtatggccggggcccaggctccgaaccgtggcatccggaggacccgttgtacggggacggcggatggggaggacaggagccccacgcggcccagtccgcctacggcggccagccgcagcactatccgcagcagccgcagcagcagtacggcgactggggcaacggccagcaggccgggtacgaccagggcgggcagcagtacgagcagcagtacgcggaccaggggcagcagtacccccagcagaacgcggcccagcagcagtaccagcagcacgccgcccaggggcagcagcacaacccccagaatcaccagcagcacgaccctcaaggtcagcagcagcacaacccccaaggtcagcagcagtatgccgaccagactcatcagcagtacggcaacggcggctgggagaccggggcgcacccccaggtcccgtatgccgccgatccggccgacccgtacggggggcagcccgccgcgtacagcggtgagcagcccgacttctacggcacgcccgacgcctacccgcccccggagccgcccggtcggcgccgcgccgagcccaagcccgagcccgagccggagaccgactgggacccgggccccgatgagggagaacacgccttcttcgcgggcggcggcgacgatgacgacgacctcgacgacgaggccaagggccgcggcggacgaggtgaccgccgtggccgtggcgatggcaaggcaaagaagcgccgcaacggatgcgcctgcctggtggtcgtgctggtgttcggcggtggcctcggcggtgtcgggtactacggctggcagttctaccaaaatcgtttcggcgcggcacccgactacgcgggggacgggacgggcgagcaggtgaccgtcgtcatcccgaagggtgccttcgggtcggtgatcggccagaagctggaggaggccggggtcgtcaagagcgccggggccttcgtctccgctcaggcgacgaatcccgacggggacaagatccagccgggcgcgtacacgctcaagaaggaaatgtccgcgaagagcgccgtcgagctcatgctcagccccaagagcaagaacaacctgacggtctacgagggccagcgcaacgcgcgggtctacaccgcgatcgacacgcgtctcggagtcaaaaagggaaccaccaagggcgtcgccgagaaggaatggtcgaccctcgggctcccggactgggcgaacaccgacaaggacatcaaggacccgctggagggattcctctacccgtccacctatccggtctccaagggcatgaagcccaaggacgtcctgaaggaaatggtcaacctggccaaggacaagtacgccgcactgggcatccaggcgaaggccaaggacctgaacctgaagaatccgctccaggtcctgacggtcgcgagcctcgtccagtccgaaggaaactccaagaacgacttcgaaaaggtcgcgcgggtcgtctacaaccgtctgaagccggacaacaccgagacctacggcctcctcgacttcgactccacggtgaattacctgcgcggcgaatccaagctcgccaccggttcggtcaacgacctgcggaagatcaacgacccgtacaacacctacaagatcaagggtctgccgcccggaccgatcagcaaccccggtgatgtggcgatcaacgcggccctcaatccggccaagggcaactggtactacttcgtttcgatcagcgcggacaagacgcttttcgccgagaccaacgaagagcagaaccgcaatcgcgagaagtacctcgaagagcagaagaacggacaatga

SEQ ID NO: 44967 - protein, 605 aa, Streptomyces avermitilis MA-4680
MTEYGRGPGSEPWHPEDPLYGDGGWGGQEPHAAQSAYGGQPQHYPQQPQQQYGDWGNGQQAGYDQGGQQYEQQYADQGQQYPQQNAAQQQYQQHAAQGQQHNPQNHQQHDPQGQQQHNPQGQQQYADQTHQQYGNGGWETGAHPQVPYAADPADPYGGQPAAYSGEQPDFYGTPDAYPPPEPPGRRRAEPKPEPEPETDWDPGPDEGEHAFFAGGGDDDDDLDDEAKGRGGRGDRRGRGDGKAKKRRNGCACLVVVLVFGGGLGGVGYYGWQFYQNRFGAAPDYAGDGTGEQVTVVIPKGAFGSVIGQKLEEAGVVKSAGAFVSAQATNPDGDKIQPGAYTLKKEMSAKSAVELMLSPKSKNNLTVYEGQRNARVYTAIDTRLGVKKGTTKGVAEKEWSTLGLPDWANTDKDIKDPLEGFLYPSTYPVSKGMKPKDVLKEMVNLAKDKYAALGIQAKAKDLNLKNPLQVLTVASLVQSEGNSKNDFEKVARVVYNRLKPDNTETYGLLDFDSTVNYLRGESKLATGSVNDLRKINDPYNTYKIKGLPPGPISNPGDVAINAALNPAKGNWYYFVSISADKTLFAETNEEQNRNREKYLEEQKNGQ

SEQ ID NO: 44968 - DNA, 1122 bp, Bacillus cereus ATCC 14579
  CDS (1)..(1122)
ttgatagagaatcaagtgaaaaagaagcgtagacgcatctttttattttcgattattgcactgcttttagtttgtggttcagtctatgcgtatatttcatccgcattaggaccagttgatagcgggaataaaaaagagattgaagtagaaattccgaaaggatcatctacaagtaaaattggagaaattttagaagaaaaaggcgctgtaaaaaacggtacagtttttagtttttatacaaaggctaaatcgaaaagtttacaagcaggtacatatttattaaatccttcaatgaatgctgaagatgtgatcgaacaaatgtcagctggcaacgtgcatcgtccagctctttataaagtgacgattaaagaaggggcgcaagtaactgaaattgcagaaacgattgcgacagaactaaagtggaataaagatgatgttacgcgtcaattaaacgataaagcatttattcaaaaaatgcagcaaaagtatccgaagttattaacggataaaatctttgatagtaatattaaatacccattagaaggttatttatatcctgcaacgtattcgttttataagaaagatacaacgttagaagaaattgtaattccaatgcttgagaaaacaaatgcaatcattgttcaaaatgaggcgaaaatgaaagcgaagaattgggatgttcatcagcttttaacattatcttcacttattgaagaagaggcaactggttttacagatcgtcaaaagatctctagtgtcttttataatcgtttagcaaaaggtatgccgcttcaaacggatccaacggtattatatgcacttggaaagcataaacaacgtgtattatacgaagatttaaaggtcaactcaccgtacaatacgtatgttgtaaaaggattgccggtagggccaattgcaaactctggtaaacattcagtagaagctgcgttagaacctgcgcaaacagattattattatttcttagctgcaccaagtggtgaagtgtactatgcgaaaacattagaagagcataatgcattaaagcaaaaatacattacgaaaaaaacagtgaaatggggagggatagcgaaaaaagtcgcacatccctcttttttgtggtaa

SEQ ID NO: 44969 - protein, 373 aa, Bacillus cereus ATCC 14579
MIENQVKKKRRRIFLFSIIALLLVCGSVYAYISSALGPVDSGNKKEIEVEIPKGSSTSKIGEILEEKGAVKNGTVFSFYTKAKSKSLQAGTYLLNPSMNAEDVIEQMSAGNVHRPALYKVTIKEGAQVTEIAETIATELKWNKDDVTRQLNDKAFIQKMQQKYPKLLTDKIFDSNIKYPLEGYLYPATYSFYKKDTTLEEIVIPMLEKTNAIIVQNEAKMKAKNWDVHQLLTLSSLIEEEATGFTDRQKISSVFYNRLAKGMPLQTDPTVLYALGKHKQRVLYEDLKVNSPYNTYVVKGLPVGPIANSGKHSVEAALEPAQTDYYYFLAAPSGEVYYAKTLEEHNALKQKYITKKTVKWGGIAKKVAHPSFLW

SEQ ID NO: 44970 - DNA, 1032 bp, Nitrosomonas europaea ATCC 19718
  CDS (1)..(1032)
atgcctaaatcaacacgttttctgaaactcaccagtttcgttcttattgtcattctggttggcagtacgctgttttcagtatggttctatcgactggctacaactccgttgaatctccctgcagtacccagtgaattttcaattgagcccggaagtgggttacaccgtattgccggacaattggccgaagcaggtatcctttccaatgaatggtctttcatattgcttgcccatatcaccggatacaacgcatcactcaaggctggggattatcagcttaccgagaagctgtcaccgttagacctgctgaaatatctcacccggggaaaggtcaggcaatatgcgatcacctttcttgaaggatggaccttttctcaattcagaaaagctctggacgaacatcctgctctccggcatgactccgacaaactcaacgactcagaattactgcgcgcaatcggagcaaaagaatctcatgctgaaggtcttttcttcccggatacttacttctttacccgaaacagcagtgatctgaccattctgaaacgtgcctaccaggccatgcagcagcacctcgaaacagtgtggcttgcacgacaggaatttctcccgttaaaagatcagtatgatggcctgattctggcttcgatcatagaaaaagaaaccggagcagataatgagcgcacccagattgccggtgtattcatcaaccgtctgcgtcacaatatgaaactccagactgacccgactgtaatctacgggatgggtaacaaatttgatggaaacctgcgcaagatcgatcttcaaaccgaccatgaatataatacttatactcgcttcggcctgccgcccactcccattgccatgccaggcctggcttccatccgggcagcctttaatcctgcaattactgatgaactttattttgttgccagaggtgacggaacttcccacttctcatccacacttgaagagcataatcgtgccgtcctgaaatatcagaaatcatccataaagcattctgtccattaa

SEQ ID NO: 44971 - protein, 343 aa, Nitrosomonas europaea ATCC 19718
MPKSTRFLKLTSFVLIVILVGSTLFSVWFYRLATTPLNLPAVPSEFSIEPGSGLHRIAGQLAEAGILSNEWSFILLAHITGYNASLKAGDYQLTEKLSPLDLLKYLTRGKVRQYAITFLEGWTFSQFRKALDEHPALRHDSDKLNDSELLRAIGAKESHAEGLFFPDTYFFTRNSSDLTILKRAYQAMQQHLETVWLARQEFLPLKDQYDGLILASIIEKETGADNERTQIAGVFINRLRHNMKLQTDPTVIYGMGNKFDGNLRKIDLQTDHEYNTYTRFGLPPTPIAMPGLASIRAAFNPAITDELYFVARGDGTSHFSSTLEEHNRAVLKYQKSSIKHSVH

SEQ ID NO: 44972 - DNA, 903 bp, Helicobacter hepaticus ATCC 51449
  CDS (1)..(903)
atgcttttggatttttttattatcattgttataaccatattgttttatttgcttcaccctgtgcaaactgaacgcataatcaatctgcccaaaggctcactgcccaaaattatagcatacttaaatgataacgggcaacacattaataaattagacactctttttattcgtttcttaggacaaccacaaagtggatatattgatatgaaagctgaattgttacctaaaggtgcattttttaaatctcttgtaagctcaaaagctgcaactaaagaagttacactgattccaggtgaaactctgtattatttcattcgcatactctcccaaaaatttaatctttctacagaagaactccaaagcgcttatgataagtattttccttatcctgatggcgtgatttttcccgatacctatagccttcctgttggtattaaagaagatgaaataatgaagattctctatgaaatctccataaaacgacacgaacaaaatgcgataaagctactcggctcatacaatcaagaacaatggtttaaaaatgtgagtattgcttctgtggtgcaaaaagaagcagcaaataacgaagaaatgcccattgttgcagccgtagtgtttaatcgtatcaaaaaaaatatgcctctgcaaatggacggctcacttaattatgggcaatattcacattctaagattacacctgaacgtatccgtaatgacaatagcccctataatacttataaaaataaaggtgtgccaccatatcctgctggaagcgtaagcctacaagccattgaagcggtgcttaagcctgctgatgtggattatctctattttgtacgagatagagccacaggcacacataaatttagtaaaacttacgaagaacatcgtagctatttctaa

SEQ ID NO: 44973 - protein, 300 aa, Helicobacter hepaticus ATCC 51449
MLLDFFIIIVITILFYLLHPVQTERIINLPKGSLPKIIAYLNDNGQHINKLDTLFIRFLGQPQSGYIDMKAELLPKGAFFKSLVSSKAATKEVTLIPGETLYYFIRILSQKFNLSTEELQSAYDKYFPYPDGVIFPDTYSLPVGIKEDEIMKILYEISIKRHEQNAIKLLGSYNQEQWFKNVSIASVVQKEAANNEEMPIVAAVVFNRIKKNMPLQMDGSLNYGQYSHSKITPERIRNDNSPYNTYKNKGVPPYPAGSVSLQAIEAVLKPADVDYLYFVRDRATGTHKFSKTYEEHRSYF

SEQ ID NO: 44974 - DNA, 1047 bp, Wigglesworthia glossinidia endosymbiont of Glossina brevipalpis
  CDS (1)..(1047)
atgtcttattatttatattgtattagatcaaaatataaaatgaaaaaaaaaataaataaaatattatatttattaatattaatacctatttttttttttagactatttatttttgaaagagaatctttgcacataaataataatgcattaattacaataaagaaaggtagcacaatattagatttgaaaaatttaatggaagaaaaaacatttaataatcatttatacttattgccatggttaattaaattatatcctaaatataaatacataaaggcaggaacttattttttaaaaacagaatataatattaaagacgctttaaatatttttgtgttaggaaaagaaaaacaattttctattactttttttgaaggatcaacattgcaagattgtttaattatattaaaaaattctccatatatagagcaagacctaataaatgtaaatatatacaatttatcagaaaaattagggtataaatacaaatttccactagaaggaagtttatatccagatacttatttgtatgtaaaaaatactaaagctagtgaaatattaaaaagagcaaaaagaaatatggatgttattttagaaaaaatatgggacaacagagaatatgatttgccatataaaaattctcaatcattattaattatggcttcgattatcgaaaaagaaacatcaataaaaaaagaacgtgcaattgtagcttctgtctttgtaaatagattaaaaaacaaaatgaaattgcaatctgatccaactgttatgtatggtttaagaaataaaaaaacaattaatcataatgatttgactatacctactaaatacaacacatatattattaatggactgcctcctactccaatatcaatgcctggttttgaatctatttatgcagctgctcatccaaaaaaaagtaattatttttattttgtatctaatggttacggcagtcatatatttagcgaaaactttaataatcataaaaaagcaataaaacaatatataaataaaaaggtacaatttaatgataaaaagtaa

SEQ ID NO: 44975 - protein, 348 aa, Wigglesworthia glossinidia endosymbiont of Glossina brevipalpis
MSYYLYCIRSKYKMKKKINKILYLLILIPIFFFRLFIFERESLHINNNALITIKKGSTILDLKNLMEEKTFNNHLYLLPWLIKLYPKYKYIKAGTYFLKTEYNIKDALNIFVLGKEKQFSITFFEGSTLQDCLIILKNSPYIEQDLINVNIYNLSEKLGYKYKFPLEGSLYPDTYLYVKNTKASEILKRAKRNMDVILEKIWDNREYDLPYKNSQSLLIMASIIEKETSIKKERAIVASVFVNRLKNKMKLQSDPTVMYGLRNKKTINHNDLTIPTKYNTYIINGLPPTPISMPGFESIYAAAHPKKSNYFYFVSNGYGSHIFSENFNNHKKAIKQYINKKVQFNDKK

SEQ ID NO: 44976 - DNA, 1035 bp, Bordetella pertussis Tohama I
  CDS (1)..(1035)
atgagaaaacgtattcgtttctattttctgctgctcgtgctggtggcgctgctcggcgccgcgctggcggccggcggcgcctggacctggatgcacaggccggtggcgctcaagtccgaccgcatcgatttcgtggtggatccgggcagcgcgccgcgcgccatcgcgcgcaccctcaaccaggccggcgtggcggtctgggagccgggcttcgtctggatggcgcgcctgtccgagctggacaagcagatcaaggccggcggctaccaggccatcgacggcgactcgccctggcagttgctgcaacggctggcgcgcggcgacatgagccagcgccagatcactttcctggagggctggacgttccggcagatgcgccaggcgctgcgcgaacatcccgacgtcaagcagaccctgggcgagaccagcgacgaggccctgatggaaaggctgggctcgacggtgactcatcccgagggcatgttctttcccgacacctatgtgttcactccgggcagcacggatttcgacatcctgcggcgcgcctaccaggaagggcagcgcatcctggagtcgacctgggccaagcgccaggatgggctgccggtgggcacgccctacgaagcgctgatcctggcctccatcgtcgagaaggagaccggccacgggtcggagcgcgcgcgcgtggccggggtgttcgccaaccggctgcgcatcggcatgctgctgcagaccgatccgaccgtgatctacggcatgggcgaggcctaccagggccgtatccgcaagcgcgacctgcagaccgacacgccatggaacacctacacccgtccgggcctgccgcccacgcccatcgccgcgcccgggcgcgccgcgctgctggcggcggtgcagcccgaacgccacaaatacctgtttttcgtgtcgcgcggcaacggcaccagcgagttctcggtcaacctgaacgaccacaaccgcaatgtgtcgcgctacatattgggacaagggcaaccgcaacaaggatcgcagcaatga

SEQ ID NO: 44977 - protein, 344 aa, Bordetella pertussis Tohama I
MRKRIRFYFLLLVLVALLGAALAAGGAWTWMHRPVALKSDRIDFVVDPGSAPRAIARTLNQAGVAVWEPGFVWMARLSELDKQIKAGGYQAIDGDSPWQLLQRLARGDMSQRQITFLEGWTFRQMRQALREHPDVKQTLGETSDEALMERLGSTVTHPEGMFFPDTYVFTPGSTDFDILRRAYQEGQRILESTWAKRQDGLPVGTPYEALILASIVEKETGHGSERARVAGVFANRLRIGMLLQTDPTVIYGMGEAYQGRIRKRDLQTDTPWNTYTRPGLPPTPIAAPGRAALLAAVQPERHKYLFFVSRGNGTSEFSVNLNDHNRNVSRYILGQGQPQQGSQQ

SEQ ID NO: 44978 - DNA, 1047 bp, Bordetella bronchiseptica RB50
  CDS (1)..(1047)
atgcgcacacttatgagaaaacgcattcgtttctattttctgctgctcgtgctggtggcgctgctcggcgccgcgctggcggccggcggcgcctggacctggatgcacaggccggtggcgctcaagtccgaccgcatcgatttcgtggtggatccgggcagcacgccgcgcgccatcgcgcgcaccctcaaccaggccggcgtggcggtctgggagccgggcttcgtctggatggcgcgcctgtccgagctggacaagcagatcaaggccggcggctaccaggccatcgacggcgactcgccctggcagttgctgcaacggctggcgcgcggcgacatgagccagcgccagatcactttcctggagggctggacgttccggcagatgcgccaggcgctgcgcgaacatcccgacgtcaagcagaccctgggcgagaccagcgacgaggccctgatggaaaggctgggctcgacggtgacccatcccgagggcatgttctttcccgacacctatgtgttcactccgggcagcacggatttcgacatcctgcggcgcgcctaccaggaagggcagcgcatcctggagtcgacctgggccaagcgccaggatgggctgccggtgggcacgccctacgaagcgctgatcctggcttccatcgtcgagaaggagaccggccacgggccggagcgcgcgcgcgtggccggggtgttcgccaaccggctgcgcatcggcatgctgctgcagaccgacccgaccgtgatctacggcatgggcgaggcctaccagggccgtatccgcaagcgcgacctgcagaccgacacgccatggaacacctacacccgtccgggcctgccgcccacgcccatcgccgcgcccgggcgcgccgcgctgctggcggcggtgcagcccgaacgccacaaatacctgttcttcgtgtcgcgcggcaacggcaccagcgagttctcggtcaacctgaacgaccacaaccgcaatgtgtcgcgctacatattgggacaagggcaaccgcaacaaggatcgcagcaatga

SEQ ID NO: 44979 - protein, 348 aa, Bordetella bronchiseptica RB50
MRTLMRKRIRFYFLLLVLVALLGAALAAGGAWTWMHRPVALKSDRIDFVVDPGSTPRAIARTLNQAGVAVWEPGFVWMARLSELDKQIKAGGYQAIDGDSPWQLLQRLARGDMSQRQITFLEGWTFRQMRQALREHPDVKQTLGETSDEALMERLGSTVTHPEGMFFPDTYVFTPGSTDFDILRRAYQEGQRILESTWAKRQDGLPVGTPYEALILASIVEKETGHGPERARVAGVFANRLRIGMLLQTDPTVIYGMGEAYQGRIRKRDLQTDTPWNTYTRPGLPPTPIAAPGRAALLAAVQPERHKYLFFVSRGNGTSEFSVNLNDHNRNVSRYILGQGQPQQGSQQ

SEQ ID NO: 44980 - DNA, 993 bp, Chromobacterium violaceum ATCC 12472
  CDS (1)..(993)
atgaagaaaatttcccgcgttctgttgctgctgctgttgtgcgcggccggctggctgggctgggcgctgctgctgcccgtcgacatgcccgcaggcggctacaagctgctggtcggccccaaccgcacgatgaagcagatcgcgcatgcgctggcgaaggacggcgcgatacgcaatggccagctgatgatcgcgctggcgcggatttccggttccgatcgcaaggtcaaggccggcctgtaccggctggagggcgggcagtcgatgctggacgtgctggaccggctggtgcagggccatccggacgaggccagcctgaccgcgatagaaggctggactttccgccagctgcgccaggcggtggaccgcaatccggatatcaagcacgacgcgctgaagatgagcaatgccgagctgatgcatcagctggacctgcccgacatcaatcccgagggcttgttctttcccagcacctatctgttcacgccgggctcttccgatatcgatctgtaccggcaggccttttcgacgatggcgcagcagctggacgccgcctgggcggcgcgcaagccgggcctgccttacgccacgccgtacgagttgttgaccatggccagcctgatcgagaaggaaacctccagcgaggccgaccggccgatggtggcggcggtgttcgtcaaccggctgaagaagggcatgcggctgcagaccgatccctcggtgatctacggcatgggcagcagctaccagggcaatatcgccaaggccgacttgcgccgcgatacgccgtacaatacctatacccgcgccggcctgacgccgacgccgatctcgctgccgggcaaggccgcgctgtacgcggcggcccagccggccgaaaccgacgcgctgtatttcgtcgcccgcggcgacggcagctcccagttttccagcaccctggacgagcataaccaggcggtgcgcaaatacatcctgaagaaaggccagcaatga

SEQ ID NO: 44981 - protein, 330 aa, Chromobacterium violaceum ATCC 12472
MKKISRVLLLLLLCAAGWLGWALLLPVDMPAGGYKLLVGPNRTMKQIAHALAKDGAIRNGQLMIALARISGSDRKVKAGLYRLEGGQSMLDVLDRLVQGHPDEASLTAIEGWTFRQLRQAVDRNPDIKHDALKMSNAELMHQLDLPDINPEGLFFPSTYLFTPGSSDIDLYRQAFSTMAQQLDAAWAARKPGLPYATPYELLTMASLIEKETSSEADRPMVAAVFVNRLKKGMRLQTDPSVIYGMGSSYQGNIAKADLRRDTPYNTYTRAGLTPTPISLPGKAALYAAAQPAETDALYFVARGDGSSQFSSTLDEHNQAVRKYILKKGQQ

SEQ ID NO: 44982 - DNA, 1095 bp, Porphyromonas gingivalis W83
  CDS (1)..(1095)
atggttcagaaaaaacgcaagaaaacgacctacagcagatccgcctcccacagaaaaaagaggaatcgcacacgcagaagagctgtgatcctttggatcacggcactactccttataccgatggctcttgtttcgctgggagcttacctgctactgtctcctgccggcaatgcccgggaaaatacctatatatatatccgaccgactacgacactgaccgatgtagagcgacagctccagcagaatacccgactgcggaggccttcgtttttccatctggcagcgcgatattataaattagaggaaaagctccgcccgggtcgctatggaatagctccacgaatgaataccaagcagatactggagactttggcacacggaaaacagtcggctgtacgcttccacctccgccacgtccgcacacaggaggatctgatcggaaggatgacgggcaaactgatgatgaagccggaagagctttcttccctgttggccgactccgctttctgcgattcgctgggattcgatccacactccatccgcagcctttttctgcccgaaacatacgaagtggattgggacattaggccaaaggacttggttctgaggctgaagagatactacgaccgctattggacagcagagcgacggagtctggccgactcattggggctgacgccgatccaagtatccattatcgcatccatcgtggaggaggagtcgggaaaatccgatgaatacccgcagatagccggtctctatatccgtcgcttgcgtgaggggatgctcttgcaggccgatccgacggtgaagtttgcgatgggagacttttccatccgtaggatcctgaatgtccatttgcagacggattccccgtacaacacttataaaaacgaaggactgcctccgggcccgatccggctaccgcataccgcgaccatggacagcgtgctccgagcggatcggcatggctacctgtatatgtgtgccaaggaggacttctccggccgtcaccgttttgcccacacctatgccgaacaccaacgcaatgcggctctctatcgcaaagcactcaatgaaagggggatcaaatga

SEQ ID NO: 44983 - protein, 364 aa, Porphyromonas gingivalis W83
MVQKKRKKTTYSRSASHRKKRNRTRRRAVILWITALLLIPMALVSLGAYLLLSPAGNARENTYIYIRPTTTLTDVERQLQQNTRLRRPSFFHLAARYYKLEEKLRPGRYGIAPRMNTKQILETLAHGKQSAVRFHLRHVRTQEDLIGRMTGKLMMKPEELSSLLADSAFCDSLGFDPHSIRSLFLPETYEVDWDIRPKDLVLRLKRYYDRYWTAERRSLADSLGLTPIQVSIIASIVEEESGKSDEYPQIAGLYIRRLREGMLLQADPTVKFAMGDFSIRRILNVHLQTDSPYNTYKNEGLPPGPIRLPHTATMDSVLRADRHGYLYMCAKEDFSGRHRFAHTYAEHQRNAALYRKALNERGIK

SEQ ID NO: 44984 - DNA, 1038 bp, Gloeobacter violaceus PCC 7421
  CDS (1)..(1038)
atgagaggccggggcacctggtggcgggtactgccggtgctggtggtcttggcgctcggggccggtgggttgtgggtaaattcgccgccgcccaccgccaaagccgtgcgcgtcgtgctgcccaccggcagcggcagtctgcgcatcggccagaatctggccgatgccggggcgatccgctccgcctgggcctggctggcactggtctgggtgcgcggctggcaaaacgacctcaaagccggcacctacgaaattcccccgggccgctcgcttatcgcggtggccgatcaggtgcgccgcggcgagacgctgcgctttcgctatcggatcatcgaaggctggaacctggctcagatggccagctacttcgagcagttgggttactttcgcacccgggagtttctcgcactcaccagcgggcctggcatgatccgccccgcctggctgcccgagggtctcgaccgcctcgaaggtttcttgtttccgagtacctacgagcttcccgccgagaccctcggggcgcgcgccgccgtgaaccagatgctttcgaccttcgagaagaccgccctgccgctgtggcgcgcccgggtcaaaccggcccggtcgctcaaggactgggtggcgcttgcgagcttgatcgaaaaagaagcggccgtcggtgaggagcgcgccacgatcgccggggtcttcgccaaccgcctacgcctcggcatgcccctcgcctccgacccaaccgtcgagtacgccttcggcatccgtcagaccgccgatacccccctcacctacgcccaggtgcttaagccctcgccctacaacacctatatcaaccccggtctgcccccgacgcccatcgcctcgccggggctcgcgagcctcgaagccgccctggcaccggcgctcacgccgtatctgtatttcgtcgcccgctacgacggcacccacgtcttcagccgcaccgaggccgagcacgagcaggccaagcgccaaatccgcgccgagcggcgggcgggggccggagccgccccccaggcccgctag

SEQ ID NO: 44985 - protein, 345 aa, Gloeobacter violaceus PCC 7421
MRGRGTWWRVLPVLVVLALGAGGLWVNSPPPTAKAVRVVLPTGSGSLRIGQNLADAGAIRSAWAWLALVWVRGWQNDLKAGTYEIPPGRSLIAVADQVRRGETLRFRYRIIEGWNLAQMASYFEQLGYFRTREFLALTSGPGMIRPAWLPEGLDRLEGFLFPSTYELPAETLGARAAVNQMLSTFEKTALPLWRARVKPARSLKDWVALASLIEKEAAVGEERATIAGVFANRLRLGMPLASDPTVEYAFGIRQTADTPLTYAQVLKPSPYNTYINPGLPPTPIASPGLASLEAALAPALTPYLYFVARYDGTHVFSRTEAEHEQAKRQIRAERRAGAGAAPQAR

SEQ ID NO: 44986 - DNA, 1017 bp, Photorhabdus luminescens subsp. laumondii TTO1
  CDS (1)..(1017)
atgaaatggaaaaaacgcctttttgccctattggctttgattgtcattacggcagcaatattactctatgctggctatgaaaaagttgaaaaatttgcggatcaaacattaacaattaaacagaatcgaatatttaccctgccaacaggtattggtcgtcatggtttggaagcgttactggttcgggataacctgattgaagatagtcatattttcccttggttattaagattggagccaaaacttgccgagttcaaagcgggaacttaccaattaacacgagaaatgactttacgggaaatgttgcaattattctctagtggtaaagaagcgcaatttacggtccgttttgttgaaggtagccgtttatctgattggtggagaatactacagcaatctgaatatcttaaacatgaattggataataaagatgctcaggaattggctgaaatactcgatattaaagatacagatactctggaagggtggctttatcctgatacctatcactatacggcaggcacaagcgatgtagcattgctgaaacgagcatatcgacagatgaaaatgacgctggaagaggaatgggaaggtcgcgacaaaaatctgccctataagaatgcttatgaaatgttgattatggcgtcgattattgaaaaagaaactggtgttgaggctgagcggacaaaagttgcttctgtatttattaatcgtttacggttgaatatgcgacttcaaactgatccgacagtgatttatggtttaggtgaaaaatatacaggcactatttttcgtaaagatttaacaacattgacgccctacaatacttatatgattaatggtctgccacctacaccgattgcaatgcctggccttgcttctataaaagcggctgcacacccggcaaaaaccgaatttctctattttgtggcgaatggcaaaggtggtcatacttttacgaccaatctggctgcgcataacaaggcggtaaatatttaccgtcagaggttaaaatag

SEQ ID NO: 44987 - protein, 338 aa, Photorhabdus luminescens subsp. laumondii TTO1
MKWKKRLFALLALIVITAAILLYAGYEKVEKFADQTLTIKQNRIFTLPTGIGRHGLEALLVRDNLIEDSHIFPWLLRLEPKLAEFKAGTYQLTREMTLREMLQLFSSGKEAQFTVRFVEGSRLSDWWRILQQSEYLKHELDNKDAQELAEILDIKDTDTLEGWLYPDTYHYTAGTSDVALLKRAYRQMKMTLEEEWEGRDKNLPYKNAYEMLIMASIIEKETGVEAERTKVASVFINRLRLNMRLQTDPTVIYGLGEKYTGTIFRKDLTTLTPYNTYMINGLPPTPIAMPGLASIKAAAHPAKTEFLYFVANGKGGHTFTTNLAAHNKAVNIYRQRLK

SEQ ID NO: 44988 - DNA, 1017 bp, Vibrio vulnificus YJ016
  CDS (1)..(1017)
gtgataaaaaaaataatagggctgctctttattgccgcgttgatgataggcgttgctactttttgggcatattcgcaaaccaaaacctacgttaaccaaccgctcaaactcgagggcagtgagatcatcaccattccttcaggaagtggttttggccgcacattggccattctgacagagaaaggctggattgaggaacccacacatctggcgcgcttaattcccaaactctacccagaaattactcgaataaaagcaggtacctaccaaatccaatcagagatgtcgctttatcaagctttggaagtgttcaatcttggcaaagaacatcaatttaccatcacatttgtcgagggaagtcgtttccaagagtggatggtgcagatggcacaagacccttatttggttcatgaattggcaggtttgagcgaagcagaaattgccaagcgactggagataccctatgaaaagcttgaaggcctttttcttgcggaaacctatcactatacctacggcacttctgatgttgagttactcaaacgcgcacatgagaagttaaatcgagtgctggataaacattggcagcagcgtcaagataagttgccgctaaaaaacagttatgaagcgctaattctagcttccattattgagaaagaaaccgctattgatgaagaacgagagcgagttgcgtctgtatttgtgaaccgcttaaataagcgaatgcgcttgcaaacggaccctacggtgatctatggcatgggggaggcctacgatggcaacattcgcaagaaagatctacgcacgccaacgccatacaatacttacgtgattaacggattgccaccgacgccgattgcgatggcgggagaagcctctatcgctgccgcattaaatccagagaacagcagctatctttactttgtcgctagcggtaagggtgggcatgtgttctcaaaaacattagctgaacataatagagcagtaagagcatatctgcgggaattgaagaaaagatga

SEQ ID NO: 44989 - protein, 338 aa, Vibrio vulnificus YJ016
MIKKIIGLLFIAALMIGVATFWAYSQTKTYVNQPLKLEGSEIITIPSGSGFGRTLAILTEKGWIEEPTHLARLIPKLYPEITRIKAGTYQIQSEMSLYQALEVFNLGKEHQFTITFVEGSRFQEWMVQMAQDPYLVHELAGLSEAEIAKRLEIPYEKLEGLFLAETYHYTYGTSDVELLKRAHEKLNRVLDKHWQQRQDKLPLKNSYEALILASIIEKETAIDEERERVASVFVNRLNKRMRLQTDPTVIYGMGEAYDGNIRKKDLRTPTPYNTYVINGLPPTPIAMAGEASIAAALNPENSSYLYFVASGKGGHVFSKTLAEHNRAVRAYLRELKKR

SEQ ID NO: 44990 - DNA, 1149 bp, Corynebacterium diphtheriae NCTC 13129
  CDS (1)..(1149)
atgcgaatggaaagtaaatacgtcaaacggcgtcaacgtggtttggccgtgttggttgctgccttagtcttgattattggttcggtaatttacatcggcgtccattttgtcaacggagggtctgattacaagggtgcgggcaacggagagatggcgcttgtggagatcaaagaagggtcgtctctttccgaactagggcctgaacttgccgagcgtgggatcgtcgcaagtaacgatgctttccaaggcgctgcattttctaatccgggggccagccaagttaagccaggtttttatcgcctagaaaagaaaatgagtgctgcagaagcagtcaaagcactgctcgatccttcgcgtaagatcgatatgctcgaaatccatggtggctccacattgatagacgtcacagtggttaagggacaaacgcgtaaaggaatctactcaatgatttcagacgtgacgtgttctcaaggctcgaccaaatgcattagttctgaggaactgcagcaggtaggtgcaacagcatcgttggaagaacttggagttccagattgggctcgggatgcagttgctgcgcgtgcaaatgatcctaaacgtttggaaggtttgattgttccagggtcatatatcgttaatccagaaaaagatgcccttggcattttgcaggatctgattaagcgtggtgccgaaacattcgaaaagacctcacttgcgcagcgcgcacagactgttgggctgagtccttatgagttgctcaccgcggcttcgcttgtagaacgcgaagcgccagcaggagactttgacaaagttgcgcgggtcattcttaatcgtttggcgaagccaatgcgtcttgagtttgactcaactgtgaactatggcttggcagaacaagaagtcgctacgaccaacgaggaccgcgctcgcgtgactgcatggaatacttatgctaaagatgggttgccagatactccgattgctagtgcctccgttcaagctattgaagcacttgaaaatcctgccgagggggactggctgtacttcgtaacgattgataaaaacggaaccactgtgttcaccaataattttgaggatcaccaaaatgctacccgcgattcgattgaaaatggcgtgttagatagcaatcgataa

SEQ ID NO: 44991 - protein, 382 aa, Corynebacterium diphtheriae NCTC 13129
MRMESKYVKRRQRGLAVLVAALVLIIGSVIYIGVHFVNGGSDYKGAGNGEMALVEIKEGSSLSELGPELAERGIVASNDAFQGAAFSNPGASQVKPGFYRLEKKMSAAEAVKALLDPSRKIDMLEIHGGSTLIDVTVVKGQTRKGIYSMISDVTCSQGSTKCISSEELQQVGATASLEELGVPDWARDAVAARANDPKRLEGLIVPGSYIVNPEKDALGILQDLIKRGAETFEKTSLAQRAQTVGLSPYELLTAASLVEREAPAGDFDKVARVILNRLAKPMRLEFDSTVNYGLAEQEVATTNEDRARVTAWNTYAKDGLPDTPIASASVQAIEALENPAEGDWLYFVTIDKNGTTVFTNNFEDHQNATRDSIENGVLDSNR

SEQ ID NO: 44992 - DNA, 1257 bp, Rhodopseudomonas palustris CGA009
  CDS (1)..(1257)
atgagtgaaaggccgccgatttcgccgagaagcccgcgtgcggcgctcgagccggagcagcttccgccgccgccgaagcggtccgatcacgcccgcaatccgctggtcatcatcggcaatgcgatcatcactttcattgtggttgtgatgatcggcgccggcggcttgtacgtgtacggcaagaacaagctcgaagcgccgggaccgctcgcgcaggacaagacggtcaatattccgcagcgtgctggcctcgacgacatcgcgcagatcctgaagcgcgaaggcgtcatcgaagacggttggctggtgttcgcaggcggcgtgatggcactacgcgcccgcaccgagctcaagcctggcgagtatctgtttcagaagaacgccagcctgcgcgacgtgatcggaaccatcgtcgaaggcaaggtggtgcagcacgcggtgacgattcccgagggactgacttcggaacagatcgtcgagcgcctgtccgacaatccgatcttcaccggaagcatccgtgaaattccgcgcgaaggaacgttgctgccggagacctacaagtttccgcgcgggacgccgcgcgagcaggtgatccaccgcttgcagcaggcgcagaagcgggtgctcagcgagatctgggagcgtcgcagccccgacctgccgatcaagactccggagcaactggtgacgctggcttcgctggttgagaaagagaccggcaagccggacgagcgcacgcgcgtcgccgcggtgttcgtcaatcggctgcagaagaagatgcggctgcagtccgatccgacgatcatctatggcctcgtcggcggcaagggtacgctcggccgtccgatcaagcgaagcgagatcacgcagccgtccccgtacaacacctatgtgatcgacggattgccgcccgggccgatcgccaatccggggcgcgcgtcgcttgaggctgcggccaatccggcgcgcacccgcgatctgtacttcgtcgccgacggcagcggtgggcacgccttcagcgacaattacgaggtgcaccagaagaacgtcggcaagctgcgggcgcaggaaaagcagctccagaacgacaccgtcgagccgccggaggaaacgccgccgaccgcggccgctccggctgccgagcccgccggcgatcctgcggcagccgcgccggccggggcgccgaaggccgccggcaagaacggtgcgcagaagcgccgcgctcgcaatgccacgccgaacggtgcgaccgagtaa

SEQ ID NO: 44993 - protein, 418 aa, Rhodopseudomonas palustris CGA009
MSERPPISPRSPRAALEPEQLPPPPKRSDHARNPLVIIGNAIITFIVVVMIGAGGLYVYGKNKLEAPGPLAQDKTVNIPQRAGLDDIAQILKREGVIEDGWLVFAGGVMALRARTELKPGEYLFQKNASLRDVIGTIVEGKVVQHAVTIPEGLTSEQIVERLSDNPIFTGSIREIPREGTLLPETYKFPRGTPREQVIHRLQQAQKRVLSEIWERRSPDLPIKTPEQLVTLASLVEKETGKPDERTRVAAVFVNRLQKKMRLQSDPTIIYGLVGGKGTLGRPIKRSEITQPSPYNTYVIDGLPPGPIANPGRASLEAAANPARTRDLYFVADGSGGHAFSDNYEVHQKNVGKLRAQEKQLQNDTVEPPEETPPTAAAPAAEPAGDPAAAAPAGAPKAAGKNGAQKRRARNATPNGATE

SEQ ID NO: 44994 - DNA, 1023 bp, Geobacter sulfurreducens PCA
  CDS (1)..(1023)
atgaaagtatccgtcaacctccgcgacagacgcctccttgtggtggcggccctgatcatcgccagtatccttgccccgttggtccgttatgggctcttcctcgccgtgccagccggcaacgggaaaaacgtccggattctctccttcgaaaagggggccacccctcggcgtattgccggtgagcttgaggcggccgggctgatcaccagtgcccggctgtttgtattccatgcccgtctgcatggagaggccgaacggctcaaggccggcgaataccaattctccgatgccatgaagcccgcagaaattctccacaagctggtggccggcgaggtctatgctcaacctttcgccgttcccgaaggatattccatgtaccaggtcgcggaattgctggaaggtaaaggaatgttctcgcgggaacgcttcctggctgccgctactgatccgtcgtttctggccgaactcggcatccagagcagcagtgtcgagggctacctctacccgagcacctatgccgtttcccgatccatggacgaaaaggatctgattcgggtcatggtatcccagttcgacaagatctatgcggccggattcgcagaggaggcgcgtcgccgggggatatcgcggcatcgagtggtgacccttgcctcaatgattgaaaaggaggctgtttctccggcggaacgccctctgatctcctcggttttccacaatcgcttggccaagggcatgcgcctccagagcgaccccactgcggtctatggtgtgcgagcctttggcgggaacgtgacccgtcaagatatcctgcggaatacctcgcacaatacctaccgcatcgccggacttccgccgggccccatcggtaatccgggacgcgacgctctggctgccgccctcaatccggccgccacccgctatctctatttcgtggcccgtaaggacggtacgcaccatttttcagccacgctggtggaacataacgcagcagtccaacgatacttgaaagatcccaccaaatga

SEQ ID NO: 44995 - protein, 340 aa, Geobacter sulfurreducens PCA
MKVSVNLRDRRLLVVAALIIASILAPLVRYGLFLAVPAGNGKNVRILSFEKGATPRRIAGELEAAGLITSARLFVFHARLHGEAERLKAGEYQFSDAMKPAEILHKLVAGEVYAQPFAVPEGYSMYQVAELLEGKGMFSRERFLAAATDPSFLAELGIQSSSVEGYLYPSTYAVSRSMDEKDLIRVMVSQFDKIYAAGFAEEARRRGISRHRVVTLASMIEKEAVSPAERPLISSVFHNRLAKGMRLQSDPTAVYGVRAFGGNVTRQDILRNTSHNTYRIAGLPPGPIGNPGRDALAAALNPAATRYLYFVARKDGTHHFSATLVEHNAAVQRYLKDPTK

SEQ ID NO: 44996 - DNA, 1248 bp, Mycobacterium avium subsp. paratuberculosis str. k10
  CDS (1)..(1248)
atggttgacagcgcccgccgcgagcgcgccgagcccgaggcggtggggccgccgcggcgcagatccagccggatggcccggaacagggccgagcggggccggcgccggcggcgcttcgccctgcgcgccgccctggcgctgctggtcgtggtggtgctggccggggtgttcgccggcggcaagctgtggcacaccgtgttcgggccgggcgacgactacagcggcagcggcaagcgcgacctggtgatccagatccaggccggcgactccaccaccatggtcggcgagacgctgcacaaccagcacgtggtcaagacggtgcgggcgttcgtcaacgccgcgcacggcaacagcaagatcgactccatccagcccggcttctaccggatgcgcaccgagatcccggcctccgacgccgtcgcccggctggccgaccccaacagccgggtgggccggctggtcatcccggagggccgtcagctcgacgacaccaccgacatgaagaccaacaaggtcaaccccggcatcttcaccctgatctcccaggccacctgcgtggacctggacggcaaccggcgctgcgtgccggtgcagcagctgcgcgcggccgcgaccaacagcaccaccgcggcgctgtcggtgccgccgtgggcgctggaaccggtcaacgagctgggcagggaccatcgccggatcgaggggctgatcgcgccgggcaccttcaacgtcgacccgtcggcgtccccggagagcatcctggccgggctgatcagcgccggggccgaggagtacctgaagtccgggctggtggacaccgcccaggcgatgggcctgtcgccctacgacatcctggtggtggcgtcgctggtgcagcaggaatccaacaccccggacttcgccaaggtcgcgcaggtgatctacaaccggctgcacgcccaccacacgctggaattcgactcgacggtcaactacccgctggaccgccgcgaggtggccaccagcgacgccgaccggggccagaagacgccgtggaacacctacgtgtcgcagggcctgccggccaccgcgatctgttcgcccggcatcgacgcgctgcacgccgccgagcaccccgcgccgggggactggctctacttcgtcaccatcgacgccgccgggacgacgctgttcaccaaggactatcagcagcacctggccaacatcgagctggctaagcacaacggtgtcctcgacagcaccccccgctag

SEQ ID NO: 44997 - protein, 415 aa, Mycobacterium avium subsp. paratuberculosis str. k10
MVDSARRERAEPEAVGPPRRRSSRMARNRAERGRRRRRFALRAALALLVVVVLAGVFAGGKLWHTVFGPGDDYSGSGKRDLVIQIQAGDSTTMVGETLHNQHVVKTVRAFVNAAHGNSKIDSIQPGFYRMRTEIPASDAVARLADPNSRVGRLVIPEGRQLDDTTDMKTNKVNPGIFTLISQATCVDLDGNRRCVPVQQLRAAATNSTTAALSVPPWALEPVNELGRDHRRIEGLIAPGTFNVDPSASPESILAGLISAGAEEYLKSGLVDTAQAMGLSPYDILVVASLVQQESNTPDFAKVAQVIYNRLHAHHTLEFDSTVNYPLDRREVATSDADRGQKTPWNTYVSQGLPATAICSPGIDALHAAEHPAPGDWLYFVTIDAAGTTLFTKDYQQHLANIELAKHNGVLDSTPR

SEQ ID NO: 44998 - DNA, 1095 bp, Lactobacillus johnsonii NCC 533
  CDS (1)..(1095)
ttgctaaatcaagacaaaaagaaaaatcatgagttagaggaacaggcatctaaaaaggttactcgttggatccttagtggactaggagcgattttagttttagttgtcttgattggaggctgttacgtaggatacgcacttcaaccagtcaatcgacatgatgaagatgttgttagtgttcatattcctgcgggagcaactaatagtcaaattgctcaaattttacaagagaaaaagattattagaaatgcggccgttttcaacttttggttaaagagtcatagtgcgacaaattttcaagcagggaatttttatttatcaccttcaatgcataacaaagagattgtgagccaattgcaaggtggaggtggtcgtccagttgttggtcatgttctaataaaagaagcacaaacaattgatagtattgctactacagttagcaagaataccaagtatagtcgacaagatttcttaaagctaatgaaagataagagctttatgaagagtttggagaagcaatatcctaaacttttaactagttctatgaacagtaagggtgttcgctatcatttagaaggatatctcttcccagcaaaatatgatgtttatcaaggagcttctttaaaagaattagttaatcaaatggttgataagactgatcaagttttgcaaccatactacagttcaattaagaagaagcacttaacagtacaggaagttttaactttagcttcattagtagaacgtgaaggtgttaaaactaaagataggcgtatgattgctggagtattctttaacagacttaaagctaatatgccacttcagtcagatatttcagtaatgtatgcattgaataagcataaacattctttatcactaaaggatattaaagtaaaatcaccatataacttatatgttcataaaggatatggacctggaccatttaacaatccaagtctagattcaattagtgctgtattgaacccaattaagtctaactatctctactttgttgcaaaccttaagactggtaaggtttactacaacgaaaactatgacgaacatttgaaacgaaatagtagtttaggccagtaa

SEQ ID NO: 44999 - protein, 364 aa, Lactobacillus johnsonii NCC 533
MLNQDKKKNHELEEQASKKVTRWILSGLGAILVLVVLIGGCYVGYALQPVNRHDEDVVSVHIPAGATNSQIAQILQEKKIIRNAAVFNFWLKSHSATNFQAGNFYLSPSMHNKEIVSQLQGGGGRPVVGHVLIKEAQTIDSIATTVSKNTKYSRQDFLKLMKDKSFMKSLEKQYPKLLTSSMNSKGVRYHLEGYLFPAKYDVYQGASLKELVNQMVDKTDQVLQPYYSSIKKKHLTVQEVLTLASLVEREGVKTKDRRMIAGVFFNRLKANMPLQSDISVMYALNKHKHSLSLKDIKVKSPYNLYVHKGYGPGPFNNPSLDSISAVLNPIKSNYLYFVANLKTGKVYYNENYDEHLKRNSSLGQ

SEQ ID NO: 45000 - DNA, 1083 bp, Bdellovibrio bacteriovorus HD100
  CDS (1)..(1083)
atgaagaaaacgattttggttctgattcttgcggtggtgatccttttggcctctgtcggtggcggcgtggcctatctggcgtatcagtttaccaactcccgccccagcgatgtggctcaggatgtggtttacgaagtcactccaggaaaaggttttgccacgattgccaaagagcttgaagaaaagggtctggtgaaaaacgccacgttctttaatctttttgcccgctttaaaggggatcgttccaaaatcaaagtcggtgaataccttcttcgcaccaatatgatcccgactgaagttcttgaggccatcacttcaggtaaaagtattgcccgaagttttacggtcagcgaaggtcttagcacctacgaaattgccgaactttatgaaaagcagggcttcggcacagccgaaagctttatggctttggtgcgggatccagcgctgattcaaagtctgctgggcgaaaaagccgacagtctggaaggttatctgtttccggaaacctacatgttgaccaagtacacggacaccaaaacgctgatctcaaacatggtgaagcgttttttgtacgtttacaacgaagtgatggcacaggctgaaatcagatccatgacccgcaatcaagtggtgacgttggcaagtatcatcgaaaaagaaaccggcgctccagaggaaagaccgctgatttcttcggtcttccacaatcgcctggcgaagaaaatgcgcctgcaaaccgatccaacggtgatttacggaaaagccgaagccctgggtaagatcgtgatcaatatcacgcgcgcggatttgcaaacacccactcgttacaacacctatgtgatttacggattgcctccgggcccgattgcgaacccaggtcgtgaagcgatcttggcggccgtgaagcctcaagagtcccagtatttgttctttgtcagccagaatgacgggacccatgtgttttctgaagactacaagggccatcagcgtgcggttcaaaaattccagttggatcgtaaagcgcgtgaaggaaaatcctggagagacctgcaaaaacgcccgtccactccggataaaaactag

SEQ ID NO: 45001 - protein, 360 aa, Bdellovibrio bacteriovorus HD100
MKKTILVLILAVVILLASVGGGVAYLAYQFTNSRPSDVAQDVVYEVTPGKGFATIAKELEEKGLVKNATFFNLFARFKGDRSKIKVGEYLLRTNMIPTEVLEAITSGKSIARSFTVSEGLSTYEIAELYEKQGFGTAESFMALVRDPALIQSLLGEKADSLEGYLFPETYMLTKYTDTKTLISNMVKRFLYVYNEVMAQAEIRSMTRNQVVTLASIIEKETGAPEERPLISSVFHNRLAKKMRLQTDPTVIYGKAEALGKIVINITRADLQTPTRYNTYVIYGLPPGPIANPGREAILAAVKPQESQYLFFVSQNDGTHVFSEDYKGHQRAVQKFQLDRKAREGKSWRDLQKRPSTPDKN

SEQ ID NO: 45002 - DNA, 1023 bp, Treponema denticola ATCC 35405
  CDS (1)..(1023)
atgaaaaaaaaatcaaagattgtcataataatattgtgtatagccggccttcttgccggtacaatattttttgttttgtcgcttaataatccccctttagaattttcagaaccgcttgtaacatttaaaataccgcgcggtactgccgcaaaaacggttattggtgagttaaaagctaaaaatcttatacgctcggagctttatgcctatgcctatcttaggcttaaaaaacttaatttaaaggccggcacatatcaaataaggcccgaaatgaccacccatgatattttacataagctgacccaaggctctcaagcccttaaaaagcttacaatacctgagggcttaactctaaaaaagacggctcaagttttcgaaactgtaggtcttataaaagctgaagactttattgcaataacttccgattccgattttttagaaaaaaacgaaattaaggcaaaaacagccgagggctttttatatccggatacctattttttcggagaagaagatacgcctgagatgatggtaaaaatgattataaaaactttttttgaaaaaacttcatccattccgaattttcctaaagattttaacgaaatttataaaaaggtgattttggccagcattattgaaagagagtatcagcttcctgaagaagctcctataatttcaagcgtttttactaaccgccttaaaataaatatgggacttcaatcatgtgcaaccgttgaatacataatcaccgaaatcaaaaataaaaagcatcctactcggcttttttatgaagacttggaaattcaaagtccttacaatacctacatccatgaaggccttccgccggggcctatttcgaaccccggatttacggccttaaatgctgcctgtaatcccgcaaatacggattatttttatttcagactgatcgatccggataccggaaagcatgtatttacaaaaaccataactgagcataataaggccggagaaggtcttttattaaaaaaagccgccggtcaataa

SEQ ID NO: 45003 - protein, 340 aa, Treponema denticola ATCC 35405
MKKKSKIVIIILCIAGLLAGTIFFVLSLNNPPLEFSEPLVTFKIPRGTAAKTVIGELKAKNLIRSELYAYAYLRLKKLNLKAGTYQIRPEMTTHDILHKLTQGSQALKKLTIPEGLTLKKTAQVFETVGLIKAEDFIAITSDSDFLEKNEIKAKTAEGFLYPDTYFFGEEDTPEMMVKMIIKTFFEKTSSIPNFPKDFNEIYKKVILASIIEREYQLPEEAPIISSVFTNRLKINMGLQSCATVEYIITEIKNKKHPTRLFYEDLEIQSPYNTYIHEGLPPGPISNPGFTALNAACNPANTDYFYFRLIDPDTGKHVFTKTITEHNKAGEGLLLKKAAGQ

SEQ ID NO: 45004 - DNA, 1041 bp, Leptospira interrogans serovar Copenhageni str. Fiocruz L1-130
  CDS (1)..(1041)
ttgtcgaaggatataaatggatttatgaatattaaaaagtttttgattttctccggatttgttattggagttctgtttttaattgcgaccgttactttttttatcgtggacgaactcaaaggaggtgcggtcgggtctggtcagaataaaatagaacttcttatcgaatccggggatacttccgggaaaattgtagaaacgttatccacacatggaatgatcaagtcttccaaatattttctttatttagtacggtttactcgtagcgctggtaagatcaaacaagggctttatgagattaacgatggaatggattctagaaaaattctacaagtgattacggaaggaaaagttaaactcgtaaactttacgattccagaaggttataacaatagacagatcggagatttactcgtttctaaaaaaatcatttccaaacgtcaggatttcttactggctgccagtgaaccacaattattgagagagtttaaaattccatctacttctgcagagggttatctttttccggagacgtacagcgttccgatcaattatccagttgataaaatcgttcgaatgatgattaaaagattttacgttcgaattacaaagatagaaaaatctaaaaatctttctcctttagaacttcataaatttataattcttgcttctgtagtagaacgagaggcgaaacgaaacgaggaaagacctcttatggcgggagtatttaacaatcgtctaaaaagggatatgcctttggaatcttgcgcaacaattcaatatctttttgataaacctcatagcaggatttttgaaaaggatctcaagatcgtatctccgtataacacatatcttaataaaggatttcctcccggaccgatttctaatcctggttttccggcgttggaagcggctttttatcctaaggaaaccgattatctgttttttcttttaaaaggggacggttatcactatttcgcaaaatctctgaaagaacacttagaagccaagaaaaagtacatagacgtactttacgattga

SEQ ID NO: 45005 - protein, 346 aa, Leptospira interrogans serovar Copenhageni str. Fiocruz L1-130
MSKDINGFMNIKKFLIFSGFVIGVLFLIATVTFFIVDELKGGAVGSGQNKIELLIESGDTSGKIVETLSTHGMIKSSKYFLYLVRFTRSAGKIKQGLYEINDGMDSRKILQVITEGKVKLVNFTIPEGYNNRQIGDLLVSKKIISKRQDFLLAASEPQLLREFKIPSTSAEGYLFPETYSVPINYPVDKIVRMMIKRFYVRITKIEKSKNLSPLELHKFIILASVVEREAKRNEERPLMAGVFNNRLKRDMPLESCATIQYLFDKPHSRIFEKDLKIVSPYNTYLNKGFPPGPISNPGFPALEAAFYPKETDYLFFLLKGDGYHYFAKSLKEHLEAKKKYIDVLYD

SEQ ID NO: 45006 - DNA, 1323 bp, Desulfovibrio vulgaris subsp. vulgaris str. Hildenborough
  CDS (1)..(1323)
atgacggctgacggaaagctggacgacgcgcaaacggacgcgcacgagtccccatcccctgatgataccgtcatcgacggaggaacgtcgcctctgccatccgaagccagcgaggcgccctccggtgacgccgcgcctgtcgaggctgcgacaccgccggacgaccccgcatcggcatccggtggcgaccatccgccaagcactcccccgtcacccccgtcgcccccgtcatccccgcccacgctggccacgccgtccacgcagtcgtccccgccgctgtcatcccgtccggcatggctgcggtggctgctgcgccttctgggtgtgctgtgcctcgtggtgctgtgcgcgggcggctacgcgggctatgacgcatggcgttttctgaacgtgccgccccagacccccggcgaggagacgaccttcgacgtggaacccggtgcctcgttcgacaaggtggcgcgacagcttgaacagcgagggctcgtctccagcgcgtggcggttcaagctgctggggcactggatggagtggacgggcagcctcaaggccggacgtttcgccatgcacacgggctggacacccggccgcgtccttgaccagcttgtcaacggacagcccatcctctatcgcctgaccttgcgggaagggctcacatggtgggaagtgggacgccttctcgaaagcgagggattcgcccggttctcagatttcagcgccgtcatccacgacccggccttcctgcggcactacggcatcccgttcgattcggcagaggggttcctgttccccgagacctacctgctcaagaaaccgcagacgttgaaccgtgaagccgcccggtctgtggcggggcgtcttgtcgatacgttctggcgaagcaccgccgctgtactgccgctggggcacaggacacctcccgacgatttgcggcggctggtgacgctggcgtccatcgtcgaacgtgagacgggtgtgcccgcagaacgtgcccgcgttgccggggtgtacacaaaccgcttgcgtgtggggatgatccttcaggccgaccccacggtcatctacggcctcggccccaccttcgacggcaacctgcggcgcagtcatctgcaggatggcgacaacccctacaatacctaccgcaagccggggctgccgcccggccccatctgttcaccggggttcgaggcgttgcaggcggcagtgaagcccgaagaccacggctacttctactttgtcgcccgcaaggacggcacccatcagttcagcaccaacctcgacgaccataacgccgccgtgcgcaagttccagttgggccgctag

SEQ ID NO: 45007 - protein, 440 aa, Desulfovibrio vulgaris subsp. vulgaris str. Hildenborough
MTADGKLDDAQTDAHESPSPDDTVIDGGTSPLPSEASEAPSGDAAPVEAATPPDDPASASGGDHPPSTPPSPPSPPSSPPTLATPSTQSSPPLSSRPAWLRWLLRLLGVLCLVVLCAGGYAGYDAWRFLNVPPQTPGEETTFDVEPGASFDKVARQLEQRGLVSSAWRFKLLGHWMEWTGSLKAGRFAMHTGWTPGRVLDQLVNGQPILYRLTLREGLTWWEVGRLLESEGFARFSDFSAVIHDPAFLRHYGIPFDSAEGFLFPETYLLKKPQTLNREAARSVAGRLVDTFWRSTAAVLPLGHRTPPDDLRRLVTLASIVERETGVPAERARVAGVYTNRLRVGMILQADPTVIYGLGPTFDGNLRRSHLQDGDNPYNTYRKPGLPPGPICSPGFEALQAAVKPEDHGYFYFVARKDGTHQFSTNLDDHNAAVRKFQLGR

SEQ ID NO: 45008 - DNA, 1110 bp, Bartonella quintana str. Toulouse
  CDS (1)..(1110)
atgtccgatgtgaaaaatagaaaaccattaaaggatgtaaatgactcttctttggattatttagcagataataatgatatattggtacataaaaaacgaaagaagtcatttatcgtacgtaatccgttggtcattctcggtcatttttttctaatgctgcttgtggttgttcttttgagtataagtgttcctctttatattggaaaaagtatttttgaagggaagggaacatttgaggaagagcaagttattcttattaatcccgggacagggattcgtgaaatcgcttcattgcttgaaaaaaatggtctcattcgatcatcggatgtttttgtctatgcagttggttatcatcaaaaaacaacgcgtcttaaggccggtgaatatttaattccagcttatgcttcgatgcgagatattatggatatccttgtgaaaggcaaatctattgaatatacgttcacagtaccagaaggtttgacggttcaacaagtctttgatcgattagctgcaaatgaaattttgattggggatctcccaaaagttttgcctccagaaggcagtttgatgacggatactgttcattttattcggggcacaacgcgcaaagaaattataaaaaggctgcgtgagggacagacaaaattaattaatactatatgggctatgcgctcacctgatttaccaatcaaatccattgatgaatttgttatattggcatcgattgttgagaaagaaacaagaattgcagcagagagaccaaaagttgctgcggtgttttataaccgtcttgcaaaacatatgcgtttgcaatctgatccaacggtaatttatggtctcttcggtggaaaaggaatgccttctggacgcccaatttaccgttcagatcttgagaaggaaacaccatataatacttataaaattgatggtttgccgccaacagctattgcaaatccaagtcgtgattctttgaaagcggtagcgcattcaccaagcagtgatctgctctattttgtagctgatggttcgggagggcatgttttttctaggactttggaggaacataatatgaatgttcgtaagtggcgtgcattaaagcaaacacgttaa

SEQ ID NO: 45009 - protein, 369 aa, Bartonella quintana str. Toulouse
MSDVKNRKPLKDVNDSSLDYLADNNDILVHKKRKKSFIVRNPLVILGHFFLMLLVVVLLSISVPLYIGKSIFEGKGTFEEEQVILINPGTGIREIASLLEKNGLIRSSDVFVYAVGYHQKTTRLKAGEYLIPAYASMRDIMDILVKGKSIEYTFTVPEGLTVQQVFDRLAANEILIGDLPKVLPPEGSLMTDTVHFIRGTTRKEIIKRLREGQTKLINTIWAMRSPDLPIKSIDEFVILASIVEKETRIAAERPKVAAVFYNRLAKHMRLQSDPTVIYGLFGGKGMPSGRPIYRSDLEKETPYNTYKIDGLPPTAIANPSRDSLKAVAHSPSSDLLYFVADGSGGHVFSRTLEEHNMNVRKWRALKQTR

SEQ ID NO: 45010 - DNA, 1107 bp, Bartonella henselae str. Houston-1
  CDS (1)..(1107)
gtgtccgatgtgaacaatcaaaggctcctgaaggacgtagatgattcctcttcgaatcatataataaataataagtttttattagcaaagaaacgaaagaagtcgtttattgttcgtaatccgttagttattctcggtcatttttttctgatgcttattgtggtttttattttggccataagtattcctctttatattggaaaaagtatttttgaaggaaaagggataacagagaaagaacaagttgtccttatctatcctggaacaggaattcgtgaaattgcttcacttcttgaaaaacgtggtttcattcgatcatctgatgtttttgtttatggggttggttaccatcaaaaaacaacagatcttaaggctggtgaatatttaattccagcatatgcttcgatgcgggatattatggatatcctagtgaaaggaaaatctattgagtacacatttacagtaccagaaggtttgacggttcaacaagttttcgatcgattagcggctaatgaaattttaattggggatcttccaaaagttttgcctccagagggtagcttgatgacggatactgttcatttcattcggggaacaacgcgtaaagaaattataaacaggttgcgcgaaggacagacaaaactcattcatgctatatgggctacacgctcacctgatttgccaatcaagtccattgacgaatttgttatattggcatcaattgttgagaaagaaacaggaattgcagcagagcgaccgaaagttgctgcggtgttttataaccgtcttgcaaaacatatgcgtcttcaatctgatccaacagtaatttatggtctctttggtgggaaaggactgccatccggtcgtgcaatttaccgttcagatcttgagaaggaaacaccatataatacgtataaaattaaggggttgccaccaacagctattgcgaatccaggtagagattctttgaaagcggtggcgcattcaccgagcagtgatgtgctctattttgtagctgatggttctggagggcatgttttttctagaactttggaggaacataatataaatgtccgcaaatggcgtgcattaaaagcaacacattaa

SEQ ID NO: 45011 - protein, 368 aa, Bartonella henselae str. Houston-1
MSDVNNQRLLKDVDDSSSNHIINNKFLLAKKRKKSFIVRNPLVILGHFFLMLIVVFILAISIPLYIGKSIFEGKGITEKEQVVLIYPGTGIREIASLLEKRGFIRSSDVFVYGVGYHQKTTDLKAGEYLIPAYASMRDIMDILVKGKSIEYTFTVPEGLTVQQVFDRLAANEILIGDLPKVLPPEGSLMTDTVHFIRGTTRKEIINRLREGQTKLIHAIWATRSPDLPIKSIDEFVILASIVEKETGIAAERPKVAAVFYNRLAKHMRLQSDPTVIYGLFGGKGLPSGRAIYRSDLEKETPYNTYKIKGLPPTAIANPGRDSLKAVAHSPSSDVLYFVADGSGGHVFSRTLEEHNINVRKWRALKATH

SEQ ID NO: 45012 - DNA, 1074 bp, Acinetobacter sp. ADP1
  CDS (1)..(1074)
ttgattgatatgcccaagcagcccacaaaacccaaaatgaagaaaaaaccgcagcctcaaacagagtcatggtttaaaacaaacaaatggctaatggcagcgctcgtcttgttatgtgtggttggtattgtgctatgggcaaatttgtttaagccttatccgattgatggtaaaaggcagatgttggcgattgcgccaggcgatacctatacacgctttatagatcgcatggagaaagatggaaagatcagtttgccgattgtgcttaaaatttatcaaaaatttctcattcatgacagtttaaaggcaggtgtgtacgaaatccgtcaagggatgagtattcgccaagtgatggtaatgctgtccaatgcagaaaatgcgcagatgaaccgaattttggtgattgagggaacaacattcaaacagttgattgagaatcttaaaaaagatccactcgtgaccaaaactgtagtgaatttaccgtattccgagatgttaaaagctttggatattccttaccaacatccagaaggcttatttgaaccgaatacctacttttttgcaaaaggtgagacggataagaaaattttgactgatctgtatcgttatcaaatgaaaaccctgaatgaagaatggcagaagcgtgctcgtgatcttccttataaaaataaatatgaagcattaattatggcttcgattattgaaaaagaaaccagtatcgattcagagcttgaacaggtttcgggtgtatttgtacgtcgtttaagactcgggatgcgcttgcaaacggatccgaccgtaatttatggcatgggcgatcgatatcaaggcaaaattagccgtgaggatttacgaacagcaacggcctacaatacctataccatggcggggcttcctccaacgccaattgctttgccaggcaaaaaagcaattgcggctgccatgcatccagatcagtcagacaatatttattttgtggcaacaggtaatggcggacataaatttagcgccaatttacaagaccataatcaagcggttcaacaatacttgtccgtgttaagatcgaaaaattaa

SEQ ID NO: 45013 - protein, 357 aa, Acinetobacter sp. ADP1
MIDMPKQPTKPKMKKKPQPQTESWFKTNKWLMAALVLLCVVGIVLWANLFKPYPIDGKRQMLAIAPGDTYTRFIDRMEKDGKISLPIVLKIYQKFLIHDSLKAGVYEIRQGMSIRQVMVMLSNAENAQMNRILVIEGTTFKQLIENLKKDPLVTKTVVNLPYSEMLKALDIPYQHPEGLFEPNTYFFAKGETDKKILTDLYRYQMKTLNEEWQKRARDLPYKNKYEALIMASIIEKETSIDSELEQVSGVFVRRLRLGMRLQTDPTVIYGMGDRYQGKISREDLRTATAYNTYTMAGLPPTPIALPGKKAIAAAMHPDQSDNIYFVATGNGGHKFSANLQDHNQAVQQYLSVLRSKN

SEQ ID NO: 45014 - DNA, 1020 bp, Erwinia carotovora subsp. atroseptica SCRI1043
  CDS (1)..(1020)
atgaaaaaaaagaaaattggtttgctgattatcgccgctgttgttctgatgttgctggtagcgtggcagaaaatgcagcgttttgctgattctccattggctatcgaaaacgaaactattttcacgcttccggctggtacgggaagagaagggctggaaacgctgcttctcgatcaaaaaattattactgatggtgcgttttttccgtggttgctgcgtatcgaacctgaattggcaaaattcaaggcaggtacgtaccgctttacgacgggaatgaccgtacgcgagatgttggccttactgtccagcggcaaggaagcgcaattcaccatccgctttgtcgaaggttcacgtctaaaagagtggatcgtcacattgctgcaggcaccttatatcaagcatgcactggccgataaaaccgaacaggacatcgccactcagttggaaatcaacgataaggcgaacccggaaggttggttttatcctgacacgtattcatacacggccggtacgagcgatagcgccctgttacagcgtgcgcatcagcgtatgaaaaaaacggtggatgacgtatggaaagggcgtgaagaaggcttaccctacaagacacctgacgagttgctgacgatggcgtcaatcattgaaaaagaaacggcaatcaatgaagaacgtacgcaggtcgcttccgtttttatcaatcgcttacggcttggtatgcggctgcaaactgatcccacggtgatttatggcatgggggatgactataaaggtgtgataacccgtaaagcattagatacgccgacgccttacaatacgtatgtcatcatcggcttaccgccgacgccgatcgcgatgccggggaaagcgtcattggatgcggctgcacatcctgctaaaacgtcgtatctgtatttcgtggcggatggaaaaggcggacacagttttaccactaaccttgcagaccataatcgtgctgtaaaggtataccgctcagcgttaaaggaacgggatgaacagtaa

SEQ ID NO: 45015 - protein, 339 aa, Erwinia carotovora subsp. atroseptica SCRI1043
MKKKKIGLLIIAAVVLMLLVAWQKMQRFADSPLAIENETIFTLPAGTGREGLETLLLDQKIITDGAFFPWLLRIEPELAKFKAGTYRFTTGMTVREMLALLSSGKEAQFTIRFVEGSRLKEWIVTLLQAPYIKHALADKTEQDIATQLEINDKANPEGWFYPDTYSYTAGTSDSALLQRAHQRMKKTVDDVWKGREEGLPYKTPDELLTMASIIEKETAINEERTQVASVFINRLRLGMRLQTDPTVIYGMGDDYKGVITRKALDTPTPYNTYVIIGLPPTPIAMPGKASLDAAAHPAKTSYLYFVADGKGGHSFTTNLADHNRAVKVYRSALKERDEQ

SEQ ID NO: 45016 - DNA, 1110 bp, Propionibacterium acnes KPA171202
  CDS (1)..(1110)
gtgagcggaccgttcaacgagcacgatgacccgaaggcggaattttggtacaaacttcgcagcgcggtcgccgtcatcctttccctgaccgtgctcgtcggcgggtgcgtcttcgtcggtgtgaaggtctacgacggctacatctcgtacaagtctgctgacgactacctcggagatggcgagaaggacgtcttagttcgggtacctgctggcgcatcggtaagcgaagttggctcgatcctgctcgataacgacgtcgtcaagtcaacgaaggcatataacaaggcccttcgcgattcggaatctgacgttactattcaggctggtcagtacaagctcaagacgcatatgaacgccgcaaaggccgtgtccattctggacaatccggacaatatccagcgcacccgtgtcaccctgcccgagggcttaaccacagagcaacagttcgggatcatggccaagggaaccacgatgccagttggcagcttccagaatgcgtataagcaaactgcgaagctaggcctgccggtctgggccaaggggcgcccagagggcttcctctttcccgacacctatgaggtggggtcaaatccaactccgctagaaatcctgcagatgcaaacgaatcagttcgccaagcaggttaacacgatgaatttcattggccaggctcagactattaaacgtagcccctacgatgccctcatcgtcgcctccatcttggaaagagaggccaaaaagccaaaagatatgcagatgatcgccgggatcatctacaaccgcctccaacaaggaatgaagttggagtcggatgctacggtgctctacgccaaccacgtcgaaggcaagctgacaacgaacgacgaacagcgtgccaaggattcgccgtacaacacctatttgtataacggcttgccgcctacccctatcgacaaccccggtgcgacatctatggaggcagctgtgacaccgattaagagtgactacctttattgggttgttacagatcctgacaagggcactacggcgtattccaagacgctggctgagcacgagaaaaatgtcaagaaattccaagcttggtgtcaggaccacaaggggaagtgctag

SEQ ID NO: 45017 - protein, 369 aa, Propionibacterium acnes KPA171202
MSGPFNEHDDPKAEFWYKLRSAVAVILSLTVLVGGCVFVGVKVYDGYISYKSADDYLGDGEKDVLVRVPAGASVSEVGSILLDNDVVKSTKAYNKALRDSESDVTIQAGQYKLKTHMNAAKAVSILDNPDNIQRTRVTLPEGLTTEQQFGIMAKGTTMPVGSFQNAYKQTAKLGLPVWAKGRPEGFLFPDTYEVGSNPTPLEILQMQTNQFAKQVNTMNFIGQAQTIKRSPYDALIVASILEREAKKPKDMQMIAGIIYNRLQQGMKLESDATVLYANHVEGKLTTNDEQRAKDSPYNTYLYNGLPPTPIDNPGATSMEAAVTPIKSDYLYWVVTDPDKGTTAYSKTLAEHEKNVKKFQAWCQDHKGKC

SEQ ID NO: 45018 - DNA, 1575 bp, Streptococcus pyogenes MGAS10394
  CDS (1)..(1575)
ttggctttgaccgattttaaggataaagaccaacaagatcagcagcgaagctttaaagagcagattcttgctgagttggaaaaagcaaatcaaatcagaaaagaaaaagaggaagaactttttcaaaaagagttggaagctaaagaagcagctaggagaacggcccagctatatgctgaatataaaagacaagatgcttttcaaaaagagtctatagcacataacaataagacagccaaacactttcaagctataaaagatgcggtaatgacttcagaagcgattaaaccgactttactttctgaaaaagaaaactcatctttaaaaacgacaagtaagagagtcgtgcaggcaaatgagcttcaagagactgcctctaaagaatctcaagtaccgttaactattgagaaaggtcattcagtgagacgaaaattaagcaaacgccaacagactgagcgagctgctaaaaagatttcaaccgttttgattagctctattattataacccttttggctgttactctagcaggagcaggctatgtttatagtgctttaaatcctgttgataaaaatagtgatgcctttgttcaagttgagataccatctgggtcaggcaataaattgattggtcaaattcttcaaaaaaaaggtttaatcaagaatagcactgtttttagtttttatacaaaatttaaaaactttacaaattttcagagcgggtattacaatctgcaaaaaagtatgagtctagaagaaattgctagtgctttacaagaaggtggtacagcagaacctaccaagccatctcttgggaagatcttgattccagaaggatacacgattaaacaaatagctaaagctgttgagcataatagcaagggaaagaccaaaaaagctaaaacaccttttaacgagaaggattttttggatttagtcacggatgaggcttttattcaagatatggtaaaaagatatccaaaattattagcaactatcccaactaaagaaaaagctatttaccgtttggaaggttaccttttcccagcaacctataactattacaaagaaactactatgagagaacttgtagaggacatgctggcagctatggatgctactttggtaccctattatgataaaattgctgctagtggtaagacagtcaacgaggtattgaccttggcctctttggttgaaaaagaaggttcaacagacgatgacagacgtcaaattgcaagtgtcttttataaccgccttaatagcggaatggcactacaatctaatatagctattttgtatgcgatggggaaacttggtgagaaaacaaccttggctgaggatgctactattgacaccaccattaattctccttataatatttataccaatacaggtctgatgcctggtccagttgctagctcgggggtttctgcaattgaagcaaccctaaatccagcctcaacggattatttatactttgtggccaatgtccatactggtgaagtttactatgcaaaaacatttgaagagcactctgcaaatgttgaaaaatatgtgaatagtcaaattcagtaa

SEQ ID NO: 45019 - protein, 524 aa, Streptococcus pyogenes MGAS10394
MALTDFKDKDQQDQQRSFKEQILAELEKANQIRKEKEEELFQKELEAKEAARRTAQLYAEYKRQDAFQKESIAHNNKTAKHFQAIKDAVMTSEAIKPTLLSEKENSSLKTTSKRVVQANELQETASKESQVPLTIEKGHSVRRKLSKRQQTERAAKKISTVLISSIIITLLAVTLAGAGYVYSALNPVDKNSDAFVQVEIPSGSGNKLIGQILQKKGLIKNSTVFSFYTKFKNFTNFQSGYYNLQKSMSLEEIASALQEGGTAEPTKPSLGKILIPEGYTIKQIAKAVEHNSKGKTKKAKTPFNEKDFLDLVTDEAFIQDMVKRYPKLLATIPTKEKAIYRLEGYLFPATYNYYKETTMRELVEDMLAAMDATLVPYYDKIAASGKTVNEVLTLASLVEKEGSTDDDRRQIASVFYNRLNSGMALQSNIAILYAMGKLGEKTTLAEDATIDTTINSPYNIYTNTGLMPGPVASSGVSAIEATLNPASTDYLYFVANVHTGEVYYAKTFEEHSANVEKYVNSQIQ

SEQ ID NO: 45020 - DNA, 1086 bp, Desulfotalea psychrophila LSv54
  CDS (1)..(1086)
atgaatggtaaaatccttcgatatggtattgtgaaacgggtcgtgcttggcgcgaccctctttctttttttggcaattggtattttttttgcctggttgtactcctatctgcaaactcccgcccctcctattttggactccccctcccaagttgtggtcaatattccgcgtggagcttcttttcccagaatccagaaaattcttgccggggcagggcttgtcaacgatgatctccgttttgcccttatggcccgttatcttggtcttgcccgtcaggtcaaggcgggtgagtttgccttgcccgttgaacgtaggcccgtggagttgcttcgtcaattggttgtagcaaagcctgttcagcacagtgtaactgtacctgaagggctgaggatagaggagcttgccgccatctttgccgctgatgattggtgtgatgctgagcgttttatcagcctggcaagagacgaggtatttatcgcctctctggggcttgcccctttgccctctcttgagggttatctttatccggatacctactatcttacccgtaatatccatggggcggaggccattataccaattcttgtccatcgcttctccgttgtttggcgcaggcttgtcgcaggtcgtgaggcggctggcgagtacagccgtttacagcttgtcactctcgcctccctcgtggaggaggaggcaagggtggctatggaacagccccgtattgcaggcgttttttataatcggttaaaaagaggtattcgtttgcaatctgacccgacggttctctacggccttgatgagcatcagggcccgattaccagaactgatctgcgccgcaaaactccctataatacctactctatcccaggccttccccggggccctatctgtaatcccggcgaaaaggccctgcaggcggtactgcaaccggagaaaaacagctatctctattttgtctccaataacgatggtacccatgtcttttcgaccaaccttcgagatcataatagggctgtctataactatcggcgaaaactcaaaaaagagagagatggagaaaaaactggtcagatagggatcaattga

SEQ ID NO: 45021 - protein, 361 aa, Desulfotalea psychrophila LSv54
MNGKILRYGIVKRVVLGATLFLFLAIGIFFAWLYSYLQTPAPPILDSPSQVVVNIPRGASFPRIQKILAGAGLVNDDLRFALMARYLGLARQVKAGEFALPVERRPVELLRQLVVAKPVQHSVTVPEGLRIEELAAIFAADDWCDAERFISLARDEVFIASLGLAPLPSLEGYLYPDTYYLTRNIHGAEAIIPILVHRFSVVWRRLVAGREAAGEYSRLQLVTLASLVEEEARVAMEQPRIAGVFYNRLKRGIRLQSDPTVLYGLDEHQGPITRTDLRRKTPYNTYSIPGLPRGPICNPGEKALQAVLQPEKNSYLYFVSNNDGTHVFSTNLRDHNRAVYNYRRKLKKERDGEKTGQIGIN

SEQ ID NO: 45022 - DNA, 1032 bp, Rickettsia typhi str. Wilmington
  CDS (1)..(1032)
atgttaaaaaatttattaaaaaccaaattatcattagttataatatctttaactataactatattgatgactttaataaattttagtatattttatgttttgatgcctggtaatcttgctcaaaataaaacaataattattgaacctaaattatctgtaaatcaaatagttacaaaactttattttaataaagtaataaaatatccgataatttttaaggtaatcgctaaaatttattctataacaagacctattaaaagcggtgaatatgtgtttacacgtaatatatcgcctatacaaactttaagaatattagcaagcggtaaatctataatacacaagattgttgtaccagaaggtacagtagttagtgatgtgatcaagaaaattaatgaagaaagtcgattatttggagcaatcaaaggtataatacctgaaggttttttaatgccttcaacgtattttttttcttatggtgatcaaaaagatcagatcattgatcaaatgagaaatttaatgtctattaatttagataaagtaatgaaacatcttgcaccggattccccattaaaaactagaattgaggttttaactcttgcttcaataattgaaaaagaagctggctcaaatgcagaaaagcctattatagcagcagtatttattaatcgtttaaagaaaaatatgaagttacaagccgatccgactactatatatgctttgactgaagggaaatttaaattagcaagagctttaacaaaaaaagatttattacgaaagctaccatataatacttattatatcaaaggtttgccaccaggtccaattgcttgtccatcgttgaaatcgttagaagcagttgtcaaacctgctaaaacggatgcattattttttgtagttgatggtaagggtgggcatcatttttctaataatcttaatgatcataatagatttgttgaaatttaccgtaaaagtttaattaaagtacctgaaactccaattgatcttaaaaacacaaaaaaaaaatatgaataa

SEQ ID NO: 45023 - protein, 343 aa, Rickettsia typhi str. Wilmington
MLKNLLKTKLSLVIISLTITILMTLINFSIFYVLMPGNLAQNKTIIIEPKLSVNQIVTKLYFNKVIKYPIIFKVIAKIYSITRPIKSGEYVFTRNISPIQTLRILASGKSIIHKIVVPEGTVVSDVIKKINEESRLFGAIKGIIPEGFLMPSTYFFSYGDQKDQIIDQMRNLMSINLDKVMKHLAPDSPLKTRIEVLTLASIIEKEAGSNAEKPIIAAVFINRLKKNMKLQADPTTIYALTEGKFKLARALTKKDLLRKLPYNTYYIKGLPPGPIACPSLKSLEAVVKPAKTDALFFVVDGKGGHHFSNNLNDHNRFVEIYRKSLIKVPETPIDLKNTKKKYE

SEQ ID NO: 45024 - DNA, 1026 bp, Yersinia pseudotuberculosis IP 32953
  CDS (1)..(1026)
atgaaaagaaaaagcaccaaagcactgatcctttttgttgtgatctgtttgggattactgctgttgggttatcaaaaagtacaagattttgcgcgtcagcccttggcgattaagcaagagacttactttaccttaccggtaggtaccgggcgggttgctctagagaatttattgctacgtgatcatgtgattgctaatacaggtttatttccctggctactgcgcatagaacccgaactggctaattttaaggctgggacatatcgttttacgccgggtatgacggtacgtgagatgctggagttgttggtcagtggtaaagaagcccagtttaccgttcgttttattgaaggtaagcgcctgcgtgattggctggatgaattacaacagtcaaaatatatcaaacatgtgctggaagggaaaacagatgctgaaattgcgcagttactggggttaaaagagagtgaacaccccgaaggctggctctatcctgatacctactcctataccgcaggtacaacggatttaacactgctcaaacgtgcccatcaacgaatggagaaaaccgttgcagaaatctggcaggggcgtgatgacggattgccgtataagaccccaagtgatttggttactatggcatcaatcattgaaaaagaaaccgcggtaaatgaggagcgggataaggtggcttctgtcttcattaaccgtttacgtcttggtatgcgcctacaaacggatccaacagtgatttatggtatgggcgaaaagtataacggcaacattactcgtaaagacttagataccccgacaccttataatacctatgttatttccggtttgccgccaacccccattgccatgccagggttggcatcgctgaccgctgctgcccatccggcccaaacgccctatctctattttgtcgcagacggcaagggcgggcatacattcaccactaatttagccagtcataatcaagccgtgcgtgtttatcgccagtcgctaaaggataaaaatgaacagtaa

SEQ ID NO: 45025 - protein, 341 aa, Yersinia pseudotuberculosis IP 32953
MKRKSTKALILFVVICLGLLLLGYQKVQDFARQPLAIKQETYFTLPVGTGRVALENLLLRDHVIANTGLFPWLLRIEPELANFKAGTYRFTPGMTVREMLELLVSGKEAQFTVRFIEGKRLRDWLDELQQSKYIKHVLEGKTDAEIAQLLGLKESEHPEGWLYPDTYSYTAGTTDLTLLKRAHQRMEKTVAEIWQGRDDGLPYKTPSDLVTMASIIEKETAVNEERDKVASVFINRLRLGMRLQTDPTVIYGMGEKYNGNITRKDLDTPTPYNTYVISGLPPTPIAMPGLASLTAAAHPAQTPYLYFVADGKGGHTFTTNLASHNQAVRVYRQSLKDKNEQ

SEQ ID NO: 45026 - DNA, 1032 bp, Borrelia garinii PBi
  CDS (1)..(1032)
gtgcttattaaaattgggaaagtatttattcttttgttctttttaggatctgtttttttaatttttatatattttttaaatctatcttctttagcaaatggtttagtttatgaatttgatgttgagaaaggttggggagttaaaaaaatagctaaagaattaaaaaaacaaaaattaattaaatccgaattgcttcttgtttttatttcgtatatttttggtagtgacaaacaatttaaagagggaagatatttaatcaatagtgatctttctacatttgagatgtataaagagtttttaaggggatcttctaatgtaaatattgatgttacaatacccgaagggtatactagcagaagaattgcttctaagcttaaagaatttgctgttattgatgatgttcaagattttctttttttgatcaacgaaaaatcatttatttacgagcttgggttcgattatgattctcttgagggatttttattcccagatacctataaattttataagggtatggaaataaagaatattgttcgcatgtttgttgacaatttttttaataagcttaaatctataggtgttgtttttagtgattattcaaataaagatctttaccatagagtaataatagcatctattgttgagcgtgagtatagagttaaaagtgaagcttcaactatgtcttcggttttttataacagaataaaatccggtatggcattacaatcttgtgctactattgaatatattattacagaggagctaggacgaagccatcccaaaagaatttatttttcagatttagagatagattctccctataatacatatattaataaagggtatcctcctactccaatttcaaatgctggtattatttcactgcaagcagcttttttccctaaaaatacgcaatatttattttttgtagtacaagactctaagttgggcacacatcaattttcatcagattattcttcacatcttttaggagcaaaagattatattaaaaattttattactaaggattaa

SEQ ID NO: 45027 - protein, 343 aa, Borrelia garinii PBi
MLIKIGKVFILLFFLGSVFLIFIYFLNLSSLANGLVYEFDVEKGWGVKKIAKELKKQKLIKSELLLVFISYIFGSDKQFKEGRYLINSDLSTFEMYKEFLRGSSNVNIDVTIPEGYTSRRIASKLKEFAVIDDVQDFLFLINEKSFIYELGFDYDSLEGFLFPDTYKFYKGMEIKNIVRMFVDNFFNKLKSIGVVFSDYSNKDLYHRVIIASIVEREYRVKSEASTMSSVFYNRIKSGMALQSCATIEYIITEELGRSHPKRIYFSDLEIDSPYNTYINKGYPPTPISNAGIISLQAAFFPKNTQYLFFVVQDSKLGTHQFSSDYSSHLLGAKDYIKNFITKD

SEQ ID NO: 45028 - DNA, 1056 bp, Symbiobacterium thermophilum IAM 14863
  CDS (1)..(1056)
ttgtcgaacgcagccaaggcggtccgactggttctcgccctgctgatcctgctggccgcgctcgggggcgccgcctacggcggcctgcgctgggcgctcgcccgcctggagccggcggacccgaccgcggggcttctggaggtcgagatcccgtccggcgccaccaccaccgacgtcgcgcagatcctggcggaacatggcatcatccgtgatccggctgtctttcggtattacgtgcgctaccgggagctggacggccagatcgtctcaggccggtacgagctctcggccgcgatgtccgcggaccagatcctgaccaagctggtgaacggcgaggtggtcgtgcgccgcttcacgatcccggaggggctgacggtggagatgatggccgacctgctggccgaggcgcaggtcgtggaccgcgaggccttcctggacgccgcgctggccgcggcggcggagaacccctacctcccggaggacgtcgagctgattcagccaatggagggctacctgttccccgccacgtatcagtaccactcgggcatcaccgccgaggaggtggtggcgatgctcatggcgcgcttcgaggccgtctggacgcccgagttgctggcccgagccgacgagatgggcctttcggtgcacgaggtgaccaccctggcgtccatcgtcgagacggaggcgcgcgtggcggcggagcagccgcagatcgcgggcgtgtacctgaaccggctggccgtgggcatgccgctgcaggccgacccgaccgtgtactacgccctggggctgccccgatccgaggcgctgtcctacgacgacctggaggtcgactccccctacaacacgtaccgataccccggcctgcccccggggcccatcgccgcccccggcgaaggggcgatccgtgcggtgctctaccccgccacccacgactactactacttcgtcgccaagaacgacggctccggcgagcactacttcgccaccacgtacgcggagcatctggagaacgtcgaccgggcggaggccaacctggcggaacaggggccgtaa

SEQ ID NO: 45029 - protein, 351 aa, Symbiobacterium thermophilum IAM 14863
MSNAAKAVRLVLALLILLAALGGAAYGGLRWALARLEPADPTAGLLEVEIPSGATTTDVAQILAEHGIIRDPAVFRYYVRYRELDGQIVSGRYELSAAMSADQILTKLVNGEVVVRRFTIPEGLTVEMMADLLAEAQVVDREAFLDAALAAAAENPYLPEDVELIQPMEGYLFPATYQYHSGITAEEVVAMLMARFEAVWTPELLARADEMGLSVHEVTTLASIVETEARVAAEQPQIAGVYLNRLAVGMPLQADPTVYYALGLPRSEALSYDDLEVDSPYNTYRYPGLPPGPIAAPGEGAIRAVLYPATHDYYYFVAKNDGSGEHYFATTYAEHLENVDRAEANLAEQGP

SEQ ID NO: 45030 - DNA, 1074 bp, Mannheimia succiniciproducens MBEL55E
  CDS (1)..(1074)
gtgaatctccgggtgtttttattgatgatgaaaaaatgtattcgttttatttttctgttgcttttaatgttcgcagctgccggattttggggctacaattatattcaaaaattggtcaatgaacccgttaatattaaagcggaacaattacttactctggagcgggggactaccggtaaaaaactttttgccttgctggaaaaggaaaatatcattgccgataatatacttttccctttgttattaaaacttcagccccaatttaataatgtaaaggcgggaacttattcattagaaggcgtaaaaactctaggcgatttattaaccttgcttaacagcggtaaagaagcgcagttcgctttacgttttaccgacggcgaaacctggaagcaggtgaaaaaatcactggaaaacgcaccgcacttgaaacatgaattgaaagataaaaccgacgttgaggtttttcatcaatttaaagagatgttgcccgaatttgaggtgcaaaatgcgtacaaaaccttagacggctggatttatcccgatacgtataattacacgccgaattctacggatgtggctttagtcaaacgatctgtcgagcgaatggtgaaaacgctggaaaaagcatgggcggaacgtgatgaggatttgccgttgaataatccttatgaaatgttgattcttgcctctattgtggaaaaagaaagcggtatttccgccgaacgcggaaaaatcgcctcggtgtttgttaatcgtctgaaagccaaaatgaagttacaaacggatccgacggtaatttacggcatgggtgaaagttatcagggcaatattcgtaaaaaagatttggaatcgccgacaccttataatacctatgtgattgacggtttgccgcctacaccgattgcaaacccgagtgaagatgcgttaaacgcagttgcgcatcctgaaaggacggactttttatattttgtcgccgacggctcgggcgggcataagttcagccgtagtctgattgaacacaacaaagcggtgcaggaatatttgctttggttgcgccggaataaaaacaaataa

SEQ ID NO: 45031 - protein, 357 aa, Mannheimia succiniciproducens MBEL55E
MNLRVFLLMMKKCIRFIFLLLLMFAAAGFWGYNYIQKLVNEPVNIKAEQLLTLERGTTGKKLFALLEKENIIADNILFPLLLKLQPQFNNVKAGTYSLEGVKTLGDLLTLLNSGKEAQFALRFTDGETWKQVKKSLENAPHLKHELKDKTDVEVFHQFKEMLPEFEVQNAYKTLDGWIYPDTYNYTPNSTDVALVKRSVERMVKTLEKAWAERDEDLPLNNPYEMLILASIVEKESGISAERGKIASVFVNRLKAKMKLQTDPTVIYGMGESYQGNIRKKDLESPTPYNTYVIDGLPPTPIANPSEDALNAVAHPERTDFLYFVADGSGGHKFSRSLIEHNKAVQEYLLWLRRNKNK

SEQ ID NO: 45032 - DNA, 1038 bp, Bacteroides fragilis YCH46
  CDS (1)..(1038)
atgaataagaaaagaaagaaaatatttctcagcatactggctacttttttcttcatttgtatcgccggtgcaggaacagtctattactacctattttacccccagtttcatccaagtaagacaacttatatctatatagaccgcgatgatactacagactccatcttcaataaaataaaaaagcaaggaaaccctcatagctttaatggcttcaaatggatgtctcatttccgtgaatatagtaaaaatatccataccggacgttatgccatcaaacccggagataacacttatcaattatacagtagattatcaagaggctatcaaactcctgtcaacctgacaattggaagtgtccgaacacttgacagattagtccgcagcgtagggaaacagttaatgatagattccgctgaaattgccatggcactatacgactctatttttctggaaaaaatgggatacacagaagccaccatcccctgcttatttattcccgagacatatcaggtatattgggatgtcagtgcagcagactttttagcccgaatgaagaaagagcatgataaattttggaacaaagaccgactctcaaaggcccaagcaatagggatgactcctgaagaaatttgcacgctggcctccatcgtagaagaagaaaccaacaacaatgcagaaaagcctatggttgcaggattgtacatcaaccgattacatgccggcatgcccctgcaagccgacccgactatcaaattcgcactacaagatttcgggttacgcagaatcaccaatcaacacttagacgtacagtctccctataacacttacctgaatgcgggactgcctccgggtcctatccggataccatcacccaaggggctggacagtgtcttgaattatgtaaagcataactatatctatatgtgcgcaaaagaagatttctccggtacgcataattttgcctccaactatgcagatcacatggttaatgcaagaaaatactggaaagcgctgaatgaaagaaagatttttaagtaa

SEQ ID NO: 45033 - protein, 345 aa, Bacteroides fragilis YCH46
MNKKRKKIFLSILATFFFICIAGAGTVYYYLFYPQFHPSKTTYIYIDRDDTTDSIFNKIKKQGNPHSFNGFKWMSHFREYSKNIHTGRYAIKPGDNTYQLYSRLSRGYQTPVNLTIGSVRTLDRLVRSVGKQLMIDSAEIAMALYDSIFLEKMGYTEATIPCLFIPETYQVYWDVSAADFLARMKKEHDKFWNKDRLSKAQAIGMTPEEICTLASIVEEETNNNAEKPMVAGLYINRLHAGMPLQADPTIKFALQDFGLRRITNQHLDVQSPYNTYLNAGLPPGPIRIPSPKGLDSVLNYVKHNYIYMCAKEDFSGTHNFASNYADHMVNARKYWKALNERKIFK

SEQ ID NO: 45034 - DNA, 1020 bp, Burkholderia mallei ATCC 23344
  CDS (1)..(1020)
atgtccctactgaagaagtgcgccgcgctcgcggcgctcgccgtcgtattgctgggcgtcgcgtgcgcgggcggcgcctattactgggccactcggccgctcgcgctcgccgcgccgatcctcgatgtgacgatcaagccccgcagcagcgtgcgcagcgtcgcgcagcaactcgtgcacggcggcgtgggcgtcgagccgcgcctgttcgtcgcgatgacgcgcgtgctgttcctgtcgagccggctcaagtccggcaattacgaattcaagacgggcgtgagcccttacgaggtgttgcagaaggtcgcgcgcggggacgtgaacgaatatgtcgtgaccgtgatcgagggctggacgttccggcgcatgcgcgcggagctcgacgcgaatgcggcgctcgcgcatgcgagcgcggggatgagcgacgcggcgctgctgcgcgcgatcggcgcgcccgccgaagtcgtcgcgcgcggcaccggcgaggggctgttctttccggatacctatctgttcgacaagggcacgagcgacctgaacgtgtatcggcgcgcgtaccggctgatgcaggcgcgcctggccgacgcgtggaccgcccgtcggcccggcctgccgttcaagaccccttacgaggcgctgacggtcgcgtcgctcgtcgagaaggagacggggcacgcgtccgaccgtgcgttcgtgtcgggcgtgttcgcgaatcgcctgcgggccgggatgccgctgcagaccgatccctcggtgatctacggaatgggcgacgcgtacacggggcggctgcgcaagcgcgatctgcagaccgacactccgtacaatacctacacgcgccgcgggctgcccccgacgccgatcgcgctgccgggcgaggcggcgctctacgccgcggtgaacccggcggcgacgtccgcgctctatttcgtcgcgaggggcgacggcacgagcgtcttctcggacacgctcggggatcacaacaaggccgtggacaaatacatacgaggtcaatga

SEQ ID NO: 45035 - protein, 339 aa, Burkholderia mallei ATCC 23344
MSLLKKCAALAALAVVLLGVACAGGAYYWATRPLALAAPILDVTIKPRSSVRSVAQQLVHGGVGVEPRLFVAMTRVLFLSSRLKSGNYEFKTGVSPYEVLQKVARGDVNEYVVTVIEGWTFRRMRAELDANAALAHASAGMSDAALLRAIGAPAEVVARGTGEGLFFPDTYLFDKGTSDLNVYRRAYRLMQARLADAWTARRPGLPFKTPYEALTVASLVEKETGHASDRAFVSGVFANRLRAGMPLQTDPSVIYGMGDAYTGRLRKRDLQTDTPYNTYTRRGLPPTPIALPGEAALYAAVNPAATSALYFVARGDGTSVFSDTLGDHNKAVDKYIRGQ

SEQ ID NO: 45036 - DNA, 996 bp, Methylococcus capsulatus str. Bath
  CDS (1)..(996)
atgaggcgtaccctgctgctcgcggtaatggcgctggtggccggcgccgcggtgaaggatttcatcgagtctaccgagcggccgcttgccaacaccgagccagtcgtgttcgagatcgcacggggacagggcctgaaggacgtggctctggcgctgaaggaggcgggcgtgatcgatgagccctggtggctcatgctgcaggcctggagggaaggtctggcgcgcaggctccagtcgggggaatacgagattccgccgggcctggaccgacgcgggttgctggcgctgttcgcttccgggaaagtgctacagcatgccatgaccctggtcgaaggctggactttccggcagatgttggcggcgctgcgggcccagccggctctcgagcacctcgtcacggcggagagcgacggtgtcgtgctgatgcgggtgctgggaatcccggaaggagatccggaagggcggtttttccccgatacttatttcttcaccaagggcacgtcggacgtcgagatcctcaagcgcgctcaccggcgtatggcgacggtcctcgctgcggaatgggcgcggcgggcgccggaccttccctaccggacgccggacgatgcactcatcatggcttccatcatcgagaaagaaaccgccctgcccgctgaaaaggccgaagtggccggtgtgctggtccggcggctgcgcaccgggatgcctttgcaggtcgatccgactgtgatctacggcctgggcgaccgctttgacggcaatctgcgtcgcgaacacctcaaggcggacaccccctacaacacctatctccatcgcggtctgccgccggcaccgatcgccgcgcccggcctggcttcgctgcgggccgcgctgaacccggcaccgggcgacagtctgtattacgtggcacggggagacggcggccaccgcttctcgcggacctgggacgaacaccgacaggcggtagagctttatcaaaaggtcgggcagccatga

SEQ ID NO: 45037 - protein, 331 aa, Methylococcus capsulatus str. Bath
MRRTLLLAVMALVAGAAVKDFIESTERPLANTEPVVFEIARGQGLKDVALALKEAGVIDEPWWLMLQAWREGLARRLQSGEYEIPPGLDRRGLLALFASGKVLQHAMTLVEGWTFRQMLAALRAQPALEHLVTAESDGVVLMRVLGIPEGDPEGRFFPDTYFFTKGTSDVEILKRAHRRMATVLAAEWARRAPDLPYRTPDDALIMASIIEKETALPAEKAEVAGVLVRRLRTGMPLQVDPTVIYGLGDRFDGNLRREHLKADTPYNTYLHRGLPPAPIAAPGLASLRAALNPAPGDSLYYVARGDGGHRFSRTWDEHRQAVELYQKVGQP

SEQ ID NO: 45038 - DNA, 999 bp, Legionella pneumophila str. Lens
  CDS (1)..(999)
atgcaattctctagacataaaaaactggttattcttgttttatccttgttttttatgtctttcttgtttttattttggaatatatatcgcttattgtatacaccaataattccgaaaactgcttctccaatgattattgccttggataaggcgacgtccgcttatcaatttgcttatattttgcaagataaaaaattaatacattctgccaaattttttctattgattattcgttttgaaggattatcgcatcagttaaaggcaggtgtgtatcaaattactcctggcgaaactgcaatgaaattactacatcgagtagttgctggtgatgtaattacgcaaaattttacgatcatcgaaggatctacacagcagaaagtagattatgacctaagacaagctaattatttgaaatacaatccagaagattgggcaatagtaaaagaaaattaccaaagcgcagaggggttacttctagcagacacttatcaataccaaggtgggagtagtagtagggcattattagagcaagcccatcgtaatttattaaattatcttaataccagttggacaaacagagcaccaaatttgccttataaaactgcttatgagctattgattgctgcgtcaattattgaaaaagaaactgcaattgcgcaagagaaaaaattgatttctggtgtgatggtaaacaggttaaagaaaaaaatgccattacaaatggatcctacggttatctatggacttggaaatcaatataaaggaaaattaacacataatgatttgctaattcaatcaccatataactcttatttgaacagagggttgcctcccaccccaatagctatggttggcaaagaggccatagatgccgctgcacatccgcaattgtccaattatttatactttgttgccaaaggagatggcactcatcaattctccgaaacttatgagcaacaaagaaaagcaattaaccaatatagacgcaaggattattaa

SEQ ID NO: 45039 - protein, 332 aa, Legionella pneumophila str. Lens
MQFSRHKKLVILVLSLFFMSFLFLFWNIYRLLYTPIIPKTASPMIIALDKATSAYQFAYILQDKKLIHSAKFFLLIIRFEGLSHQLKAGVYQITPGETAMKLLHRVVAGDVITQNFTIIEGSTQQKVDYDLRQANYLKYNPEDWAIVKENYQSAEGLLLADTYQYQGGSSSRALLEQAHRNLLNYLNTSWTNRAPNLPYKTAYELLIAASIIEKETAIAQEKKLISGVMVNRLKKKMPLQMDPTVIYGLGNQYKGKLTHNDLLIQSPYNSYLNRGLPPTPIAMVGKEAIDAAAHPQLSNYLYFVAKGDGTHQFSETYEQQRKAINQYRRKDY

SEQ ID NO: 45040 - DNA, 1014 bp, Photobacterium profundum SS9
  CDS (1)..(1014)
gtgctaaagaagttgttcattgttgtactgatactgggtgtgtttgtagcaggtgttgcaggctggtcgtatcaacaggttaaccagtctcttgaacagcctgtgattaatcaagaagatgtacttttaacggtaacacctggaaccagttttcgagggttgctgaatcaattagcgaatgctgacgttgtaacaccatcaaaatggacacgttggattggtcgtttagagcctaagcttacacatattaaagcgggtacatatttgatcatgccagatcaaaatctgcgagaagtgcttggattagtcacatcaggaaaagagcatcagttttctattactctcgttgaaggtgaccgatttgttgattggctagagcaattaagaacatcaccagctgttgtgcatgcaagtgaaggtatgtcagaagcagatattgctcaagccattggcgcgacaaagataaataagcttgaaggttacttattgcctgaaacctataattatacggcgggtacgtctgatcttgagttattaaaacgcgcgtacaataagatgacggctttacttgatacggcatggcaagctcgtgataacgatgtgccattaaagtcggcttatgaagccttaattatggcctcgattattgaaaaagaaacggccgttgatactgaacgaactttggtttcttcagtatttatgaaccgcttaaataaaggcatgcgccttcaaacagacccaacggttatttacggtatgggtgataaatatgaaggtaacattcgtaaacgcgatttacgcacgccaacaccttataacacgtataccatttttggtttgcccccaacgccaatcgcaatgccgagtaaggcatctgttttagcggcggtaaacccagaaacaagttcgttttactattttgtggctgacggtaaaggcggccataaattttctaaatcgctggtagagcataatcgtgctgtacgcgcttatttaaagacgttaagaaactga

SEQ ID NO: 45041 - protein, 337 aa, Photobacterium profundum SS9
MLKKLFIVVLILGVFVAGVAGWSYQQVNQSLEQPVINQEDVLLTVTPGTSFRGLLNQLANADVVTPSKWTRWIGRLEPKLTHIKAGTYLIMPDQNLREVLGLVTSGKEHQFSITLVEGDRFVDWLEQLRTSPAVVHASEGMSEADIAQAIGATKINKLEGYLLPETYNYTAGTSDLELLKRAYNKMTALLDTAWQARDNDVPLKSAYEALIMASIIEKETAVDTERTLVSSVFMNRLNKGMRLQTDPTVIYGMGDKYEGNIRKRDLRTPTPYNTYTIFGLPPTPIAMPSKASVLAAVNPETSSFYYFVADGKGGHKFSKSLVEHNRAVRAYLKTLRN

SEQ ID NO: 45042 - DNA, 984 bp, Thermus thermophilus HB8
  CDS (1)..(984)
gtggtggccctcttcctcaccttcctcctcctcctcctctacgccctctggcttctcggccccacgggaagggaggccgtggtgcgcattccccggggggccacgggggcggaggtggcgaggattttggaggaggcggggcttctgcgctcgggccacgccttttccgcctacctccgcttctcgggccgggcgaagcgcctcgtccccggggtctaccgcctgaagggcgagggggccttccgcctggcccgggccctcaccgggggcgtgaagcccctaagcgtcaccctcaccttccccgagggggagagggcggtggactacgcccggaggctctcccaggcggggcttgacggggagggcttcctcaggctcgtggaacgcccgggggccctgaagcccccctacgtggaggggcggaccctggagggctacctcttccccgccacctacacctttgacctcctcgccacccccgaggaggtggtgcgggccatgctccgccgctttgaggcggagctcacccccccggtgcagaggcttctagaggagcgggggctttccgtccacgcctgggtcaccctggcctccatcgtggagaaggaggcgggaagcgccgaggagatgccctatatcgccggggtcttcctgaaccgcctggagcggggcatgcccctccaggccgaccccacggtggcctacgccttggggaagaggctcccggagctttcccgggaggcgggggacttccaggtggactccccctacaacacctaccgctacggcggccttcccccggggcccatcgccaaccccgggcggaaggccctcctcgccgtcttgaacccggtgcgccaggacgaaaggggccgcccctacctctacttcttccacgcccaggggcggctttacctgaacgtggactttgcgggccacctccgggacctcgcccgctaccgctacgcctccccgtccccgtga

SEQ ID NO: 45043 - protein, 327 aa, Thermus thermophilus HB8
MVALFLTFLLLLLYALWLLGPTGREAVVRIPRGATGAEVARILEEAGLLRSGHAFSAYLRFSGRAKRLVPGVYRLKGEGAFRLARALTGGVKPLSVTLTFPEGERAVDYARRLSQAGLDGEGFLRLVERPGALKPPYVEGRTLEGYLFPATYTFDLLATPEEVVRAMLRRFEAELTPPVQRLLEERGLSVHAWVTLASIVEKEAGSAEEMPYIAGVFLNRLERGMPLQADPTVAYALGKRLPELSREAGDFQVDSPYNTYRYGGLPPGPIANPGRKALLAVLNPVRQDERGRPYLYFFHAQGRLYLNVDFAGHLRDLARYRYASPSP

SEQ ID NO: 45044 - DNA, 1092 bp, Geobacillus kaustophilus HTA426
  CDS (1)..(1092)
atgaaacagaacgattttagggcgccagaggcgcggcttgtgcggaaaatcgtcttgattgtctgtgctgttctgctggcggcgtttgtcattgccggcgccagcagtttcttatacatccgttcagcgcttaagcccgtcgacccgaatgaccgcaccccggtccatgtctcgattccgatcggttcatcggcggcggcgattgccgagcagctcgaacaaaagcggctcattaaaagcgcggccgtgtttcgcttatatgtccgctggaaaaatgaatccggcttccaggctggggagtatgagttgacgcgggcgatgccaatggcgcgcatcattgagctgttaaaaacggggaaatcgctaaaaatcggattgaagctgaccgttccggaagggtcgcaattggtgcaaatcgctgacctcattgctgcgaaaacagggtacaaacaagaacaaattatgaaattgcttaacgatcgcgcgtatatcgaacggctgatgaaaatgcacccggatttgttgactgatgatatttttcggaaaggcatccgctatccgctggaaggctacttgttcccggcgacgtatgtgtttgctgacgaaaagccgccgctctcagagatcattgaggcgatggtggcgaaaacggcagctgtgcttgacacatataaggcagcgatgaaagaaaagaacatgtcgccgcatcagctgttgacgatgtcgtcgctcattgaggaagaggcgacggaaaaagctgaccgccaaaaaatcgccagcgtgttttacaatcggctgcaccgcggcatgccgcttcaaaccgacccgaccgttttgtacgcccttggcgaacataaagagcgtgtgttgtataaagatttgcaggtcaattcgccgtacaacacgtacattcataaagggctgccgccggggccgatcgccaacgccggcgtaatgtcgatcgaagcggcgcttgaaccggcggcgaccgactatttatactttttggcgacaccgggcggcgaggtcatttttacgaaaacgttggccgagcataaccgggaaaaggcgaagcatattggaaaacaatag

SEQ ID NO: 45045 - protein, 363 aa, Geobacillus kaustophilus HTA426
MKQNDFRAPEARLVRKIVLIVCAVLLAAFVIAGASSFLYIRSALKPVDPNDRTPVHVSIPIGSSAAAIAEQLEQKRLIKSAAVFRLYVRWKNESGFQAGEYELTRAMPMARIIELLKTGKSLKIGLKLTVPEGSQLVQIADLIAAKTGYKQEQIMKLLNDRAYIERLMKMHPDLLTDDIFRKGIRYPLEGYLFPATYVFADEKPPLSEIIEAMVAKTAAVLDTYKAAMKEKNMSPHQLLTMSSLIEEEATEKADRQKIASVFYNRLHRGMPLQTDPTVLYALGEHKERVLYKDLQVNSPYNTYIHKGLPPGPIANAGVMSIEAALEPAATDYLYFLATPGGEVIFTKTLAEHNREKAKHIGKQ

SEQ ID NO: 45046 - DNA, 957 bp, Salmonella enterica subsp. enterica serovar Paratypi A str. ATCC
  CDS (1)..(957)
atgtggaaagttcgccatctggcgaacagcacgttacttattaaaaacgagactatttttacgctcaaggcgggaacggggcggctggcgcttggcgaccagctttatgatgaaaaaatcattaatcgcccccgggtatttcagtggctgctgcgcgtggagcctgagttatcgcactttaaagcgggaacttaccgttttacgcccgggatgaccgtacgggagatgcttgagttgctggagagcggcaaagaagcgcaattcccgttgcggtttgtggaagggatgcgccttagcgattacctgaaacagctacgggaggcgccgtatattcgccatacattgccggatgatgactacgccactgtcgctcaggcattaaagcttgcgcacccggaatgggtagaagggtggttctggcctgatacctggatgtataccgccaacaccagcgatgtcgctattctcaagcgagcgcatcaaaagatggtgaaagctgtcgatactgtctggaaaggtcgggccgaggggctgccttataaagatcagaaccaactggtgacaatggcctcgattattgaaaaagagacggctgtcgccagcgaacgcgatcaggtggcctcagtctttattaatcgcctgagaatcggtatgcgccttcagaccgatcccaccgtgatttacgggatggggacgagttataatggtaacttgtcgcgtgcggatctggaaaagccgacggcttataacacgtataccataaccgggctgccgccaggaccgattgcatcgcccagcgaagcgtcattgcaggcggcggcgcatccggcgaaaacgccgtatctctattttgtggccgacggtaaaggcggtcacacatttaacaccaatcttgccagccataatcggtcagtgcaggagtacctgaaagtgcttaaggaaaaaaatgggcagtaa

SEQ ID NO: 45047 - protein, 318 aa, Salmonella enterica subsp. enterica serovar Paratypi A str. ATCC
MWKVRHLANSTLLIKNETIFTLKAGTGRLALGDQLYDEKIINRPRVFQWLLRVEPELSHFKAGTYRFTPGMTVREMLELLESGKEAQFPLRFVEGMRLSDYLKQLREAPYIRHTLPDDDYATVAQALKLAHPEWVEGWFWPDTWMYTANTSDVAILKRAHQKMVKAVDTVWKGRAEGLPYKDQNQLVTMASIIEKETAVASERDQVASVFINRLRIGMRLQTDPTVIYGMGTSYNGNLSRADLEKPTAYNTYTITGLPPGPIASPSEASLQAAAHPAKTPYLYFVADGKGGHTFNTNLASHNRSVQEYLKVLKEKNGQ

SEQ ID NO: 45048 - DNA, 1005 bp, Idiomarina loihiensis L2TR
  CDS (1)..(1005)
atgaaaaaacgtcttattttagcgctgcttgttgcagcttttgtggtttcggccgtggctgtctttgtatccgggcgctggtatttatcgcagccaatacaaagtgacgctagtacgcctctattgttagattttagaggaggagcaactgcccgtagcgtaaccattcaagtaacagagcactttgagaaggggaactctgcattaatttatcgcctgagtcaggtttttgacgatgtcgaccatttgcaagctggcctttatgaaattaacggacgacaaagctggtttgatgtctggagtatgttgagtcaagggcgggaaaaaacctttactgtgactctggttgaaggattgactctcgagcagtggagagctcaactaaaacagctaccttacctaaaagatgagtcttctgaattggatccggcggaactcaggcaaaagctgggcgttacagaaacctctattgaaggtgttttattacctgaaacctacagttacagagcttacacaacggatattgctattctgaagcaagcgtaccaatctatgcagcaggtgctggaaaatgcctggcaagagcgttcagacagatgccctgtaaactcaccttacgaattgctgatactggcttctattattgagaaagaaaccggtttggccgatgaacgtccgctggttgcaagcgtatttgccaatcgtttagctgtcggcatgcggttgcagtctgatccgacgacaatctatggtattgaaaattttgacggcaatctgactcgtactcatttgcgcgagaaaacagaatacaatacttatcgaattaacggattaccgccaacaccaattgcgatgcccggcaaagcctcaattaaagcagcagcaaatccggcacgttctccgtactattattttgttgcggataaatcaggtggccatgttttctcggaaacactggaagaacatcaacaggctgtacgccgatatcaactgaatcaagagtga

SEQ ID NO: 45049 - protein, 334 aa, Idiomarina loihiensis L2TR
MKKRLILALLVAAFVVSAVAVFVSGRWYLSQPIQSDASTPLLLDFRGGATARSVTIQVTEHFEKGNSALIYRLSQVFDDVDHLQAGLYEINGRQSWFDVWSMLSQGREKTFTVTLVEGLTLEQWRAQLKQLPYLKDESSELDPAELRQKLGVTETSIEGVLLPETYSYRAYTTDIAILKQAYQSMQQVLENAWQERSDRCPVNSPYELLILASIIEKETGLADERPLVASVFANRLAVGMRLQSDPTTIYGIENFDGNLTRTHLREKTEYNTYRINGLPPTPIAMPGKASIKAAANPARSPYYYFVADKSGGHVFSETLEEHQQAVRRYQLNQE

SEQ ID NO: 45050 - DNA, 1002 bp, Azoarcus sp. EbN1
  CDS (1)..(1002)
atgaagtcgctgctcctccgattgtttctcgtcgtcgcactcggcgctgcagcgagtctcgccgccgcgtggtggtatgtcacgcgtccgctgccgctcgcccggccggtcgtcgacttcacggtgcagcgcgggtttacgatgcgcgagacggctgcggcgatcgccggtgccggtgtcgatgtcgatccgcgcgtgctgtactgggtcgcgcggctcacgggcaaggccgaccgcattctggcgggcagctacgaggtccacaccggggtcacgccgtggctgctgatcctcaagctgtctagcggtgacgtgtcgcaggctcaactgcgcctcgtcgagggctggaatttccgccaggtacgggccgcgctcgaagcaagccccgaactgatacaggataccgtgggcctgtcggaggcggagatcctgcagcgcatcggcgcgacggagtcccatcccgaagggctgttctttcccgatacctatcttttcgacaaacagtcgagcgcgctggcgctgctcgcccgcacgtatcgggcgatgcacgagcggctcgcgcaggcgtgggagacgcgaaaccccgatctgcctctcgcgtcgccgtacgaagcgctgatcctcgcctcgatcgtcgagaaggaaacaggtcgcgcggaagatcgcacgctcattgcatcggtgttcgtgaaccgcctgcgcagcggcatgcgtttgcagaccgatccgacggtgatctatggccagggcaacgcgttcgacgggaatctgcgcaagcgcgacctcgaaaccgaccacgcctacaacacctatacgcgcaccgggcttccgccgaccccgatcgcgatgccgggactcgacgcgctgctggccgcggtcaggccgccgacgaccgattacctctatttcgtctctcgcggtgacggcacgagcgagttttcgacgaatctgaacgaccataacaaggccgtgagtcaataccagcggagaacgggaagttga

SEQ ID NO: 45051 - protein, 333 aa, Azoarcus sp. EbN1
MKSLLLRLFLVVALGAAASLAAAWWYVTRPLPLARPVVDFTVQRGFTMRETAAAIAGAGVDVDPRVLYWVARLTGKADRILAGSYEVHTGVTPWLLILKLSSGDVSQAQLRLVEGWNFRQVRAALEASPELIQDTVGLSEAEILQRIGATESHPEGLFFPDTYLFDKQSSALALLARTYRAMHERLAQAWETRNPDLPLASPYEALILASIVEKETGRAEDRTLIASVFVNRLRSGMRLQTDPTVIYGQGNAFDGNLRKRDLETDHAYNTYTRTGLPPTPIAMPGLDALLAAVRPPTTDYLYFVSRGDGTSEFSTNLNDHNKAVSQYQRRTGS

SEQ ID NO: 45052 - DNA, 1002 bp, Zymomonas mobilis subsp. mobilis ZM4
  CDS (1)..(1002)
atgtgccgcctttttcaccggcaagacagaatgagcggacaaaagccgcccagccgttggcttggtcgcttgcttctctttctgttacttgcgctggtgtttctaggcggcattgcttttaatcgggcaatggtgacccccaataacaaagaattggtcgtcaccatccccgaaggcagttcttttggtaaaacagcccgcatcttaaaagaggcaggcgttatccgctctgagaatgtctttttgtggctgcttcatagcaaacctgcttttatgttacgggcaggggactaccgtatcggtgcatctcgttctctaagtcaggtcatagaccttctttctcatgggcccaatgtgcggcatatctttgtcgttccagaagggatgccttctttggaagtgcatgaccgactgatggcagaaccccttttgacgggggaaatcgctgttcccgaagaaggcagcttactaccagacggttattcttttacgccgggtgaaaaacggtcgcttgtgatcgccagaatgcaagctgcaatgcagaaaatgcttcataaattatggagtgaaaaatcacctttggcacaggttaaaacgcctaaggaagcgattattctcgcctctattgttgaaaaagaaacggcacttcctgaagaacgtccgattgtcgcggcagtctattataatcgccttgccaaaaatatgcggttacaagctgatccgactatcatttatccgattacgcacggctatcctttggggcatcctatcttgcgttcggaattacaggcgcataacgattacaatacctatcagatgactggccttcctaagggagccatcaccaatccggggcggcagtctattgaagctgttttgcatcccgccaaaagcgaagcgctctattttgtcgcaaatggcaaaggcggccatatcttttccaataatttggaagatcaaaaccgccatgtccgcgactattacgcttcaaagaaaaactga

SEQ ID NO: 45053 - protein, 333 aa, Zymomonas mobilis subsp. mobilis ZM4
MCRLFHRQDRMSGQKPPSRWLGRLLLFLLLALVFLGGIAFNRAMVTPNNKELVVTIPEGSSFGKTARILKEAGVIRSENVFLWLLHSKPAFMLRAGDYRIGASRSLSQVIDLLSHGPNVRHIFVVPEGMPSLEVHDRLMAEPLLTGEIAVPEEGSLLPDGYSFTPGEKRSLVIARMQAAMQKMLHKLWSEKSPLAQVKTPKEAIILASIVEKETALPEERPIVAAVYYNRLAKNMRLQADPTIIYPITHGYPLGHPILRSELQAHNDYNTYQMTGLPKGAITNPGRQSIEAVLHPAKSEALYFVANGKGGHIFSNNLEDQNRHVRDYYASKKN

SEQ ID NO: 45054 - DNA, 1155 bp, Silicibacter pomeroyi DSS-3
  CDS (1)..(1155)
atgtggcgtgctctcgcctcgaacatgctgaccgttctggcggttggcctgttcctgctggccggcgtgatcctttggggcaagtcgcaatacaccgcgcagggcccgctggacgaggcgatctgccttcaggtcaagagcgggtcgaacatgacccgcgtcagccgcgatcttgaggcctcgggcgcggtcagcagcggtgccatgttccgcatcagcgcgcgctattccgaaaaggcgacgcagctgaaggcaggcagctatctggtcaaggaaggcgcctcgatggaggagatcatcgaccagatcacccgtggcggcgcgagcagctgcggcaccgagatcgtctatcgcatcggcgtcaaccgcctgctgctggaagtgcgcgagctggatccggccaccgaacaattcgtggaactggtcgagttcgacccaagcgagggcgaggcgcccgcggtctatgccgagaagcgcgccgagcgcgacacccgctaccggttggccatggccgagggcgtcaccagctggcaggtggtcgaaggtctgaaggcctgggacgtgctggcgggtgaggtggacgagctgccgcgcgagggcctgctggcccccgacagctatgacgtgacggtggggatggagcgtgccgcgctgctggcccagatgcaggagaagcaggagctgcggatcaacgccgcctgggaggcgcgcgtcgacggcctgcctctgcaaagccgcgaggagatgctgatcctggcctcgatcatcgagaaggaaaccggcgtgcccgaagagcgccgccaggtggccagcgtctttgtaaaccggttggaccggggcatgcgcctgcagaccgacccgaccgtgatctatggtatcaccaagggcaaaggggtgctgggacggggtttgcgtcaaagtgagcttcgcggcgtaacgccttggaacacttatgtgatcgaggggctgccgccgaccccgattgccaatcccggactggcaagcctggaagcagccgtcaatccggacacgaccgattacgtctttttcgttgccgatggcagcggtggccacgcctttgccgaaacgctggacgagcataatcgcaacgtcgccaaatggcgcgcgatcgaggcgcagcaacagggcaactga

SEQ ID NO: 45055 - protein, 384 aa, Silicibacter pomeroyi DSS-3
MWRALASNMLTVLAVGLFLLAGVILWGKSQYTAQGPLDEAICLQVKSGSNMTRVSRDLEASGAVSSGAMFRISARYSEKATQLKAGSYLVKEGASMEEIIDQITRGGASSCGTEIVYRIGVNRLLLEVRELDPATEQFVELVEFDPSEGEAPAVYAEKRAERDTRYRLAMAEGVTSWQVVEGLKAWDVLAGEVDELPREGLLAPDSYDVTVGMERAALLAQMQEKQELRINAAWEARVDGLPLQSREEMLILASIIEKETGVPEERRQVASVFVNRLDRGMRLQTDPTVIYGITKGKGVLGRGLRQSELRGVTPWNTYVIEGLPPTPIANPGLASLEAAVNPDTTDYVFFVADGSGGHAFAETLDEHNRNVAKWRAIEAQQQGN

SEQ ID NO: 45056 - DNA, 1140 bp, Bacillus clausii KSM-K16
  CDS (1)..(1140)
atgacaaagcaaccgaaacagcattcagagctttatcaggaacgtgcatcccaagccaaaaccgtccgtaagatcgtgtttatttgtgttttaattctgtttgccgtgatcttggccgccggcatatttagttatttttacttaacaaccgctttaaaaccaatggacgaagaagggaaaggcaccgatatagaagtaacgattcctgtcggaacttcgacaagcggaattgcggacattctagaagaagaaggattaatccgcaatgcaacgtttttccgttattacgcccgttataaaaatgaatcggatttccaagcaggaacgtatacattaaacacatcaatgggcgtggatgagcttattgcaagtttaaaagatggccgagtcgtggcggaggctgcctcgacgattactattcctgagggccttaacttagcaagcttaagcgaaagacttgccgagtttactggaacatcccaagaagaagtaatggctgttatagatgatgaagaatatgtcaaagagcttatcgacgactatgacatgctgacagatgaaattttaaacgaagagattcatcaccctctggaaggctacttgtttcccgccagttatccatttgaagaggaacagcctcctgtaaaaacggtcattgaagcgatgcttgaccaaatggaacaaatttatcaaaacaataccgacttgattgaaaacagcgagtacaccttccatgagctgctgacgattggatccattattgaacgggaagcaaaagaggcaccagaccgctttgaaatttctggcgtccttcataaccgattagagcaaaatatgaagctgcaagtcgacccaaccgttgcatacgcccaaggcgagcatatttatatgacaacctatgatgaccttgacatcgattcaccgtataatacgtatcgatatgaagggttgccgcctggaccgattgctacagtccgggaacaatcacttgtagctgctgctgacccgaatgacactgattacctgtatttctatgcccgttacaacggtgaaatcatctacaatgaagattacaacaagcatctagaagcacgtgatgcctaccgtcatgaatgggaagaagcagaaaataatgagtag

SEQ ID NO: 45057 - protein, 379 aa, Bacillus clausii KSM-K16
MTKQPKQHSELYQERASQAKTVRKIVFICVLILFAVILAAGIFSYFYLTTALKPMDEEGKGTDIEVTIPVGTSTSGIADILEEEGLIRNATFFRYYARYKNESDFQAGTYTLNTSMGVDELIASLKDGRVVAEAASTITIPEGLNLASLSERLAEFTGTSQEEVMAVIDDEEYVKELIDDYDMLTDEILNEEIHHPLEGYLFPASYPFEEEQPPVKTVIEAMLDQMEQIYQNNTDLIENSEYTFHELLTIGSIIEREAKEAPDRFEISGVLHNRLEQNMKLQVDPTVAYAQGEHIYMTTYDDLDIDSPYNTYRYEGLPPGPIATVREQSLVAAADPNDTDYLYFYARYNGEIIYNEDYNKHLEARDAYRHEWEEAENNE

SEQ ID NO: 45058 - DNA, 1050 bp, Gluconobacter oxydans 621H
  CDS (1)..(1050)
atgtctgaaggtcagcctgacggcgaggaaccgcggaagcttgttcttccgccaaaggctggccgcaagctggcgctcttcggggcgccactgctcctcgtcgcaggactggccgcaggttacgggcactacaccgatcccggaccgctgcaggacgagaagactttcgtcattccgcatggcaacaatgcccgtgtgacaaaggcgctccaggacgacgggatcctttcctcgacctgggcatccggtacgtttttccggattgccgcgttcctgacgcatcgcgatggccagatccacgctgcggaactgcagtttccggcccgggtttcggtcgcacatacccttgaaatcctgcgtcacggcaagcccgtttcccatcagcttacggtacccgaggggctgacggccctcaggattgcggccattctgaacaaggctcctgcgctgagcggtgaagtgcccacgcttgccgagggcagtgtctttccgcagaccgtctcttatgtgtggggaacgtcacgtcaggctctggccgaaaaactgcagaaaatgatggcggccagacttgccgctgcctgggacggccgtaatgtcgaagcgctggatgggctgattcagtctccacaggaattgctggttctcgcatcgctgatcgagcgtgagacggccgtgccgtccgagcggccgatggtggcgcgcgtgttcctgaaccgcctgaaactgggtatgcggcttcagacggatccgagcgtgatctacgggctcagcaatggtgcaggcacgctggacgcgccgctgacccatgaagatctgcagaccccggggccttacaacacctatcttcagactggactgccacccggtcccatctgttcgccgggaccgacctcactggatgccgcagcgcatccggctgacgggaagatgctgtattttgtggcgacggggacgggcgggcataatttcgccgagacgctcgccgatcaggataaaaacatccgcgcctatcacgtccacctgtcggcgacaccccagaaccagaactga

SEQ ID NO: 45059 - protein, 349 aa, Gluconobacter oxydans 621H
MSEGQPDGEEPRKLVLPPKAGRKLALFGAPLLLVAGLAAGYGHYTDPGPLQDEKTFVIPHGNNARVTKALQDDGILSSTWASGTFFRIAAFLTHRDGQIHAAELQFPARVSVAHTLEILRHGKPVSHQLTVPEGLTALRIAAILNKAPALSGEVPTLAEGSVFPQTVSYVWGTSRQALAEKLQKMMAARLAAAWDGRNVEALDGLIQSPQELLVLASLIERETAVPSERPMVARVFLNRLKLGMRLQTDPSVIYGLSNGAGTLDAPLTHEDLQTPGPYNTYLQTGLPPGPICSPGPTSLDAAAHPADGKMLYFVATGTGGHNFAETLADQDKNIRAYHVHLSATPQNQN

SEQ ID NO: 45060 - DNA, 1074 bp, Xanthomonas oryzae pv. oryzae KACC10331
  CDS (1)..(1074)
gtgggtgtggcggtgactggcaaacgcggatgtctggccgtgctgggcacgggattgctgctcgcagcgctgctggcgattgccgccgtggtggcgtggcggcattacctgcacttcgccgatactcccgtgcccgcgagcgcgcccagcgtggtgattgcgcccggtgatgcgctcaaggccacactgcgcaaactgcgtgcggccggcctggcacagggcaccgagctggaatggcagctgctggcgcgtcaggtcgatgcggccggcaagctcaaggtgggcgagtacgcgctggcaccggcgctgtcgccgcgcgaactgctgacgcgcatgcgccaggggcgggtgatccagtaccgcttcacacttgtggaaggctggaatttccgccagctccgcgccgcactggcgaccgccacgccgctgcaacattccaccagtgtgctggacgatgccgcgctgatggcgcggctggggttcgccaagcagcacccggaagggcgcttcctgccagaaacctatgtgtaccagcgtggcgacagcgatctcgacgtgctcaagcgcgcgcatgcggccatggacaaggcgctggcgcaggcgtgggaacagcgcaccccgaatcttccgctcgcttcgccggaacaggcattgatcctggcctcgatcatcgaaaaagaaaccgcgttggccaccgagcgcccgctgatcgccggggtgttcctgcgccgtttgcagatgggcatgaagctgcagaccgacccgaccgtgatctacggcatcggcagcagctacgacggcaatatccgccgccgcgacctgaccaccgacacgccgtacaacacctacacccgcaccggcctgacgccgacgccgatcgccatgccgggccgcgaggccctgctggcggcggtgcgtccggcgcccggtgaggcgctgtatttcgtggcggtgggcgatggcaccggcgcgcatgcattctcggccacgctggccgaacataacgcagcggtggcacgctatctgcagcgccgccggctgcaaagcacgccgcaaaccgagcccacgccatga

SEQ ID NO: 45061 - protein, 357 aa, Xanthomonas oryzae pv. oryzae KACC10331
MGVAVTGKRGCLAVLGTGLLLAALLAIAAVVAWRHYLHFADTPVPASAPSVVIAPGDALKATLRKLRAAGLAQGTELEWQLLARQVDAAGKLKVGEYALAPALSPRELLTRMRQGRVIQYRFTLVEGWNFRQLRAALATATPLQHSTSVLDDAALMARLGFAKQHPEGRFLPETYVYQRGDSDLDVLKRAHAAMDKALAQAWEQRTPNLPLASPEQALILASIIEKETALATERPLIAGVFLRRLQMGMKLQTDPTVIYGIGSSYDGNIRRRDLTTDTPYNTYTRTGLTPTPIAMPGREALLAAVRPAPGEALYFVAVGDGTGAHAFSATLAEHNAAVARYLQRRRLQSTPQTEPTP

SEQ ID NO: 45062 - DNA, 948 bp, Neisseria gonorrhoeae FA 1090
  CDS (1)..(948)
atgttgaaaaaaatgttgaaatggactgccgtttttttgaccgtatcggcagccgttttcgccgcgctgctttttgtccctaaagacaacggcagggcataccgaatcaagattgccaaaaatcagggtatttcgtcggtcggcaggaaacttgccgaagaccgcatcgtgttcagcaggcatgttttgacggcggcggcctacgttttgggtgtgcacaacaggctgcatacggggacgtacagattgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagttttttcccgacagctacgaaatcgatgcgggcggcagcgatttgcagatttaccaaaccgcctacaaggcgatgcaacgccgcctgaacgaggcatgggcaggcaggcaggacgggctgccttataaaaacccttatgaaatgctgattatggcgagcctgatcgaaaaggaaacggggcatgaggccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctatacgcgcgggggcttgccgccaaccccgattgcgctgcccggcaaggcggcaatggatgccgccgcccaccgttccggcggaaaaatacctgtatttcgtgtccaaaatggacggcacgggcttgagccagttcagccatga

SEQ ID NO: 45063 - protein, 315 aa, Neisseria gonorrhoeae FA 1090
MLKKMLKWTAVFLTVSAAVFAALLFVPKDNGRAYRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWAGRQDGLPYKNPYEMLIMASLIEKETGHEADRDHVASVFVNRLKIGMRLQTDPSVIYGMGAAYKGKIRKADLRRDTPYNTYTRGGLPPTPIALPGKAAMDAAAHRSGGKIPVFRVQNGRHGLEPVQP

SEQ ID NO: 45064 - DNA, 1095 bp, Lactobacillus gasseri
  CDS (1)..(1095)
ttgctaaatcaggacaaaaagaaaaatcatgagttagaagaacaagcatcaaaaaaggttacccgctggattcttagcggattaggtgccattttagtcttgtttatcttaattgggggctgttatgttggttatgctctgcagcctgccaatcgtcatgatgaagatgtggtcagtgttcatattcctgcaggtgcaactaatagtcagattgctcagattttacaagagaaaaagattattagaaatgcgactatctttaacttttggttaaagagccatagtgcaaccaattttcaggcaggtaatttctatctctcaccctcgatgcataacaaagaaatcgttagtcaattgcaaggtggaggtggccgtccagttgtcggtcacgttttgataaaagaagggcaaacgattgatagtattgctacaacagttggtaagaatacgaaatatagccgtcaagacttcttaaagctaatgaaagatcaaagctttatgaagagtttggaaaagcaatatcctaaacttttaactagttcaatgaacagtaaaggtgttcgttatcacttagaaggatatctcttcccggctaagtatgatgtctatcaaggagcttctttgaaagaactagttaaccaaatggttgataagactgatcaagttttacaaccatactatagttccatcaagaaaaagcatttgactgtgcaggaagttttaactttagcttccttagttgagcgtgaaggtgttaagtctaaggatcgtcgaatgattgctggggtattctttaaccgaattaaagcaaatatgccgcttcaatctgatatttcagtcatgtatgcactgaataagcataaacattctttgaccctaaaggatattaaggtagaatctccatataacttgtatgttcacaagggatatggtccaggaccatttaataatccaagtttagattcaattagcgctgtattaaccccaatcaagtctaactatctctactttgttgcaaatcttaagactggtaaggtttactacaatgaaaattatgacgagcacttgaaacgtaatagtagtttaggccagtaa

SEQ ID NO: 45065 - protein, 364 aa, Lactobacillus gasseri
MLNQDKKKNHELEEQASKKVTRWILSGLGAILVLFILIGGCYVGYALQPANRHDEDVVSVHIPAGATNSQIAQILQEKKIIRNATIFNFWLKSHSATNFQAGNFYLSPSMHNKEIVSQLQGGGGRPVVGHVLIKEGQTIDSIATTVGKNTKYSRQDFLKLMKDQSFMKSLEKQYPKLLTSSMNSKGVRYHLEGYLFPAKYDVYQGASLKELVNQMVDKTDQVLQPYYSSIKKKHLTVQEVLTLASLVEREGVKSKDRRMIAGVFFNRIKANMPLQSDISVMYALNKHKHSLTLKDIKVESPYNLYVHKGYGPGPFNNPSLDSISAVLTPIKSNYLYFVANLKTGKVYYNENYDEHLKRNSSLGQ

SEQ ID NO: 45066 - DNA, 963 bp, Magnetospirillum magnetotacticum MS-1
  CDS (1)..(963)
atgaagatcgtcgccggtgtcctggccatcatcctgatcgggctcggctggtccgcctgggaaggccatcgccgtttcaccgcgccgggaccgtcgcctaagccggtgatcgtgatcatccccaaggggtcgggcaccgagcttatcgcccactccctggaaggggccggggtgatctcgtcgcgctacgtctttgccgcaggcgtgaaattgcgccgcgtcaccctcaaggccggtgaatacgcctttcccgcccaggtctcgccggaagaggccatgcgcatcatcgccgacggcaaggtggtgattcacaagctgaccgtggccgagggactgaccacgcgtcaggtgctggatatggtcagcgaggccgatttcctggccggtcccatcacccgcaaagtgtccgagggccacctgctgcccgagacctggcacatggtccgcgacgagttgcgcgacgacgtcatcgcccgcatggaaaaggccatgacccagacgctcgacgtgctgtgggtggcccgtgcccccggtctgccgctcaaaagcaaggaggaggcgctgatcttggcctccatggtcgagcgcgagaccggcaccgaatccgaacgcccccgcgtcgccgccgtgttctacaaccgtctggcccgcaatatgcggcttcagtcggacccgacagtgatctacggcgtctcggacggcctgggcgaactggaccaccccctgacgcgggccgaacttcagaccaatcacccctggaatacctataccatcgacggtctccccaagacccccatcgccaatcccggccgcgcttccctggaagccgtactgcacccggccaaaagcgacgaactctacttcgtcgccaacggcaccggcggccacaccttcgcccgcacgctcgacgaacacaacgccaacgtggccaagtggcgtcagatcgagaaagcggggaagtag

SEQ ID NO: 45067 - protein, 320 aa, Magnetospirillum magnetotacticum MS-1
MKIVAGVLAIILIGLGWSAWEGHRRFTAPGPSPKPVIVIIPKGSGTELIAHSLEGAGVISSRYVFAAGVKLRRVTLKAGEYAFPAQVSPEEAMRIIADGKVVIHKLTVAEGLTTRQVLDMVSEADFLAGPITRKVSEGHLLPETWHMVRDELRDDVIARMEKAMTQTLDVLWVARAPGLPLKSKEEALILASMVERETGTESERPRVAAVFYNRLARNMRLQSDPTVIYGVSDGLGELDHPLTRAELQTNHPWNTYTIDGLPKTPIANPGRASLEAVLHPAKSDELYFVANGTGGHTFARTLDEHNANVAKWRQIEKAGK

SEQ ID NO: 45068 - DNA, 1077 bp, Azotobacter vinelandii
  CDS (1)..(1077)
atgcgaaaatggctgctgctgctggaaagtggcctgctggtggggggactgctcctgtcgtccgccgtctggcagcagagggccgcgctcgaacagcctctgaggctcgccgaggagcgtctgctggaggttccgagcggtgccacgcccggcggtctgctcaatcgtctgcaggacgagggactgttgcacgggagcttctggctgcgcctgtactggcgcttcaatctgtccgagcagggtatgcgcagcggcgaatatcgcctggagccaggcatgacggccgccgaactgctcgaactctggcagcgtggcgaggtggtgcagtacaacctcactttggtggagggctggagcttccgtcaggttcgggccgcattggcccggaccgacaaactggagcagtccctggaaggggtttccgatgccgagctgatggctcggctgggtcagccggacgcccacccggaggggcgcttcttccccgatacctaccgctatgtgcgcggcatgagcgacttcgagctgctcaggcaggcccatgcccgcctgcagcaggtgctcgccgaggaatgggccgggcggtcgccggacctgccctacgcgacgccctacgaggcgctgatcatggcctcgatcgtcgagaaggaaaccggcattccccgcgaacgcgagcagatcgccggcgtgttcgtgcggcgcctggaacagggcatgctgctgcagaccgatccgacggtcatctatggcctgggcgagcgctacaacggcaagctcgggcgcgccgagctgctcgcgaccacgccctacaacacctatgtccagcccggcctgccaccgacgccgatcgccctgccgggacgcgaggcgatccatgcggcgctgcatccggcggagggccgcgagctgtattttgtcgcccgcggcgatggtagccatatcttttccgaaaccctggaggcgcacaaccaggcggtgcgcgagtaccagctcaagcgccgcaccgactaccgctccagcccatcgtccgaggcggtggagcgttccgagcggcaagacgacgaggaaaacccgtga

SEQ ID NO: 45069 - protein, 358 aa, Azotobacter vinelandii
MRKWLLLLESGLLVGGLLLSSAVWQQRAALEQPLRLAEERLLEVPSGATPGGLLNRLQDEGLLHGSFWLRLYWRFNLSEQGMRSGEYRLEPGMTAAELLELWQRGEVVQYNLTLVEGWSFRQVRAALARTDKLEQSLEGVSDAELMARLGQPDAHPEGRFFPDTYRYVRGMSDFELLRQAHARLQQVLAEEWAGRSPDLPYATPYEALIMASIVEKETGIPREREQIAGVFVRRLEQGMLLQTDPTVIYGLGERYNGKLGRAELLATTPYNTYVQPGLPPTPIALPGREAIHAALHPAEGRELYFVARGDGSHIFSETLEAHNQAVREYQLKRRTDYRSSPSSEAVERSERQDDEENP

SEQ ID NO: 45070 - DNA, 981 bp, Desulfitobacterium hafniense DCB-2
  CDS (1)..(981)
atggcagttcttgcgggagcaggaatcgcagcttggtggaactgggcgagccaaccctacgctgaggaaggaagcaatgctgcagaagtgcagtttatgataactccgggaatgaatgcctctcaagttgctcaggaactggaacatcaggggcttatccgcaatgccctggcctttcgctttttggccagtcagcaaaatgtggattccaagctgctggcgggagagtaccagctttccgcccaaatgcccccccaggaaatgattaataagattcttgagggacctgacgtgcatactgtaaaggtcaccattcccgagggatatacgacagcccagattattgatctatttgtaaagaatgacttgggaagcaaagaggattatcagagggttattgaaagcgagcctttcagttattcttttcttgccgatatccctgcgggaccgaaccggctggatggttttctttttcctgatacctacttctttgctccggaggccggtcctaaggaaaacatcaatcgaatgcttaaacgctttgaacaggaaataaccccggaagtgatgactaaattggcagaaatgaatcttacgctgcgggagtgggtgaatctcgcttccatcgtagaaaaggaagcaggcaaggatgcggaccgtccgattatcgccggaattttccttaatcgcctcaagatcgacatggccctccaatcctgtgccaccattcaatatgtactgggaactcagaaatatatcctctctttagaagatatccaggtggagtctccttataacacctataagtatccgggattgccgcccagccccattgccagtcctgggcatgcctctctggatgcagtgctcaacagcacggattccgattacctatacttcttagctactccaagtggtgagacgatttatgcgaaaacccatcaggagcatttgcagaatcaggccaagtatatgaattaa

SEQ ID NO: 45071 - protein, 326 aa, Desulfitobacterium hafniense DCB-2
MAVLAGAGIAAWWNWASQPYAEEGSNAAEVQFMITPGMNASQVAQELEHQGLIRNALAFRFLASQQNVDSKLLAGEYQLSAQMPPQEMINKILEGPDVHTVKVTIPEGYTTAQIIDLFVKNDLGSKEDYQRVIESEPFSYSFLADIPAGPNRLDGFLFPDTYFFAPEAGPKENINRMLKRFEQEITPEVMTKLAEMNLTLREWVNLASIVEKEAGKDADRPIIAGIFLNRLKIDMALQSCATIQYVLGTQKYILSLEDIQVESPYNTYKYPGLPPSPIASPGHASLDAVLNSTDSDYLYFLATPSGETIYAKTHQEHLQNQAKYMN

SEQ ID NO: 45072 - DNA, 1170 bp, Desulfovibrio desulfuricans G20
  CDS (1)..(1170)
atgaacgagaacccgcagcaggaaccggcagaacggcatccggcggcatcttccgcagatggtgcgccggagcaggacaactcggatgcggctcgcggcggtgctgtgcgcctgcggcgcagattgcgcgtgctgcctgccgcggcgctggcgttgctgctggccgtggcggtctatgtggttctggatgcgtggatgttcatgaccacgccgccggaaaagaacgggcgcgatgtgaccgtgcagatacggcccggttcgacgtttatccgtgtggcgtggcagctcaggcaggccggagccataacggatgtgacgcggttccgtctgctgggcatgtacagaaagcagaccggagccgtacacgcgggagaatttctggtgaataccggctggacccccggcagggtgctggacgccgtggtgaacggcacgccggtggttcatccgctggcgctgcgcgaaggtttgccgtggtgggaggtggcccgtctggtggaacagggcggttttgcccggtatgaagatttcagggcggttatccacgatccggaatttctcgggcactggaaaatccctttcgattctgcagagggctacctttttccggaaacgtacatgctgcagcgtccgccggagatgaacagggcttccgcccgtgccgtggcggatatgctggtgagtatgttctaccgtaagtctgcattgctgtggtccgtacaagcgccggaacacgaagccggtgtccggcaggatgaacctcagccggaagagctgggaaggctggtcattctcgcctcgctggtggaaaaagaaaccggactgccttccgaacgcgagcgcatagccggtgtgtatgccgcgcgcctgaggcggggcatgcttatgcagtgtgaccccactgtcatctacgggcttggagaatcctttgacggcaacctgacccgcactcatctgcgcgatgcggaaaatccctataatacctaccggcataaaggcctgccgccgggccctatctgttctccggggctggattcccttgccgcggcgctgcggccggaacagcacaactatctgtattttgtctcgcgcggcgacggctctcatcatttcagcagtacgctgacagagcataaccgcgcagtacgcaagtatcagctgggcagatag

SEQ ID NO: 45073 - protein, 389 aa, Desulfovibrio desulfuricans G20
MNENPQQEPAERHPAASSADGAPEQDNSDAARGGAVRLRRRLRVLPAAALALLLAVAVYVVLDAWMFMTTPPEKNGRDVTVQIRPGSTFIRVAWQLRQAGAITDVTRFRLLGMYRKQTGAVHAGEFLVNTGWTPGRVLDAVVNGTPVVHPLALREGLPWWEVARLVEQGGFARYEDFRAVIHDPEFLGHWKIPFDSAEGYLFPETYMLQRPPEMNRASARAVADMLVSMFYRKSALLWSVQAPEHEAGVRQDEPQPEELGRLVILASLVEKETGLPSERERIAGVYAARLRRGMLMQCDPTVIYGLGESFDGNLTRTHLRDAENPYNTYRHKGLPPGPICSPGLDSLAAALRPEQHNYLYFVSRGDGSHHFSSTLTEHNRAVRKYQLGR

SEQ ID NO: 45074 - DNA, 1041 bp, Haemophilus somnus 2336
  CDS (1)..(1041)
atgaagaaaattttattcattgtattgttgtttttgtgtggtgcaggcggtagcgttttttgggcatattggcaaataactgactttgtaaaacaacctgttaaagtcaaagaagagcaacttttaactgttgtgcgaggaacgaccggcaataaattggcaatattattagaaaatgaagggttaatcgaaaatgggaaatggttgccttggctgcttaaattaaaacccgaattgaataaaattaaagccggtacttattccctcgttaatgtagaaaatattcaagatcttcttgatgtacttaatcagggcaaagaggtgcaatttaatttgcaattgattgaagggcaacgttttaaaacttggcgtaaaattttagaaaatgcaccgcacttgcggcaaacattacaaggaaaatcggagaaagagatttttactttgctggagttgccggcttattcaaaagctgtttatgaatggaaaacgattgatggttggttatatccggatacttatagttacacgcctaactctagcgatttggcactgttaaaacgtgcggcttcccgtaccataaaagcgttagagcgagcttggcaacaaagaaatgtaaatttgccattgaaaaatccctatgaaatgttaattcttgcttctattgtggaaaaggaaacagcattgagtgaggagagagcgaaagtagcgggcgtttttgtgaatcgtttaaataagcaaatgaaattacaaacagatccaacggtgatctatggtatgggtgatgattataaaggtaatattcggaaaaaagatttattgacaccaaccccttataatacctatgtgattgatggtttaccgccgacgccgattgctatggtaagcgaggaaagtttacaggctgttgctaaaccggaacagcatgattatttatattttgtcgcagatggaagcggtggacacaagtttagtaaaacattggcagaacataaccgtgctgtgcaagaatatttgcgttggtaccgttctcaatcaaaatag

SEQ ID NO: 45075 - protein, 346 aa, Haemophilus somnus 2336
MKKILFIVLLFLCGAGGSVFWAYWQITDFVKQPVKVKEEQLLTVVRGTTGNKLAILLENEGLIENGKWLPWLLKLKPELNKIKAGTYSLVNVENIQDLLDVLNQGKEVQFNLQLIEGQRFKTWRKILENAPHLRQTLQGKSEKEIFTLLELPAYSKAVYEWKTIDGWLYPDTYSYTPNSSDLALLKRAASRTIKALERAWQQRNVNLPLKNPYEMLILASIVEKETALSEERAKVAGVFVNRLNKQMKLQTDPTVIYGMGDDYKGNIRKKDLLTPTPYNTYVIDGLPPTPIAMVSEESLQAVAKPEQHDYLYFVADGSGGHKFSKTLAEHNRAVQEYLRWYRSQSK

SEQ ID NO: 45076 - DNA, 1035 bp, Actinobacillus pleuropneumoniae serovar 1 str. 4074
  CDS (1)..(1035)
atgattaaaaaacttcttattgctttaggcttatgcggtctaattgctgccggcggtgcaatttacggttatcaaaaactctccggtcttgccgagcatccgcttaccgcaaaagcagatcaattctttatcttagagaaaggcacatcaagccaaaagctggcacaattattggaagaacaaggtattgttaatcatgatgatgttagcctactcccctatcttattcgttttaaaccggaactgagtaaatttaaagcggggacttactcactgaatggacttaacacggttgaagatttgctgaaacatttaagttccggcaaagaagtccaacttaacgtgcaatttatcgaaggtaaaacctttaaggtttggcgcgaacaacttgcgaaagcaagttatatgcaacacacgctaaccggaaaatccgaagcggaaatcgctcaattgctcggtattgcccatgagaaactcgagggctggattgcacccgatacttatagctatgtgccgaattcaagcgatttggaattacttaaacgagcttatcaaaagcaacaaaaagcattggataacgcttggcaaaatcgtgcggaaaatctaccgcttgcaaacccgtatgaaatgctgattttggcttctatcgtggaaaaagaaaccgcagttacgagtgaacgcccacaagtagcatctgtatttatcaaccgtctcagactaaaaatgaaactgcaaaccgacccgaccgtaatttacggtatgggcgatcggtataacggtaatattcgtaaaaaagatttagaagaagcaacaccttataatacttatgtaattgacggcttaccgccgacaccgattgcaatgccgagcgaagcggcattaaaagcggtttcacaaccggataatacgccatatctctattttgtggcagacggcagcggcggacacaaatttagtaaaaatctagaccaacacaaccaagcggttcgtgactggatcaaaatcgaacgaaacaaaaaacttgagaagaaataa

SEQ ID NO: 45077 - protein, 344 aa, Actinobacillus pleuropneumoniae serovar 1 str. 4074
MIKKLLIALGLCGLIAAGGAIYGYQKLSGLAEHPLTAKADQFFILEKGTSSQKLAQLLEEQGIVNHDDVSLLPYLIRFKPELSKFKAGTYSLNGLNTVEDLLKHLSSGKEVQLNVQFIEGKTFKVWREQLAKASYMQHTLTGKSEAEIAQLLGIAHEKLEGWIAPDTYSYVPNSSDLELLKRAYQKQQKALDNAWQNRAENLPLANPYEMLILASIVEKETAVTSERPQVASVFINRLRLKMKLQTDPTVIYGMGDRYNGNIRKKDLEEATPYNTYVIDGLPPTPIAMPSEAALKAVSQPDNTPYLYFVADGSGGHKFSKNLDQHNQAVRDWIKIERNKKLEKK

SEQ ID NO: 45078 - DNA, 1050 bp, Pseudomonas aeruginosa UCBPP-PA14
  CDS (1)..(1050)
atgcgcaaactgctggtgctgctggagagtggcctgttgttcgttggcctctgcgtcggcctggctgcatggcagcagcagcgggcgctggagcagcccctgcaattgaccgaggagcgcctgctggacgtttcctcgggctccacgccgggcggcatgctcgcgcgtctggagcaggaagaggtgctccatggcgcgttctggctgcgcctctactggcgtttcaacctgccgggccaggccctgcacagcggtgaataccgcctcttgccggggatgacgggcgccgacctgctggaactctggcgtgaaggcgaggtggtgcagtacagcctgaccctggtcgagggctggagtttccgccaggtgcgcgaagcgctcgccaggcagggcaagctggagcagaccctggccggcctgagcgacggcgagatcatgcaacgcctcggcaagcccgacgaagtggccgaagggcgcttcttccccgatacctaccgctacacccgtggcatgcgcgacatcgacatactgcgcaaggcctaccagcggatgcagaacatcctcgccaaggaatgggatggccgcagccaggacctgccttatcgcgacgcctaccaggcgctgatcatggcctcgttggtggaaaaggaaaccggcgtgccggaagagcgttcgcagatcgccggcgtcttcgtccgccgcctgcagcgcggcatgctgttgcagaccgatccgacggtgatctatggcatgggcgagcgctacaacggcaagatcacccgcgccgacctgcgcgaaccgaccccttacaatacctatgtggtgccgggcatgccgccgaccccgatcgccctggccgggcgcgaggctattcgcgccgcgctgcatccggccgagggcgagaccctgtatttcgtggcgcgcggcgatggcagccacgtgttctccagcagcctggacgaacacaacaaggcggtccgcgagtatcagttgaagcgtcgctcggactatcgctccagccccgcgcccatcaccccgccgccacaatga

SEQ ID NO: 45079 - protein, 349 aa, Pseudomonas aeruginosa UCBPP-PA14
MRKLLVLLESGLLFVGLCVGLAAWQQQRALEQPLQLTEERLLDVSSGSTPGGMLARLEQEEVLHGAFWLRLYWRFNLPGQALHSGEYRLLPGMTGADLLELWREGEVVQYSLTLVEGWSFRQVREALARQGKLEQTLAGLSDGEIMQRLGKPDEVAEGRFFPDTYRYTRGMRDIDILRKAYQRMQNILAKEWDGRSQDLPYRDAYQALIMASLVEKETGVPEERSQIAGVFVRRLQRGMLLQTDPTVIYGMGERYNGKITRADLREPTPYNTYVVPGMPPTPIALAGREAIRAALHPAEGETLYFVARGDGSHVFSSSLDEHNKAVREYQLKRRSDYRSSPAPITPPPQ

SEQ ID NO: 45080 - DNA, 933 bp, Fusobacterium nucleatum subsp. vincentii ATCC 49256
  CDS (1)..(933)
atgaaaaaattatttgctattatctttataatatttataattttagcaggaacaactgtctatcagtttgtgaaaaaagataaatataatttggttttagaaatagataaagataaacctttaaaagaatccttatcagttttacctgtatcaaataatcctttttttaaattatacttaaaatttagaaatgatgggaaagatataaaagcaggtaactatgaattaagaggaaaattcaatatgatagaacttgtttctatgcttgaaagtggtaaatctaaggtatttaagtttacaataatagaagggaatacagttaaaaatgttatagataaattagttgctgatggaaaagggaaaagggaaaattttgaaaaagcatttaaagaaatagatttttcttatccaactcctgatggtaattttgaaggctatttataccctgaaacttattttataccagaatcttatgatgagaaggctataattaatatatttttaaaagaatttttaaaaaaattcccagtggaaagctatccagataaagatgaattttatcaaaaattaataatggcttctatacttgaaagagaagcagctgttgaaagtgaaaagcctattatggcatcagttttctataatagaatcgctaagaatatgactttatcagcagattctactgttaattttgtctttaattatgagaaaaaaagaatatactataaagatttagaagttgattctccatataacacatataaaaataagggattacctcctggacctatatgtaatccaactgttagttctgttgaggcagcttatcacccagcagatactgaatatttattctttgttacaaaaggtgggggagaacattttttcagtaaaacatacaaggagcatttagattttcagaaaaataaatga

SEQ ID NO: 45081 - protein, 310 aa, Fusobacterium nucleatum subsp. vincentii ATCC 49256
MKKLFAIIFIIFIILAGTTVYQFVKKDKYNLVLEIDKDKPLKESLSVLPVSNNPFFKLYLKFRNDGKDIKAGNYELRGKFNMIELVSMLESGKSKVFKFTIIEGNTVKNVIDKLVADGKGKRENFEKAFKEIDFSYPTPDGNFEGYLYPETYFIPESYDEKAIINIFLKEFLKKFPVESYPDKDEFYQKLIMASILEREAAVESEKPIMASVFYNRIAKNMTLSADSTVNFVFNYEKKRIYYKDLEVDSPYNTYKNKGLPPGPICNPTVSSVEAAYHPADTEYLFFVTKGGGEHFFSKTYKEHLDFQKNK

SEQ ID NO: 45082 - DNA, 1284 bp, Psychrobacter sp. 273-4
  CDS (1)..(1284)
atgagcacgccaacacctgaaacgcctcctgaacgtcctaatgatacgctatcgaatgaccaaaaaggcactgctgacgagcgtgtcgatgggacacctttgaattcaaaaccagtcgatgagacaggtgcaaaagaagttccgcctaccgatatctcgctcattagcggtgataataaaccacgccattataaaatcgataacccttcattctttatgcagcgtggttatcaagtactattggtgcttgggttaattgctgcatttttcttggtcatggtttatcagactttatttggtcggattgaacagccgcagcagatggtgacgattgagaaaggtcagacctattacggtttgctaccgcagtggcaacaggaaatcccgctgttttctgccacgattgccaagctttatatgaaaacgcaggtcgatggtccattgcatgccggtatttaccaattaccggaaaaccctaccattgctgaggcgctacacgtacttgggcaaggggtaaaagcggcaatggtcaaggtacaaattatcgagggcaaaacctcaaaagatttgtatcaggcgctacgtgataataaaggcatcaaaaaagaagtgctaacggctgacagtacgaatgctagcatcgcacaagcgttagatttggttggtatcttgccggatacggttgccaacagtaatgaccctatcgttaatcacaatcttgaaggctggtttgcccctgatacttattattatggagaaggcaccactgacaagaaagtgttgaccgacttgtacaagcgccaacagcaggcactgaccaaggcatgggaaaaccgtgcgccaaacctcccttatcagagcccttatgaggcgctggtgatggcgtctattattgaaaaagaaaccagtgtggaagaagagcgtcctttggtctcagcagtctttaataaccgcttgaacaaaagcatgcgtatgcagacggatcctaccattatctatggtatgggcagccgctatgaaggtaatattcgccgtaaagacatcgatgaaaaaacgcgctataacacctatcaaatcgatggtttgccgcctacacccattgcactgccgtcagctgcttctatcgaagcaaccttacatcctgctaagagcgaagcgctatattttgtggcgacaggcaacggcgggcataaatttaccaatagcttaactgagcacaatcaagcggttaaagagtatctcggcgtcatgcgtgagaaaaaagcccaaacgccgccgcagtaa

SEQ ID NO: 45083 - protein, 427 aa, Psychrobacter sp. 273-4
MSTPTPETPPERPNDTLSNDQKGTADERVDGTPLNSKPVDETGAKEVPPTDISLISGDNKPRHYKIDNPSFFMQRGYQVLLVLGLIAAFFLVMVYQTLFGRIEQPQQMVTIEKGQTYYGLLPQWQQEIPLFSATIAKLYMKTQVDGPLHAGIYQLPENPTIAEALHVLGQGVKAAMVKVQIIEGKTSKDLYQALRDNKGIKKEVLTADSTNASIAQALDLVGILPDTVANSNDPIVNHNLEGWFAPDTYYYGEGTTDKKVLTDLYKRQQQALTKAWENRAPNLPYQSPYEALVMASIIEKETSVEEERPLVSAVFNNRLNKSMRMQTDPTIIYGMGSRYEGNIRRKDIDEKTRYNTYQIDGLPPTPIALPSAASIEATLHPAKSEALYFVATGNGGHKFTNSLTEHNQAVKEYLGVMREKKAQTPPQ

SEQ ID NO: 45084 - DNA, 996 bp, Ralstonia eutropha JMP134
  CDS (1)..(996)
atgacacgtctttttctacgcctgggactgctcgtcctcgttcttgccctggctgccgccggcgctttcgcgtggtgggccaaccagccgctgggcctgtccgcctcgcctgtcgaagtcgtcatcaagccgaattccggtgtcgccagcgtcggccgccagctccagcgcggcggcgtgagcatggacccgcgcctgttccagttgctggcgcggctgaccggccatggtccggacctgaaggcaggcggctatacattcgaaacgggcattacgccgatgggtgtggtcggcaagctcgcacgcggcgaagtcacgcactatgtcgtcaccgtgatcgagggctgggaattccgcaagatgcgcgccgcggtggatgccagcccggctctgcgccatgacacgaaggacatgtcggacgccgatctgatgaaggcgattggcgccacggaagatgccccggaagggctcttcttccccgacacctacctgttcgcgcgcggcagcagcgatatcgagctgtaccgccatgcctacaaggccatgcagcggcggctgaacgaggcctggaacgcgcgctccgcggacctgccgtacaagaccccgtacgaggcgctggtgatggcgtcgatcgtcgagaaggaaaccggccaggccaccgagcgcccgatgatcgccgcggtgtttgtcaaccgcctgcgcaagaacatgatgctccagaccgacccgaccgtgatctacggcattggcgagcgcttcgacggcaacctgcgcaagcgcgacctgcagaccgacacgccgtacaatacctacacccgtaccggcctgccgcccacgccgatcgcgctgccgggcctggcttcgctggccgcggctaccgcgccggccccgtccgatgcgctgtatttcgtggcgcgcggcgacggtaccagccatttctccaatacgcttcccgaacacaaccgcgcggtagatcagtaccagcgcggcaaataa

SEQ ID NO: 45085 - protein, 331 aa, Ralstonia eutropha JMP134
MTRLFLRLGLLVLVLALAAAGAFAWWANQPLGLSASPVEVVIKPNSGVASVGRQLQRGGVSMDPRLFQLLARLTGHGPDLKAGGYTFETGITPMGVVGKLARGEVTHYVVTVIEGWEFRKMRAAVDASPALRHDTKDMSDADLMKAIGATEDAPEGLFFPDTYLFARGSSDIELYRHAYKAMQRRLNEAWNARSADLPYKTPYEALVMASIVEKETGQATERPMIAAVFVNRLRKNMMLQTDPTVIYGIGERFDGNLRKRDLQTDTPYNTYTRTGLPPTPIALPGLASLAAATAPAPSDALYFVARGDGTSHFSNTLPEHNRAVDQYQRGK

SEQ ID NO: 45086 - DNA, 1176 bp, Mesorhizobium sp. BNC1
  CDS (1)..(1176)
atgactgacaggaacgaccagccgtcgaggactttcgtattcagttcgggccgcgacgcacttcgccctgaggctgccacgccgccgccgccgaagcgttcacggcagtcccgtaaccagtttatcgtcttcctgaatttcgtcgtctcttccatcgttttcgtgctggtggtcgccggcatcgccttttacttcggcaaaagcgcgttcgaggggccgggaccttccaccacgacgcagaccgttttgatcaagcccaatacgggcgtgcgggagatcgcaagcattctggagagcgaaggcctcatcagcgatgcgcggatcttcatgatcgggctcagggtccacggcgccgatagcaagctcaaggcaggcgaatacgagatcaaggctggcgcttccatgcaggacatcatggagctcctggagagcggcaagtcggttctctattcgctgaccattcccgaagggcttacggtggcgcaggtcttcgagcgcatcgccaagaccgaagaacttgcaggcgagttgccggaagagctgccacctgaaggaagccttgccgccgataccctgcgtttcacccgcgggctttcccgcaaagaggttgtcgaacggctgaaagcgcagcaagaggaactggtgcaaagcatttggcagcggcgatccgaggatctccccatcgaggatatcaacgcgttcctgacgcttgcctcgatcgtggagaaggagaccgggcgctcggacgaacgctcgcgcgtggccgccgttttcctcaacaggctgaagcgtggcatgcggcttcaatcagaccccaccgtgatctatggtatctttggcggccaaggaaagccggcggaacggccgatctaccggtccgatctcgacaagatgacgccctataacacctatctggtaaaagggctgccgccgacgcccatcgccaatccggggcgggcggcgctggaggctgtggccaatccgtcgcggaccgaggaactctacttcgtggccgatggtaatggcggccatgtctttgcttcctcgcttgacgagcacaatgaaaacgtagcccgctggcgcaaaatcgagcgcgagagagccgccgctgcagagaaggccgcatctgaggtgcagcctgcggcagcggaaggcagcgaagtgggcgaaaactga

SEQ ID NO: 45087 - protein, 391 aa, Mesorhizobium sp. BNC1
MTDRNDQPSRTFVFSSGRDALRPEAATPPPPKRSRQSRNQFIVFLNFVVSSIVFVLVVAGIAFYFGKSAFEGPGPSTTTQTVLIKPNTGVREIASILESEGLISDARIFMIGLRVHGADSKLKAGEYEIKAGASMQDIMELLESGKSVLYSLTIPEGLTVAQVFERIAKTEELAGELPEELPPEGSLAADTLRFTRGLSRKEVVERLKAQQEELVQSIWQRRSEDLPIEDINAFLTLASIVEKETGRSDERSRVAAVFLNRLKRGMRLQSDPTVIYGIFGGQGKPAERPIYRSDLDKMTPYNTYLVKGLPPTPIANPGRAALEAVANPSRTEELYFVADGNGGHVFASSLDEHNENVARWRKIERERAAAAEKAASEVQPAAAEGSEVGEN

SEQ ID NO: 45088 - DNA, 1113 bp, Rubrobacter xylanophilus DSM 9941
  CDS (1)..(1113)
ttgaggcgctacaacaggcggaggaccagggactgggaggagctggaggcccggctcgacgccataggggcgcgctcctcctccaagcgccgccgcaaaaagcgccgctcgctggggcccgtcttcgggctggtgctcctcgcgggcgttctggccgtcatctacgccatcttcgccgccgccaccggcgaggacggggcgcgggccgagcccgtggagatccgggtcgccaagggcgacaccctctccagcgtggccgagaggctggaggagaagggggtgatcgggagctccttcctcttcgagctggaggcgcgcctggagggcaagagcacggccataaagcccggggagtacaccttccgtcccggggaggacgacgaccggatcctggcgcgcctcaccgccgggcaggccgcccccaccttcaccgtgaccatccccgagggccttaccctggagcagaccgcccggcgggttgcgcgggcgagcggcggggacatcacggcggaggagttcgagcgggccgcccggagcaccgactacccctacgccttcctcaaggaccccgccatagagacgaccgaggggttcttgttccccaagaagtacgagttcgaggaggggaccacggcccgccaggtagtggaccggctgctcgagcagtacctcatcgagaccgagggtctggacatagagggggccgagcggcggctcaacctcaccgagtacgagctggtgatcacggcctccctcatcgagcgggaggcggccaacccgcgggagaagccgctgatagcctcggtgatctacaaccggctgcgccgggggatgccgctgcagatagacgccacgatccagtacgcccgcggcgagcccaaggagaacctctccctgcaggacctgaagatagactccccctacaacacctacgaaaacccggggctcccgccgggccccatctgcagcccctcgctgagctccctgcaggcggcggtgaacccggccgagacggactacctctactacgtgctgaagcggggcggcgaggagcacttcttcacctcggactacaacgagttcctgcgggccaaggaggccgccggcctctag

SEQ ID NO: 45089 - protein, 370 aa, Rubrobacter xylanophilus DSM 9941
MRRYNRRRTRDWEELEARLDAIGARSSSKRRRKKRRSLGPVFGLVLLAGVLAVIYAIFAAATGEDGARAEPVEIRVAKGDTLSSVAERLEEKGVIGSSFLFELEARLEGKSTAIKPGEYTFRPGEDDDRILARLTAGQAAPTFTVTIPEGLTLEQTARRVARASGGDITAEEFERAARSTDYPYAFLKDPAIETTEGFLFPKKYEFEEGTTARQVVDRLLEQYLIETEGLDIEGAERRLNLTEYELVITASLIEREAANPREKPLIASVIYNRLRRGMPLQIDATIQYARGEPKENLSLQDLKIDSPYNTYENPGLPPGPICSPSLSSLQAAVNPAETDYLYYVLKRGGEEHFFTSDYNEFLRAKEAAGL

SEQ ID NO: 45090 - DNA, 1179 bp, Rhodobacter sphaeroides 2.4.1
  CDS (1)..(1179)
atgtggcgctccgtcgcctccaacgcgctgaccctcttcatcgtggtgctggtggcggcggccgggttgctggcctggggacggcaggaatataccggccccggcccgctcgccgaggccgtctgcctgcgggtggagcggggcgactcgctctcggtcgtgagccgcaggctcgaagagcagggcgcggtcagcgatgcgcgcatcttccgcatcggcgcggattattccgatcaggccgcggggctgaagttcggcagctacctgctgccgcctcgggcctcgatgggggatatcctcgacatcctgaccgcgggcggccagtcgacctgcgggcgcgaggtgaactaccggatcggggtggtggcggccgagatcatcctgcgcgagttcgacgcggccgccggccgctatgtcgaagtggcgaagttcgtgcccggcgaaggcgaggcgcccgaggcctatgcggaggcggccgaggagggcgacctgcgctggcgcgtgacgcttgccgaaggggtgacgagctggcaggtggtcgagagcctgcgcagggccgagttccttcagggcgagatcaaggaggttccccccgaaggatcgctcgcccccgacagctacgaggtggcccgcggcgacgaccgggcggcgcttctggcgcagatgcaggaccgtcaggcccgcatcatcgccgaactctgggccgcgcgttcggcggatgtgccctatgccacgccggaagaggcgatggtcatggcgagcatcgtcgagaaggagaccggcatcgcgagcgagcggccgcaggtggcgagcgtcttcgtcaaccgcctggcccaggggatgcggctgcagaccgaccccacggtgatctacggcctgaccgagggcaagggcgtgctggggcgcggcctgcgccagagcgagctgcgccgccggaccgattacaacacctatgtgatcgacgggctgccgcccacgcccatcgccaacccggggcggctctcgatcgaggcggcgctcaacccggccgagaccgactatctctatttcgtggccgatggcagcggcgggcacgccttcgccaccacgctggccgagcacaaccgcaacgtggccgcgtggcgcaagatcgaggccgagcgcgggatgcctccgccggtgggcatccagggcgagtga

SEQ ID NO: 45091 - protein, 392 aa, Rhodobacter sphaeroides 2.4.1
MWRSVASNALTLFIVVLVAAAGLLAWGRQEYTGPGPLAEAVCLRVERGDSLSVVSRRLEEQGAVSDARIFRIGADYSDQAAGLKFGSYLLPPRASMGDILDILTAGGQSTCGREVNYRIGVVAAEIILREFDAAAGRYVEVAKFVPGEGEAPEAYAEAAEEGDLRWRVTLAEGVTSWQVVESLRRAEFLQGEIKEVPPEGSLAPDSYEVARGDDRAALLAQMQDRQARIIAELWAARSADVPYATPEEAMVMASIVEKETGIASERPQVASVFVNRLAQGMRLQTDPTVIYGLTEGKGVLGRGLRQSELRRRTDYNTYVIDGLPPTPIANPGRLSIEAALNPAETDYLYFVADGSGGHAFATTLAEHNRNVAAWRKIEAERGMPPPVGIQGE

SEQ ID NO: 45092 - DNA, 1014 bp, Rubrivivax gelatinosus PM1
  CDS (1)..(1014)
atgaagcgcgcactgaagcgagggctgttcctgctgttggtgctggcgttcgctggcggcggtctggcggcctggtggctgacgcagcccctggcgctggcctcgcccagcgtcgagctgtcggtggagccgggcacgtcgccacgcgagatcgcccaggggtgggtcgacgcaggggtccgcgcgccgccgctgctgctctacgagtggttccgctggtccggccaagcgcgcaagatccgcgcgggcagctacgagatcggcccgggcaccacgccgctcgcgctgctgaacaagatggtgcgcggcgacgaggcccaggccaccgtgcggctgatcgaaggctggaccttccggcagttccgcgccgagctcgcgaaggccgaggcgctgaagccggacacagcctcgatgaacgatgccgaagtgatggcggcgctgggctcaccgggccgatcgccggagggctggttcttccccgacacctacgcctacagcaagggggcgagcgacctcgccgtgctgcagcgtgcccaccgcgcgatgcagcgccgcctcgaggcggcctggctcgagcggatgcccgacacgccgctgaagagccccgaagaggccctgacgctggcgtcgatcatcgagaaggagacgggccagacggcagaccgcggcaaggtcgccagcgtgttcgtgaaccggctgcgcatcggcatgccgctgcagaccgaccccacggtgatctacgggctcggcgaggccttcgacggcaacctgcggcggcgcgacctgcaggccgacacgccctacaacacctacctgcgcacgggcctgaccccaacaccgatctcgatgccgggcaaggcctcgttgatcgcggcggtgcggccggagacgagccgggcgctgtacttcgtcgcccggggcgacggcagcagccagttcagcgaaaacctcgccgaccataatcgggccgtgaaccgataccagcgcggcggcggccgcggcgccgcgccatga

SEQ ID NO: 45093 - protein, 337 aa, Rubrivivax gelatinosus PM1
MKRALKRGLFLLLVLAFAGGGLAAWWLTQPLALASPSVELSVEPGTSPREIAQGWVDAGVRAPPLLLYEWFRWSGQARKIRAGSYEIGPGTTPLALLNKMVRGDEAQATVRLIEGWTFRQFRAELAKAEALKPDTASMNDAEVMAALGSPGRSPEGWFFPDTYAYSKGASDLAVLQRAHRAMQRRLEAAWLERMPDTPLKSPEEALTLASIIEKETGQTADRGKVASVFVNRLRIGMPLQTDPTVIYGLGEAFDGNLRRRDLQADTPYNTYLRTGLTPTPISMPGKASLIAAVRPETSRALYFVARGDGSSQFSENLADHNRAVNRYQRGGGRGAAP

SEQ ID NO: 45094 - DNA, 1167 bp, Pseudomonas fluorescens PfO-1
  CDS (1)..(1167)
ttgctgctgctggaaaccggactggttctggcagggctgctgttgggcgccagcgcctggaagattcattcggcactggaacagcccctgaacatcacgcaggaagaactgctggatgtgcccaagggatccaccccgacccgtacttttcttggacttgaagccgatggcgtcatcaaggacgcgttctggctgcgggtctactggcgtttcaatctggccggcacgccgattcacagtggtgaataccgcatgcagccgggcatgaccgtcaacggcctgatcgacctgtggaagcgcggcgatgtggttcagtacagcctgaccctggtcgaaggctggaatttccatcaagtgcgcgccgcgctggccaaagatgaaaagatcgagcagaccctcaacggtctgagcgacagtgatgtgatggccaaaatcggtcacaagggcctgttccctgaagggcgcttcttccccgacacctaccgcttcgtgcgcggtgtgaccgataccgaactgctgaaaaaagcctttgatcgccttgacgaagtgctggccaaggagtgggagaaacgctccgccgacgtgccttacaccgagccttatcaggcgctgatcatggcgtcgctggtggagaaagaaaccggcgtgcctcaagaacgtggccagattgccggcgtcttcgtgcgccgaatggcgttgggcatgcagttgcagaccgatccgacggtgatctacggcctgggtgaccgctacaacggcaaactgacccgcgcccatctcaaggaagccacgccgtacaacacgtacatgattcccggcctgccgccgacgccgatcgccatggtcggacgtgaagccattcacgcggctctcaacccggtggatggcaccagcctctacttcgtggcccgtggcgatggcagccacgtgttctccgatgatctggacgcgcacaacaacgcggtgcgcgaataccagctcaagcggcgcgcggattaccgctcgagcccggcgcctgcaacagcgcccgaggccgctccggaagccgaggaggcgatacctgccgcctcacccgatactgcaccggaatcgttgccgcagccgcccgctcaagcgcctgcgccgacgccggaaccggaagcctccgctccccaaaacacgcaatga

SEQ ID NO: 45095 - protein, 388 aa, Pseudomonas fluorescens PfO-1
MLLLETGLVLAGLLLGASAWKIHSALEQPLNITQEELLDVPKGSTPTRTFLGLEADGVIKDAFWLRVYWRFNLAGTPIHSGEYRMQPGMTVNGLIDLWKRGDVVQYSLTLVEGWNFHQVRAALAKDEKIEQTLNGLSDSDVMAKIGHKGLFPEGRFFPDTYRFVRGVTDTELLKKAFDRLDEVLAKEWEKRSADVPYTEPYQALIMASLVEKETGVPQERGQIAGVFVRRMALGMQLQTDPTVIYGLGDRYNGKLTRAHLKEATPYNTYMIPGLPPTPIAMVGREAIHAALNPVDGTSLYFVARGDGSHVFSDDLDAHNNAVREYQLKRRADYRSSPAPATAPEAAPEAEEAIPAASPDTAPESLPQPPAQAPAPTPEPEASAPQNTQ

SEQ ID NO: 45096 - DNA, 987 bp, Rhodospirillum rubrum
  CDS (1)..(987)
atgcgggccattctcggtgttttcctggtcgcggttctggcggcgctgaccgtttttggcggttatctgtatgtgaccgatcgcttcgtcgctgcgggcccgttggctgcggagcgcgtggtggtggtggccccgggcagcggggtggacggcatcgccgccaccctggcccgcgagggcgtgatcaatgatcccctgatcttcaaaatcggcgtgcggctggccgaaacggcccgccagctcaaggccggcgaataccgcttcaccccgggcatgagcgccgagcaggtgatggggctgctggtctccgggcaggtggtggttcaccgcttcaccgtggccgaggggctgaccacccgcgtcgtccgcgacatcgtcctcgcccaggaagacctggtcggcgagatttcgctggagccgggcgaaggcgcgcttctgcccgagacctataattatctgcgcggcgatagccgcgacgccgtcgtcaagcggatgggcgcggccatgggcgaggccatcgacagcctgtgggagcatcgcgcccccggactgccggtgaccaccaaggctcaggcggtggttctggcgtcgatcgtcgagaaggaaaccgccgttccggcggagcgggcgcgggtggccggggttttcatcaaccggctgcgcatcggcatgccgctgcaatccgatccgacggtgatctatggcctgtcggctggcacgggaaccctaggccgcgccctgacccgcaaggatcttgagaccccccacgcctggaacacctatgtgatccccggcctgccgcccagcccgatctgcaatccgggccgcgagtccctggccgccgtgctcaatccggccgatggcggggatctttatttcgtcgccgatggcagcggcgggcatgtcttcgccgccagcctcgatgcgcataaccgcaatgtcgcgcgctggcgcaagatccagcgcgatcaggccaagcgggagtga

SEQ ID NO: 45097 - protein, 328 aa, Rhodospirillum rubrum
MRAILGVFLVAVLAALTVFGGYLYVTDRFVAAGPLAAERVVVVAPGSGVDGIAATLAREGVINDPLIFKIGVRLAETARQLKAGEYRFTPGMSAEQVMGLLVSGQVVVHRFTVAEGLTTRVVRDIVLAQEDLVGEISLEPGEGALLPETYNYLRGDSRDAVVKRMGAAMGEAIDSLWEHRAPGLPVTTKAQAVVLASIVEKETAVPAERARVAGVFINRLRIGMPLQSDPTVIYGLSAGTGTLGRALTRKDLETPHAWNTYVIPGLPPSPICNPGRESLAAVLNPADGGDLYFVADGSGGHVFAASLDAHNRNVARWRKIQRDQAKRE

SEQ ID NO: 45098 - DNA, 999 bp, Ralstonia metallidurans CH34
  CDS (1)..(999)
atgaaacgtctgttcctgcgcctggtcggggttctggtggtcttcgccatggccgccgccggtggctttgcctggtgggcccaccagccactcggcctgaccacatcccccatcgaagtcgtcatcaagccgaattccggcgttctcagcgtgggtcggcagatccagcgcggtggcgtgggcatggatccgcgcctgttccagatcctggtccgcatcaccggccacggcccggacctcaaggccgggggctaccagttcgagacgggcgccacgccgctggacgtgatcggcaaactggcccggggcgaggtcacgcactacgtcgtgaccgtcatcgagggttgggaattccgcaagatgcgcgcggtcgtggatgccaaccctgcgctgaagcacgacacggtgggcatgtccgacgccgatttgatgcacgcgatcggcgcggccgaatccgcgccggaagggctgttctttcccgatacctatctgttcgcgcgcggcagcagcgatatcgaactctacaagcacgcctatcgcgccatgcagcggcggctgaacgaggcctggaacgcacgcgcgcccgacctgccgtacaagacgccgtatgaggcgctggtgatggcatccatcgttgagaaggagacggggcaggcggcggagcgcccgatgatcgcggccgtgttcgtcaaccgtctgcgcaagaacatgatgctgcagaccgatccgaccgtgatctacggcctgggtgagcaattcgacggcaacctgcgcaagagggatttgctgacggacaccccgtacaatacgtacacccgtacgggcctgccgccgacgccgattgccttgccgagtctggcgtcgctggccgcagccacgacgccggcgccatcggacgccttgtatttcgtggcacgcggcgacggcagcagccatttctccaattcactacccgaacacaatcgcgcggtcgacaagtaccagcgcggcaaaccataa

SEQ ID NO: 45099 - protein, 332 aa, Ralstonia metallidurans CH34
MKRLFLRLVGVLVVFAMAAAGGFAWWAHQPLGLTTSPIEVVIKPNSGVLSVGRQIQRGGVGMDPRLFQILVRITGHGPDLKAGGYQFETGATPLDVIGKLARGEVTHYVVTVIEGWEFRKMRAVVDANPALKHDTVGMSDADLMHAIGAAESAPEGLFFPDTYLFARGSSDIELYKHAYRAMQRRLNEAWNARAPDLPYKTPYEALVMASIVEKETGQAAERPMIAAVFVNRLRKNMMLQTDPTVIYGLGEQFDGNLRKRDLLTDTPYNTYTRTGLPPTPIALPSLASLAAATTPAPSDALYFVARGDGSSHFSNSLPEHNRAVDKYQRGKP

SEQ ID NO: 45100 - DNA, 1011 bp, Burkholderia fungorum LB400
  CDS (1)..(1011)
atgtccctgttcaagaaatgtttcattgccggctcactcgtcgtcgtgctggccgcagccgcaattgctggcggataccactgggccaccagcccgctcgaactgaccccggcgcaactggatgtcaccgtcaagccgcatagcagcttgcgcagcgtcacgctgcaactcaatcgcggcggcgtgcccgtcgagcctgaactgtttgtcctgatgacgcggttgctggggctgcaaagcgcgctgaaatcgggcaactacgagttcaagacgggtgtgacgccttacgaggtgctgcagaaaatcgctcgcggcgacgtcaacgaatacgtggcgaccattatcgaaggctggaccttcaagcgcatgcgcgccgagctggatgccaatccggcgctcaaacacgacacggccggcatgagcgacacggatctgatgaacgcgatcaatgcaccggaagcgccgatcggcaatggcgaagggctgttttttccggacacgtacctgttcgacaagaacaccagtgatctcgacgtgtaccgccgcgcctaccgcctgatgcgcgtgcgtctggacgaagcgtggatggcgcgcgcgccgaacctgccgtacagaacgccgtacgacgcgttgacgatggcgtcgatcatcgaaaaggaaaccggcaagacgtcggaccggccgatggtggcggcggtgttcgcgaaccggctgcgcgtgggcatgccgctgcaaaccgatcccaccgtgatctatggcatgggcgacagctacgccggccgtatcagaaaaaaagacctgcagactgacactccctacaatacctacacccggatgggactgccgccaacgcccatctcgctgcccagtgtggcgtcgctgcaggcggcgctgaatccggcgcaaactaccgcgctgtacttcgtttcgcgcggcgacggcagcagtatcttttccgacaccctcggcgatcacaacaaggccgtggacaaatacattcgagggcaatga

SEQ ID NO: 45101 - protein, 336 aa, Burkholderia fungorum LB400
MSLFKKCFIAGSLVVVLAAAAIAGGYHWATSPLELTPAQLDVTVKPHSSLRSVTLQLNRGGVPVEPELFVLMTRLLGLQSALKSGNYEFKTGVTPYEVLQKIARGDVNEYVATIIEGWTFKRMRAELDANPALKHDTAGMSDTDLMNAINAPEAPIGNGEGLFFPDTYLFDKNTSDLDVYRRAYRLMRVRLDEAWMARAPNLPYRTPYDALTMASIIEKETGKTSDRPMVAAVFANRLRVGMPLQTDPTVIYGMGDSYAGRIRKKDLQTDTPYNTYTRMGLPPTPISLPSVASLQAALNPAQTTALYFVSRGDGSSIFSDTLGDHNKAVDKYIRGQ

SEQ ID NO: 45102 - DNA, 1176 bp, Enterococcus faecium
  CDS (1)..(1176)
ttgtcaggaaacaaacaacacccaagtaaagataaaaaagaagccagtaaggcagctacagcagatataatcgacaagcggagaaatctgcgtaaaaaagaagataagattgtgaggaagatcattttagtgattgctcttacattattgattattggcggatttcttggatttaccgtgtatcgttatgtagatagcgggttgaagcctttagataaatcagatgaccaattagtccaagtcgagatcccgagtggctcttctaacaagcagattggtgagattttggagaaggacaatattattaaaagcgggattgttttcaattattatacaaaatttaaaaatttaactggctttcaagctggctattatcagttagcgcctaatatgactcttgacgagattggcaaacagttgcaagaaggcggtacttctgagccaacaaaagttgcagatgggaaaattgccattccagaagggtacgatatcgatcagattgctgaacgggtagcgaaggtaactggtaaagacaagaaagaatttttagatttagtgaatgatgagactttctttaacgagttgcaccaaaaattcccagaactgttggaaagtgcatctaaagctgagaacacaaaataccgtttggaaggttacttattcccagccacatatgattattacacgagtacttcgcttaaggatctagtgattgaaatggtgaacaagacgaatacggtcatgcaaaactattattcagctatcaagcagaaaaatttgactgtacaagaagttttaactctagcttctctagttgaaaaagaaggcgtaaaagaaaatgatcgtaaaaacattgcacaagtcttctttaaccgaatcaaagcaaatatgccacttcagtcagatatctctgttttatacgcattaggtgaacacaaagaattagtgacgtatgaagatacagctgtagattcaccatataatttgtataccaataccggctatggacctggaccttttgacaatccaagcgaagaggcaatcaaggcagtattagaaccagcagaaaatgactattattatttcgtagcagatacgagcactggaaatgtttatttcgctaaaacttatgaagaacatatggaattagtggaaaaatatgtaaataattcttag

SEQ ID NO: 45103 - protein, 391 aa, Enterococcus faecium
MSGNKQHPSKDKKEASKAATADIIDKRRNLRKKEDKIVRKIILVIALTLLIIGGFLGFTVYRYVDSGLKPLDKSDDQLVQVEIPSGSSNKQIGEILEKDNIIKSGIVFNYYTKFKNLTGFQAGYYQLAPNMTLDEIGKQLQEGGTSEPTKVADGKIAIPEGYDIDQIAERVAKVTGKDKKEFLDLVNDETFFNELHQKFPELLESASKAENTKYRLEGYLFPATYDYYTSTSLKDLVIEMVNKTNTVMQNYYSAIKQKNLTVQEVLTLASLVEKEGVKENDRKNIAQVFFNRIKANMPLQSDISVLYALGEHKELVTYEDTAVDSPYNLYTNTGYGPGPFDNPSEEAIKAVLEPAENDYYYFVADTSTGNVYFAKTYEEHMELVEKYVNNS

SEQ ID NO: 45104 - DNA, 939 bp, Magnetococcus sp. MC-1
  CDS (1)..(939)
atgcgctacgaggcttttttgcagcaacaggcacctgtgagcgttgattttgaggtcgtccgtggttggggtgtggcgaagacagccgaacagttagaagcgcggggggttcttgactccgcgcttttttttcgactgctggatcggcaaacgcctggtactgcccttaaagcggggacttttgccattgaggcgggcatgacgcccctgcaaattttagagaagttacgctcctctcaggtggtgcagcgttcgatcacctttcccgaggggatcaccctgatccatattgccgataaatttaggcaggcgggttggccccaggtaggtgatgccttgttgactccagagggggtgcaacgattgggggtggcgcagccctcattggaaggcatgctgtttccagatacctatttttatacgctggaggaagagggttgggtggtggcccagcgcatggcccaacggatgcaacaggtgttgcagcaacagtggcaaaagcgtccagctgaacacccattaagcgcttatgaaagcctgattttagcctcgattgtggaaaaagagaccgctgccgctgccgagcgcccacaaattgctggggtgttttttaaccggctggcgcgtaagatgcgtttgcagagtgaccctaccgtcatctatggcattgccgattatcgggggaacatcacccgcacccatttgcgcacattgaccccctataatacctatatgatccaaggtttaacgccaaccccaatctgtagtcctggtgcggatgccatcaccgcggtgtttcatccgctaaaaagccgtgcgctctattttgtggcccgtggggatggttccggcacccatatgtttgcccagagtgtggcagagcataatcgcaacgtgaaaaaatatctggcgcaactgcgcaaaaaccgcaagccatag

SEQ ID NO: 45105 - protein, 312 aa, Magnetococcus sp. MC-1
MRYEAFLQQQAPVSVDFEVVRGWGVAKTAEQLEARGVLDSALFFRLLDRQTPGTALKAGTFAIEAGMTPLQILEKLRSSQVVQRSITFPEGITLIHIADKFRQAGWPQVGDALLTPEGVQRLGVAQPSLEGMLFPDTYFYTLEEEGWVVAQRMAQRMQQVLQQQWQKRPAEHPLSAYESLILASIVEKETAAAAERPQIAGVFFNRLARKMRLQSDPTVIYGIADYRGNITRTHLRTLTPYNTYMIQGLTPTPICSPGADAITAVFHPLKSRALYFVARGDGSGTHMFAQSVAEHNRNVKKYLAQLRKNRKP

SEQ ID NO: 45106 - DNA, 2058 bp, Thermobifida fusca
  CDS (1)..(2058)
atgaacggcaacgaccactatgacgaccgcccgcgccgcgcacgccggcccgacccgttgacggacccctggccgccgccacgggataccgacgcggcccctaccggggcgagggccgccgactatgagggacgcggataccgggacgagtacggggtagggcaccggcgcggcacggaggtcccccgacaggacggcttcgcatggcagccctcctccgccacgcagaccaccgctcccaccgggggagcggaaccgctggacgggacggaacgcccccgcggacggcggagacggccggggcccgcggacaccggctccttcccgttcccggtgtcggaagccgaagccttgcgtgagcagccgcgcggacggcgccgtagacccgagagcgacgaatccgcccgctgggcccccgagtcggacccgctattcgacggcaggggggcacagcccgcagggccgcggtcggcagaacgctacgaccagccgcccgaccctttgacggcttcggcgtatgcggggcgccgcgccaggtccgcccaccccgcggaatacccgcaagggcggggcaccaccccgctccgcgacgagcagcggcccggtacagcgtggtcggatgatccgctgtggtcccctgccgaccccggcagccgcagagaaaacgacgacatcctggacggccgcacccgacggcggcagccgagcgccgacgaggaccgggacatccccagacgaggccgccgagcccgtcctcccgcttttgacgaagcggacagcgccccgccgcggggacgccgctcccgtaccgtctccccgcagaccggggagacaccgaccgccacggcgagcctaaagacacgcgagaccgatctcgacgacgaagactctgacgcactcccgttcccgttcaccgaggacgaagacgacgaggccccgccccggcgctcccgcaggggccgccacagcggccgacgggctgccggtcgccgagccaagagcagacggcagcggaagaagagcaaagtcgcactcgccagcgccctgatcgtgctgagcctgttcctggtgtccgccgggacaggcggctacctgctcctgcgtacctacatcattcctccggactattccggggaaggcaacggcgaagtcgacatcgtcatcgaggaaggcgactccggaaccgtgatcgcggagaagctgcaccaggccggggtgatcgcgagcgtgcgcgcgttcaccaacgaaatccgcttctccgacatcaacttcgtgcccggcacttaccggatgcggctggggatgagcgcggaggcggcggtcgccctgctgctcgacccggagagccgtatcgcgctgaacgtgactattccggaaggactgcgcgccgagcagatcctggaccggctggctgagcagaccggaatcccccgggaagagttccaggaggcctacgaggaccacgagtcgctggacttgcccgaatacgccactcaagggccggaagggtacctcttccccgagacctacgagttcgaccgcagcgcctctgcgactgagatcctccagcagatggtggcgcagtaccggaaggtcgctgccgagatcgacctggagaaccgggcagcagaggcaggattcgacccgaacgagatcatggcgatcgccgcgatcgtgcaggccgagtccggaaagatcgaggacatggggaaggtcgcccgggtcatctacaaccgcctggacgacggcatgtacctcaagatggacagcacctgcttctacgccctcggcgagtacggcatcgcgatcaaccgggaccagcaggaccggtgccgcaacgacgagaccggatacgacacctacttccacgaaggactcccggtcggccctattgtcagccctggtaaagatgccatcgaagctgcgctcgccccggaggaggggccctggctgttcttcgtgaccaccgacccggagaacggggtcacgaaattcacggacagcgaagccgagttctgggaactggtcaacgagttcaaccagagccagagcggctga

SEQ ID NO: 45107 - protein, 685 aa, Thermobifida fusca
MNGNDHYDDRPRRARRPDPLTDPWPPPRDTDAAPTGARAADYEGRGYRDEYGVGHRRGTEVPRQDGFAWQPSSATQTTAPTGGAEPLDGTERPRGRRRRPGPADTGSFPFPVSEAEALREQPRGRRRRPESDESARWAPESDPLFDGRGAQPAGPRSAERYDQPPDPLTASAYAGRRARSAHPAEYPQGRGTTPLRDEQRPGTAWSDDPLWSPADPGSRRENDDILDGRTRRRQPSADEDRDIPRRGRRARPPAFDEADSAPPRGRRSRTVSPQTGETPTATASLKTRETDLDDEDSDALPFPFTEDEDDEAPPRRSRRGRHSGRRAAGRRAKSRRQRKKSKVALASALIVLSLFLVSAGTGGYLLLRTYIIPPDYSGEGNGEVDIVIEEGDSGTVIAEKLHQAGVIASVRAFTNEIRFSDINFVPGTYRMRLGMSAEAAVALLLDPESRIALNVTIPEGLRAEQILDRLAEQTGIPREEFQEAYEDHESLDLPEYATQGPEGYLFPETYEFDRSASATEILQQMVAQYRKVAAEIDLENRAAEAGFDPNEIMAIAAIVQAESGKIEDMGKVARVIYNRLDDGMYLKMDSTCFYALGEYGIAINRDQQDRCRNDETGYDTYFHEGLPVGPIVSPGKDAIEAALAPEEGPWLFFVTTDPENGVTKFTDSEAEFWELVNEFNQSQSG

SEQ ID NO: 45108 - DNA, 1077 bp, Geobacter metallireducens GS-15
  CDS (1)..(1077)
atggaagagtccataccaccaaaagatacccccggcgaaaccggtgatcagccgccccggcgtttcgtactgaaagatcgccgtattctggcggcgtcggcccttgccctccttctgctcctggtcctccctgcccgctatctattctttctcgccctacctgccggcgacggcaagacagtgcggatcgtcgactttgcgaagggggaatcggtcgccaggatcgccgccgacctcgaacgggacgggattgtctccagtgcccgcatctttgtcatccatacccgtctcaagggagtatcaggaaaactccaggcaggggaataccagttcagcaacggaatgcggcccggggaaatcctccgcatgatgctcaacggtgaggtcgcggtgcgccggttcgccgtccccgaaggatactccatccaccaactggcagaactccttgagagtcagaaactctttagcaaagaagggttcctcaaggctgccaccgaccctgcgctcctgaccgaactggggattgaggggaaaagcgtcgaagggtatctcttcccgagcacctacgatgtgacgcgcaccatggacgaggcagcacttatcagggccatgacggcccagttccacaaggtctgcgatggtcaactcgccgacgctgcgcgccgcatcggcatgaccccctttcaggttgtaaccctcgcctctctcatcgagaaagaggctgtagttgccacggatcgcccactcatctcgtcggtctttcacaaccggcttgccaagggaatgcgcctccagagcgaccccaccgccgtctacggcgtcagggccttcgccagcgccgtcacgaagcaggacatcgagcgccaaacgccctacaacacctatctcattgccgggctcccccccggccccatcggcaatccaagcaagggagcgattgaggccgccctcaacccggtccgcacccgctacctgtacttcgtatcaaagaaagacggcacccatcacttctccaccagcctcgacgagcacaacgccgctgtcgccacctacctgaagacgaaccgtggcaactga

SEQ ID NO: 45109 - protein, 358 aa, Geobacter metallireducens GS-15
MEESIPPKDTPGETGDQPPRRFVLKDRRILAASALALLLLLVLPARYLFFLALPAGDGKTVRIVDFAKGESVARIAADLERDGIVSSARIFVIHTRLKGVSGKLQAGEYQFSNGMRPGEILRMMLNGEVAVRRFAVPEGYSIHQLAELLESQKLFSKEGFLKAATDPALLTELGIEGKSVEGYLFPSTYDVTRTMDEAALIRAMTAQFHKVCDGQLADAARRIGMTPFQVVTLASLIEKEAVVATDRPLISSVFHNRLAKGMRLQSDPTAVYGVRAFASAVTKQDIERQTPYNTYLIAGLPPGPIGNPSKGAIEAALNPVRTRYLYFVSKKDGTHHFSTSLDEHNAAVATYLKTNRGN

SEQ ID NO: 45110 - DNA, 954 bp, Novosphingobium aromaticivorans DSM 12444
  CDS (1)..(954)
ttgccgctgctggcggcggcccttgtcgtgctggtcgtggcggcgtggctcgtcggcggctggttctcgtctggcccgctggaaaagcagctcgaattcgacgtgggcgaaggcgaggggctgagcgcgctttcggacgatctggaggcgcagggcgccatcggttcggccacgctgttcaagctgcgcgcacggctgctgggcggcggcaccgaaatcaagaccggttcgttcctgatccccaagcgcgcgagcgaagctacgatccttgaaatcctcaagggcgacaaggtcatccgccgcctgatcaccatccccgaaggcatgccgtcgatcatggtggccgagcgtctgcgcgccgtggatggcctgaccggcgatgtcgcggtgcccgaggaaggttcggtgctgcccgacagctacgactggcagaagggtgaaagccgcgccgccgtggtcaagcggatgcaggcggcaatggacaagaccctggccgaactctgggcaaagcgatcgccgcgcacggtcgccaagacgccgcaggaggcgctggtgctggcatcgatcgtcgagaaggaaacgggcaagcccgaggagcggcgcatggttgccggcctctactccaatcgcctgcgccagcgcatgctgcttcaggccgacccgacgatcatctatccgatcaccgggggcaagccgctcggccgccgcatccgccagtccgagatccaggcggtgaacggctacaacacctatacgatgatcggcctgcccaagggcccgatcaccaatccggggcgcgattccatcgcggcggtgctcgacccggcggagaccgatgcgctgttcatggtggccgacggtaccggcgggcacgttttcgcgagcacgctgcaggaacacaatgccaatgttgccaagtggttcgccatccgcaaggctcgcggcgagatctga

SEQ ID NO: 45111 - protein, 317 aa, Novosphingobium aromaticivorans DSM 12444
MPLLAAALVVLVVAAWLVGGWFSSGPLEKQLEFDVGEGEGLSALSDDLEAQGAIGSATLFKLRARLLGGGTEIKTGSFLIPKRASEATILEILKGDKVIRRLITIPEGMPSIMVAERLRAVDGLTGDVAVPEEGSVLPDSYDWQKGESRAAVVKRMQAAMDKTLAELWAKRSPRTVAKTPQEALVLASIVEKETGKPEERRMVAGLYSNRLRQRMLLQADPTIIYPITGGKPLGRRIRQSEIQAVNGYNTYTMIGLPKGPITNPGRDSIAAVLDPAETDALFMVADGTGGHVFASTLQEHNANVAKWFAIRKARGEI

SEQ ID NO: 45112 - DNA, 1047 bp, Cytophaga hutchinsonii
  CDS (1)..(1047)
atgagagataaaaaagataccgttaaatatattgtggtttgtacagggattgcatttgtaatgctgtcgtactatgtatatcagattttttttacgccaaacttcggcaataataatgacgccaaagattttgtattatatgtgcgcaaaggcgctacgtttcaggatgtactggacactcttgataaacataacgtctatgaagataaaacatcgtttgccttcatagcaaaaatgttaggatatcaggatcaggtaaaagccggcagatacgtacttcctgttaaaacaacaaaccttcaggttgttcgtaaattacgcagcggtgcacaggatcctataaaagtcaccttcaacagcattcgtttaaaaagtgaatttgcagaacgcatcggcagtaagttttcttttggttcagatacgctgcggaaattattagcagatgaagctgtttgtaaaaaatatggttttgataccagcaccatattagcgatgtttattccgaatacctatgaattttactggaccttatcagcagaaacttttatgaaccgaatgcagaatgagtatacacagttctggacggtgaaaagaaaggaacaggcacaggcagcagggttaacacctatacaagtttctattttagcatccattgttgaagctgaaacaaatatgaatacagagaaaccaaccgtagccggtgtttatatcaataggttaaatatcaatatgccgcttcaggcagatccgactgtaaagtttgccttaggtgatttcagtattaaacgcatcaatcatgatttgattgatgctgcagggaattcaccgtacaatacctatcgggtaacaggtttgccgccgggtccgatcaacatgccttctattacaacgattgataaagtattgaattatgaatcgcacaattatctgttttttgtagcggatccaaagaaacccgggtatcatattttcaatgcggattaccgttcacatgtgaataaagcaaatcaatatcgtaaaagtcttaatacacgaaatattcattaa

SEQ ID NO: 45113 - protein, 348 aa, Cytophaga hutchinsonii
MRDKKDTVKYIVVCTGIAFVMLSYYVYQIFFTPNFGNNNDAKDFVLYVRKGATFQDVLDTLDKHNVYEDKTSFAFIAKMLGYQDQVKAGRYVLPVKTTNLQVVRKLRSGAQDPIKVTFNSIRLKSEFAERIGSKFSFGSDTLRKLLADEAVCKKYGFDTSTILAMFIPNTYEFYWTLSAETFMNRMQNEYTQFWTVKRKEQAQAAGLTPIQVSILASIVEAETNMNTEKPTVAGVYINRLNINMPLQADPTVKFALGDFSIKRINHDLIDAAGNSPYNTYRVTGLPPGPINMPSITTIDKVLNYESHNYLFFVADPKKPGYHIFNADYRSHVNKANQYRKSLNTRNIH

SEQ ID NO: 45114 - DNA, 1092 bp, Cytophaga hutchinsonii
  CDS (1)..(1092)
atggcaaaaaaaagagtcatacccaaaccgaaaactccccggaaaccgattgctaaaaaaagcacacggttttcgatttcggcacagtcgtggctatttttagcaggttttgttgtattatttgccagctggtatataacctttgcttccaataccgcttttcgttcttctgcctattatatttatatcagccggggtacagaaattgaagaactgactgatacgcttgtaaaacgtaacgtaatcaaaaccggtattacattcaaatggatggcatcggtgatgcacctggaaacgctgcgtccgggtatgtaccgcgttgaaaaaggatggggcaattatcagatattatcggttgtagaaaatacggatctgcgttcctcccaactcattgatctggcagaataccgatccaggaaacgtaccattaaagaattgtgtaagcttacaggcattgatgaaaaggagtttcttgaactgctcaaagatgaagatgaagtagatgatctgggcgggttcactacagagtcggtatattgcattttcaggccgggcaggtaccgcatttataaaaacacaacccccaaagaagtactggagtatctggcctgtcaatatacacagctttggaatgaagaacgccgggatgcctgtaaccgcctggatctgacagaagatgaagttgtaattctgtcatcaatcgtttattcagaaacaaaacaacgcagcgaaatgtctaccatcgctggcgtatacatcaatcgcctgcatgataatatgaaactgcaatccgatccgactgtattgtttgcgcatacaagtatggattcccgcagggtttcaaacaaacatttagctattgaatcggattacaatacctatctgaaaaaaggattgccgcctggccctatatgtattgtaccaacctttgtgattgatgaagtcttgaaatatgattcgcacaagtattattatttctgtgcgaaaggagataaatccggctgccacaatttcgccaccaattacaacgaacacatggcgaatgcgaagaaataccggaacggattggataaaaagaaaatatataagtag

SEQ ID NO: 45115 - protein, 363 aa, Cytophaga hutchinsonii
MAKKRVIPKPKTPRKPIAKKSTRFSISAQSWLFLAGFVVLFASWYITFASNTAFRSSAYYIYISRGTEIEELTDTLVKRNVIKTGITFKWMASVMHLETLRPGMYRVEKGWGNYQILSVVENTDLRSSQLIDLAEYRSRKRTIKELCKLTGIDEKEFLELLKDEDEVDDLGGFTTESVYCIFRPGRYRIYKNTTPKEVLEYLACQYTQLWNEERRDACNRLDLTEDEVVILSSIVYSETKQRSEMSTIAGVYINRLHDNMKLQSDPTVLFAHTSMDSRRVSNKHLAIESDYNTYLKKGLPPGPICIVPTFVIDEVLKYDSHKYYYFCAKGDKSGCHNFATNYNEHMANAKKYRNGLDKKKIYK

SEQ ID NO: 45116 - DNA, 1134 bp, Clostridium thermocellum ATCC 27405
  CDS (1)..(1134)
atggtgggaataatgagcggaaacggtgcggcagtatctaaaaacaaaacaaaaaagcgaaaaaacagactcgcgtctttatttttgtactttcttgttttccttattatatttacagtcagcaccttggcttcttatacatacttcataaatgagaaagagatcaattatgaagaagttatggcaaaaatagaccccgaaaacggtattcaggttgaaatcccccggggagccaatacggacgacattgcaaacatcctcagggagcacggagtaataaaatatcctttttggtttaagtttgtttccaaattcaacggctatgacggccgttacaaatcaggaaaacatattgtgaacaaagaccttaaatataaagaaattatggaaatactctgcagcaaccctgttacaaccaccgttaccataatcgagggtaaaaatacggatcaaattgctgatattctaagcgaaaaaaaggttatcgacaaggaggcctttcttgaagcctgcaataccgaaaaatttgattatgaatttttaaaagacattccggaaaatcctcaaagagaaaacaaacttgagggataccttttcccggatacctatttctttgacccaaaagcaggagaacgggcaataattgaaaagtttttagataactttgatgcaaaattcaagccggaattttatgaaagagccaaagagctgaacatgacggtggacgaggtaattattcttgcctccataatagaaagggaaacagctctccccgaagaaaggccaattgtttccagcgtatttcacaacaggctgaagtcttcggaccccaatctaaaaaagcttgaatcctgtgccaccgtacaatatgttttgtacaaaactcagggaaaaatgaaggaaaagttgtccgacgaggatacaaaaatagaccacccgtacaacacatacctttatgaggggcttccgccgggacccatatgctgtcctggtcttgcctccatagaagctgcattgtatccggacgaagaatcagagtatctgtactttgtggcaaaaggagacggaagtcacgaattttcaagaactttggccgaacatttggaagctgttaaaaagtatcaatccaattga

SEQ ID NO: 45117 - protein, 377 aa, Clostridium thermocellum ATCC 27405
MVGIMSGNGAAVSKNKTKKRKNRLASLFLYFLVFLIIFTVSTLASYTYFINEKEINYEEVMAKIDPENGIQVEIPRGANTDDIANILREHGVIKYPFWFKFVSKFNGYDGRYKSGKHIVNKDLKYKEIMEILCSNPVTTTVTIIEGKNTDQIADILSEKKVIDKEAFLEACNTEKFDYEFLKDIPENPQRENKLEGYLFPDTYFFDPKAGERAIIEKFLDNFDAKFKPEFYERAKELNMTVDEVIILASIIERETALPEERPIVSSVFHNRLKSSDPNLKKLESCATVQYVLYKTQGKMKEKLSDEDTKIDHPYNTYLYEGLPPGPICCPGLASIEAALYPDEESEYLYFVAKGDGSHEFSRTLAEHLEAVKKYQSN

SEQ ID NO: 45118 - DNA, 1068 bp, Microbulbifer degradans 2-40
  CDS (1)..(1068)
atgagaaagttaatagtaactctctctttattcttggcttttgtagtggtacttagcggtgccgttggggcgtatttttggcagtggctgaatgcacctattgcttaccaagcgcaatacttgcaaagcgttaataacgtgtatcgcgtagagcgtggtagtaacttaacgcaaatagccaatgtattggcgcgcgagcaaataattgaatggcctaaagtgtgggtgctttatgctcgtgcctctcaaaaaacagcggtaaaagtaggtgaatataaactactggctggtgacacaccgcttgtactattaaaccgcttagtttctggcgatgtagtaagttacagcgttactttaattgaaggcagcacctttaaagactttttaactgcgctacacgcgcaagaaaaattgcaaaaaacacttgcgagaaaaaccacagagcaaattcttgccgatttgaatttagatattcagcacccagaagggtggttcttccctgatacgtacaattatattgcaggggattccgacgcagatattctaaaacgcgcccataaaactatgcgtaaagtgttagacactcagtggcaggcacgcgcgcaaaacctgccttacacacaaccttacgaggccttaataatggcctcgatagttgagaaagaaaccggcgtaccttacgagcgtgacgaaatagcaggggtgtttattcgccgcttacaaaaaagaatgcgtttacaaacagacccaacagtcatttatgggatgggcgaaaactacgcgggcaatattacccgcaaagatttgagaacacctacaccgtacaatacttatgtaattaaagggttgccacccacaccgattgccatgccgggtaaagaggcaatttacgctgcgctgcacccagccgatggcgagcacctgtattttgtggccaaaggcgatggctcgcattatttctcgtcaacattagacgagcacctagctgcagtagcgaaataccaaaagcgtcgaacctctaattaccggtctgcgccgccagtaaatacacctaccaaaaataattag

SEQ ID NO: 45119 - protein, 355 aa, Microbulbifer degradans 2-40
MRKLIVTLSLFLAFVVVLSGAVGAYFWQWLNAPIAYQAQYLQSVNNVYRVERGSNLTQIANVLAREQIIEWPKVWVLYARASQKTAVKVGEYKLLAGDTPLVLLNRLVSGDVVSYSVTLIEGSTFKDFLTALHAQEKLQKTLARKTTEQILADLNLDIQHPEGWFFPDTYNYIAGDSDADILKRAHKTMRKVLDTQWQARAQNLPYTQPYEALIMASIVEKETGVPYERDEIAGVFIRRLQKRMRLQTDPTVIYGMGENYAGNITRKDLRTPTPYNTYVIKGLPPTPIAMPGKEAIYAALHPADGEHLYFVAKGDGSHYFSSTLDEHLAAVAKYQKRRTSNYRSAPPVNTPTKNN

SEQ ID NO: 45120 - DNA, 1185 bp, Pediococcus pentosaceus ATCC 25745
  CDS (1)..(1185)
atgataggagaaatgatcttggataataacaatgattcgaatcaaagacatagtcgtgtacagagtaactataaacgacaaaaaaacggtcacaacattattaaatgggtgattggtatcttagttgctgttgttttaatcactacgtttatgggataccgctattacagcacttccctacaacctttagacgcgaagagcaataaacaaattgaaattaatattccggttggaacaacttcacgaggagtgggctcgatcctagaggataaacatgtcgttaagagtggtgcagtattcaattactacactaagtctaagaaaatcaataacttccaagcaggttattatgttttaaaaccatcgatgactttaaaacaaatcgctaaaaaacttgaaaagggtggagcagcagagccaattgccttgaacggtccacgcgtattaatcaaggaaggcgaaaatattgatcagattgctaattcgatgaaatcttcgaagtactttaagaagtccgatttcttgaaattaatgaaagatgaggactttataaagagtctagctaagcaatatcctaaattactgggatcggcgatgaaggctcaaaacgtgcgctatcgattagaagggtacttattcccagctagttatgcaattgataaaaataccaaactaaaagatgtcattacgcaaatggttgctaaagaggatgctgttttacaaccttattattctaagattaaatcagatggtttaaccgttcaggaaactttgagtgtagcgtcactagttgaaatggaaggtagtaaatctagcgatcgctctaagattgcaggggtcttcttaaatcgtatcaagcaaggtgaaacattaggatctgatgtttcaacacgttatgcagttaaaaaatccgcaacagaagacttaactcaatccgatttagcaagtactaacccatataacactcgggtgaatactggatttatgccaggaccagttgataatcctggtgaagattctattctatccgtggttaatgctgatactaaagacggatatctattcttctttgcagttacaaaaaatgtatctggttcaaaacataaagttggagacgtcttgttctacaaagacattacttcatttaacgaagcagttgcgaagtacaatccagaaggtaaatag

SEQ ID NO: 45121 - protein, 394 aa, Pediococcus pentosaceus ATCC 25745
MIGEMILDNNNDSNQRHSRVQSNYKRQKNGHNIIKWVIGILVAVVLITTFMGYRYYSTSLQPLDAKSNKQIEINIPVGTTSRGVGSILEDKHVVKSGAVFNYYTKSKKINNFQAGYYVLKPSMTLKQIAKKLEKGGAAEPIALNGPRVLIKEGENIDQIANSMKSSKYFKKSDFLKLMKDEDFIKSLAKQYPKLLGSAMKAQNVRYRLEGYLFPASYAIDKNTKLKDVITQMVAKEDAVLQPYYSKIKSDGLTVQETLSVASLVEMEGSKSSDRSKIAGVFLNRIKQGETLGSDVSTRYAVKKSATEDLTQSDLASTNPYNTRVNTGFMPGPVDNPGEDSILSVVNADTKDGYLFFFAVTKNVSGSKHKVGDVLFYKDITSFNEAVAKYNPEGK

SEQ ID NO: 45122 - DNA, 1089 bp, Trichodesmium erythraeum IMS101
  CDS (1)..(1089)
atgaaaaaaagtattaaacttatttccaatcgtgccttattttacttggccattctacctgtaagctgtggtgtttttgcttggcagggttggagttggtggagttgggtaagtagacctgtagtttcaccaacatcctctactcagtcttcacaagctaatgctataagaattaaaattcctgtgggaacttatggtcaacaaataggtgagtatttagaagatgctggtattattcgctctgcaacagcttggaatttatgggtaaaatggttgagtctacaaaatcccaatcttgagtttaaagctggaacttataatttattgcctacagaaccactaagcgcgatcgcagataaaattctacagggagatgtagttaaactcagctatgtcattcgtgaaggatggtcaattcaacaaatggctgcatatttggatgatgaaggtttttttccagctgctgattttattgcagcaacaaaaaatattccctatgataagtttccatggttaccaactaatatacctcatctagagggttatttattcccagatacttataaaatagtagcggataatattactccagaagctattatcaatcaaatgataggacagtttgaacaagtagctttgccagtttatcagaaaaaccagaacaatacaacaaaattgagtcttcatgaatgggtaagtttagcaagtattgtagaaaaggaagctgtagttgcacaagaacgtggtttaatttcgggggtgtttaataaccgtttggaacagggtatgaggttagcagcagacccaacagtagaatatggtcttggtattcgtcaaacgaaagataagcctcttacttatagtcagattgaaactccttcaccttataatacttatatgaatactgggttaccaccaactcctatttctagtccaggtaaggccagtttggaagcaactcttaatccagaagatacagaatatttgtattttatggctcgctatgatggtacccatatttttagtcgtactgctagagaacatgaggctgctattgcagaggtagagagattgttatcatctcagtaa

SEQ ID NO: 45123 - protein, 362 aa, Trichodesmium erythraeum IMS101
MKKSIKLISNRALFYLAILPVSCGVFAWQGWSWWSWVSRPVVSPTSSTQSSQANAIRIKIPVGTYGQQIGEYLEDAGIIRSATAWNLWVKWLSLQNPNLEFKAGTYNLLPTEPLSAIADKILQGDVVKLSYVIREGWSIQQMAAYLDDEGFFPAADFIAATKNIPYDKFPWLPTNIPHLEGYLFPDTYKIVADNITPEAIINQMIGQFEQVALPVYQKNQNNTTKLSLHEWVSLASIVEKEAVVAQERGLISGVFNNRLEQGMRLAADPTVEYGLGIRQTKDKPLTYSQIETPSPYNTYMNTGLPPTPISSPGKASLEATLNPEDTEYLYFMARYDGTHIFSRTAREHEAAIAEVERLLSSQ

SEQ ID NO: 45124 - DNA, 1059 bp, Moorella thermoacetica ATCC 39073
  CDS (1)..(1059)
atgggggaagaactcgaaacaagtcataattacatcatagcctttgaccggccctggcggcaccgggtcacactattacttgctttaacagccctgctggtgggcctgggctggtactttacgacccttctggctcccaggcaccccgggggagcggcaatcgaggtgtctattccgcccggagcgagttcggccaccattgccgccaccctggcggagaagggccttatccgcagccccctggccttccggctggtggccatggcccagggagtggacaggcagttaaagtcgggcagttatttaatttctcccggcctgcccctgccggctataacccgcctgctggccagcggcaacaccctggagatcgagtttaccgttccggaagggtataccgtccgccagattgcgtccctgttgcaacaaaagggactggttaaggaagaggatttcttaaaagccgccgccggggattatcctttttcttttctccagggcctgccttcggggccggaacatgtgcagggttttctcttccccgatacctaccaggtagcgccgggtacgccagcccgggaaattatcatgatgatgctgaaccgctttaaccaggtctaccaggagattgccccgcaaaaggataaagacgtggaattcaatatccgtcagattgtaaccctggcttccatagtcgaaagggaagccaaactcgacaatgaacgcccccttatcgccggggtatttatcaaccgcctccggcggggtatgaggctggaatcctgtgccacggtggaatatctcctgccggcgcccaaaccggtcctttcctaccaggacctgcaaattgattctccttacaacacctaccgggtaaagggcctgcctccaggccccattgccaatccggggcgggcctcactcctggcagtcctaaagccgaatcaaacggattatctctattttgttgccaaaccggacggctcccactacttcagcagcaccctggccgagcataaccaggctacagcccgatacgagtcaggtaacggaaattag

SEQ ID NO: 45125 - protein, 352 aa, Moorella thermoacetica ATCC 39073
MGEELETSHNYIIAFDRPWRHRVTLLLALTALLVGLGWYFTTLLAPRHPGGAAIEVSIPPGASSATIAATLAEKGLIRSPLAFRLVAMAQGVDRQLKSGSYLISPGLPLPAITRLLASGNTLEIEFTVPEGYTVRQIASLLQQKGLVKEEDFLKAAAGDYPFSFLQGLPSGPEHVQGFLFPDTYQVAPGTPAREIIMMMLNRFNQVYQEIAPQKDKDVEFNIRQIVTLASIVEREAKLDNERPLIAGVFINRLRRGMRLESCATVEYLLPAPKPVLSYQDLQIDSPYNTYRVKGLPPGPIANPGRASLLAVLKPNQTDYLYFVAKPDGSHYFSSTLAEHNQATARYESGNGN

SEQ ID NO: 45126 - DNA, 1818 bp, Streptococcus suis 89/1591
  CDS (1)..(1818)
atgacaaaggatacgaatgaaaaaaacacgcagtcttcaggcttccgcgatcaaattttacgagatttggaagaattgaaggtgaaacgtttggcggaacagtcagcggatgttcttgttgataggcgtaatgaagttatcaacgagctccagcctagtcttgccgaagaaaaagccccccatagagagactgaaattgtaaaagtagaaggtattgctttccctgattcatacttgtcagaagaacagcaagaatcagaagtgatgacggaaagtattgaagagccaacatcagaaactttggctactccagagacttttgtgattgaaaaagaagttgtttcaagtccagttccacaagatactgttgaacgaaacttggagaaattaaggaatcttgtggctgctaatacggcaggatttgatgaagtaccatcaagctcgtcagtttctgagccagtagagtctgtccttccgggaaattctcctttagaagatacatttttagaatttccaacggaagacgtgtcagctgtgactggtgatacagaaatcatctcactagaggaaactattattgctccaaagacaacggctattgttccagaagtagacaagcagatgcaggaaacacaacccagaagaagaacaacccacagaacaagcaagcaacgtcgtaaaaaacaagataatgccgctaaacacattgtctctgttatcatgtcgattgttgtagtggcagttctagtgacaggtgttactggttatatgtgggtaaaatctagtctggaaccagtcgatgcaaaagctacagaaactattcaggtagagattccagaaggaacttcaactttagaaattggtaaaattttagttgacaacaagttgattaagaatgctactatttttaattactactctaaaattaagagttataataatttccaaagtggtttttataatttaaaacaaaatatgtctgtggatgacatcgccaaagcacttcaagaaagcggaactccgacagctcaaaaagaagctgcagggaaggttttgattgttgaagggtatacattaacacaaattgctcaggctattacagacaatactaatacaaaagataagaacgataaaacaccatttactgcagaacagtttatggctactgtgaccaaccaagattttattaatcgaatggttgctacttatccaaaactgtttgccagcttaccagctgctgatagtggagttatttatcagttggaaggttacctcttcccagcggtttatgaatacagcgatgaaacaactatcgaagagctcgttgagcaaatgattgccgcgatggataatcgtttacaaccatattatgaaacgattactgctaagaatttgactgtaaatgaagttcttaccttggcatctttggttgaaaaagaaggttctactgatgaagatcgtcgaaacattgcaagtgtcttctttaaccgcttgaatgcagcaatgcctctacaatctaatattgcaatcttgtatgctcagggtaaacttggtcaagaaacaactctagcagaagatgcagcgattgatacatcaattgagtcaccatacaacatttattggacaccaggattgatgcctggaccagtggatagtccaagcctttcggctatcgaggcagtgattaatgccaacacaacagactatctttattttgtagcagatgttacaactggaaatgtttactttacaaataatattgatgaacataaccaaaacgttgctaagtatgtaaatgcacatcttaataatgagtaa

SEQ ID NO: 45127 - protein, 605 aa, Streptococcus suis 89/1591
MTKDTNEKNTQSSGFRDQILRDLEELKVKRLAEQSADVLVDRRNEVINELQPSLAEEKAPHRETEIVKVEGIAFPDSYLSEEQQESEVMTESIEEPTSETLATPETFVIEKEVVSSPVPQDTVERNLEKLRNLVAANTAGFDEVPSSSSVSEPVESVLPGNSPLEDTFLEFPTEDVSAVTGDTEIISLEETIIAPKTTAIVPEVDKQMQETQPRRRTTHRTSKQRRKKQDNAAKHIVSVIMSIVVVAVLVTGVTGYMWVKSSLEPVDAKATETIQVEIPEGTSTLEIGKILVDNKLIKNATIFNYYSKIKSYNNFQSGFYNLKQNMSVDDIAKALQESGTPTAQKEAAGKVLIVEGYTLTQIAQAITDNTNTKDKNDKTPFTAEQFMATVTNQDFINRMVATYPKLFASLPAADSGVIYQLEGYLFPAVYEYSDETTIEELVEQMIAAMDNRLQPYYETITAKNLTVNEVLTLASLVEKEGSTDEDRRNIASVFFNRLNAAMPLQSNIAILYAQGKLGQETTLAEDAAIDTSIESPYNIYWTPGLMPGPVDSPSLSAIEAVINANTTDYLYFVADVTTGNVYFTNNIDEHNQNVAKYVNAHLNNE

SEQ ID NO: 45128 - DNA, 969 bp, Thiobacillus denitrificans ATCC 25259
  CDS (1)..(969)
ttgctcggattcggcacgctggcggcagtgctgctcgcggcggggcttgcctggtatgcgacgcggccgctcgtcataacgcccttgccgaaaacggtcaacgtcgcgcccggcatgcacctcaagagcctgagcgtgatgctcgaacgggaaggcgtcgtcggcgacgcgcgggtgttctggctgctcggtcgcgtgctcggcaaggccgggacgctcaaggtcggcgtctacacgctggacaagccgctcacaccgatcgagctctacggcaagatcgagcgcggcgacgtctcgcaggcgatggtgcagttcatcgagggacggagctggcgcgaaatacggacggtgctcgcgtcgcaaccgctcctgaagaacgagagcgcaggcatgagcgacacacaggtgttgcgcgcaatcggcgcgagcgaggcataccccgagggcctgttctttcccgacacctatttctacgcgccgcacacgtccgatctcaacgtgctgcgccgcgcatatcgcctgcagcgtgaaaaactcacgagcgcatggcaggcgcgcgcgccggggctaccctacgaaaccccctatgaggccctgatcatggcgtcgatcgtggagaaggaaaccggcgccgcgttcgagcgcccgatgatcgcgggcgtgttcctcaaccggctcaagctcggcatgcggctgcaaaccgatccgaccgtgatttacggtctaggcgaacgcttcgacggcaatttgcgcaaagtcgatcttcttgccgacacgccgtacaacacctatacccgaaccgggctgccgcccacaccgatcgcgatgccgagcgcggaggcgatccgcgcggcgttgaacccggcgcagaccgatgcgctctatttcgtctcgcgcggcgacggcacccacgtcttttcgagcgacctcgcggcacacaaccgcgccgtccgccgctaccagaaatga

SEQ ID NO: 45129 - protein, 322 aa, Thiobacillus denitrificans ATCC 25259
MLGFGTLAAVLLAAGLAWYATRPLVITPLPKTVNVAPGMHLKSLSVMLEREGVVGDARVFWLLGRVLGKAGTLKVGVYTLDKPLTPIELYGKIERGDVSQAMVQFIEGRSWREIRTVLASQPLLKNESAGMSDTQVLRAIGASEAYPEGLFFPDTYFYAPHTSDLNVLRRAYRLQREKLTSAWQARAPGLPYETPYEALIMASIVEKETGAAFERPMIAGVFLNRLKLGMRLQTDPTVIYGLGERFDGNLRKVDLLADTPYNTYTRTGLPPTPIAMPSAEAIRAALNPAQTDALYFVSRGDGTHVFSSDLAAHNRAVRRYQK

SEQ ID NO: 45130 - DNA, 1155 bp, Silicibacter sp. TM1040
  CDS (1)..(1155)
atgtggcgcagtctggcctcgaacatgctgacgatcctgatcgtcggcctgtttctcttcgcgggggtgatcctgtggggcaagaatgaatacaccgccgagggccccctgtccgaagcgatctgttttcaggtgccctcggggaccaatatggcacgggtgtcgcgccgtcttgaaagcgacggcgtggtctcgagcggcaccatctttcgcatcggggtgaaatattccgacaaggcgcaggacctcaaggcaggcagctaccttgtggagcccggcgcttcgatggaagggatcgtggatcagatcacccggggcggggcctccacctgtggcaccgagatcgtctatcgcgttggcgtgacccgcgtgctggccgaggtgcgcgagctggacccggcgaccaacgcctttgtggaacgtgctgaatttgtccccggcgtggatgagacccccgcggtctataccgagaaaaaatccgaggctgacacgcgctaccgtattgcactggcagaaggcgtgaccagctggcaggtggtcgagtccctgaaggcgatggacattctcgagggggagccgggccgccgtccgccggagggcagccttgcgcccgacagctacgaggtccgccccggaacctcgcgcgaggcggtgctggccgagatgcaggcgcggcaagacaggcggatcgcggacgcctgggaagcccgtagccccgatgcggctgtcaaaaccccagaggaaatgctgatcctcgcctcgatcatcgagaaggaaaccggcgttgctgaggaacgcggtgtggtggcctctgtcttcaccaaccgcctgcggcgcggcatgcgccttcagaccgaccccacggtgatctatggtgtgaccaagggagagggcgttctgggccggggcctacggcagagcgagctgcgcggcgcaacgccgtggaacacgtatgtgatcgaaggtcttccaccaacacccatcgccaatcccgggcttgaaagcctggtggcggcagtgaacccggatcagactgactatgtgttctttgtggccgatggcaccggcggccatgcttttgccgaaacgctcgaagagcacaatcgcaacgtcgcgaaatggcgaaagatcgaagccgagcgcaacaacaactga

SEQ ID NO: 45131 - protein, 384 aa, Silicibacter sp. TM1040
MWRSLASNMLTILIVGLFLFAGVILWGKNEYTAEGPLSEAICFQVPSGTNMARVSRRLESDGVVSSGTIFRIGVKYSDKAQDLKAGSYLVEPGASMEGIVDQITRGGASTCGTEIVYRVGVTRVLAEVRELDPATNAFVERAEFVPGVDETPAVYTEKKSEADTRYRIALAEGVTSWQVVESLKAMDILEGEPGRRPPEGSLAPDSYEVRPGTSREAVLAEMQARQDRRIADAWEARSPDAAVKTPEEMLILASIIEKETGVAEERGVVASVFTNRLRRGMRLQTDPTVIYGVTKGEGVLGRGLRQSELRGATPWNTYVIEGLPPTPIANPGLESLVAAVNPDQTDYVFFVADGTGGHAFAETLEEHNRNVAKWRKIEAERNNN

SEQ ID NO: 45132 - DNA, 1050 bp, Rickettsia akari str. Hartford
  CDS (1)..(1050)
atggtaacaatatttctaagtcttataaaaataatagttattatgttaataaacttattaaaaactaaactttttttagttatagtatctctaactatatttattactatgctaaattttagtatattttatatttttgtgcctggtaatttgactcaaaatatcacgataactattgaacctaaattatccgtaaatcaaatagttacaaaactttattctaatggagtcataaaatatccaagaatttttaaggtaattgctaaaatttattctataaaaagacctcttaaaagcggtgaatatgtatttacacgtaatatatcgcctttgcaaactttaagaatattagcaagcggtaaatctatcatacacaagataattgtcccggaaggtacggtagttagtgaggttataaagaaaattaatgaagaaagtcgattacttggagaaataaaagggataatacctgaaggttttttaatgccatcaacgtattttttctcttatggagatcaaaaagagcagataatcgatcaaatgagaaatttaatgtctgctaatttagataaggtaatgcaaaatctttcgccgaattctccgttaaaaactagacttgatgtattaactctagcttcgataattgaaaaagaagccggatcaaatgcagaaaagcctataatagctgcagtattcattaatcgtttaaagaaaaatatgaagttacaagccgatccgactactatatatgctttgactgaaggaaaatttaaattagcaagagctttaacaaaaaaagacttattgcaagaactaccatataatacttattatataaaaggtttaccgccaggtccgatttcgtgtccgtcgctaaaatctttagaagcagtggtaaaacctgctaaaacggatgcattattttttgtagttgatggtaaaggcgggcataatttttctaacaatcttaatgatcataatagatttgttgaaacttatagaaaaagtttgattaaaatgcctgagccggaaattgatcttgacaaatag

SEQ ID NO: 45133 - protein, 349 aa, Rickettsia akari str. Hartford
MVTIFLSLIKIIVIMLINLLKTKLFLVIVSLTIFITMLNFSIFYIFVPGNLTQNITITIEPKLSVNQIVTKLYSNGVIKYPRIFKVIAKIYSIKRPLKSGEYVFTRNISPLQTLRILASGKSIIHKIIVPEGTVVSEVIKKINEESRLLGEIKGIIPEGFLMPSTYFFSYGDQKEQIIDQMRNLMSANLDKVMQNLSPNSPLKTRLDVLTLASIIEKEAGSNAEKPIIAAVFINRLKKNMKLQADPTTIYALTEGKFKLARALTKKDLLQELPYNTYYIKGLPPGPISCPSLKSLEAVVKPAKTDALFFVVDGKGGHNFSNNLNDHNRFVETYRKSLIKMPEPEIDLDK

SEQ ID NO: 45134 - DNA, 996 bp, Dechloromonas aromatica RCB
  CDS (1)..(996)
atgcgcaccctgaccaagattcttttcgctgtttttgtgttgttcgcgatcgcggctggcgggctgtggtggtgggcaaatcagccattgtcgctgcgctcttcaccgctcgattttcgtattgcggccggtagcagcctgcgttcggcgattacccagatgcgggagtcgggtattgaggtcgagcctggcttgctcgccttcctggcacggcttaaccgggccgatacggccatcaaggcaggtagctatgcggtcaaggatggggtaaccccgatccgcctgctggataaattgctcaagggcaaagttacgcaaggtgaactgaccctggttgaaggctggacttttcggcaatggcgagcccgtctggataaacatccggatctgaagcacgaattgcttggcttgagcgaagcggaaatcatcgaaaagctgggtttgagcgttgcaggactggaagggcagttgttcccggatacttatctgttcgacaaacaatccagcgatctcgaactgctcgcgcgggcccagcgggccatgcagcgcaaactggatgcggaatgggcaggccgcgccgccggtcttccctacaaaacttcgaatgacgcgctgatcatggcatccatcgtcgagaaagaaaccgggcgcgaatcggatcgagagctcgttgccgcagtcttcgtcaatcgcttgcgcaaagggatgttgctgcagactgatccgactgtgatctacggcattggcgagaaatttgatggcaatctgagaaagcgcgacctgctcacggacaccccgtacaatacctacacccgtcctggcttgccgccaacgccgatcgcgatgccggggcaggcttccatcagggcggcgctgaatccggcgcccagcgacgtcatctatttcgtggctcgaggcgatggcagcagtgaattttcccggaccctggacgaacacaaccgggcggttaacaaatatcagagaggtgggaagtga

SEQ ID NO: 45135 - protein, 331 aa, Dechloromonas aromatica RCB
MRTLTKILFAVFVLFAIAAGGLWWWANQPLSLRSSPLDFRIAAGSSLRSAITQMRESGIEVEPGLLAFLARLNRADTAIKAGSYAVKDGVTPIRLLDKLLKGKVTQGELTLVEGWTFRQWRARLDKHPDLKHELLGLSEAEIIEKLGLSVAGLEGQLFPDTYLFDKQSSDLELLARAQRAMQRKLDAEWAGRAAGLPYKTSNDALIMASIVEKETGRESDRELVAAVFVNRLRKGMLLQTDPTVIYGIGEKFDGNLRKRDLLTDTPYNTYTRPGLPPTPIAMPGQASIRAALNPAPSDVIYFVARGDGSSEFSRTLDEHNRAVNKYQRGGK

SEQ ID NO: 45136 - DNA, 1044 bp, Haemophilus influenzae R2866
  CDS (1)..(1044)
atgaagaaatttttaattgcgattttacttttaattttgattttagcgggcgtggctagttttggttattacaaaatgactgaatttgtaaaaacaccagtaaatgcgctggcagatcaacttttaaccattgaacgtggcacaacaggttcaaaattagccgcactttttgagcaagaaaaattaattgatgatgggaaattattaccttatttgcttaaattgaaacccgagctaaataaaataaaagcagggacttattctcttgagaacgttaaaactgtgcaagatttgttggatttgcttaattcaggtaaggaagtgcagttcaatgtaaaatggattgaaggaaaaaccttcaaggattggcgaaaagatcttgaaaatgcaccgcacttagtacaaaccttgaaagataagagtaacgaagaaattttcgcattacttgatttgccagatgttggtcaaaatctcaagctaaaaaatgtggaaggttggctttatcctgatacttacaattacactccgaaatctacggatttggacttgttgaaacgctcagcagagagaatgaaaaaggcgttaaataaggcttggaacgagcgtgacgaggatttacctttagccaatccttatgaaatgttgattctggcgtctatcgtagaaaaagaaacgggcgtggctgctgagcgagcaaaagtggcgtctgtatttctcaaccgcttaaaagcaaaaatgaaattacaaacggatccaacggtaatttatggtatgggtgagaattacagcggtaatattcgtaaaaaagatttagaaatgccaacgccttataatacgtatgtgattgatggtttaccaccaacacctatcgctatgccaagtgaaagttcgttacaggctgttgcgcatccagaaaaaacagatttttattattttgtggcagatggttctggtgggcataaatttacccgaaatttgaatgaacataataaagcggtacaagaatatttacgttggtatcgcagccagaaaaatgccaaataa

SEQ ID NO: 45137 - protein, 347 aa, Haemophilus influenzae R2866
MKKFLIAILLLILILAGVASFGYYKMTEFVKTPVNALADQLLTIERGTTGSKLAALFEQEKLIDDGKLLPYLLKLKPELNKIKAGTYSLENVKTVQDLLDLLNSGKEVQFNVKWIEGKTFKDWRKDLENAPHLVQTLKDKSNEEIFALLDLPDVGQNLKLKNVEGWLYPDTYNYTPKSTDLDLLKRSAERMKKALNKAWNERDEDLPLANPYEMLILASIVEKETGVAAERAKVASVFLNRLKAKMKLQTDPTVIYGMGENYSGNIRKKDLEMPTPYNTYVIDGLPPTPIAMPSESSLQAVAHPEKTDFYYFVADGSGGHKFTRNLNEHNKAVQEYLRWYRSQKNAK

SEQ ID NO: 45138 - DNA, 942 bp, Methylobacillus flagellatus KT
  CDS (1)..(942)
atggcttactttgtgaccacgcccttgcagttccctacggagacggtcgaattggatttgcgcatgggcagcagcctgcgcactatttccgatcaattggtagcccaaggcgtgctcaaggaaccatggagcttcattctattggttagggccatgaagatggctggtggcatcaaggctggtaactatttactggagtctggccagacaccctacgagctgttcattaccctaagcaatggtaatgtgactcaggacagcattactttcatcgaagggtggacgtttgcgcaaatgcgccaagcattgaatcagcatgaatccgtgcgccatctcaccatggcttataccgacgaagaaatcatgcgcaatatcggtgcaactgagaccgtacccgaagggatgttctttccggacacttatttcttcagcaagggcatgagcgatcaggatattctcaaacgggcctatgctgcgatgcaaaatcgcctcaaggcggcgtgggagcagcgtgcaccagggctaccctacaattcgccttatgaagcattgatcatggcctcgatcgtggagaaagaaacaggaaaggcaagtgagaggcccattatcgccggtgtctttctcaatcgcctgcgtataggcatgcgcctgcagaccgaccccacggtgatctatggcatgggggaagcattcgacggcaacctgcgcaagcgtgaccttcagcgcgatacgcctttcaacacctatacgcgggccggcctgcctcccacgcccattgccatgccgggtatggcggccattaatgcggcgctgcacccagccaagaccgatgctctgtatttcgttggcaagggagacggtagtcaccaattctcccgcacgcttagcgagcacaaccgagcggtcgtacggtatcaactgaaaggcggcaatgcgcggtag

SEQ ID NO: 45139 - protein, 313 aa, Methylobacillus flagellatus KT
MAYFVTTPLQFPTETVELDLRMGSSLRTISDQLVAQGVLKEPWSFILLVRAMKMAGGIKAGNYLLESGQTPYELFITLSNGNVTQDSITFIEGWTFAQMRQALNQHESVRHLTMAYTDEEIMRNIGATETVPEGMFFPDTYFFSKGMSDQDILKRAYAAMQNRLKAAWEQRAPGLPYNSPYEALIMASIVEKETGKASERPIIAGVFLNRLRIGMRLQTDPTVIYGMGEAFDGNLRKRDLQRDTPFNTYTRAGLPPTPIAMPGMAAINAALHPAKTDALYFVGKGDGSHQFSRTLSEHNRAVVRYQLKGGNAR

SEQ ID NO: 45140 - DNA, 1071 bp, Chloroflexus aurantiacus
  CDS (1)..(1071)
atgcggcatgtccgcgcacttctgttaggtctttcattgctggctctggtagtctcgtgtggaggatacatctttctcggtgaattgcgcgcaaccccggcgactaccggcgaaccggttgagttcattgttgaacccggtgaaactgctgacgatattgccacccggctgggtgaagccggtctgatccgtcaaccggcgctgtttcgtttgctggtacgctggcgtaatcttgatcagcagattcaggccggacgctacattctcagcccgacgatgaccatgagcgatattttgaaggtgttgcagagtggtcaggtggtgaatgacattcaaatcacgattccggaaggattgcggctcgaggaaatagcggccatcatcgcagcggcaggcctggtcagcgaagatgaatttctggcggttgcccgtgatggcgagcgcttccgtgccgattacttcttgcttaatagtctgccggcgggtgcgaccctcgaagggtacctcttcccagacacctaccgttttgcgccatcggcagatgctgaaacgattgtgcgcaaactactcgaccggtttgtcgagcagtacagtaccatcgaacgctcggtacgggttcccggcgttactgtccatcaaatcgtaacgatggcttcaatcatccagcgtgaagctgccttgttgagtgaaatgcctcaaatcagtgcagtattctggaatcggctcaagccccagtatgccccactttttggcggtggcctgctcggtgctgatgcaactgtacagtatgccttgggatacgatcccattgaaggaacctggtggcagcgcgaactgacggttgacgagctggcggtgcaaagtccgtacaatacgcgagttacgcccggcctgcccccagggccaattgcggctcctggcctggctgcactgacggcggctgcccagcccgatgagacatcaccgtatctcttcttcgtcgccagttgtgagcgcgatggttcgcataagttcgctactactatcgaagaatttcgtgtctatgaagcggagtggctggcgtgtcagtag

SEQ ID NO: 45141 - protein, 356 aa, Chloroflexus aurantiacus
MRHVRALLLGLSLLALVVSCGGYIFLGELRATPATTGEPVEFIVEPGETADDIATRLGEAGLIRQPALFRLLVRWRNLDQQIQAGRYILSPTMTMSDILKVLQSGQVVNDIQITIPEGLRLEEIAAIIAAAGLVSEDEFLAVARDGERFRADYFLLNSLPAGATLEGYLFPDTYRFAPSADAETIVRKLLDRFVEQYSTIERSVRVPGVTVHQIVTMASIIQREAALLSEMPQISAVFWNRLKPQYAPLFGGGLLGADATVQYALGYDPIEGTWWQRELTVDELAVQSPYNTRVTPGLPPGPIAAPGLAALTAAAQPDETSPYLFFVASCERDGSHKFATTIEEFRVYEAEWLACQ

SEQ ID NO: 45142 - DNA, 987 bp, Polaromonas sp. JS666
  CDS (1)..(987)
ttgctgattttggtatttgccggcgccctgctgttgtttggtgcggctttgtggtggctgcatgaaccgattccgttgcggcttgtccccggcacccaggtgctggacctcgaaatcgagccgggcacacccgccagtggtgttgcgcaggtggtagtggacagcggcgcccaggtgcctgtggtgctgctgcatgcgtggttccgtttctcggggcaggcccggcagatcaaggccggcagctatgagctggtgccgggtaccacacctcgccgattgctgagcatgctggtgcgcggcgaggaaacgctcaaaagcgtcacgctggttgagggctggactttcgcccaggttcgtacagcgctgcaaaaagcagagaatctggcgcccgatacgctcggggttggcccggaagccatcatggaacagctgggccggccgggcctgcacccggaaggccggttttttccggacacctatacctacgccaagggggccagcgacctgtccgtgctcaagcgcgccgcccgcgcgatggacaagcggctggaagccgcctgggctcaacgcaacgcggacacaccactcaaaacaccggcggaggccctgatcctggcaagcattgtggagaaagaaaccgggaaaccttcggatcgtccccagatcggcggcgtcttcaccaatcgcctgcgcctgggcatgatgctgcagaccgatcccaccgtgatttatggcctgggcccgcaatttgacggcaacctgcgcaagcgcgacctgctgacggatggcccttacaacacctatacccgggctggcttgcctcccacgcccatcgccatgcctggcaaagccgccttgctggccgcagtgcacccggcggcgaccccggcgatttattttgttgcccggggcgacggcagcagccatttcagcgccagcctggacgagcacaaccgtgccgtcaataaatatatccggggtcaataa

SEQ ID NO: 45143 - protein, 328 aa, Polaromonas sp. JS666
MLILVFAGALLLFGAALWWLHEPIPLRLVPGTQVLDLEIEPGTPASGVAQVVVDSGAQVPVVLLHAWFRFSGQARQIKAGSYELVPGTTPRRLLSMLVRGEETLKSVTLVEGWTFAQVRTALQKAENLAPDTLGVGPEAIMEQLGRPGLHPEGRFFPDTYTYAKGASDLSVLKRAARAMDKRLEAAWAQRNADTPLKTPAEALILASIVEKETGKPSDRPQIGGVFTNRLRLGMMLQTDPTVIYGLGPQFDGNLRKRDLLTDGPYNTYTRAGLPPTPIAMPGKAALLAAVHPAATPAIYFVARGDGSSHFSASLDEHNRAVNKYIRGQ

SEQ ID NO: 45144 - DNA, 1575 bp, Streptococcus pyogenes M49 591
  CDS (1)..(1575)
ttggctttgaccgattttaaggataaagaccaacaagatcagcagcgaagctttaaagagcagattcttgctgagttggaaaaagcaaatcaaatcagaaaagaaaaagaggaagaactttttcaaaaagagttggaagctaaagaagcagctaggagaacagcccagctatatgctgaatataaaagacaagatgcttttcaaaaagagtctatagcacataacaataagacagccaaacactttcaagctataaaagatgcggtaatgacttcagaagcgcttaaaccgactttactttctgaaaaagaaaactcatctttaaaaacgacaaataagagagtcgtgcaggcaaatgagcttcaagagactgcctctaaagaatctcaagtaccgttaactattgagaaaggtcattcagtgagacgaaaattaagcaaacgccaacagactgagcgagctgctaaaaagatttcaaccgttttgattagctctattatgataacccttttggctgttactctagcaggagcaggctatgtttatagtgctttaaatcctgttgataaaaatagtgatgcctttgttcaagttgagattccatctgggtcaggcaataaattgattggtcaaattcttcaaaaaaaaggtttaatcaagaatagcactgtttttagtttttatacaaaatttaaaaactttacaaattttcagagcgggtattacaatctgcaaaaaagtatgagtctagaagaaattgctagtgctttacaagaaggtggtacagcagaacctaccaagccatctcttgggaagatcttgattccagaaggatacacgattaaacaaatagctaaagctgttgagcataatagcaagggaaagaccaaaaaagctaaaacaccttttaacgagaaggattttttggatttagtcacagatgaggcttttattcaagatatggtaaaaagatatccaaaattattagcaactatcccagctaaagaaaaagctatttaccgtttggaaggttaccttttcccagcaacctataactattacaaagaaactaccatgagagaacttgtagaggacatgctggcagctatggatgctactttggtaccctattatgataaaattgctgttagtggtaagacagtcaacgaggtattgaccttggcctctttggttgaaaaagaaggttcaacagacgatgacagacgtcaaattgcaagtgtcttttataaccgccttaatagcggaatggcactacaatctaatatagctattttgtatgcgatggggaaacttggtgagaaaacaaccttggctgaggatgctactattgacaccaccattaattctccttataatatttataccaatacaggcctgatgcctggtccagttgctagctcaggggtttctgcaattgaagcaaccctaaatccagcctcaacggattatttatactttgtggccaatgtccatactggtgaagtttactatgcaaaaacatttgaagagcactctgcaaatgttgaaaaatatgtgaatagtcaaattcagtaa

SEQ ID NO: 45145 - protein, 524 aa, Streptococcus pyogenes M49 591
MALTDFKDKDQQDQQRSFKEQILAELEKANQIRKEKEEELFQKELEAKEAARRTAQLYAEYKRQDAFQKESIAHNNKTAKHFQAIKDAVMTSEALKPTLLSEKENSSLKTTNKRVVQANELQETASKESQVPLTIEKGHSVRRKLSKRQQTERAAKKISTVLISSIMITLLAVTLAGAGYVYSALNPVDKNSDAFVQVEIPSGSGNKLIGQILQKKGLIKNSTVFSFYTKFKNFTNFQSGYYNLQKSMSLEEIASALQEGGTAEPTKPSLGKILIPEGYTIKQIAKAVEHNSKGKTKKAKTPFNEKDFLDLVTDEAFIQDMVKRYPKLLATIPAKEKAIYRLEGYLFPATYNYYKETTMRELVEDMLAAMDATLVPYYDKIAVSGKTVNEVLTLASLVEKEGSTDDDRRQIASVFYNRLNSGMALQSNIAILYAMGKLGEKTTLAEDATIDTTINSPYNIYTNTGLMPGPVASSGVSAIEATLNPASTDYLYFVANVHTGEVYYAKTFEEHSANVEKYVNSQIQ

SEQ ID NO: 45146 - DNA, 1002 bp, Campylobacter coli RM2228
  CDS (1)..(1002)
atgagaataccattcttaagaactaaaaatacaactgagataaatacaattaaaacaagtaatgcatatacaattttctttttcattagaaacttctttttgatatttattttaggaattttttattatttaacacaacctttaaaaagcaattctgttgtttttttgcctcaaggttccattgctcaaattataacacatctaaaacaaaataaatatgaaatgagcacgattgataaatatatcttatttttcttgggtcatcctcaatcaggctggataaatataggcacaaaagaactcaatagaatagaatttttacacaaactcaccatagctaaagcagcattagaaacccttactctcatccctggagaaaccagtgtgatttttttagagcaagctgcaaaacaattagaacttgataaaaacacgcttttagccgaatttgaaaaacaagctacatataaagaaggggtttttcttcctgaaacttacaaaattccaaaaggaatcacagaagcacttttggttcaagttttgctcaaacatgcagaaaattcaaatagaaaaacttcggagaaaatttttggcgaatacaatgccaaaaaatggcaccaatacatcataacagcatcagtcattcaaaaagaagcggctaatgaaagcgaaatgcctatagttgcaagcgttatttataaccgtataaaaaaaggtatgaagctccaaatggatggaaccttaaactatggattttattctcatacaaaaatcactcctcaaagaataagagaagataatagctcttataatacttataaatttgaaggtttgcctaaagaagcagtttgtaatgtctctttatccgcaattcgtgctgctatctttcctgcaaaaactgattatttatattttgtaagagataaaaccacaggggcgcatatttttagcaccaatctcaatgatcataataaagccattcaatcacaaaaaaacaaataa

SEQ ID NO: 45147 - protein, 333 aa, Campylobacter coli RM2228
MRIPFLRTKNTTEINTIKTSNAYTIFFFIRNFFLIFILGIFYYLTQPLKSNSVVFLPQGSIAQIITHLKQNKYEMSTIDKYILFFLGHPQSGWINIGTKELNRIEFLHKLTIAKAALETLTLIPGETSVIFLEQAAKQLELDKNTLLAEFEKQATYKEGVFLPETYKIPKGITEALLVQVLLKHAENSNRKTSEKIFGEYNAKKWHQYIITASVIQKEAANESEMPIVASVIYNRIKKGMKLQMDGTLNYGFYSHTKITPQRIREDNSSYNTYKFEGLPKEAVCNVSLSAIRAAIFPAKTDYLYFVRDKTTGAHIFSTNLNDHNKAIQSQKNK

SEQ ID NO: 45148 - DNA, 954 bp, Campylobacter lari RM2100
  CDS (1)..(954)
atgaaaagtatcataggtaatgctaaaaatttaagaatttttttaatatgttgtgatttaattttaatttttcttttatccattttttattatctacttttacctataaaaacaaactctgtagtttttataccacaaggttctgttagcaagattataacgcaattagataaaaataactataaaatgagcagtattgataaatatactttatatttcttaggtcatccacagtctggctggataaatataggtacaaaagaattaaatagagctgaatttttacataaacttaccgttgctaaagcagcacttgaaactattactttaattcccggagaaacgactgaaattttctttgaagaattagcgccaaagttaaatttaaataccaaaaccttaatgcgagaattttacaaacaaagcccttttaaagaaggtatgctttttcctgaaacttataaaattccaaaaggtatcacagaagaacttttagtgaaatatcttttggcttattctgcaagtgaatttaaaaaactttcttataaaatttttagagaatataatgaaaaaaaatggcatgagtatatcatcatagcttccattatacaaaaagaagcagcaagtaatgaagaaatgcctatagtatcttcagttattagaaatcgcttaagaaaaggcatgaagcttcaaatggatgggacgctaaattatggaaaatactctcatgaaaaaatcactccacaaagaataagatcagataatagctcttataatacttataaatttagtggaattccaaaagaagctgtctgtaatgtttcatttgaagctatcaaggcagctatttttcctgcaaagacagattatttatactttgtaagagataaaaaaactaataagcatatttttacctctactttaaaagatcacaacaaggcaataagaaattaa

SEQ ID NO: 45149 - protein, 317 aa, Campylobacter lari RM2100
MKSIIGNAKNLRIFLICCDLILIFLLSIFYYLLLPIKTNSVVFIPQGSVSKIITQLDKNNYKMSSIDKYTLYFLGHPQSGWINIGTKELNRAEFLHKLTVAKAALETITLIPGETTEIFFEELAPKLNLNTKTLMREFYKQSPFKEGMLFPETYKIPKGITEELLVKYLLAYSASEFKKLSYKIFREYNEKKWHEYIIIASIIQKEAASNEEMPIVSSVIRNRLRKGMKLQMDGTLNYGKYSHEKITPQRIRSDNSSYNTYKFSGIPKEAVCNVSFEAIKAAIFPAKTDYLYFVRDKKTNKHIFTSTLKDHNKAIRN

SEQ ID NO: 45150 - DNA, 1080 bp, Xanthomonas albilineans
  CDS (1)..(1080)
atgcgcttcgaggtggtcgtgaccagggctaaacgcgggggtctgatgctggtggcggcggtgctggcgcttgcgctgctgctcgcagcggccggtgcatggtggtggcagagctatcgcgctttcaccgaccgcccgctgcaggcggctcagccaagcgtggaggtggcgcgtggtgcttcgttcaatagcgtgctgcgcaggttgcgcgatgctggcgtcaaccagggcagcgacttgcaatggcaggtgctggcgcgcgaactcggcgtcgccggcaagctcaggttcggcgaatacgcgctacagccgccacttagcccgcgcgccttgctgctgcggatgcgcaaggggcaggtgatccaatatcgcttcaccatcgtcgaaggctggagcctgcgccaactgcgcgcggcgctgaatgcggccacgccactgcgtcatatcaccgccgatctcggcgacaacgacctgatggccaaactcgcccagcctggtcaagctgcggaaggccgttttctgcccgagacctatctctaccagcgcggcgacagcgatctggatctgctgcggcgcgcgcataaggcgatggacaaggcgctggccgacgcatgggacagccgtgccgctggcctgctactgtcatcgccggaacaggcgctgatcctggcctcgatcgtggagaaggaaaccgctctggccgccgaacgcccgcagatcgccggcgtgttcgtgcggcgcctgcaactggggatgaaactgcagaccgatccgagcgtgatctacggcatcggtagcgcctacgccggcaacatccgcaagcgtgatctggaaaccgatacgccctacaacacctacacccgcaccggcttgccgccgaccccgattgccatgccagggcgcgaggcgctgcgcgccgcgacgcatcctgcgccgggcgacagcttgtatttcgtggcgatcggcgatggcagcggtgcgcatgcattttcttccagttatgccgaacacaacgcggcggtggcgcgttacctgcagcgcttgcgccagacgcgtagcgacgcggaggagaatccatga

SEQ ID NO: 45151 - protein, 359 aa, Xanthomonas albilineans
MRFEVVVTRAKRGGLMLVAAVLALALLLAAAGAWWWQSYRAFTDRPLQAAQPSVEVARGASFNSVLRRLRDAGVNQGSDLQWQVLARELGVAGKLRFGEYALQPPLSPRALLLRMRKGQVIQYRFTIVEGWSLRQLRAALNAATPLRHITADLGDNDLMAKLAQPGQAAEGRFLPETYLYQRGDSDLDLLRRAHKAMDKALADAWDSRAAGLLLSSPEQALILASIVEKETALAAERPQIAGVFVRRLQLGMKLQTDPSVIYGIGSAYAGNIRKRDLETDTPYNTYTRTGLPPTPIAMPGREALRAATHPAPGDSLYFVAIGDGSGAHAFSSSYAEHNAAVARYLQRLRQTRSDAEENP

SEQ ID NO: 45152 - DNA, 999 bp, Vibrio marinus
  CDS (1)..(999)
atgaaaaaaataattactgctgtttccttattgtttaccattctacttattacatgcgtactcttttattcgcgctatcaatcctttgtttctgatgatcgtgttcaatctgatcatattttaacagttgcttcaggtgatactgcacaatcaatagctaatagcatgattgcagcacctgatatggaatctaaagtattcttacgtttatttttcaaacaatatccaaatatcaccaatattaaactgggttcttataaagttacagcaggttgggactttaaaacattatttgaacacctcgttttaggtgaggaattccagcataaaatcacctttattgaaggttctacatttaaagagtggcgccaacaggtatcccaagcgacgggtattattgatgacacggctggtttatctgaaccagagatcgcaacgctgttaaatatagataatccgaaacttgaagggctgctgctccctgaaacttatttctatcctgaaggtactttggtttcagctttgtatctaaagtcacaccaaaagctacaagcttatttagacgcagcatggctatcaagagacaaaaaattaccacttaaaaatgcctatgaagctttgatccttgcgtctatcatagaaaaggaaacgggtttagagagtgaaagaacaacagttagctctgtgtttattaatcgtttgaataagcgtatgcgtctgcaaacagatccaacggttatttatggtatgggggatgactataaaggcaatattcgccgtaaacatttacgccaaaagacggcttacaacacctacgtgattaagcgcctcccaccaacacctatagcaatggtaggcaaaacatcgattgatgcggcattacacccagcaaaaacaaattatttgtactttgtcgctagcggagatggcgggcattatttttccaagaatttaaaagaacataatcgtgctgttcgtaaatacattttaaagaaataa

SEQ ID NO: 45153 - protein, 332 aa, Vibrio marinus
MKKIITAVSLLFTILLITCVLFYSRYQSFVSDDRVQSDHILTVASGDTAQSIANSMIAAPDMESKVFLRLFFKQYPNITNIKLGSYKVTAGWDFKTLFEHLVLGEEFQHKITFIEGSTFKEWRQQVSQATGIIDDTAGLSEPEIATLLNIDNPKLEGLLLPETYFYPEGTLVSALYLKSHQKLQAYLDAAWLSRDKKLPLKNAYEALILASIIEKETGLESERTTVSSVFINRLNKRMRLQTDPTVIYGMGDDYKGNIRRKHLRQKTAYNTYVIKRLPPTPIAMVGKTSIDAALHPAKTNYLYFVASGDGGHYFSKNLKEHNRAVRKYILKK

SEQ ID NO: 45154 - DNA, 27 bp, Primer
atgaaaaaagtgttattgataatcttg

SEQ ID NO: 45155 - DNA, 25 bp, Primer
ttactgcgcatttttttccttaagc

SEQ ID NO: 45156 - protein, 374 aa, consensus
  MISC_FEATURE (1)..(374): consensus for the disclosure of xaa see table XV
GXXXXXXXXXLXXXXXXXXXXXXXXXXXXXXXXXXXXXXXXXXGXYXXXXXXXXXXXXXXXXXGXXXXXXXXXXXXXXXXXXXXXEGXXXXXXXXXXXXXXXXXXXXXXXXXXXXXXXXXXXXXXXXXXXXXXXXXXXXXXXXXXXXXXXXXXXXXXXXXXXXXXXXEGXXXPXTYXXXXXXXXXXXXXXXXXXXXXXXXXXXXXXXXXXXXXXXXXXXXXXXXXXXXXXXXXXXASXXEXEXXXXXXXXXXAXVXXNRLXXXMXXXXXXXXLQXDXTXXYXXXXXXXXXXXXXXXXXXXXXXXXXXPYNTYXXXGLPPXPIXXPXXXXXXAXXXPXXXXXXXXXLYFVXXXXXXXXXXXXXXXXXFXXXXXXH

SEQ ID NO: 45157 - protein, 49 aa, consensus
  MISC_FEATURE (1)..(49): consensus for the disclosure of xaa see table XV
XXXXXXXXXEXXXXXXXXXXXXXXXXRXXXXXXXXXXXXXXXXXXXXXX

SEQ ID NO: 45158 - protein, 41 aa, consensus
  MISC_FEATURE (1)..(41): consensus for the disclosure of xaa see table XV
XNXXXXXGXXXXXXXXXXXXXXXXXXXXXXXXXXXXXXXXX

SEQ ID NO: 45159 - DNA, 759 bp, Escherichia coli (strain K-12); identical to SEQ ID NO: 29326
  CDS (1)..(759)

SEQ ID NO: 45160 - protein, 252 aa, Escherichia coli (strain K-12); identical to SEQ ID NO: 29327

SEQ ID NO: 45161 - DNA, 678 bp, Streptococcus thermophilus LMG 18311; identical to SEQ ID NO: 29328
  CDS (1)..(678)

SEQ ID NO: 45162 - protein, 225 aa, Streptococcus thermophilus LMG 18311; identical to SEQ ID NO: 29329

SEQ ID NO: 45163 - DNA, 1812 bp, Arabidopsis thaliana; identical to SEQ ID NO: 29330
  CDS (1)..(1812)

SEQ ID NO: 45164 - protein, 603 aa, Arabidopsis thaliana; identical to SEQ ID NO: 29331

SEQ ID NO: 45165 - DNA, 798 bp, Neisseria meningitidis Z2491; identical to SEQ ID NO: 29332
  CDS (1)..(798)

SEQ ID NO: 45166 - protein, 265 aa, Neisseria meningitidis Z2491; identical to SEQ ID NO: 29333

SEQ ID NO: 45167 - DNA, 678 bp, Streptococcus agalactiae 2603V/R; identical to SEQ ID NO: 29334
  CDS (1)..(678)

SEQ ID NO: 45168 - protein, 225 aa, Streptococcus agalactiae 2603V/R; identical to SEQ ID NO: 29335

SEQ ID NO: 45169 - DNA, 774 bp, Oceanobacillus iheyensis HTE831; identical to SEQ ID NO: 29336
  CDS (1)..(774)

SEQ ID NO: 45170 - protein, 257 aa, Oceanobacillus iheyensis HTE831; identical to SEQ ID NO: 29337

SEQ ID NO: 45171 - DNA, 759 bp, Oceanobacillus iheyensis HTE831; identical to SEQ ID NO: 29338
  CDS (1)..(759)

SEQ ID NO: 45172 - protein, 252 aa, Oceanobacillus iheyensis HTE831; identical to SEQ ID NO: 29339

SEQ ID NO: 45173 - DNA, 759 bp, Shigella flexneri 2a str. 301; identical to SEQ ID NO: 29340
  CDS (1)..(759)

SEQ ID NO: 45174 - protein, 252 aa, Shigella flexneri 2a str. 301; identical to SEQ ID NO: 29341

SEQ ID NO: 45175 - DNA, 678 bp, Streptococcus mutans UA159; identical to SEQ ID NO: 29342
  CDS (1)..(678)

SEQ ID NO: 45176 - protein, 225 aa, Streptococcus mutans UA159; identical to SEQ ID NO: 29343

SEQ ID NO: 45177 - DNA, 750 bp, Lactobacillus plantarum WCFS1; identical to SEQ ID NO: 29344
  CDS (1)..(750)

SEQ ID NO: 45178 - protein, 249 aa, Lactobacillus plantarum WCFS1; identical to SEQ ID NO: 29345

SEQ ID NO: 45179 - DNA, 702 bp, Coxiella burnetii RSA 493; identical to SEQ ID NO: 29346
  CDS (1)..(702)

SEQ ID NO: 45180 - protein, 233 aa, Coxiella burnetii RSA 493; identical to SEQ ID NO: 29347

SEQ ID NO: 45181 - DNA, 1491 bp, Rhodopirellula baltica SH 1; identical to SEQ ID NO: 29348
  CDS (1)..(1491)

SEQ ID NO: 45182 - protein, 496 aa, Rhodopirellula baltica SH 1; identical to SEQ ID NO: 29349

SEQ ID NO: 45183 - DNA, 1596 bp, Oryza sativa (japonica cultivar-group); identical to SEQ ID NO: 29350
  CDS (1)..(1596)

SEQ ID NO: 45184 - protein, 531 aa, Oryza sativa (japonica cultivar-group); identical to SEQ ID NO: 29351

SEQ ID NO: 45185 - DNA, 1503 bp, Oryza sativa (japonica cultivar-group); identical to SEQ ID NO: 29352
  CDS (1)..(1503)

SEQ ID NO: 45186 - protein, 500 aa, Oryza sativa (japonica cultivar-group); identical to SEQ ID NO: 29353

SEQ ID NO: 45187 - DNA, 657 bp, Methanococcus maripaludis S2; identical to SEQ ID NO: 29354
  CDS (1)..(657)

SEQ ID NO: 45188 - protein, 218 aa, Methanococcus maripaludis S2; identical to SEQ ID NO: 29355

SEQ ID NO: 45189 - DNA, 681 bp, Desulfotalea psychrophila LSv54; identical to SEQ ID NO: 29356
  CDS (1)..(681)

SEQ ID NO: 45190 - protein, 226 aa, Desulfotalea psychrophila LSv54; identical to SEQ ID NO: 29357

SEQ ID NO: 45191 - DNA, 765 bp, Bacillus licheniformis DSM 13; identical to SEQ ID NO: 29358
  CDS (1)..(765)

SEQ ID NO: 45192 - protein, 254 aa, Bacillus licheniformis DSM 13; identical to SEQ ID NO: 29359

SEQ ID NO: 45193 - DNA, 882 bp, Leuconostoc mesenteroides subsp. mesenteroides ATCC 8293; identical to SEQ ID NO: 29360
  CDS (1)..(882)

SEQ ID NO: 45194 - protein, 293 aa, Leuconostoc mesenteroides subsp. mesenteroides ATCC 8293; identical to SEQ ID NO: 29361

SEQ ID NO: 45195 - DNA, 702 bp, Methanococcoides burtonii DSM 6242; identical to SEQ ID NO: 29362
  CDS (1)..(702)

SEQ ID NO: 45196 - protein, 233 aa, Methanococcoides burtonii DSM 6242; identical to SEQ ID NO: 29363

SEQ ID NO: 45197 - DNA, 759 bp, Enterococcus faecium; identical to SEQ ID NO: 29364
  CDS (1)..(759)

SEQ ID NO: 45198 - protein, 252 aa, Enterococcus faecium; identical to SEQ ID NO: 29365

SEQ ID NO: 45199 - DNA, 801 bp, Methanosarcina barkeri str. fusaro; identical to SEQ ID NO: 29366
  CDS (1)..(801)

SEQ ID NO: 45200 - protein, 266 aa, Methanosarcina barkeri str. fusaro; identical to SEQ ID NO: 29367

SEQ ID NO: 45201 - DNA, 2195 bp, Lycopersicon esculentum; identical to SEQ ID NO: 29368
  CDS (80)..(1717)

SEQ ID NO: 45202 - protein, 545 aa, Lycopersicon esculentum; identical to SEQ ID NO: 29369

SEQ ID NO: 45203 - DNA, 690 bp, Haloarcula marismortui ATCC 43049; identical to SEQ ID NO: 29370
  CDS (1)..(690)

SEQ ID NO: 45204 - protein, 229 aa, Haloarcula marismortui ATCC 43049; identical to SEQ ID NO: 29371

SEQ ID NO: 45205 - DNA, 1710 bp, Nicotiana tabacum; identical to SEQ ID NO: 29372
  CDS (1)..(1710)

SEQ ID NO: 45206 - protein, 569 aa, Nicotiana tabacum; identical to SEQ ID NO: 29373

SEQ ID NO: 45207 - DNA, 819 bp, Acinetobacter sp; identical to SEQ ID NO: 29374
  CDS (1)..(819)

SEQ ID NO: 45208 - protein, 272 aa, Acinetobacter sp; identical to SEQ ID NO: 29375

SEQ ID NO: 45209 - DNA, 660 bp, Aquifex aeolicus; identical to SEQ ID NO: 29376
  CDS (1)..(660)

SEQ ID NO: 45210 - protein, 219 aa, Aquifex aeolicus; identical to SEQ ID NO: 29377

SEQ ID NO: 45211 - DNA, 768 bp, Bacillus subtilis; identical to SEQ ID NO: 29378
  CDS (1)..(768)

SEQ ID NO: 45212 - protein, 255 aa, Bacillus subtilis; identical to SEQ ID NO: 29379

SEQ ID NO: 45213 - DNA, 681 bp, Halobacterium sp; identical to SEQ ID NO: 29380
  CDS (1)..(681)

SEQ ID NO: 45214 - protein, 226 aa, Halobacterium sp; identical to SEQ ID NO: 29381

SEQ ID NO: 45215 - DNA, 681 bp, Lactococcus lactis; identical to SEQ ID NO: 29382
  CDS (1)..(681)

SEQ ID NO: 45216 - protein, 226 aa, Lactococcus lactis; identical to SEQ ID NO: 29383

SEQ ID NO: 45217 - DNA, 759 bp, Lactobacillus plantarum; identical to SEQ ID NO: 29384
  CDS (1)..(759)

SEQ ID NO: 45218 - protein, 252 aa, Lactobacillus plantarum; identical to SEQ ID NO: 29385

SEQ ID NO: 45219 - DNA, 759 bp, Listeria innocua; identical to SEQ ID NO: 29386
  CDS (1)..(759)

SEQ ID NO: 45220 - protein, 252 aa, Listeria innocua; identical to SEQ ID NO: 29387

SEQ ID NO: 45221 - DNA, 759 bp, Listeria monocytogenes; identical to SEQ ID NO: 29388
  CDS (1)..(759)

SEQ ID NO: 45222 - protein, 252 aa, Listeria monocytogenes; identical to SEQ ID NO: 29389

SEQ ID NO: 45223 - DNA, 729 bp, Methanosarcina acetivorans; identical to SEQ ID NO: 29390
  CDS (1)..(729)

SEQ ID NO: 45224 - protein, 242 aa, Methanosarcina acetivorans; identical to SEQ ID NO: 29391

SEQ ID NO: 45225 - DNA, 663 bp, Methanococcus jannaschii; identical to SEQ ID NO: 29392
  CDS (1)..(663)

SEQ ID NO: 45226 - protein, 220 aa, Methanococcus jannaschii; identical to SEQ ID NO: 29393

SEQ ID NO: 45227 - DNA, 648 bp, Methanopyrus kandleri; identical to SEQ ID NO: 29394
  CDS (1)..(648)

SEQ ID NO: 45228 - protein, 215 aa, Methanopyrus kandleri; identical to SEQ ID NO: 29395

SEQ ID NO: 45229 - DNA, 729 bp, Methanosarcina mazei; identical to SEQ ID NO: 29396
  CDS (1)..(729)

SEQ ID NO: 45230 - protein, 242 aa, Methanosarcina mazei; identical to SEQ ID NO: 29397

SEQ ID NO: 45231 - DNA, 666 bp, Methanobacterium thermoautotrophicum; identical to SEQ ID NO: 29398
  CDS (1)..(666)

SEQ ID NO: 45232 - protein, 221 aa, Methanobacterium thermoautotrophicum; identical to SEQ ID NO: 29399

SEQ ID NO: 45233 - DNA, 648 bp, Pyrococcus abyssi; identical to SEQ ID NO: 29400
  CDS (1)..(648)

SEQ ID NO: 45234 - protein, 215 aa, Pyrococcus abyssi; identical to SEQ ID NO: 29401

SEQ ID NO: 45235 - DNA, 906 bp, Pyrobaculum aerophilum; identical to SEQ ID NO: 29402
  CDS (1)..(906)

SEQ ID NO: 45236 - protein, 301 aa, Pyrobaculum aerophilum; identical to SEQ ID NO: 29403

SEQ ID NO: 45237 - DNA, 654 bp, Pyrococcus furiosus; identical to SEQ ID NO: 29404
  CDS (1)..(654)

SEQ ID NO: 45238 - protein, 217 aa, Pyrococcus furiosus; identical to SEQ ID NO: 29405

SEQ ID NO: 45239 - DNA, 759 bp, Salmonella enteritidis; identical to SEQ ID NO: 29406
  CDS (1)..(759)

SEQ ID NO: 45240 - protein, 252 aa, Salmonella enteritidis; identical to SEQ ID NO: 29407

SEQ ID NO: 45241 - DNA, 759 bp, Salmonella typhi; identical to SEQ ID NO: 29408
  CDS (1)..(759)

SEQ ID NO: 45242 - protein, 252 aa, Salmonella typhi; identical to SEQ ID NO: 29409

SEQ ID NO: 45243 - DNA, 759 bp, Shigella dysenteriae; identical to SEQ ID NO: 29410
  CDS (1)..(759)

SEQ ID NO: 45244 - protein, 252 aa, Shigella dysenteriae; identical to SEQ ID NO: 29411

SEQ ID NO: 45245 - DNA, 717 bp, Staphylococcus aureus; identical to SEQ ID NO: 29412
  CDS (1)..(717)

SEQ ID NO: 45246 - protein, 238 aa, Staphylococcus aureus; identical to SEQ ID NO: 29413

SEQ ID NO: 45247 - DNA, 717 bp, Staphylococcus aureus; identical to SEQ ID NO: 29414
  CDS (1)..(717)

SEQ ID NO: 45248 - protein, 238 aa, Staphylococcus aureus; identical to SEQ ID NO: 29415

SEQ ID NO: 45249 - DNA, 717 bp, Staphylococcus epidermidis; identical to SEQ ID NO: 29416
  CDS (1)..(717)

SEQ ID NO: 45250 - protein, 238 aa, Staphylococcus epidermidis; identical to SEQ ID NO: 29417

SEQ ID NO: 45251 - DNA, 687 bp, Streptococcus pyogenes; identical to SEQ ID NO: 29418
  CDS (1)..(687)

SEQ ID NO: 45252 - protein, 228 aa, Streptococcus pyogenes; identical to SEQ ID NO: 29419

SEQ ID NO: 45253 - DNA, 678 bp, Streptococcus pneumoniae; identical to SEQ ID NO: 29420
  CDS (1)..(678)

SEQ ID NO: 45254 - protein, 225 aa, Streptococcus pneumoniae; identical to SEQ ID NO: 29421

SEQ ID NO: 45255 - DNA, 762 bp, Enterococcus faecalis; identical to SEQ ID NO: 29422
  CDS (1)..(762)

SEQ ID NO: 45256 - protein, 253 aa, Enterococcus faecalis; identical to SEQ ID NO: 29423

SEQ ID NO: 45257 - DNA, 26 bp, Primer
atgaaaaccgtaactgtaaaagatct

SEQ ID NO: 45258 - DNA, 27 bp, Primer
ttatgcctggtgtaaaatagttaatac

SEQ ID NO: 45259 - protein, 163 aa, consensus; identical to SEQ ID NO: 29426
  MISC_FEATURE (1)..(163): consensus for the disclosure of xaa see table XV

SEQ ID NO: 45260 - protein, 8 aa, consensus
  MISC_FEATURE (1)..(8): consensus for the disclosure of xaa see table XV
XXXEXRXD

SEQ ID NO: 45261 - protein, 37 aa, consensus; identical to SEQ ID NO: 29428
  MISC_FEATURE (1)..(37): consensus for the disclosure of xaa see table XV

SEQ ID NO: 45262 - protein, 47 aa, consensus; identical to SEQ ID NO: 29429
  MISC_FEATURE (1)..(47): consensus for the disclosure of xaa see table XV

SEQ ID NO: 45263 - protein, 42 aa, consensus; identical to SEQ ID NO: 29430
  MISC_FEATURE (1)..(42): consensus for the disclosure of xaa see table XV

SEQ ID NO: 45264 - DNA, 1440 bp, Escherichia coli
  CDS (1)..(1440)
atgtctattgtggtgaaaaataacattcattgggttggtcaacgtgactgggaagtgcgtgattttcacggcacggaatataaaacgctgcgcggcagcagctacaatagctacctcatccgcgaagaaaaaaacgtgctgatcgacaccgtcgaccataaattcagccgcgaatttgtgcagaacctgcgtaatgaaatcgatctggcggatatcgattacatcgtgattaaccatgcagaagaggaccacgctggggcgctgaccgaactgatggcacaaattcccgatacgccgatctactgtacagccaacgctatcgactcgataaatggtcatcaccatcatccggagtggaattttaatgtggtgaaaactggcgacacgctggatatcggcaacggcaaacagctcatttttgtcgaaacaccaatgctgcactggccggacagcatgatgacttacctgacaggcgacgcggtgctgttcagtaacgatgctttcggtcaacactactgcgacgagcatctgttcaacgatgaagtggatcagacggagcttttcgagcagtgccagcgttactacgccaatatcctgacgccgttcagccgcctggtaacaccgaaaattaccgagatcctgggctttaacttaccagtcgatatgatagccacttcccacggcgtggtatggcgcgataacccgacgcaaattgtcgagctgtacctgaaatgggcggctgattatcaggaagacagaatcaccattttctacgacaccatgtcgaataacacccgcatgatggctgacgctatcgcccaggggattgcggaaaccgacccacgcgtggcggtgaaaattttcaacgtcgcccgaagcgataaaaacgaaatcctgactaatgtcttccgctcaaaaggcgtgctggtcggcacttcgacgatgaataacgtgatgatgccgaaaatcgccgggctggtggaggagatgactggtttacgcttccgtaacaaacgcgccagtgctttcggctctcacggctggagcggcggtgcggtggatcgtctttccacgcgcctgcaggatgcgggtttcgaaatgtcgcttagcctgaaagcgaaatggcgaccagaccaggacgctctgaagttatgccgtgaacacggtcgcgaaatcgcccgtcagtgggcgctcgcgccgctgccgcagagcacggtgaatacggtagttaaagaagaaacctctgccaccacgacggctgacctcggcccacggatgcagtgcagcgtctgccagtggatttacgatccggcaaaaggcgagccaatgcaggacgttgcgccaggaacgccgtggagtgaagtcccggataacttcctctgcccggaatgctccctcggcaaagacgtctttgaagaactggcatcggaggcaaaatga

SEQ ID NO: 45265 - protein, 479 aa, Escherichia coli
MSIVVKNNIHWVGQRDWEVRDFHGTEYKTLRGSSYNSYLIREEKNVLIDTVDHKFSREFVQNLRNEIDLADIDYIVINHAEEDHAGALTELMAQIPDTPIYCTANAIDSINGHHHHPEWNFNVVKTGDTLDIGNGKQLIFVETPMLHWPDSMMTYLTGDAVLFSNDAFGQHYCDEHLFNDEVDQTELFEQCQRYYANILTPFSRLVTPKITEILGFNLPVDMIATSHGVVWRDNPTQIVELYLKWAADYQEDRITIFYDTMSNNTRMMADAIAQGIAETDPRVAVKIFNVARSDKNEILTNVFRSKGVLVGTSTMNNVMMPKIAGLVEEMTGLRFRNKRASAFGSHGWSGGAVDRLSTRLQDAGFEMSLSLKAKWRPDQDALKLCREHGREIARQWALAPLPQSTVNTVVKEETSATTTADLGPRMQCSVCQWIYDPAKGEPMQDVAPGTPWSEVPDNFLCPECSLGKDVFEELASEAK

SEQ ID NO: 45266 - DNA, 1230 bp, Thermococcus kodakaraensis
  CDS (1)..(1230)
atgccgaggctgtgggttgaaaagctctgtactgatccggagctctacatcataagggttgatgatgaccaaataaggtacttcgaggccacatgggacattcccgaggggataacttacaacgcctacctgatgaagctcgacggtgcagttgtcctctttgatacaacaaagaaggagtacaccgacctttttatggacgcacttaggaagctcgttgatccaaaggagataacccacataatcgtccaccacacagagccagatcacagcggtgccctgcccaaagtccttgaggagaacggctacagggcccaggtgataggaacccagttcgcgaggaacctccttcaggggttctatggagacaaagttgtcgagaacttcaaggtcgtcaaggacggcgaggagatgcagatcggcggaaagaccttccgattcatagcagttccatggcttcactggcccgacacgatgataacctacgtcgttgaggacaggataatcttctcctgcgacgcaggcggcgggtactcaattcccgaaaccatcgacgacagcgatgaggagttcgtggagaagtacctcccgcacgtgaccaagtacatcgtcaccgttatcggccactaccacaagtacatcgtccagaacatcaagaagctgaagagtcttggaatagttgagagcgctaggatgatactccccggccacggcttggtgtggaagagggacccgctcaggatattcgaacactacgagcgcgttggtgcaggggtttccgaaaaggacaaggttctcgtcatctacgactccatgtacggtttcgttgaaaggagaatggagatcgttcttgatgaactaaggaagcacggaaagaaacctgtagtttaccgcttcacggacaaggaagctccagcggtcagcgacatactcggcgaggttccgagcgctgaagccctgataattggcgcatcaacctacgaggccgagatacacccgagaatacgctacgccctctacgagatcgttgacaaggccaactacgaaaagcccgttctcattgtcggggccttcggctggggcggcgttgctggtaggaaaatcgaaacgatgatcaccagaagcaagttcgaccacgttgcgacagttgagagcaaaggctacccaacgccagaggacgaggagaagctgagggaagccgtcaggaagctcgttcagtggactttgtag

SEQ ID NO: 45267 - protein, 409 aa, Thermococcus kodakaraensis
MPRLWVEKLCTDPELYIIRVDDDQIRYFEATWDIPEGITYNAYLMKLDGAVVLFDTTKKEYTDLFMDALRKLVDPKEITHIIVHHTEPDHSGALPKVLEENGYRAQVIGTQFARNLLQGFYGDKVVENFKVVKDGEEMQIGGKTFRFIAVPWLHWPDTMITYVVEDRIIFSCDAGGGYSIPETIDDSDEEFVEKYLPHVTKYIVTVIGHYHKYIVQNIKKLKSLGIVESARMILPGHGLVWKRDPLRIFEHYERVGAGVSEKDKVLVIYDSMYGFVERRMEIVLDELRKHGKKPVVYRFTDKEAPAVSDILGEVPSAEALIIGASTYEAEIHPRIRYALYEIVDKANYEKPVLIVGAFGWGGVAGRKIETMITRSKFDHVATVESKGYPTPEDEEKLREAVRKLVQWTL

SEQ ID NO: 45268 - DNA, 1491 bp, Vibrio fischeri ES114
  CDS (1)..(1491)
atgactattcatattaaaaacaatgttaactgggttggacaacgcgattgggaagtatctgatttccatggtactgaattcaaaatgaccaagggtacaagttataacagctatctcattcaagaagaaaaaaccgtgcttattgatacggtcgatcatcgttttagtcatcaatttattcaaaatttagaaatggaaattgatcttgcgagcattgattacattgtcattaatcatgctgaagaagatcattcaggagcgcttgctgcattaatggagaagatccctggtactccaatttactgcactgaaaatgcgattgattccattgtcggacatcatcatcaccctgagtggaattttaatccaattaagacaggtgatgcattggatattggtaatggaaagcaattgatctttgttgaagcacctatgcttcattggccagatagcatgatgacctatttaactggtgatgcaattctgtttagtaacgatgcatttggtcaacattattgcgatgaacgtttatttaatgacgaagtagatcaaacagaattgatggatcaatgtttacgttattacgcgaatattcttacgccattcagtgctttggttaccgctaaaattaaagaagtattaagcttcaatttacctgtcgacatgattgcaacttctcacggttgtgtatggcgagataaccctactcaaattattcatcaatatttagagtgggctgataattatcaagaagatcgtattacgattttttatgattctatgtcaaacaacactcgaatgatggctgatgctattgcccaaggtattcacgatgtagaccctgctgttgcagtcaaagtattcaatgtttctcgtcaagataagaatgatattttaaccagtgtgttccgctcaaaagggatccttgttggttcatcaaccatgaacaatgtaatgatgcctaaaattgcgggtatgttagaagagatcgccggtcttcgatttagagcaaaaaaagcaggagcatttggtagttacggttggaatggtggtgctgttgatcgaatccattcacgtttaaccgatgctggttttgaaaccgcagtaggtttaaaagctaaatggcgaccagatggtcaagcgatgaaattatgccgagagcatggacaatttattgcaaaacagtgggcgttagcaccattaacaacgacatttaatacaattaatgtcgataaaaaaattcagacaatagaagaaccggttgttcttgttgaaccaagtgccgaactagaaaaaccagcgacagaagtgacgtcatcaaaagatgcaaaacagtgcatgctttgctcggtctgtaattgggtctatgaccctgaaattggtgaaccgaatcaaggtgtagaaccaaatacaccgtggtcttcagttcctaatgatttcttatgccctgaatgtcatttaggtaaagacgtatttgtggaaattaagtag

SEQ ID NO: 45269 - protein, 496 aa, Vibrio fischeri ES114
MTIHIKNNVNWVGQRDWEVSDFHGTEFKMTKGTSYNSYLIQEEKTVLIDTVDHRFSHQFIQNLEMEIDLASIDYIVINHAEEDHSGALAALMEKIPGTPIYCTENAIDSIVGHHHHPEWNFNPIKTGDALDIGNGKQLIFVEAPMLHWPDSMMTYLTGDAILFSNDAFGQHYCDERLFNDEVDQTELMDQCLRYYANILTPFSALVTAKIKEVLSFNLPVDMIATSHGCVWRDNPTQIIHQYLEWADNYQEDRITIFYDSMSNNTRMMADAIAQGIHDVDPAVAVKVFNVSRQDKNDILTSVFRSKGILVGSSTMNNVMMPKIAGMLEEIAGLRFRAKKAGAFGSYGWNGGAVDRIHSRLTDAGFETAVGLKAKWRPDGQAMKLCREHGQFIAKQWALAPLTTTFNTINVDKKIQTIEEPVVLVEPSAELEKPATEVTSSKDAKQCMLCSVCNWVYDPEIGEPNQGVEPNTPWSSVPNDFLCPECHLGKDVFVEIK

SEQ ID NO: 45270 - DNA, 1011 bp, Archaeoglobus fulgidus DSM 4304
  CDS (1)..(1011)
gtgaatccggggtttgaggacgtgctcaggcggaacgttgagaggtatgctgacagaattgattacgttgttatgaaccacgccgaacccgaccacgccggggcgataccctttatcatggaaagcagcgacgctttgctggtgaccacgaagaagggggctgagatggcgaagttctactacgatgttcctgaaagcagggtgagggttgttgaggatggggaggagataagcctcggcgaaaaaactctccgcttcatccacgctccgtggcttcactggcctgaaacgatgttcacctatctcgtggaggatggaatactcttcccctgtgatttctttggctgtcacacagcttacggcttctacgatgacgaggtgcctgagattctctactacgcccagagatacttcggtgagataatgatgcccttccgcagtatgggaaagaaggctctggagaaaataaaaggcctgaaaataaacatgatagccccaagccacgggccgatttacagaaacctcgagaaaatcctgtcagcatacgagaaatggactgcaggggaaactgaggaaaaggtgcttgtggtttacgccaccatgtggggctcgacggagaggatggtgaatctgcttactgagctgctgatgaaggagggtttgaaggttgccgttcacaatttagcgagtgcggacattggcgagattgcgaaggacttggttgactcaagagctattgtgctcggcactccaactgtgctgggaggaatgcaccccctcgccctcttcgctgcaaacctcgtaaaggctctgagaccaccagccagatacgcagcagttctgagctctttcggctggggtggaggggctgtgaagcagattgaggagatagtttcttctctgaacctcgaagttctcggggttgttgaagttagggcaaagccatcggattcagaccttgagaaggtaagaaagctggctgagaaaattgcaggggtggtgaaggtatga

SEQ ID NO: 45271 - protein, 336 aa, Archaeoglobus fulgidus DSM 4304
MNPGFEDVLRRNVERYADRIDYVVMNHAEPDHAGAIPFIMESSDALLVTTKKGAEMAKFYYDVPESRVRVVEDGEEISLGEKTLRFIHAPWLHWPETMFTYLVEDGILFPCDFFGCHTAYGFYDDEVPEILYYAQRYFGEIMMPFRSMGKKALEKIKGLKINMIAPSHGPIYRNLEKILSAYEKWTAGETEEKVLVVYATMWGSTERMVNLLTELLMKEGLKVAVHNLASADIGEIAKDLVDSRAIVLGTPTVLGGMHPLALFAANLVKALRPPARYAAVLSSFGWGGGAVKQIEEIVSSLNLEVLGVVEVRAKPSDSDLEKVRKLAEKIAGVVKV

SEQ ID NO: 45272 - DNA, 1467 bp, Archaeoglobus fulgidus DSM 4304
  CDS (1)..(1467)
gtgtctcctcacccttttcacaccttcaactttcagcaagtcctcttcactgccagagtatctgacgatgtagtcgtagtcgtaaaaaacctcgtgcacctcctcgcaaatttccttcagcttctccaaggctttctccctctcaagatggttgacccaaacttcgaggtacatggctgccctaagccgcactcctttaaatcttttcgattctttttaaggttaattttgcattcggaattgaaaaattcgaaaatcgagagaaagttttataggagagggaatgaagttaatcatatgaaacctgttgagttgaaagacggcgtattttgggtgggggcaatcgattgggatgagagggattttcacaacttcgttacggcaagggggctgacgtacaactcctacctcatagtggatgataaggtggttctcgttgatacggtaaagcacaaattcgtgaaagagtctatggaaaggataagaaagcttgtggacccttcgcagatagactacgtcatcgttaaccacattgagccggaccactcaagcggtttgccggacacgatgaggattgcgaaggatgcaaccgtagtttgcacgcagagagcaaaggatggaatctgcaagtactacgactgcgacggctggaacattcaggttgtcaagggaggagacacactgaaaatcggaaagaggaccttaacgttcatagacatgaccatgctccactggcctgacagcatggcaacgtacataaacgaggacaaaatcttgctgtcaaacgatgccttcgggcagcatgttgcaagcgaatacaggtttgatgaggaaatcggagttgaagaagcgttgaagtgggccaaagtttactacgcaaacattctcatgcccctcggagggctgattcaaaagaagctgaaggagataaaggagtcggggcttgagattgacataatcgccccaagtcatggagttgtgtggaaaaatcccggaaggataatcgaagcctacgaccgctggtcaagattcgagccaacaaacaaggtcgttatcgtcttcgattcgatgtggcactcgacggagaagcttgcgatggcaatcgccgaaggggcgggaagtgaaggggctgacgtcagagtgatgcatatcaggaaggattactggactgacattgttaccgagatcctcgacgccaaggcaattgctgttggctcacccacaatccacaacggcctgttcccgacagttgccggctttctcacataccttaagggcctgaagccacaaaataaaaaagctctggctttcggctcctacggctggaacgggaatgcggtcaaggaagttcagaaggtgcttgaggagctcaagttcgagaccctcgaaccgttcatggtgaagttcaagccatccgaagaggagctgcagaaggctttcgagttaggaagggagctggcacgatga

SEQ ID NO: 45273 - protein, 488 aa, Archaeoglobus fulgidus DSM 4304
MSPHPFHTFNFQQVLFTARVSDDVVVVVKNLVHLLANFLQLLQGFLPLKMVDPNFEVHGCPKPHSFKSFRFFLRLILHSELKNSKIERKFYRRGNEVNHMKPVELKDGVFWVGAIDWDERDFHNFVTARGLTYNSYLIVDDKVVLVDTVKHKFVKESMERIRKLVDPSQIDYVIVNHIEPDHSSGLPDTMRIAKDATVVCTQRAKDGICKYYDCDGWNIQVVKGGDTLKIGKRTLTFIDMTMLHWPDSMATYINEDKILLSNDAFGQHVASEYRFDEEIGVEEALKWAKVYYANILMPLGGLIQKKLKEIKESGLEIDIIAPSHGVVWKNPGRIIEAYDRWSRFEPTNKVVIVFDSMWHSTEKLAMAIAEGAGSEGADVRVMHIRKDYWTDIVTEILDAKAIAVGSPTIHNGLFPTVAGFLTYLKGLKPQNKKALAFGSYGWNGNAVKEVQKVLEELKFETLEPFMVKFKPSEEELQKAFELGRELAR

SEQ ID NO: 45274 - DNA, 1230 bp, Pyrococcus abyssi GE5
  CDS (1)..(1230)
atggttaaggtttggatcgagaagttgcttgaggaacctgagctgtacctactaagggttgacgatgataggataaggtacttcgaggcaacctgggacatacccgagggaataacgtacaacgcctacctgatgaagctcaaggatgtcgtgatcttattcgatgcatggaagaaggattataccgaggagttcatagaggccctatcaagcttagtcgatccaaaggaaattacgcacatagtagttcaccacacggagccagaccatactggtgcccttccaaagttgcttgagctcaacgaatataaagctcaaatcataggaaccaacttcgccaaaaacttgcttcagggattctacggtagcgacgtcgtcaagaatttccacgtggttagggatggggaagaggtaaagattggagacagaacgttcaggttcattacagttccctggctccactggcccgacacgatgataacttacgtcatagaagacaagctgatattcagttgcgacgccggtgggggttacgggattccaagggcgatagatgacagcgatgaggaggtagtcaaagagtaccttccgtacgtgaccaagtacatagttactgtcataggtcactaccacaagtacatagttcagaacatcaagaagctcaagagcctggggataatcgagagcgtcaggatgatactccctgggcacggattgatttggaggaggaacccagttaggatattcgagcattatgagagggtaggagcgggaattccgacaaaggataaagttctcgtgctttatgactccatgtacggcttcgtcgaggagaggatgaaggtagttatagaggagcttaggaagtacaacaagaagccggtaatttacaggttcacagataaagaggctccagccgtaagcgacatactcggagaagttccagatagtgaagctttgataattggcgtctcaacgtacgaagccgatgtgcaccccaggatacgctacacactctacgagatattagacaaggcaaactatgataagccagttctaatcgttggagcatttggttggggtggagttgccgggaagaagattgaaaccctaataagcaggagcaaattcgagttggttgaggttgtagagacgaagggtagaccaacggaagaagataaagaaaagcttagggaagccgtgagaaggttaattcaatggatttcctag

SEQ ID NO: 45275 - protein, 409 aa, Pyrococcus abyssi GE5
MVKVWIEKLLEEPELYLLRVDDDRIRYFEATWDIPEGITYNAYLMKLKDVVILFDAWKKDYTEEFIEALSSLVDPKEITHIVVHHTEPDHTGALPKLLELNEYKAQIIGTNFAKNLLQGFYGSDVVKNFHVVRDGEEVKIGDRTFRFITVPWLHWPDTMITYVIEDKLIFSCDAGGGYGIPRAIDDSDEEVVKEYLPYVTKYIVTVIGHYHKYIVQNIKKLKSLGIIESVRMILPGHGLIWRRNPVRIFEHYERVGAGIPTKDKVLVLYDSMYGFVEERMKVVIEELRKYNKKPVIYRFTDKEAPAVSDILGEVPDSEALIIGVSTYEADVHPRIRYTLYEILDKANYDKPVLIVGAFGWGGVAGKKIETLISRSKFELVEVVETKGRPTEEDKEKLREAVRRLIQWIS

SEQ ID NO: 45276 - DNA, 1236 bp, Pyrococcus horikoshii OT3
  CDS (1)..(1236)
atgtgcatggttaaggtctgggtcgagaaactattagatgagcccgagttatatatattgaggctagacgatagtgaaattaagcactttgaggccgcatggagcatacccgagggtataacttacaatgcttatttaatgaaagttggagatgcagtcgtgctctttgacacatggaaaggggaatacactgagaagtttttagagagtctttcaacccttgtggatcctaaggaaataacgcatataatagttcaccatactgagccggatcatagtggggcccttccaaagcttctggaacttaatgagtacagggcaaagctcataggaacgacctttgccaagaatttattacaaggcttttatggagacaaagtagttgaaaacttccacacaataaaggatggagaagaggtaaaaattgggaataggacctttaggttcataactgttccttggcttcattggcctgatacaatgataacttacgatgtagaggataaactaatcttcagttgcgatgcgggaggaggttatgggatccctgaggccatagatgatagcgatgaagacgttgtgaaaaagtacttaccttacgtaacgaagtacatagtaaccgtgataggacactatcataagtacatagttcagaatattaagaaactcaaggaactcggaataatagagaatgcgaacatgatacttcccggacatggtttaatttggagaaagagtcctaccagaatatttgagcattatgaaagggttggagctggaatcccgactaaggataaggttttagttatatatgactccatgtatgggttcgttgagaaaaggatgagtgttgttatagaagagctgaagagatacggtaaaaagccagtcgtctatagattcacggataaggagaacccagctatcagcgacatcctcggcgaagttccagacagtgaagctttagttataggagtatcaacgtatgaggcggatatacacccaaggatgaggtgcgccctttatgagatcttagataaggcgaattacgaaaagcctgttttaatagtgggagcatttggatggggaggagttgcaggaaagaaggtagagaccttaatttccaggagcaaattcgagctagtcgatgtcgtggaaacaaaaggaaggatgactagtgaagatgaagaaagattgagggaagctgtgagaaagctaattcaatggcaactttag

SEQ ID NO: 45277 - protein, 411 aa, Pyrococcus horikoshii OT3
MCMVKVWVEKLLDEPELYILRLDDSEIKHFEAAWSIPEGITYNAYLMKVGDAVVLFDTWKGEYTEKFLESLSTLVDPKEITHIIVHHTEPDHSGALPKLLELNEYRAKLIGTTFAKNLLQGFYGDKVVENFHTIKDGEEVKIGNRTFRFITVPWLHWPDTMITYDVEDKLIFSCDAGGGYGIPEAIDDSDEDVVKKYLPYVTKYIVTVIGHYHKYIVQNIKKLKELGIIENANMILPGHGLIWRKSPTRIFEHYERVGAGIPTKDKVLVIYDSMYGFVEKRMSVVIEELKRYGKKPVVYRFTDKENPAISDILGEVPDSEALVIGVSTYEADIHPRMRCALYEILDKANYEKPVLIVGAFGWGGVAGKKVETLISRSKFELVDVVETKGRMTSEDEERLREAVRKLIQWQL

SEQ ID NO: 45278 - DNA, 1197 bp, Thermotoga maritima MSB8
  CDS (1)..(1197)
atgccaaaaatctggactgaaaggatcttcgacgatccggaaatctacgttttgaggatagatgatgaccgaataagatacttcgaagcggtctgggaaatacccgaagggatcagctacaacgcatatcttgtgaagctgaatggtgcaaacgttctgatagacggctggaagggaaactacgcaaaagagttcatcgacgctctgtccaagatcgttgatcccaaagagatcacgcacatcatcgtaaaccacaccgagccggaccacagcggatctctccccgcaacactcaaaacgattggacacgatgtggaaataatcgcttcgaacttcggaaaaagacttctcgaaggcttctacggcataaaagacgtgactgtcgtgaaggatggagaagagagagaaatcggaggaaaaaaattcaaattcgtcatgactccatggcttcactggcccgacacgatggtgacgtatcttgatggaattctcttcagctgtgatgtgggtggtggatacctgctcccagagatcctggacgactcaaacgagagcgttgtggaaaggtaccttccccacgtcacaaagtacatcgtcacggtgataggccattacaagaattacatcctcgaaggtgcggaaaagctctccagtctgaagataaaggcgctccttccagggcacggactgatctggaagaaagatcctcagagacttttgaatcactacgtgagcgttgcaaagggagatccgaaaaaaggaaaggtcacggtgatctacgattccatgtacggcttcgtcgagaacgtgatgaagaaggcgatcgactctctcaaggagaaaggtttcacaccggttgtgtacaaattctccgacgaagagagacccgcgatcagcgagatcctgaaagacatcccggacagtgaagcactgatcttcggtgtttccacctacgaagcagagatacatccactcatgagattcacccttctcgagataatagataaagcgaactacgaaaaacccgtcctcgtctttggagtgcacggctgggctccatccgcagaaagaacagcaggagagcttctgaaagaaacgaagttcagaattctctccttcacggagataaaaggttcaaacatggatgagagaaagatcgaagaggcgatatctcttctcaaaaaagaactggagtga

SEQ ID NO: 45279 - protein, 398 aa, Thermotoga maritima MSB8
MPKIWTERIFDDPEIYVLRIDDDRIRYFEAVWEIPEGISYNAYLVKLNGANVLIDGWKGNYAKEFIDALSKIVDPKEITHIIVNHTEPDHSGSLPATLKTIGHDVEIIASNFGKRLLEGFYGIKDVTVVKDGEEREIGGKKFKFVMTPWLHWPDTMVTYLDGILFSCDVGGGYLLPEILDDSNESVVERYLPHVTKYIVTVIGHYKNYILEGAEKLSSLKIKALLPGHGLIWKKDPQRLLNHYVSVAKGDPKKGKVTVIYDSMYGFVENVMKKAIDSLKEKGFTPVVYKFSDEERPAISEILKDIPDSEALIFGVSTYEAEIHPLMRFTLLEIIDKANYEKPVLVFGVHGWAPSAERTAGELLKETKFRILSFTEIKGSNMDERKIEEAISLLKKELE

SEQ ID NO: 45280 - DNA, 1158 bp, Methanothermobacter thermautotrophicus str. Delta H
  CDS (1)..(1158)
atgacagcaaaaaggattgctgatggggtttactacacaggcaccatcgactgggacagaaggaccttcgatgaacttgtaaccctcccgaggggtacaagttacaactcctacctgatctctggaaccagcgccacagccctcattgacaccacggagccatcaagggcagccgaactcctcaggacccttgaggagatggacgcagatataaaatacatagtatcacagcatgcagaacaggatcactcaggcaccatacccgaactccttgaaatctaccctgaggcagaggtcatcgggacacctgcatgcatagaacttctgcaggagcttctgaggatcaacgggaacttcagggaggttaaggacggtgaaagcctctccctgggtgacaggacactgagattcatcgtaacaccatgggttcactggccagataccatggtaacctaccttgaggaggatggcatactctttacatgcgacttcttcggatcacacattgcaacatcagacatcatggagacaccagatgacttcctgagggaggcaaagaggtactacgcccacataatgatgcccttcagccagatggtggcatcaaacctcaggaagatctcagagcttgaagtatccatgatagcaccatcacatggcccggtcatatctgaacccgggctcataatggacgcctatgatacctggacctcaggcggggatggagtggtcatcgcctacaccaccatgcatggaagcaccagggtcatggttgagagactcacagagaaactcatggaacttgatgtgagtgtgagaccggtgaacgttgcagaacatgacacaggggaattcctgacggaactcgtcgacgcatccgtgcttgtcgtggcatccccgacggtactcacaagaccacatccagccatagcatcagtcctctacctcgtaaacgccctgagaccacccttaaggcatgttgcggtcatgggatcctatggatggggcagcctgatagaatccgaggtcaggaagctcctgtcaaatctgaatgtcgaataccttgaatccgtccttgtgaagggtctcccggtggaggaggaccttcagagggtggatgaacttgccatgaagataaagggggtgaatgaatggtaa

SEQ ID NO: 45281 - protein, 385 aa, Methanothermobacter thermautotrophicus str. Delta H
MTAKRIADGVYYTGTIDWDRRTFDELVTLPRGTSYNSYLISGTSATALIDTTEPSRAAELLRTLEEMDADIKYIVSQHAEQDHSGTIPELLEIYPEAEVIGTPACIELLQELLRINGNFREVKDGESLSLGDRTLRFIVTPWVHWPDTMVTYLEEDGILFTCDFFGSHIATSDIMETPDDFLREAKRYYAHIMMPFSQMVASNLRKISELEVSMIAPSHGPVISEPGLIMDAYDTWTSGGDGVVIAYTTMHGSTRVMVERLTEKLMELDVSVRPVNVAEHDTGEFLTELVDASVLVVASPTVLTRPHPAIASVLYLVNALRPPLRHVAVMGSYGWGSLIESEVRKLLSNLNVEYLESVLVKGLPVEEDLQRVDELAMKIKGVNEW

SEQ ID NO: 45282 - DNA, 1233 bp, Methanothermobacter thermautotrophicus str. Delta H
  CDS (1)..(1233)
ttggtgtttaatatgaaggctgatgcagtaaaaattgcggatggtgtctactgggttggtgtgatggactgggacataaggagctaccatggttacacccttggaggcacaacctacaatacctacctcatatttggggatgaacgggtggcccttgttgacaacacttaccccggaacctcttcacagatgtttggaaggataaccgacgcctttgaaagggaaggaagggatgaaaagattgacctcataatacagaaccacattgaaagggatcacagcggttccatcaccgaggtcctcaaaaggtacggttcagagataatctgcaccgcaaaggcagctgagggcctcaggcagcactattccataccccaggataccccgatgcagaccgttaaaacaggggacagcactgacctcgggggaaagaccctcacattccttgaggccccaatgctccactggccagacagcatgttcaccctcctcgaggaggaaggtattctcttctcaaatgatgccttcggacagcacctctgcatcagcaaacgctttgataaggacgtccctgaagctgtactgatggatgctgccatgaaattctatgcaaaccttttaacaccactctccccccttgtactcaggaagttcagtgaggttaaggaactgggcctccttgagaagatagggatgatagcgccctcccacggccagatatggaccgagcccctgaagataatagctgcatacactgactgggccaccgggaagtgcagggacaaggccaccataatctatgacaccatgcactactccaccaggatgctggcacatgccatggccgagggtctcatggcagcggacgtggatgtgtcgatgcacttccttcatgaggatgagaggagtgagattgtgaagaatatccttgagagcaaggcagtattcataggaagcccaacaatgttcaacggaccattcccaagcctcggtgaccttatatattatctcaaaggacttacgttcgatcgcacaggctttaaaaggcttgcagttgtattcggatcaaagggatggggtggcggtgcagtgagaacccttcaggaggagctctcaggtgcaggattcgaggttgctgaaacctttgaggttaactatgtccccacctccggagacctggatgaatgctacagcatcgggaagagcgtcggtgaaaggataaagaaaatgtag

SEQ ID NO: 45283 - protein, 410 aa, Methanothermobacter thermautotrophicus str. Delta H
MVFNMKADAVKIADGVYWVGVMDWDIRSYHGYTLGGTTYNTYLIFGDERVALVDNTYPGTSSQMFGRITDAFEREGRDEKIDLIIQNHIERDHSGSITEVLKRYGSEIICTAKAAEGLRQHYSIPQDTPMQTVKTGDSTDLGGKTLTFLEAPMLHWPDSMFTLLEEEGILFSNDAFGQHLCISKRFDKDVPEAVLMDAAMKFYANLLTPLSPLVLRKFSEVKELGLLEKIGMIAPSHGQIWTEPLKIIAAYTDWATGKCRDKATIIYDTMHYSTRMLAHAMAEGLMAADVDVSMHFLHEDERSEIVKNILESKAVFIGSPTMFNGPFPSLGDLIYYLKGLTFDRTGFKRLAVVFGSKGWGGGAVRTLQEELSGAGFEVAETFEVNYVPTSGDLDECYSIGKSVGERIKKM

SEQ ID NO: 45284 - DNA, 1230 bp, Methanothermobacter thermautotrophicus str. Delta H
  CDS (1)..(1230)
atgtgtggtgatataatgaaggccagagcagagaagatagcagatggattatactggactggtgtccttgactgggacatcagaaactaccacggatacacacttcaggggacaacctacaacgcctaccttgtattcggagatgaaggtgtggcgctgattgacaactcatatccagggaccttccaggagctcatggcaaggatggaggatgcattcaaccgtgagggaagagagatgagagtggacttcatagtccagaaccatgttgaaagggaccacagcggagtgctggtggaacttcacaggaggttccctgaggcagagatccactgcacagaagttgccgtggagggactgctcaagcattacccggcccttgagggcacagagttccgcacagtgaagaccggggattccatcgacctcggaggaaggaccctcaccttccttgaggcacccctgctccactggccagacagcatgttcaccttccttgataccggcatactgttctcaaacgacgcctttggacagcacctctgctatccacagcgcctcgacaccgaaatacccgaatacatactcatggatgctgccaaaaaattctatgcgaacctcataacacccctatcaaagcttgtgctcaggaagttcgatgaggtgaaggaactcggcctccttgataagatagggatgatagcgccctcccatggccagatatggaccgaacccatgaagataatagaagcatacaccgcctgggccacaggtaaggtgaagaagaaggtcaccgtaatctatgatacgatgcaccactccacagccatgatggcccatgcaatagcagagggggccatgagcgagggggctgatgtgagggtctactacctccatgaggacgaccgcagcgagatcgtgaaggacatacttgacagtcacgccattgccctcggagcacccgcaatctacgatgaaccctacccgagcgttggagacctcctgatgtacctccgtggtctgaagttcaacaggaccgggcagaggagggccatggtattcgggtcaatgggtggcaggggaggtgccaccgggaccatgcagaaactccttgcggatgctggattcgatgtcatggaggcggatgaaatctactacgtcccgaacaatgaggaactcgatgcatgcttcgaggctggaagaaggcttgcaggtgatctcaatgaatga

SEQ ID NO: 45285 - protein, 409 aa, Methanothermobacter thermautotrophicus str. Delta H
MCGDIMKARAEKIADGLYWTGVLDWDIRNYHGYTLQGTTYNAYLVFGDEGVALIDNSYPGTFQELMARMEDAFNREGREMRVDFIVQNHVERDHSGVLVELHRRFPEAEIHCTEVAVEGLLKHYPALEGTEFRTVKTGDSIDLGGRTLTFLEAPLLHWPDSMFTFLDTGILFSNDAFGQHLCYPQRLDTEIPEYILMDAAKKFYANLITPLSKLVLRKFDEVKELGLLDKIGMIAPSHGQIWTEPMKIIEAYTAWATGKVKKKVTVIYDTMHHSTAMMAHAIAEGAMSEGADVRVYYLHEDDRSEIVKDILDSHAIALGAPAIYDEPYPSVGDLLMYLRGLKFNRTGQRRAMVFGSMGGRGGATGTMQKLLADAGFDVMEADEIYYVPNNEELDACFEAGRRLAGDLNE

SEQ ID NO: 45286 - DNA, 1179 bp, Clostridium acetobutylicum ATCC 824
  CDS (1)..(1179)
atgagtgctgaaaagctttgtgaaaatgtatattgggtaggtgtaaaggatcaaaaattaagagtgtttgacataataatgaatacaaaaaaagggtcaacatataattcttatttaattaatgatgataaggttgcaataatagatactgtaaaagatggtttttatgatgaatttttaaaaagtattaaaagcgttataggcgacaaaaaggtagactacatagtcgtgcagcatacagaattagatcacagtggttctatgtatagattgataaaagagtatccagaagctaaggttgtttcatcaaaagcagctaatatgtatttaaaagagatagtaaatgatgaatttaatagtttagatgctatggaagtgaaggagcttaatttaggtaaaaatacattagaatttatatctgcccctaaccttcattggccagatacaatgttcacttataataaagaaaataatatactatttacctgtgatgttatgggatgccactattgccctgatggaagcataaaggatgagggtggagaagattatcttccagaaatgagatattactttgatgtaataatgtcaccttttaagaagtttgtaaatatgggtttagataaaattaaagatctaaagcttgatatgatagctccaagccatggaccagttcatattaatgatatagaggaaagtgtgaagctttatagagagtgggctaaagaaaaggaacctaaggagaagaacgttcaaatattttatattactgcctatggaaacacaggtatcatggcaaaacatttatgcgaggatataaataaaaaaggtgtaaaggcagaagtgcatgagataactgatatgaaaatggaagatatagttgaattgatagcagatgctaatggagttttggttggttctccaacaataaatcaagacgctgtaagacctgtatgggatgttctttcatcagtatgtcctatagttaatagaggaaaggcagcagctgcatttggatcttatggatggagtggagaaggtgtccctatgatgatggatagattaaagtccttaaagtttaaaactccagacaatggtcttaagtttaaattcgtacctgctagtaaagagttcagcgaagccgataaatttgtagatgattttataggtttattataa

SEQ ID NO: 45287 - protein, 392 aa, Clostridium acetobutylicum ATCC 824
MSAEKLCENVYWVGVKDQKLRVFDIIMNTKKGSTYNSYLINDDKVAIIDTVKDGFYDEFLKSIKSVIGDKKVDYIVVQHTELDHSGSMYRLIKEYPEAKVVSSKAANMYLKEIVNDEFNSLDAMEVKELNLGKNTLEFISAPNLHWPDTMFTYNKENNILFTCDVMGCHYCPDGSIKDEGGEDYLPEMRYYFDVIMSPFKKFVNMGLDKIKDLKLDMIAPSHGPVHINDIEESVKLYREWAKEKEPKEKNVQIFYITAYGNTGIMAKHLCEDINKKGVKAEVHEITDMKMEDIVELIADANGVLVGSPTINQDAVRPVWDVLSSVCPIVNRGKAAAAFGSYGWSGEGVPMMMDRLKSLKFKTPDNGLKFKFVPASKEFSEADKFVDDFIGLL

SEQ ID NO: 45288 - DNA, 1203 bp, Clostridium acetobutylicum ATCC 824
  CDS (1)..(1203)
gtgccagctataaaaattaaagataatatattttctgttggagttctaaatcctagtctccgtatttttgacatcataatgaaaacagaatacggtacttcctataatgcttatctaattaaaggtaaaaaaaatgtacttatagatacagtacatggaagatttttcgatgaatatttagaaaatataaaaagtgtaatagacccttcctctattgactatgtaataatgaatcactgtgaacctgatcactctggctctcttgctagattgtacgaagtagcccctcagattaaagttattgcctcaaatgctggaaaaatatacctaaaaaatattacaaacaaagaaaccttagacgtaaaagcagtcaaaacaaatgatactttagacataggcaatggaaaggtcctaaagttcgccattgctccattccttcattggccggattcaatgtttacaattcttgaggaagacaaaatagccttcacctgtgatttccttggatgccacttctgtgaaccaagaatgtttgatacaaaaataacctatatgccgaaatatgagaaatcctttaaagagtactatgacgctattttttctccttttaaaccttatgtagtaaaaggacttgatattttggacgcattagatttagacttcatagctacaagccatggtccaatcctaacacgagaaggtctattagcggcatcaaaacaaaaatatagagacttaagttccgaaattcaaagtacaactaaatatatccctatattttactgtagtgcttatggtaatacggaaatattagctaatgaaattgcttccggaataaaaagcgtattaaatgatgctaatatagaaatgctagatataattaactatgattattcagatttaaaagaaaagattaatatttgtgatgcatttatgcttggaacacctactataaacaaagatgccctatttccaatatgggagcttattggaggcattgatgctgtaaactgcaaaaacaaacccgcttccgcttttggttcctttggatggagtggagaggctattcctttcgttatttcaagacttaaagaattaaaacttaaagtatttcaagatggttttacatgtttatttgttccatctgaggatgatattaaaaaagcctttaaatttggagaagactttgccaaaagtatatag

SEQ ID NO: 45289 - protein, 400 aa, Clostridium acetobutylicum ATCC 824
MPAIKIKDNIFSVGVLNPSLRIFDIIMKTEYGTSYNAYLIKGKKNVLIDTVHGRFFDEYLENIKSVIDPSSIDYVIMNHCEPDHSGSLARLYEVAPQIKVIASNAGKIYLKNITNKETLDVKAVKTNDTLDIGNGKVLKFAIAPFLHWPDSMFTILEEDKIAFTCDFLGCHFCEPRMFDTKITYMPKYEKSFKEYYDAIFSPFKPYVVKGLDILDALDLDFIATSHGPILTREGLLAASKQKYRDLSSEIQSTTKYIPIFYCSAYGNTEILANEIASGIKSVLNDANIEMLDIINYDYSDLKEKINICDAFMLGTPTINKDALFPIWELIGGIDAVNCKNKPASAFGSFGWSGEAIPFVISRLKELKLKVFQDGFTCLFVPSEDDIKKAFKFGEDFAKSI

SEQ ID NO: 45290 - DNA, 1122 bp, Clostridium perfringens str. 13
  CDS (1)..(1122)
atgtacacaccttatggaacaacttataattcatatgttgtaaaaggtagtgaaaaaacagcaatatttgaaactgtaaaagctgaattctttgatcaatatatagcaagattaaaagacttaggtgtagaaccttcagaaattgactatatcgttgtaagtcatactgagcctgaccatgctggttctataggtaaaatattagaattagctcctaatgctaaaatagtagcatcacctatagctattaactatataaaagaaatagttaatggagatttcgaatcaatcccagttaaagatggagattcaatttctttaggaaataaaactttaaaattcatgtcagtaccattcttacactggcctgatacaatctacacttacgtagaagaagataaaactcttatcacttgtgattcattcggaagccactattcttgtgaagaaatgtttgatgatttaattcctaatgaagaagaatatatggaagcattaaaatactactttgattgtataatgggaccatttaaaccatatgttttaaaagctcttgataaaataaaaggattagacatagaaataatctgtccaggtcatggtccaatcttaagatctaacccatataaagtggttaatctttataaagaatggagtactccagctccagctaaggaagttaaaaaagcttcaatattctatgtttctgcatatggatatactaaacaattagctgaaaaaatagctgaaggtattaaatcaactggaaacttagacataaatctatttaatataatagaacatgatatgacagaattagttggcgaagttggttcatcagatgctatattatttggttctccaacaatcgtaaatgaacttgttgagccagtaagagacttaatggcaaaacttaaccctgtagttcatggtggaaaaatagctggtgcctttggttcatatggatggagtggtgaagctgttcctagaatagaaagtagattaaaagaattaagaatgaaaatgcctgttgaaggtttaagaattaaatttaagccatcagaagaagaagctcaaaaagctttcgactttggtgttgaaataggaaatgctttaaaataa

SEQ ID NO: 45291 - protein, 373 aa, Clostridium perfringens str. 13
MYTPYGTTYNSYVVKGSEKTAIFETVKAEFFDQYIARLKDLGVEPSEIDYIVVSHTEPDHAGSIGKILELAPNAKIVASPIAINYIKEIVNGDFESIPVKDGDSISLGNKTLKFMSVPFLHWPDTIYTYVEEDKTLITCDSFGSHYSCEEMFDDLIPNEEEYMEALKYYFDCIMGPFKPYVLKALDKIKGLDIEIICPGHGPILRSNPYKVVNLYKEWSTPAPAKEVKKASIFYVSAYGYTKQLAEKIAEGIKSTGNLDINLFNIIEHDMTELVGEVGSSDAILFGSPTIVNELVEPVRDLMAKLNPVVHGGKIAGAFGSYGWSGEAVPRIESRLKELRMKMPVEGLRIKFKPSEEEAQKAFDFGVEIGNALK

SEQ ID NO: 45292 - DNA, 1221 bp, Clostridium perfringens str. 13
  CDS (1)..(1221)
atgaataaagaaattaaactaagaaatgatatttactcagtaggagtaattgacaatagacctgttccatttcacagattaatattagaaaaaggaactacatacaatagttatttattaaaaactagaaagccaacagttattgatactgtagatttaatatatacaaaagattttttaaataatttaaaagagattattgatttaaaagatataagttacatagttattaatcatacagaaccagatcattcaggtgcattaggtggactagctagacaagctattaatgctaaaatagtttgcagtgaaaaagccgtatatcatctaaaagaattatataaattacatgatagagattttatagtagtaaatgatggggatacccttgatataggaggaaaaacattattatttaaaatgactccttatcttcacactgaggaaacaatgattacatatgatgtggaagataaaatattatttccttgtgatatttttagtactcatcttactgccaaggaacatttctcaagtaaatcaaatgaagatattacagaggactttttaacttactataaacttataatggaaccacatagaaaatacattagaccactgattgatatattaaaagatttagatatagaagttattgctccatcacatggttatatactagatgaaaatattcaatcatatattgatatatatgataaatatagtaaagaaactaaaaaagggaaaaaagctactatagtttacactacaatgagaaatgcaacaaaaaaaatagctgaaaaattcaaatctgaattagaaaatgaggatattgaagtttatatatttaatgcagataaaagtactaaagaagatatattagcttcaataaaagaatcagattcaatactatttggtacttcaactaaatatggagatttaataggttctattgaagatatattaaaagaattacctaaattagatttaagcaataaacttttaggtgcttttggttcatttggatggagtggtgaacctatagaaataattcaggattacttaaactctacaaatggtaatgttttaaatacttcatcaataataaaatctactggtatgattgatgttcatttcccagtaagaattagattctcactaaatgaagaatcagaaaaagaagttgtaagagctgctgattatatcagttcaataatataa

SEQ ID NO: 45293 - protein, 406 aa, Clostridium perfringens str. 13
MNKEIKLRNDIYSVGVIDNRPVPFHRLILEKGTTYNSYLLKTRKPTVIDTVDLIYTKDFLNNLKEIIDLKDISYIVINHTEPDHSGALGGLARQAINAKIVCSEKAVYHLKELYKLHDRDFIVVNDGDTLDIGGKTLLFKMTPYLHTEETMITYDVEDKILFPCDIFSTHLTAKEHFSSKSNEDITEDFLTYYKLIMEPHRKYIRPLIDILKDLDIEVIAPSHGYILDENIQSYIDIYDKYSKETKKGKKATIVYTTMRNATKKIAEKFKSELENEDIEVYIFNADKSTKEDILASIKESDSILFGTSTKYGDLIGSIEDILKELPKLDLSNKLLGAFGSFGWSGEPIEIIQDYLNSTNGNVLNTSSIIKSTGMIDVHFPVRIRFSLNEESEKEVVRAADYISSII

SEQ ID NO: 45294 - DNA, 2637 bp, Clostridium perfringens str. 13
  CDS (1)..(2637)
atgaattatttagaagtaaaaaaagatatttattgggttggatctttagatcctgaattaagagtttttgatattattatgtacactccttacggaactacttataactcatatgttgttaaaggtagtgaaaaaatagctgtatttgaaacagtaaaagaaaaatgttttgatgattacctatcaaaacttaatagcttaggtattgatcctaaatcaatagattacatagttgttgatcatacagagcctgaccatgctggatctgttgaaaaattacttgaattatctcctaaagctaaagttataggttcaatgcaagctatagaattcttaaaagatatagttaataaagattttgaatatatagttgttggagataacgacacaatttcattaggaaacaaaacattacaatttatctctgcaccatttttacattggccagattcaatgtacacttatattccagaggataaagctttaataacttgtgactcttttggaagccactattcttgtgaagaagtatttaatgacttagttcctaatgaagaggaatatttagatgccttaagatactactatgattgtatctttggaccatataaaccatatgttttaaaagctatagataagattaaagatttagatatagaacttgtatgcccaggtcatggacctatccttagacaagatccttggaagataataaatacttataaggaatggagtactccagtaaaacctaaaataaatggagataaaaaggttactattccttacgtatcagcttatggttatactaaagaattagctgaagaaatagctaagggaatacaatctgaacataatgttgaagttaaattatatgatttaacttatagcaagcaagaagatgtattagctgacataggagaatccgatggtatattatttggatcaccaacaatagttggagaattattacctcctattagaattcttttagctaacttaaaccctattattcacggtggaaaatatgctgcagcctttggttcatttggttggagtggtgaagctgttccaagaatagaagctagattaaaagaattaaaaatgaatatatttggacctggtttaagaattaagttcaaaccatcaacaactgaattaaaagaagcttttgaatttggtagagatttctcaagaactatgtttggagaaaaagaacttgattatgctccaaataatgctacagaaactaaagaagtattaactggaaatggtaaaacaagatattggaaatgtttagtttgtggtgaaatattcgaaagtccagtatgccctgaagtttgccctgtttgtggagctggaaaagaacaatttatagaagtagaaatggatacttttgaaaagaatgatactaatgataacttcgttattataggtaatggagctgctggattctacgctgctaaaacaataagagaaataaacagtactgcttctgttaaattactttcaagtgaagaagtatcttcttactcaagaccaaatctttcagatcttttaaatgaagaaatgaatttagatactttctacttagctaaatcttcttggtacaaagaaaataatatagaagaattactaggagttactgttacttctatagataaagatgctaaaaaagtaatcttaaaagatggtactgaaataccatatactaaacttatattagctaatggtagccataactttattccaccatttagaattaaaaacaatgatgaagaagttactttaaattgtgaaaatattcatgagtttaaaggtatctattctattaaagacttaaaagatacttttgatgttaaagaagaaatgaaagaagctaagaaggctgttgttataggtgctggtcctcttggattagaagcagcttgggaaatgaaacttgctggattagatgttacagtagttgaattcttaccaaatcttatgaataaccaattagatcaagaaggtgctgatatctttaaaaatcaagtttctgattgtggaataacattcataacatcagatgaatgtactgaaataataactaaagatagcaaattaacttctttaaacttaaagagcggaaaaactttagatgctgatattcttctagtttcaacaggtattagaagtaatatagaattagctaaagaaagtggaattgaatgcaatagaggtgttattgttaacgaaagaatggaaacaagtgttaaagacatatatgcttgtggagatgtagctgaatttaatggtcttgtttacggaaattggcctgctgctatagaaatgggtaaaactgctggtgcaaatgcatgtgaagcagaaaaagcatttgaaaactttacaccatctataatattagatgctttaaatactcatgtattctcagctggtttaataagatttaacgattcttcttatgaaaaaataagttctaaagatgaatcaaaaggtcaatatactaaactattcttcaaagacaacatcttagttggaggaattatagttggtgatatttctaaggcaggacaaataataatagcaatagataataaactatctaaagcagctgctttatcaaatgatttactataa

SEQ ID NO: 45295 - protein, 878 aa, Clostridium perfringens str. 13
MNYLEVKKDIYWVGSLDPELRVFDIIMYTPYGTTYNSYVVKGSEKIAVFETVKEKCFDDYLSKLNSLGIDPKSIDYIVVDHTEPDHAGSVEKLLELSPKAKVIGSMQAIEFLKDIVNKDFEYIVVGDNDTISLGNKTLQFISAPFLHWPDSMYTYIPEDKALITCDSFGSHYSCEEVFNDLVPNEEEYLDALRYYYDCIFGPYKPYVLKAIDKIKDLDIELVCPGHGPILRQDPWKIINTYKEWSTPVKPKINGDKKVTIPYVSAYGYTKELAEEIAKGIQSEHNVEVKLYDLTYSKQEDVLADIGESDGILFGSPTIVGELLPPIRILLANLNPIIHGGKYAAAFGSFGWSGEAVPRIEARLKELKMNIFGPGLRIKFKPSTTELKEAFEFGRDFSRTMFGEKELDYAPNNATETKEVLTGNGKTRYWKCLVCGEIFESPVCPEVCPVCGAGKEQFIEVEMDTFEKNDTNDNFVIIGNGAAGFYAAKTIREINSTASVKLLSSEEVSSYSRPNLSDLLNEEMNLDTFYLAKSSWYKENNIEELLGVTVTSIDKDAKKVILKDGTEIPYTKLILANGSHNFIPPFRIKNNDEEVTLNCENIHEFKGIYSIKDLKDTFDVKEEMKEAKKAVVIGAGPLGLEAAWEMKLAGLDVTVVEFLPNLMNNQLDQEGADIFKNQVSDCGITFITSDECTEIITKDSKLTSLNLKSGKTLDADILLVSTGIRSNIELAKESGIECNRGVIVNERMETSVKDIYACGDVAEFNGLVYGNWPAAIEMGKTAGANACEAEKAFENFTPSIILDALNTHVFSAGLIRFNDSSYEKISSKDESKGQYTKLFFKDNILVGGIIVGDISKAGQIIIAIDNKLSKAAALSNDLL

SEQ ID NO: 45296 - DNA, 1176 bp, Pyrococcus furiosus DSM 3638
  CDS (1)..(1176)
atgaaaagtgtgaaacttttggatggagtctattgggttggtgttaaggactggagcaggagaatatttgactccctcatccccctcccggaaggtacctcttacaacgcctacctcgtggttggcaacgaaaagagcgccctcatagacacggtaaacccaggtttcgagagagaacttgaggaaaaggtcagtgagatagtcccccttaaggagatagactatgtggtcatgaaccatgctgagcctgaccacgcgggtgcaataccatacataatggagcgcaacaaaaaggctctgctcatcacaacggaaaagggaaaagagctcgcgaaagcatactacaatgtccccgatgagaggataatagtcgtgaaggacggggatgaggtagacctcggtggcaaaacgctccgctttatagaggctccatggctccactggccggagacgatgtttacctatctcgttgaggacaaagtgctgttcccatgtgacttcttcggtgctcacactgcccacggcctctacgatgacgaggttccttctataatcgagtacgcccagaggtacttcggtgagataatgatgcccttcgcaggcatggccaaaagggccatggaaaagctcaaagggctggaaatcaaaatgatagccccaagccacggtcccatctatagaaacccggagaggattctaaaagcctacgaaagctgggtaaatggggagactagggagaaggtacttgtagcttatgtgagcatgtggggctccaacagagagatggcgaaggagctggctgatttacttgtggccaaagggattgacgttaaggtttacgacctcgtgagcgccgacatcggggagcttgcaaaggacctcgttgactcaagggccatagttctggcggctcctacagtgctcgggagcgcccatccgctcgccgtttatgctgcctacctcgtgaaagccctgagacccccggcgaagtacgccgtcctaataggttcccacggatggcacgggaggagcatagatgcaatactggagatcctgaagggtgcaaactttgaagtgctcgggacggtagatgctcacgcaaggccgaaggaagaagactacaaagccctccacagcttggctgacctcttggcgaaaaaggttagaggtgagtga

SEQ ID NO: 45297 - protein, 391 aa, Pyrococcus furiosus DSM 3638
MKSVKLLDGVYWVGVKDWSRRIFDSLIPLPEGTSYNAYLVVGNEKSALIDTVNPGFERELEEKVSEIVPLKEIDYVVMNHAEPDHAGAIPYIMERNKKALLITTEKGKELAKAYYNVPDERIIVVKDGDEVDLGGKTLRFIEAPWLHWPETMFTYLVEDKVLFPCDFFGAHTAHGLYDDEVPSIIEYAQRYFGEIMMPFAGMAKRAMEKLKGLEIKMIAPSHGPIYRNPERILKAYESWVNGETREKVLVAYVSMWGSNREMAKELADLLVAKGIDVKVYDLVSADIGELAKDLVDSRAIVLAAPTVLGSAHPLAVYAAYLVKALRPPAKYAVLIGSHGWHGRSIDAILEILKGANFEVLGTVDAHARPKEEDYKALHSLADLLAKKVRGE

SEQ ID NO: 45298 - DNA, 1245 bp, Pyrococcus furiosus DSM 3638
  CDS (1)..(1245)
atgccaaaagtttggattgagaagttaacggaagatatggaactttatctaataagagttgatgacgaccagataaagtactttgaagcagcctgggacattccagaggggataacgtacaactcctaccttctaaagcttaatgatgctgttgttttgtttgacacagtaaagaaagattatgaagatttattcatggatgcactaaagaagctagttgatccaaaggaaataacccatataatagttcaccacaccgaaccagatcacagtggagctcttcccagggttctcgaggagaacgagtataaagctatggtaataggaactcagtttgcaaggaacttgctcgaaggcttttacggaaaaaaggtcgtagagaactttaaggtaataaaagacggagaagaaatgaaaataggaggaaagacattccggtttataacagttccttggcttcattggccagacacaatgataacttacttggttgaggataagataatattctcttgcgacgctggtggggggtactcaatcccagagaccatagacgatagcagtgaggaagtggtagagaaatacctaccctatgtcacaaagtacattgtcaccgtaataggtcactaccacaagtacattgtggagaacataagaaaactaaaagagcttggcatagtaaaagatgtaaaaatgattcttcctggccacggtttaatatggaggagagaccccattagaatatttagacactatgaagaagtgggagctggtagagcagaaaaaggaaaagtgcttgtagtttacgattcaatgtatgggtttgtggagaagagaatggacattgttatagacgagctgaagaagcacggaatgaagcccgtaatctacaagtacacggacaaggtagctcctgctgtaagcgatatccttggcgaggttccaagtgctgaggcaatagttattggagtctcaacgtatgaagccgatatacaccccaggataagatatctcctctacgaaattatagacaaggcaaactacgaaaagccagtgttgatagtgggagcctttggctggggaggaggagcagggaagaaaatagagagcatgataacaaggagcaaattcgaccacgtaatgaccgttgaaagcaagggagctccctctgcagaggatgaggaaaagataagagatgctgtaagggaattaattcagaggagcctaccaacaggaaatacataa

SEQ ID NO: 45299 - protein, 414 aa, Pyrococcus furiosus DSM 3638
MPKVWIEKLTEDMELYLIRVDDDQIKYFEAAWDIPEGITYNSYLLKLNDAVVLFDTVKKDYEDLFMDALKKLVDPKEITHIIVHHTEPDHSGALPRVLEENEYKAMVIGTQFARNLLEGFYGKKVVENFKVIKDGEEMKIGGKTFRFITVPWLHWPDTMITYLVEDKIIFSCDAGGGYSIPETIDDSSEEVVEKYLPYVTKYIVTVIGHYHKYIVENIRKLKELGIVKDVKMILPGHGLIWRRDPIRIFRHYEEVGAGRAEKGKVLVVYDSMYGFVEKRMDIVIDELKKHGMKPVIYKYTDKVAPAVSDILGEVPSAEAIVIGVSTYEADIHPRIRYLLYEIIDKANYEKPVLIVGAFGWGGGAGKKIESMITRSKFDHVMTVESKGAPSAEDEEKIRDAVRELIQRSLPTGNT

SEQ ID NO: 45300 - DNA, 1212 bp, Fusobacterium nucleatum subsp. nucleatum ATCC 25586
  CDS (1)..(1212)
atgtattgttgtacaaaaataaatgatgatattatttggattggtattaatgacagaaaaactgaaagatttgaaaactatattcctttggataatggagtaacatataattcatatctaataatggatgaaaaaatatgtatagttgatggtgttgaagaaggagaaaatggaaattttttaagtaaaatagaagcaatgataggtaattctcctgttgattacattattgtaaatcatgtcgagcccgaccactctggttcaattaaaaatatgttaaaaatttatccagaattaaaagttgtaggaaatgcaaaaactataatgatgttaaaattattaggtcttgacctaccagatgaaagagttgtaattgtaaaagaaaaagatattttagatttaggaaaacataaattaactttctatttaatgcctatggtgcattggcctgaatcaatggcaacttatgatataacagataaagttttattttcaaatgatgcttttggaagttttggagcattagatggtgcaatttttgatgatgaagttaatacagatttttttactgatgaaatgagaagatattattcaaatatagttggaaaatttggtgctcctgtaaatgccatattaaaaaaattatcttctgttgaaatttcttgtatctgcccttctcatggtctaatttggagaaaatatataaaagaaattatagaaagatatcaaaaatgggctaatatggaacctacaaaagaaggtgtagtaatagtttatggaagtatgtatggaaatactgctgaaatggcagaaattttaggaagagaattgggaaatagaggaataaaagatgttataatttatgactcatctaaaacagatcactcatatatattcagtacaatttggaaatataaagggcttatgttaggttcatgtgctcataataatgatatttatccaaaaatggaaccattacttcataaattagaaaactatggtttaaaaaatagatatttaggaatttttggaaatatgatgtggagtggtggtggagtaaaaagaatcaaagaatttgctaatactttgactggtctagaacaagttggagagcctattgaaataaaaggacatgttacttctgctgaaagagatagattaattgaacttgctaatcttatggcagataaacttattgctaatagaaaataa

SEQ ID NO: 45301 - protein, 403 aa, Fusobacterium nucleatum subsp. nucleatum ATCC 25586
MYCCTKINDDIIWIGINDRKTERFENYIPLDNGVTYNSYLIMDEKICIVDGVEEGENGNFLSKIEAMIGNSPVDYIIVNHVEPDHSGSIKNMLKIYPELKVVGNAKTIMMLKLLGLDLPDERVVIVKEKDILDLGKHKLTFYLMPMVHWPESMATYDITDKVLFSNDAFGSFGALDGAIFDDEVNTDFFTDEMRRYYSNIVGKFGAPVNAILKKLSSVEISCICPSHGLIWRKYIKEIIERYQKWANMEPTKEGVVIVYGSMYGNTAEMAEILGRELGNRGIKDVIIYDSSKTDHSYIFSTIWKYKGLMLGSCAHNNDIYPKMEPLLHKLENYGLKNRYLGIFGNMMWSGGGVKRIKEFANTLTGLEQVGEPIEIKGHVTSAERDRLIELANLMADKLIANRK

SEQ ID NO: 45302 - DNA, 1218 bp, Fusobacterium nucleatum subsp. nucleatum ATCC 25586
  CDS (1)..(1218)
atgcataatgttagaaaaataactgaagatctttattggattggagcaaatgaccgtcgtcttgcactttttgaaaatatacaccctattccagaaggagtgtcatataactcatatatgttattggataaagaaacagtcgtttttgatactgttgactggtctgtaacaagacaatatattgaaaatatagaatatttattaaatggtagagaattagactatttagtagtacatcatatggagccagatcactgtggttcgattgaagaattagctcttcgttatccaaaaatgaaaataatttcttctgaaaaaggatttatgtttatgagacaatttggatacaaaagtataaatggtcatcaattaattgaagccaaagagggagataaattcaaatttggtaaacatgaaattgtatttttagaagcacctatggttcactggccagaagtattagtaagttttgatactacaaatggagcattattctcggctgatgcttttggttcgtttaaatctcttgatggaagattatttaatgatgaagtaaattgggatagagattggttagatgaaggtcgtcgttacttaacaaatattgttggaaaatatggacctcatattcaacatctattgaaaaaagcaggaccaattgttgataaaattaaatttatttgtcctttacatggtgtagtttggagaaatgattttggatatttaattgataagtatgataaatggagtagatatgaacctgaagaaaaaggaatattaattgcttatgcttcaatgtatggtaatacagaaaatgctgttgaaattctagctgctaaattagctgaaaaaggaattacaaatattaagatgtttgatgtgtcaaatactcatgtatcttatttaatttcaaatgtattcaaatatagccatatagttatagcttctcctacatataatttaggaatttatccagttattcataactttgtaatggatatgaaagctttaaacttacaaaatagaacagttgcaatagttgaaaatggttcttgggctagaaaatctggagatttattacaagaattctttgaaactcaaataaaagatataactgttttaaatgaaagagtagggttaacttcatcagctaacaatgtaaaccttgatgaaatggatacacttgttgatgctttggttgaatctttaaataaatag

SEQ ID NO: 45303 - protein, 405 aa, Fusobacterium nucleatum subsp. nucleatum ATCC 25586
MHNVRKITEDLYWIGANDRRLALFENIHPIPEGVSYNSYMLLDKETVVFDTVDWSVTRQYIENIEYLLNGRELDYLVVHHMEPDHCGSIEELALRYPKMKIISSEKGFMFMRQFGYKSINGHQLIEAKEGDKFKFGKHEIVFLEAPMVHWPEVLVSFDTTNGALFSADAFGSFKSLDGRLFNDEVNWDRDWLDEGRRYLTNIVGKYGPHIQHLLKKAGPIVDKIKFICPLHGVVWRNDFGYLIDKYDKWSRYEPEEKGILIAYASMYGNTENAVEILAAKLAEKGITNIKMFDVSNTHVSYLISNVFKYSHIVIASPTYNLGIYPVIHNFVMDMKALNLQNRTVAIVENGSWARKSGDLLQEFFETQIKDITVLNERVGLTSSANNVNLDEMDTLVDALVESLNK

SEQ ID NO: 45304 - DNA, 1248 bp, Methanosarcina acetivorans C2A
  CDS (1)..(1248)
gtgtaccgtattttggtacattttattttgagagtaaatgattcagaagagagttggaggaaaagtatggaaatatataatatcccggagattgccaggaatgttttcggagttgggtcaaaagattggaaccgcaggatcttcgattctttaatcccgttgccagagggtaccagctacaattcttatctcgtgaaaggcgagaaaaaaacagccctcatagataccgtgaatccgggttttgaagaggaattggaagcaaaaatcaacatggtttcggacctgaaaaaactcgattacctgataatgaaccatgcagaaccggaccacgccaatgcaattcgatttatccttgaaaaagctccagaggccctgtttgtcacgaccaagaaaggagtaaagatggcaaagctctaccatgagctgcctgaagcccgaatcaaaatcgttgccgaaggagatagccttgaccttggaggaaagactcttcgtttcatagaagctccctggctccactggccagaaaccatgtttacatacctgcctgaagataaagtccttttctcatgcgactttttcggggcacatacagcccagggagtctatgacgaagagatcgaagagctagtttctcttgcaaagcgctactacggggaaatcatgatgccctttgggaaaatgggagccagagcccttgagaagataaaggaccttgggatagaaataattgcccccagccacgggccgatttacaaaaacccgaagcgaatcctggacccttatgagaaatggactcaaggaaaaaccgagaacaaagcccttattgtttatgtgagtatgtgggggtctacccgggagatgatcaggacaattgcagaaaccctgctaaaagaaggagtggatgtcaggatgtatgaccttgtagcctcggacataggagatgttgcaagggaactggttgattccaggtctatagtccttggagcaccgacagtcctcggaggtatgcacccgcttgccctgtacggcacttacctggtaaaagccctcaaccccccggcaaagtatggggttgtactcgggtcctttggctggggaggaggtgcactgaagcaggcaggcgaactcctggctccttctaaaatagagattgtgggcaccctacaggtacagggcagagccagcagagaaaaattaaagaaagttgaggagatagggcgagaactggctcgaaaaatgaagacataa

SEQ ID NO: 45305 - protein, 415 aa, Methanosarcina acetivorans C2A
MYRILVHFILRVNDSEESWRKSMEIYNIPEIARNVFGVGSKDWNRRIFDSLIPLPEGTSYNSYLVKGEKKTALIDTVNPGFEEELEAKINMVSDLKKLDYLIMNHAEPDHANAIRFILEKAPEALFVTTKKGVKMAKLYHELPEARIKIVAEGDSLDLGGKTLRFIEAPWLHWPETMFTYLPEDKVLFSCDFFGAHTAQGVYDEEIEELVSLAKRYYGEIMMPFGKMGARALEKIKDLGIEIIAPSHGPIYKNPKRILDPYEKWTQGKTENKALIVYVSMWGSTREMIRTIAETLLKEGVDVRMYDLVASDIGDVARELVDSRSIVLGAPTVLGGMHPLALYGTYLVKALNPPAKYGVVLGSFGWGGGALKQAGELLAPSKIEIVGTLQVQGRASREKLKKVEEIGRELARKMKT

SEQ ID NO: 45306 - DNA, 1218 bp, Methanosarcina acetivorans C2A
  CDS (1)..(1218)
ttgggagatatggaaacagaaaaaactgacggagccgtcgaaattgccaggggagtttactgggtaggagcaatcgactggaacggcagggattttcacgggttcaccacgcctggtgggacgacctacaactcctatcttgttgtgggggaaaaaactgcccttatcgataccgtaaaggctccctttgcaggggagatgctcaggcgtattacccagataatcgatccttcaaagctcgattacattgtagtaaaccatatggaacttgaccacgcaggttctctggccgagctcaaaaaacaaaccgatgcaaagattttcattacaaaacggggcgttgacatccttaacggctatttcagaggcctgggcagtgagaactgggatcttgaggttgtgcagaccggagatgaactggaccttggaggcaagaccctcatgttccttgaagccacaatgcttcactggcctgacagcatggaaactttcctgaaagaagaccggatcctcttctcaaacgatggtttcgggcagcacatagccacctcaaagaggtatgacttcgaagtaggggatgttatcccggatgctgccgagtattatgcaaacatactgatgccgtttcacatgcctctgcttcgttttatgggagtactggacaaaatgggagtggaccctctgcagatcgccccttcccacgggatcatctggaaacaggacctcaaaaaaatccttgaggcatacagggcatgggctaatggggaagtaaatgaaaaggtgcttgtcatatacgacactatgtggggaagcacggaaataatggcaaccgagattgcagaagcggtccgggcggcgggagttgaggtcaaacttcttaaccttcggaaaaacacccggaaccatataatgaaagagatgctcgatgcagctgcctttgcagtgggatccccaactcttaataacgggcttttcccaacagtaggagacttcctggtatatctcaaaggccttcgcccccagaagaaaaaagctgtggctttcggatcatacggatggggcggaggagcagtaaaaacagtagaaaaagaattaaaagatacaggaatcgaagtgctggaacccggactgcagattaggtacagaccatatgaaaaagagctggaaagatgcagaaaactcggggagcagcttgcggctgttgcaaaagagcagtaa

SEQ ID NO: 45307 - protein, 405 aa, Methanosarcina acetivorans C2A
MGDMETEKTDGAVEIARGVYWVGAIDWNGRDFHGFTTPGGTTYNSYLVVGEKTALIDTVKAPFAGEMLRRITQIIDPSKLDYIVVNHMELDHAGSLAELKKQTDAKIFITKRGVDILNGYFRGLGSENWDLEVVQTGDELDLGGKTLMFLEATMLHWPDSMETFLKEDRILFSNDGFGQHIATSKRYDFEVGDVIPDAAEYYANILMPFHMPLLRFMGVLDKMGVDPLQIAPSHGIIWKQDLKKILEAYRAWANGEVNEKVLVIYDTMWGSTEIMATEIAEAVRAAGVEVKLLNLRKNTRNHIMKEMLDAAAFAVGSPTLNNGLFPTVGDFLVYLKGLRPQKKKAVAFGSYGWGGGAVKTVEKELKDTGIEVLEPGLQIRYRPYEKELERCRKLGEQLAAVAKEQ

SEQ ID NO: 45308 - DNA, 1179 bp, Thermoanaerobacter tengcongensis MB4
  CDS (1)..(1179)
atgaaagcaatggtcataaaaccgggagtaagcaagataggagcagttcactgggagagaaggttgtttgactcgttaattcccctgccagatggtactagctataacgcttatctggtagaaggcaaggagaaagttgcgcttttggacactgttgacccgatgacagaatatattttgatggaacaactgaaagatgtgaaaaagattgattatataatagctcatcacgcagagcaggaccattcaggcagtatccctgcagttttggaaaagtataaagaggcgaaggtggtgtgcactccaaaggctaagactttcctaatagatctccttcccatacctgaagacaaatttatcactgtggaagatggagatactttagaccttggaggtaaaaccctcaagttcatacatgccccatgggttcactggcctgagacgatgttcacttacttggtggaagacaagatactttttacatgcgactttttaggttcacaccttgcgacttctgagctttatgctacagatgaatgtaaagtatatgattcagctaaaaggtactatgcagaaataatgatgccttttaggaactttatagaaaagcaccttgagaaaataaaggatttagatatagaaataatagctccaagccatgggcctgtttataacaaccccgagtttatattaaatgcgtacagagaatgggttttagacaagcctaaaaacattgtgttaatcccttatgtgacaatgcacggcagtgtaaagaaaatggtagaatatctagaggctgctttagtagagaggggagttattgtaaagccttttgacctctctgtaactgatataggagaatttgcaatggctttagtggatgctgccacagtcgtcatggccactcctactgtgctggtagggccacacccaatggctgtttacgccgcttatctcacaaatgctttgaaacctaaagttaaattcatttcagtgattggctcctacaactgggggagcaaggctgtagaccagattactcagatgtttggtaacttaaaagtagaatttattccttcagtatatataaaaggctatccaaaagaagaagactttaaagctcttgatgcacttgctgaggaaattgtaaaaaggcacaaagaagcaggaattatgtaa

SEQ ID NO: 45309 - protein, 392 aa, Thermoanaerobacter tengcongensis MB4
MKAMVIKPGVSKIGAVHWERRLFDSLIPLPDGTSYNAYLVEGKEKVALLDTVDPMTEYILMEQLKDVKKIDYIIAHHAEQDHSGSIPAVLEKYKEAKVVCTPKAKTFLIDLLPIPEDKFITVEDGDTLDLGGKTLKFIHAPWVHWPETMFTYLVEDKILFTCDFLGSHLATSELYATDECKVYDSAKRYYAEIMMPFRNFIEKHLEKIKDLDIEIIAPSHGPVYNNPEFILNAYREWVLDKPKNIVLIPYVTMHGSVKKMVEYLEAALVERGVIVKPFDLSVTDIGEFAMALVDAATVVMATPTVLVGPHPMAVYAAYLTNALKPKVKFISVIGSYNWGSKAVDQITQMFGNLKVEFIPSVYIKGYPKEEDFKALDALAEEIVKRHKEAGIM

SEQ ID NO: 45310 - DNA, 1197 bp, Methanosarcina mazei Go1
  CDS (1)..(1197)
atggggatgaaaaatatgaaaaattataatattccggaaatagcccggaacgtattctgggttggggcaaaggactggaaccgcaggatgtttgacgctctgattcctctgcctcaggggacaagctataacgcttaccttgtaaaaggagaaaagaaaacagctctcatagataccgtgaacccgggatttgaagaggagttcgaacaaaaaataaaccttgtttccgacctggaaaagcttgactatctggtcatgaaccatgccgagcctgaccattccagcgcgattcgttatattatggataaggctcctgactccatacttgtcgcgactgaaaggggaataaagatggcaggcctttatcatgagcttcctgaagatcgcataaaggttgttgctgaaggggacagcatcgaccttggcgggaagactctccgcttcatagaagcgccctggctccactggccggaaaccatgtttacatatctgccggaagaaagagtacttttcccatgtgattttttcggagctcatactgcccagggagtttatgacgacgacctggaagaccttatccccctggcaaaacgctattacggggaaataatgatgcccttcaataaaatgggggcaaaggctcttgaaaaaataaaggacctcgagattgacattatagctccaagccacgggccgatatataagaatccagagaggatacttgagccttacagaaaatggactgctggaaaaactgaaaataaagcccttgttgtctatataagcatgtggggctcaacaaaagagatggtaaatgcaattgcagaaactcttcttaaagaaggagttgatgtaaggatgtatgaccttgcggcctcagacctgggggatgttgccagagagcttgtagactcaagagccattatactggggactcctacagtgcttgcaggaatgcacccgcttgccctgtacggtgcttacctggtaaaagcgctcaaacctccggctaaatacggagttgtcctggggtcattcggctggggaggaggagcattgagacaggcaggagatatcctgaccccttcaagtatggaagttgttggtacgcaccaggttaagggcagggcgaaagaggaagacctaaagaaaatagaagagataggcaggcaacttgctcaaaaaatgaaagcttaa

SEQ ID NO: 45311 - protein, 398 aa, Methanosarcina mazei Go1
MGMKNMKNYNIPEIARNVFWVGAKDWNRRMFDALIPLPQGTSYNAYLVKGEKKTALIDTVNPGFEEEFEQKINLVSDLEKLDYLVMNHAEPDHSSAIRYIMDKAPDSILVATERGIKMAGLYHELPEDRIKVVAEGDSIDLGGKTLRFIEAPWLHWPETMFTYLPEERVLFPCDFFGAHTAQGVYDDDLEDLIPLAKRYYGEIMMPFNKMGAKALEKIKDLEIDIIAPSHGPIYKNPERILEPYRKWTAGKTENKALVVYISMWGSTKEMVNAIAETLLKEGVDVRMYDLAASDLGDVARELVDSRAIILGTPTVLAGMHPLALYGAYLVKALKPPAKYGVVLGSFGWGGGALRQAGDILTPSSMEVVGTHQVKGRAKEEDLKKIEEIGRQLAQKMKA

SEQ ID NO: 45312 - DNA, 1227 bp, Chlorobium tepidum TLS
  CDS (1)..(1227)
atgaccgataataaaattcttccaattaccgacgatgtctcctggattggcgtgcttgatccgggcctgatcaccttcgatatcgtcatggagaccaaatacggcactacctacaattcttacttcatcaacgccgagaaaaaaacggtggttgaaacgaccaaggtgaagttctggccgacctatatcgaaaaattgaaaaaggtggtcaatcctgaagagatcgaatacatcatcgtcgatcacaccgaacccgaccactcgggtaacgtacacaacttgctctccgttgcgccgaatgccactgtggtgggtagcggtaacgccatcaagttcctgcgtgaccagaccggccacgacttcaaacatcttgtagtcaagcatggagacaagctcgacctcggcaacaagacgattcacttcattggtgctccaaacctgcactggcctgacacgatctactcctggctggaggaggatagggtactctttacctgcgactccttcggctgccactactgcaacgaagcgatgtatgatgacctctgtggtgatttcgatgacgcatttaaatactactttgacgccattttgaggccgttcagcaagtacatgcttcaggcgatcgaaaaaatacgcccactcgatattaaagtcatttgccctggccatggaccgatcctgcgctcggactggaagaaatatgtcgatctttcggagcgatacgctaaaagcgccattgccatgccaaatgagaagagcattctcatcgcctatgtctctgcttatgaaaacacctcggtgctggcgcaaaagatcgccgaaggcttgcggtcagcgtgtgacttcaacgttgatgtttgtgatatcgaaaacatgtcggcagagaaacttgaagagaagattgcgcattcgatgggaatcatcatcggctctcccaccatcaaccagaacattgttcatcagatctacggcatttttgccgtgctcaatccgttgcgcgaccgtggcaaactggccgcagcgttcggctcatacggctggagtggtgaaggagtaaaaatcatcgagagcaacctggctaacctcaagctcaaggtgttcgaccagaacgtgatggtcaagttccagcctcacgaacctgaattcgagcagtgcagggaattcggaaaggcatttgctgaaaaaatgatcgagatgtacaatcttacctgcaatattaaatag

SEQ ID NO: 45313 - protein, 408 aa, Chlorobium tepidum TLS
MTDNKILPITDDVSWIGVLDPGLITFDIVMETKYGTTYNSYFINAEKKTVVETTKVKFWPTYIEKLKKVVNPEEIEYIIVDHTEPDHSGNVHNLLSVAPNATVVGSGNAIKFLRDQTGHDFKHLVVKHGDKLDLGNKTIHFIGAPNLHWPDTIYSWLEEDRVLFTCDSFGCHYCNEAMYDDLCGDFDDAFKYYFDAILRPFSKYMLQAIEKIRPLDIKVICPGHGPILRSDWKKYVDLSERYAKSAIAMPNEKSILIAYVSAYENTSVLAQKIAEGLRSACDFNVDVCDIENMSAEKLEEKIAHSMGIIIGSPTINQNIVHQIYGIFAVLNPLRDRGKLAAAFGSYGWSGEGVKIIESNLANLKLKVFDQNVMVKFQPHEPEFEQCREFGKAFAEKMIEMYNLTCNIK

SEQ ID NO: 45314 - DNA, 1200 bp, Clostridium tetani E88
  CDS (1)..(1200)
atgtattgtgttagaaaaataactgaagacctttattgggttggtggcaacgaccgtcgccttgccctttttgaaaatattcatcccattccaaagggagtttcctataactcttatctacttttagatgaaaaaactgtactctttgatactgtagactggtcaatttgtcgccagttcattgaaaatgttaaaggagttttagggaacaaacctttagattatatggtaattaaccatgtagagccagatcatgcagcatgtgttgaagaaattattcttcgttatcctgatgtaaaaattatatgtactgaaaaagcacttatgtttatgaatcaatttggttttaatatagatgaaaaagtaatagaagttaaagaaggagacactatgtcctttggaaaacaccaagtagtatttgtgtctgctccaatggtgcattggccagaagctatggtaacatatgacactactgaaggcatactattttctgccgatgcctttggctcttttggttccttagatggtaagttatttaatgatgagataaacattaacagagattggattgatgagggaagaagatattatacaaacattgtaggaaagtatggagctcatgttcaatctttgttaaagaaagcagcagatttagatattaaaattatttgtccattacatggaccagtatggcgtaataatttagattacttacttgataagtacgataagtggagtagttatgaacctgaggaaaaaggtgtaatgattgtttatgcatcaatgtatggaaatacagaagctgctgccaacgatttagcaacaaggctagtggaaaagggaatgaccaatgtggctatgtatgatgtttcaaaaactcatgtatcttatcttatttctgagacatttaaatacagtcatgtggttcttgcttctgtaacttacaatttaaacatttatccgccaatgtttaattatattatggatatgaaagcattaaatctacaaaagcgtacctttgctctcattgaaaatggatcctgggcccctcaatcaggacaattaatgtataagcttttagatgaaatgaaagaaatgacaattttagataatgaaatatcattgaattctactataaaaaaagatgacatggattcaatagaagaacttgcccaaaatattatagaatcaatgaattaa

SEQ ID NO: 45315 - protein, 399 aa, Clostridium tetani E88
MYCVRKITEDLYWVGGNDRRLALFENIHPIPKGVSYNSYLLLDEKTVLFDTVDWSICRQFIENVKGVLGNKPLDYMVINHVEPDHAACVEEIILRYPDVKIICTEKALMFMNQFGFNIDEKVIEVKEGDTMSFGKHQVVFVSAPMVHWPEAMVTYDTTEGILFSADAFGSFGSLDGKLFNDEININRDWIDEGRRYYTNIVGKYGAHVQSLLKKAADLDIKIICPLHGPVWRNNLDYLLDKYDKWSSYEPEEKGVMIVYASMYGNTEAAANDLATRLVEKGMTNVAMYDVSKTHVSYLISETFKYSHVVLASVTYNLNIYPPMFNYIMDMKALNLQKRTFALIENGSWAPQSGQLMYKLLDEMKEMTILDNEISLNSTIKKDDMDSIEELAQNIIESMN

SEQ ID NO: 45316 - DNA, 1188 bp, Clostridium tetani E88
  CDS (1)..(1188)
atgagctttaaagtaacaaataaagttacttgggttggtaaaattgattgggaattaagaagatttcatggagatgaatattcaactcatagggggacatcctacaattcctatctaataaaagataaaaaaatagttttaattgatacagtatgggaacccttttctaaggagtttgtggagaacttaaaaaaagaagtagatttaaataaaattgactatataataatgaatcataatgaaatagatcatagtggagctttgccactactaatgaaggagattcctaatacacctatttattgtactgctgatggagctaaaattttaaaggcacattatcataaggattggaactttgttgaggtaaaaacaggagatactttggatataggtgaaagtaaactaacctttgtagaggctaaaatgttacactggccagatagtatgtttacctatatgtcaggagagaatatattgtttagtaatgatgcttttggtcaacattatgcctcagatttaatgtataatgacttagtagatcaggctgaattatatcaagaaagtatgaaatactatgctaatatcttaacaccttttaatagctttgtaattaaaaagatagaagaagttttagcgcttaatttaccactaaacatcatagccacaagtcatggagtcatatggagagataatccggctcaaataatagagcagtacataaaatgggctaatggctatgaagaaaatcaaataaccgttctttacgatactatgtggaatggaacaagaagaatggcagaaggtatagctgaggggattaaatctgtaaataaagatattacagttaaactttttaatgcggcgcattcagataaaaatgatgttataacagaaatatttaaatcaaaagtgctattagtaggttctgcaacagtaaataaaagtattatgtctgctacagcaggaatacttgatatgataagaggattaggattaaagaataaaaaagcagcggcttttggagcttatggatggagtggagaggcagtgaaaatattagaggaaaaattaaagaatggaaagtttgaaatactagaatcaggaataaaagaactttggaatccagataaagatgctatgaatagatgtagacaatttggcaagaatattgtagaaaaattatag

SEQ ID NO: 45317 - protein, 395 aa, Clostridium tetani E88
MSFKVTNKVTWVGKIDWELRRFHGDEYSTHRGTSYNSYLIKDKKIVLIDTVWEPFSKEFVENLKKEVDLNKIDYIIMNHNEIDHSGALPLLMKEIPNTPIYCTADGAKILKAHYHKDWNFVEVKTGDTLDIGESKLTFVEAKMLHWPDSMFTYMSGENILFSNDAFGQHYASDLMYNDLVDQAELYQESMKYYANILTPFNSFVIKKIEEVLALNLPLNIIATSHGVIWRDNPAQIIEQYIKWANGYEENQITVLYDTMWNGTRRMAEGIAEGIKSVNKDITVKLFNAAHSDKNDVITEIFKSKVLLVGSATVNKSIMSATAGILDMIRGLGLKNKKAAAFGAYGWSGEAVKILEEKLKNGKFEILESGIKELWNPDKDAMNRCRQFGKNIVEKL

SEQ ID NO: 45318 - DNA, 1248 bp, Clostridium tetani E88
  CDS (1)..(1248)
ttgggggtaataaatatgatgaaaaatgtaataattaaagaaaaaatttatttagtaggaaaaattgatgatagggatgtaccatttcatagattaactttaacaaagggaacaacttataatagctatcttttgcttacagaaaaacctacaattattgatactgtagatataagttttggaagggaatatattcaaagtctaaaaaacttaatagatttagataaaattcaatatatagtaataaaccatacagaaccagatcattcaggagctttaggaagtcttgcttacaatgctaaaaatgcaactattgtttgtacagataaagcagttgatcagttaaaagctatgtataaactttataatagaaatttcttagtagttaaaaatggagatactttagatattggtgggaaaactcttgaatttataaaaacaccgtatcttcatacagaagaaactatggtaaccttcactaaagaagataaaatattatttccatgtgatatattcagtactcacatatcaaattatgaatactttaacgataaagctaaagaggacatattagaggattttaaaacatattacagtttaataatgcatcctcacagaagatatgtacaaaatatgataaataaaatagaaaatttggatatagaaattatagcaccatcccatggttttatattaagggaagatgttaaaaaatttataaatatatatgatgaaatgagtaaaaatacaaatatagataaaaaagttttaatattgtattctacaatgacaaacaatactaaaaagatttcagaactaataaaagaacattttgaaagggatagtataaatacagaattaattaacgttaataaaacatcagatgaggagatatttaaaaaagttaaagagtcagatgcggtgcttgttggaacatcaacaaaatacggagatatgataggaagactagaagatattctaaaaagtttaaaggatatggatttagaaaataaaatagcagcagcatttggatcttatggatggagcggagaaggtattgaagttgtacaggattatttaaatgaaacaaatatgaaagttttaagtacttcatacattataaaatccacaggaatgacagacgtgaaatttccaataagaattaaattttcaccagaagaaaatgataaagaagaaataaagaaaacaactacatttatagtagacttgttattaaattcaatataa

SEQ ID NO: 45319 - protein, 415 aa, Clostridium tetani E88
MGVINMMKNVIIKEKIYLVGKIDDRDVPFHRLTLTKGTTYNSYLLLTEKPTIIDTVDISFGREYIQSLKNLIDLDKIQYIVINHTEPDHSGALGSLAYNAKNATIVCTDKAVDQLKAMYKLYNRNFLVVKNGDTLDIGGKTLEFIKTPYLHTEETMVTFTKEDKILFPCDIFSTHISNYEYFNDKAKEDILEDFKTYYSLIMHPHRRYVQNMINKIENLDIEIIAPSHGFILREDVKKFINIYDEMSKNTNIDKKVLILYSTMTNNTKKISELIKEHFERDSINTELINVNKTSDEEIFKKVKESDAVLVGTSTKYGDMIGRLEDILKSLKDMDLENKIAAAFGSYGWSGEGIEVVQDYLNETNMKVLSTSYIIKSTGMTDVKFPIRIKFSPEENDKEEIKKTTTFIVDLLLNSI

SEQ ID NO: 45320 - DNA, 1197 bp, Bacteroides thetaiotaomicron VPI-5482
  CDS (1)..(1197)
atggaacagaaaacaagaattaaaggaaatgtccactatgtgggagtaaatgaccgtaataaacaccgttttgaggcgttatggccgttgccctatggagtttcgtataactcttatttgattgatgatgaaatggtggcgttggtggatactgtagatatctgttattttgaagtctacttgcgcaagatcaagcaagtaatcggcgaacgtcctattaactatttgattataaatcacatggagccggatcattcgggctccatccgattgattaaacaacactatccggatattattattgtcggcaataagcaaaccttcggcatgattgaaggattctacggtgttaccggcgagcaatatctggtgaaagacggagacttccttgcattaggcaagcatatgcttcgtttctatatgactccgatggtgcactggcccgaaacgatgatgacatttgatgaaacggacggaatccttttctcaggtgacggattcggatgctttggcactgtagacggaggatttctggatacccgtatcaatgtagataagtactggggtgaaatggtgcgttactactccaatatcgttggcaaatacggtagtccggtacagaaagccctgcaaaaattgggaggactgcctatcactaccatttgctctacacacggaccggtatggacagagaatatttccagggtgatcggtatctacgaccgtctgagccgttatgatgcggacgaaggtgtggttatcgtatatggcagtatgtatggaaatacggaacagatggcggaagctattgctgcggaactctcagcacagggaatcaggaatattgtgatgcacaatgtgacgaagagtcatccttcttatatccttgcagatattttccgttataaaggattgattgtcggttctccgacatacagtaatcagatattcccggaagtggaatcgttattgtctaagattctggttcgcgaactcaaaggacgttatttgggatacttcggttccttcacctgggcaggagctgctgtgaagcgtatggctgaatttgcggaaaagagtaagttcgaactggtaggcgatccggtagagatgaaacaggcgatgcaggatattacttatacccagtgtgagaacctggcacgtgcgatggcggaccgcttgaaaaaagaccgctaa

SEQ ID NO: 45321 - protein, 398 aa, Bacteroides thetaiotaomicron VPI-5482
MEQKTRIKGNVHYVGVNDRNKHRFEALWPLPYGVSYNSYLIDDEMVALVDTVDICYFEVYLRKIKQVIGERPINYLIINHMEPDHSGSIRLIKQHYPDIIIVGNKQTFGMIEGFYGVTGEQYLVKDGDFLALGKHMLRFYMTPMVHWPETMMTFDETDGILFSGDGFGCFGTVDGGFLDTRINVDKYWGEMVRYYSNIVGKYGSPVQKALQKLGGLPITTICSTHGPVWTENISRVIGIYDRLSRYDADEGVVIVYGSMYGNTEQMAEAIAAELSAQGIRNIVMHNVTKSHPSYILADIFRYKGLIVGSPTYSNQIFPEVESLLSKILVRELKGRYLGYFGSFTWAGAAVKRMAEFAEKSKFELVGDPVEMKQAMQDITYTQCENLARAMADRLKKDR

SEQ ID NO: 45322 - DNA, 1845 bp, Prochlorococcus marinus subsp. marinus str. CCMP1375
  CDS (1)..(1845)
atgttcaataattcaaagaatcaattcacacaatcttcgaatggcaaagatgtagttcagctaccaatagaagatggatttatttctattagatgccttagccccaaaaaactaaggtttgaaattgaatattccttaggtaaaggaacaacttccaatgcatttcttttttcaaaaaataatggatctcacataatttctcctgctgttttggtgaatccacctggagccaactttcaagaagtatttctaccaacattaaaaacgcttatcaataaaaccaaagaactacatattattattggtcatgtcaatccaaatcgcattagccttctacgagcactcgccacagaatttaaaaatataaaaattatctgttctaatccaggtggaaaattacttaaagaactctggtatcaaaaaaagccttctaaagaaaagctgaatgaagagaaagggttaattattccttctttaccagaaattcgtttaataaaacaagaagaatctatttctatcttcaacgattatgaattgagattaatacctgcccctacagctcgatggcctggtggactaatagctttggaagaaaaaacaggcttactaatgagtgacaaattatttggtacacatatttgtacagcagaatgggccgagagcaatagaagtagcacagaagaggaaaggcgtcattattttgactgtcttatgactccaatggtgagtcaaattaatcgaattattgaaaaaattgagttgcttaatattacgtcaattgcacctggtcatggaccagcaattgacacaagctggcgcagtttattaaatgattatcaaagatggggaggacagcaaagcaaagcctctatcaaaatcatcctgttatttgccagtgcatatggaaatactgcatcaattgcagatagtctagctaaaggaattagttcaactggagttcaagtaacaagtctaaattgcgaatttacaccagccaatgaattattaaatgagatacaaaaagcagatgcatatctcattggttcgccaaccctaggaggacatgcaccgacaccgattgtgtctgcactaggcactttgcttgcagaaggagatagaaacaagcctgtaggtatattcggtagttacgggtggagtggtgaagctttagatttgctagaaaataagttacgtaatggaggctttgaatttgcctttgatccaatcaaaatcaagttcagtccaaatgctgaagtaataaaaacacttgaagaaacaggaacaatgttagggaggaaacttattaaaaaagagcgtcaagaacaacgtcgattaagtggaggtattaatgctacaaaaagtgaccctgcattattagcacttgggaaagttgtcggctccttatctatcttggcagctcaaaaacatgaagaagaaaattccattagcagtgcaatggtagctagttggattagccaagcgagtttctcaccaccaggaatcacaattgccgtagctaaagatagagctgtagaagctttgctacataagcaagatctctttactttaaatattttaaatgaaaataattatcaaaattccctaaaacaatttcttcaacctttcttgccaggagaagatcgattatcaggcttaaatttactacgcagccctggagagcaacccatacttcctgaggccatagcatggatagaaggttgtgtaaaacaacgaatggagtgtggtgaccactggctaatttatgcagaaatcctacatggaaaagttttagatccgaatggagttacagctgtacatcatcgtcataccggagcaaattattaa

SEQ ID NO: 45323 - protein, 614 aa, Prochlorococcus marinus subsp. marinus str. CCMP1375
MFNNSKNQFTQSSNGKDVVQLPIEDGFISIRCLSPKKLRFEIEYSLGKGTTSNAFLFSKNNGSHIISPAVLVNPPGANFQEVFLPTLKTLINKTKELHIIIGHVNPNRISLLRALATEFKNIKIICSNPGGKLLKELWYQKKPSKEKLNEEKGLIIPSLPEIRLIKQEESISIFNDYELRLIPAPTARWPGGLIALEEKTGLLMSDKLFGTHICTAEWAESNRSSTEEERRHYFDCLMTPMVSQINRIIEKIELLNITSIAPGHGPAIDTSWRSLLNDYQRWGGQQSKASIKIILLFASAYGNTASIADSLAKGISSTGVQVTSLNCEFTPANELLNEIQKADAYLIGSPTLGGHAPTPIVSALGTLLAEGDRNKPVGIFGSYGWSGEALDLLENKLRNGGFEFAFDPIKIKFSPNAEVIKTLEETGTMLGRKLIKKERQEQRRLSGGINATKSDPALLALGKVVGSLSILAAQKHEEENSISSAMVASWISQASFSPPGITIAVAKDRAVEALLHKQDLFTLNILNENNYQNSLKQFLQPFLPGEDRLSGLNLLRSPGEQPILPEAIAWIEGCVKQRMECGDHWLIYAEILHGKVLDPNGVTAVHHRHTGANY

SEQ ID NO: 45324 - DNA, 1773 bp, Prochlorococcus marinus subsp. marinus str. CCMP1375
  CDS (1)..(1773)
atgagtactaactcaagagcagtcatcgaacaaaaaattactagccctagactttcattgcaatgcgagccaattgcaagcaatactaccgcgattagatcactagactgggatcgcagtcgatttgatattgaatttggtttacgaaatggaacaacctacaacagttttattattcaaggagaaaaaacagccttaattgatagcagccatgtcaaattcagaagcacttgggttgacgcactaaccaaatgcattgatccaaaaacaattgattttttaattgtcagtcataccgagccagatcattctggattaataagcgacattctagatctcaataatgatattgaaattgttggctcaaaagttgccattcaatttttagaaaaccaaattcatcggccttttaaatctacagcaataaaaaccgggggagaacttgatttaggtattaatccatctaatggtatccatcacaaacttgacttcattagtgctccaaatcttcattggccagatacaattttttcttttgatcatgcaacaagtattctttacacatgtgacgcttttggccttcattactgtacagatgaattatttgatcttgatccagatgcaattcttcccgattttcgctactactacgattgtttaatgggtccaaatgcgcgcagtgttcttcaagcacttaagcgaattaaaaatttaccaaccatacaaacaattgccgtaggtcatggacctcttttgcgtcataatttagatctatggttaaataattaccaggagtggagtggtcaacgaagtcaaggagaagattatgcagcggtatgctatatcagtcaatatgggttttgtgatcgactaagtcaagcaattgcattaggaataaataaagcagatgcacaagtacaactagttgacatcagagcttctgatgcacaagaactcagtgcacttattggagatgcaaaagctgttgttgttccaacttggcctaataagcctgacgctgaactccaaagctcgataggaacattgcttgctgcattaaaaccgaagcaatgggtcgccgtatatgaaggctatggaaaaaatgatgagccaattgatgttgttgcgaatcaattgagaagtttgggacaaaaagaagctttttcgcctctaagggtcaagcaatcacctgatgctaatacttttcaacaatttgatgaagccggaactgatctgggacaattactcaatcgaaagaaaaatattgcaaccatcaaaagctttgatggagatcttatgaaagcaatgggtcgtattagtggaggactatatgtagtaacagctagccaaggtgatgatagtaataagcgtagaggtgccatggttgcaagttgggttagccaagcaagtttcaatcctcctggtcttacagttgctgtagcaaaagatcgtgcaattgaggcgctgatgcaagtaggtgatcgttttgttttaaatgtgctagaagaaaataactatcaacacttattcagacaatttctaaaaagattccctccaggagctaatcgttttgaaggaattactgttatggaggatgtagccaaaggaggtccagtcttaggagatgcacttgcatatttagattgttttgtaaaacaacgtcttgaaacaactgatcactggatcatctatgcattagttgaacatggcaatatttcaaatacagagacaaaaacagccgtacaccatcgcaaagttggcacttcttactaa

SEQ ID NO: 45325 - protein, 590 aa, Prochlorococcus marinus subsp. marinus str. CCMP1375
MSTNSRAVIEQKITSPRLSLQCEPIASNTTAIRSLDWDRSRFDIEFGLRNGTTYNSFIIQGEKTALIDSSHVKFRSTWVDALTKCIDPKTIDFLIVSHTEPDHSGLISDILDLNNDIEIVGSKVAIQFLENQIHRPFKSTAIKTGGELDLGINPSNGIHHKLDFISAPNLHWPDTIFSFDHATSILYTCDAFGLHYCTDELFDLDPDAILPDFRYYYDCLMGPNARSVLQALKRIKNLPTIQTIAVGHGPLLRHNLDLWLNNYQEWSGQRSQGEDYAAVCYISQYGFCDRLSQAIALGINKADAQVQLVDIRASDAQELSALIGDAKAVVVPTWPNKPDAELQSSIGTLLAALKPKQWVAVYEGYGKNDEPIDVVANQLRSLGQKEAFSPLRVKQSPDANTFQQFDEAGTDLGQLLNRKKNIATIKSFDGDLMKAMGRISGGLYVVTASQGDDSNKRRGAMVASWVSQASFNPPGLTVAVAKDRAIEALMQVGDRFVLNVLEENNYQHLFRQFLKRFPPGANRFEGITVMEDVAKGGPVLGDALAYLDCFVKQRLETTDHWIIYALVEHGNISNTETKTAVHHRKVGTSY

SEQ ID NO: 45326 - DNA, 1776 bp, Prochlorococcus marinus subsp. pastoris str. CCMP1986
  CDS (1)..(1776)
atgataacttctgcaaaaacaagttcttcagaaatgaataaagttgagcaaaaattatctgtgcaacagaaagtttttgcagatgacacaattgcaattagatctctcgactgggatcgaagtaggtttgatattgaatttggattaagaaatggaactacttataatagttttatcattaagggccaaaaaatagcaataattgatacaagccacgctaaatttgaaaaactatggtttgagcaattacttagagaagtaaatccagaagaaattgattatttaattacaagtcatacagagcccgaccactcaggtttaattggaaaactcttaactcttaatccacaaataatagtagttggttcaaaattagcgcttaaatttattgaagatcaaatacatattccatttaaaagtttagaagtaaaaagtgggcaatatttagatcttggagctaaccctacaagtggagtaaatcataatattgaatttataagtgcaccaaatttacattggccagataccattttctcctacgatcacggtacaaatgttttatatacatgcgatgcttttggattgcattattgctctgatgaattttttgataatgatcaaaaagaaatttatgaagattttcgtttttattacgattgccttatgggccccaacgcacgaagtgttctacaagctatcaaacgaatagataagttacctagacttaaaactatagctgtgggtcatgggccattgcttcataatcaagtaaatttttggaaagaaaagtattcagagtggagtagtaacaagagtaaaggcaatgaatttgtatctgtatgctacatcagtgattatggatattgtgatcgattaagtcaagctatatctcacggcataagtaaggcagatgcacaggttcaattaattgatttaagatcttcagattctcaggaattaacaggtttaatttcagaatctaaagccgtagtaatcccaacctggcccgttacgtctgataatgaattaaaagagtctcttggcactctttttgccgcattaaagcctaaacaatttacggcagtttacgatgcttttggaggaaatgatgaaccgatagactcattagcaagtaagttgagagaattaggacaaaaagaagccttttcacctctaagagttaaaaatattccagatcctattatctatcaacaatttgaagaagctggaaccgacttgggacaattaattaataagaagaaaaatattgcttcaatgaaaagccttgattcaaatcttgataaagctttagggagattaagtggaggtttatatgtagttacagctagccaaggagaaggttcgacttttagacaaagcgcaatggtagcaagctgggttagtcaggcaagtttcagtccgccaggcattacagttgcagtagcaaaagatagagctattgaatcttatatgcaagttggagaaggttttgtagttaatatcttacgagaagataactatcaaaaaatgtttagacattttttaaaaagatttgcacctggggcagatagatttgctgatgtagatgtagtaaacaatatcgcaaatggtggaccagtactttctgattctctcgcatttttagattgtaaagtaagttcacgattagagactccagatcattggattatttacggtatagttcaaaatggaagcgtttctgatttatcctgtaaaacagccgttcatcataggaaagttgctaatcactactaa

SEQ ID NO: 45327 - protein, 591 aa, Prochlorococcus marinus subsp. pastoris str. CCMP1986
MITSAKTSSSEMNKVEQKLSVQQKVFADDTIAIRSLDWDRSRFDIEFGLRNGTTYNSFIIKGQKIAIIDTSHAKFEKLWFEQLLREVNPEEIDYLITSHTEPDHSGLIGKLLTLNPQIIVVGSKLALKFIEDQIHIPFKSLEVKSGQYLDLGANPTSGVNHNIEFISAPNLHWPDTIFSYDHGTNVLYTCDAFGLHYCSDEFFDNDQKEIYEDFRFYYDCLMGPNARSVLQAIKRIDKLPRLKTIAVGHGPLLHNQVNFWKEKYSEWSSNKSKGNEFVSVCYISDYGYCDRLSQAISHGISKADAQVQLIDLRSSDSQELTGLISESKAVVIPTWPVTSDNELKESLGTLFAALKPKQFTAVYDAFGGNDEPIDSLASKLRELGQKEAFSPLRVKNIPDPIIYQQFEEAGTDLGQLINKKKNIASMKSLDSNLDKALGRLSGGLYVVTASQGEGSTFRQSAMVASWVSQASFSPPGITVAVAKDRAIESYMQVGEGFVVNILREDNYQKMFRHFLKRFAPGADRFADVDVVNNIANGGPVLSDSLAFLDCKVSSRLETPDHWIIYGIVQNGSVSDLSCKTAVHHRKVANHY

SEQ ID NO: 45328 - DNA, 1776 bp, Prochlorococcus marinus str. MIT 9313
  CDS (1)..(1776)
atgaacgttgcgagcaaagacaccacggtgacaacggccagcactgctccaaggttgtcactgcaatgcgcagctatcgctagcgacaccaccacgatccgtgccctcgattgggaccgcagccgctttgatatcgagttcggcctccgtaacggcaccacctacaacagcttcctggtgagaggtgccaagacagcactgatcgataccaaccacctcaagtttgaggacacctggctaccgatgcttaagcagcaaatcgatccaaaagcgatcgactatctcatcatcagccacaccgaacccgaccattccgggctagtgggccagatcatcgatctcaatcccgagatcgaaatcgttgcttcgaaggtcgccatcaagttcctagaagatcaggtgcatcgccccttccgctcgcgagaagtcaaaagcggcgaagaactggatctaggcactaactcaacaagcggtatcgctcaccgcttcgaatttctgagtgcgcccaacctgcactggccagacacaatcttctctttcgaccacgccacagggattctttacacctgtgatgcatttggtctgcactattgctcagaagaactcttcgaccaggacccctccgcactggccccagacttccgcttctattacgactgcttgatggggcccaatgcgcgcagtgttgtccaggctttgaagcgcatggatcagctgccagagatcaccacaattgccgttggtcacggcccgctactccgccaccatctcaagctttgggtcgaagactatcgcgactggagcagccaacgaaaccaaggagaaagctatgcagccatctgttatctcagttattacggcttttgcgaccggctcagccaagccattgcccacggcatcggcaaagccaaaggcgaggtacaactagtcgatcttcgcgccactgatgcgcaagaactgagcgcattaattggtgaagcaaaggctgtagtagtaccaacctggccatcccaaccagatgcagaactgcagagttcaattggcaccctattggcagctttgaatcaaaagcaatgggttgccgtttacgatgcctatggcggcaatgatgagccaattgatgcagtagcagcgcagctgcgtagccttgggcaaaaagaagctttcgaacctttaagggtgcggcaagctcctgacgggaatgtctaccaacgcttcgaagaagctggtaccgaccttggacaactgctcaaccaaaagcaaaatattgcggcaatgaaaagcctagatactgaacttgacaaggccatgggtacccttagtggcggcctttatgtcgtcaccgccagccaagatgaagagtccagccaacgacgtggcgccatgatcgcaagctgggtaagtcaagcaagtttcacaccgccagggctaaccgtcgcagtagccaaagacagagccatagaaaccctgatgcaagtaggggatcgtttcgtgatcaacgtattaagagaagacaactatcaacccttactaaggcaattcctcaaacgcttcccccccggagccgatcgtttcgaaggagtgaatgtactcaacaatgttgctaaaggaggccccgtcctcgtggatgcgctggccttcttggattgcctcgtcaaacagcgactagaaacccccgatcactggatcatctacgccctggtggaacaaggcaatgtggcggatgctgaagctaaaacagcagtacatcaccgcaaagtagggaaccactactga

SEQ ID NO: 45329 - protein, 591 aa, Prochlorococcus marinus str. MIT 9313
MNVASKDTTVTTASTAPRLSLQCAAIASDTTTIRALDWDRSRFDIEFGLRNGTTYNSFLVRGAKTALIDTNHLKFEDTWLPMLKQQIDPKAIDYLIISHTEPDHSGLVGQIIDLNPEIEIVASKVAIKFLEDQVHRPFRSREVKSGEELDLGTNSTSGIAHRFEFLSAPNLHWPDTIFSFDHATGILYTCDAFGLHYCSEELFDQDPSALAPDFRFYYDCLMGPNARSVVQALKRMDQLPEITTIAVGHGPLLRHHLKLWVEDYRDWSSQRNQGESYAAICYLSYYGFCDRLSQAIAHGIGKAKGEVQLVDLRATDAQELSALIGEAKAVVVPTWPSQPDAELQSSIGTLLAALNQKQWVAVYDAYGGNDEPIDAVAAQLRSLGQKEAFEPLRVRQAPDGNVYQRFEEAGTDLGQLLNQKQNIAAMKSLDTELDKAMGTLSGGLYVVTASQDEESSQRRGAMIASWVSQASFTPPGLTVAVAKDRAIETLMQVGDRFVINVLREDNYQPLLRQFLKRFPPGADRFEGVNVLNNVAKGGPVLVDALAFLDCLVKQRLETPDHWIIYALVEQGNVADAEAKTAVHHRKVGNHY

SEQ ID NO: 45330 - DNA, 1848 bp, Prochlorococcus marinus str. MIT 9313
  CDS (1)..(1848)
atgtcgatgtcctccatccacgagcctgctgcagcagcgcagcgaacggtgatcacactcccaatcgaaaagggcctgatcagcttgcgcggccttagtccacaacgtctgcgctttgagctggaatatgccctggagcgaggcagtaccgccaatagctttcttttctctgccggggacgactcatatgggcaacctcaagcggctgtcctggtacacccccctggcgacgcctatgcggaggttttcatgccggcactcgccaaggctctaccttcagataccacgacgttgaaggtggtcgttggtcacatcaaccccaaccgagttgcgctactcaaaaagctagccagcacctaccccaagctgaaattaatcagttccaatcccggcgccaaattgctcagagagctttgggagcaacgcaaaccagcaacacccaacaacaatgaacaagaagagtcatcccttccgtctcttccatccattgagattgttcgacaagaacagaagctctccctcagcaacgaacacgcattgtggctgctaccagcgccaacagctcgctggccaggcggcctactggccttcgaagaaagccttggcttgttgatgagcgacaaactattcgccgcccacctctgcacaagcgaatgggcagaagccaatcgcatcagcaccgaagaggagcgtaggcatttctacgactgcctgatggctcccatggccagccaggtagataccttagtagagcggcttgaagagctagacatccgcacgatcgccccatgccatgggccagccatagaaacgagctggcggagcctcttgaatgactaccgccgctggggtgaaagccaacaacaagcccctttaaaggtcgttcttcttttcgccagcgcctacggcaacacagcggcgattgctgacgcactcgcaaaaggagtctccagtactggtattcaagtagaaagcctcaactgcgaattcacacctgcgaatgaattggtgaatgcaatccaacaagccgatgcctacttgattggatcgccaacccttggagggcatgcaccaacaccaatcgtatcggccctaggaaccttgctggccgaaggtgaccgcaacaaaaaggtaggcatattcggcagctatggctggagtggagaggcattggaacttctcgaaaagaagctacgtgatggtggtttctcctttggattcgagccaatcaaagtgaagttcagtcccgatgctgccatggtgaaaaccctggaagagacaggaacactgtttgggcgaaacctgctcaaaaaacagcggcgtcagcaaccacgagcaagcagtggcatgagtgcaagccgtagcgatccagccgtgcttgcccttggtcgggtagtgggctcactatgcatcttgacggctcgtaaaggggaagggaatacagcgcttagcggcgcaatggtcgcaagctgggttagccaagccagcttttcaccgccagggctgagcgtggccgtcgccaaagaccgagccgttgaagcgttgctgcatcggggcgaccacttcgctctcaatgtgttggcagcaggaaggcaacacgaactgatgaaacatttcctgcaaccattcccagctggttcagaccggttcgcagggctagaccttgacgccagtcccgcaggtcaaccgctgcttaaaaatgctctggcatggcttgaaggatgcgtacagcaacgcatggaatgtggagaccactggctgctatatgccgagatcagccatggtgccctacttgagcgagaaggcacgacggctgtgcatcagcgccgcagcggggcgaactactga

SEQ ID NO: 45331 - protein, 615 aa, Prochlorococcus marinus str. MIT 9313
MSMSSIHEPAAAAQRTVITLPIEKGLISLRGLSPQRLRFELEYALERGSTANSFLFSAGDDSYGQPQAAVLVHPPGDAYAEVFMPALAKALPSDTTTLKVVVGHINPNRVALLKKLASTYPKLKLISSNPGAKLLRELWEQRKPATPNNNEQEESSLPSLPSIEIVRQEQKLSLSNEHALWLLPAPTARWPGGLLAFEESLGLLMSDKLFAAHLCTSEWAEANRISTEEERRHFYDCLMAPMASQVDTLVERLEELDIRTIAPCHGPAIETSWRSLLNDYRRWGESQQQAPLKVVLLFASAYGNTAAIADALAKGVSSTGIQVESLNCEFTPANELVNAIQQADAYLIGSPTLGGHAPTPIVSALGTLLAEGDRNKKVGIFGSYGWSGEALELLEKKLRDGGFSFGFEPIKVKFSPDAAMVKTLEETGTLFGRNLLKKQRRQQPRASSGMSASRSDPAVLALGRVVGSLCILTARKGEGNTALSGAMVASWVSQASFSPPGLSVAVAKDRAVEALLHRGDHFALNVLAAGRQHELMKHFLQPFPAGSDRFAGLDLDASPAGQPLLKNALAWLEGCVQQRMECGDHWLLYAEISHGALLEREGTTAVHQRRSGANY

SEQ ID NO: 45332 - DNA, 1749 bp, Synechococcus sp. WH 8102
  CDS (1)..(1749)
atggtcgtcgctgccgctgcaccaaagctgtcgctgcagtgcgaggccatcgccggtgatacgtgcacgatccgttcgctcgactgggatcgcagccgctttgacatcgagttcggcctgcgtaacggcaccacttacaacgccttcctggtgcgcggtgagcgcactgccctgatcgacaccagccacgccaaattccgcgacacctggattcctctgctgaaggagcagatcgagcccacagccatcgatgtgctgatcgtgagccacaccgaaccggatcactccggattgatcggcgacctaatcgacctcaaccccgacattgagatcgtcggctcgaaggtggcgctgcaattcctgcaggaccaggtgcaccggcccttcaagtcccgcgctgtgaagtccggcgaggagctggatcttggaaccaacccggagagcggcatccagcatcgcttcgaattcctcagtgctccgaacctgcactggccagacacgatcttttccttcgatcacggcaccggcatcctctacacctgcgatgccttcggcctccactactgctccgacgacgtcttcgacagtgacccgggcgccatcgccccggacttccgcttctattacgactgcttgatggggcccaacgcccgcagtgtgttgcaagccctcaaacgcatgggcggactgccggagatcaacacgatcgctgtcggccatggccccctactgcgccaccacctcagccactgggtgaacgactatcgcgagtggagtggtcaacgcagcaagggtgagagttatgcagccgtctgctatctgagccaatacggcttctcagatcggatcagccaagccatcgcccatgggatcggcaaggccgaagcccaggtgcagctggtggacctgcgcgccacggaccctcaggaactgacggcgctgattggagatgccaaagcggtggtggtgcccacctggccagcggaaccggacggagagctgcaggcctccatcggcaccttgctggctgcccttcaccccaaacaactggtgggcgtttttgatgcgtttggcggcaacgatgagccgattgacgccgtggccgatcagctgcgcagccagggccagaagcaggccttcgctccgctgcgcattcgtcaacttccgcaggggagcgattaccagcgctgcgaagaatccggcaccgacctcggccagctgctgaccaaggagaaagccatcgcggccatgaagagcctggatggggatctggacaaagccctggggcggatcagcggcgggttgtacgtggtgacagcgagccagggcgagggggaatcccagcgccgcagcgccatggtggccagttgggtgagccaggccagcttttccccgccgggcctcacggtggcggtcgccaaggacagggccatcgaggccttgatgcaggtggaggaccgctttgtgctcaatgtgctgcgggaggacaaccaccaaccgctgctgcgccatttcctcaagcgctttccccctggtgctgatcgctttgccggcgtgaacgtgctggaaggggttgcggatggcggccctgtgttgaccgatgccctggcttacctcagttgccgggtggagcaacggatggaaggacccgaccactggatcatctacgccgtggtggagcagggcaatgtggccgatgccgaagccagtaccgccgtgcaccaccgcaaagtgggcaaccactactga

SEQ ID NO: 45333 - protein, 582 aa, Synechococcus sp. WH 8102
MVVAAAAPKLSLQCEAIAGDTCTIRSLDWDRSRFDIEFGLRNGTTYNAFLVRGERTALIDTSHAKFRDTWIPLLKEQIEPTAIDVLIVSHTEPDHSGLIGDLIDLNPDIEIVGSKVALQFLQDQVHRPFKSRAVKSGEELDLGTNPESGIQHRFEFLSAPNLHWPDTIFSFDHGTGILYTCDAFGLHYCSDDVFDSDPGAIAPDFRFYYDCLMGPNARSVLQALKRMGGLPEINTIAVGHGPLLRHHLSHWVNDYREWSGQRSKGESYAAVCYLSQYGFSDRISQAIAHGIGKAEAQVQLVDLRATDPQELTALIGDAKAVVVPTWPAEPDGELQASIGTLLAALHPKQLVGVFDAFGGNDEPIDAVADQLRSQGQKQAFAPLRIRQLPQGSDYQRCEESGTDLGQLLTKEKAIAAMKSLDGDLDKALGRISGGLYVVTASQGEGESQRRSAMVASWVSQASFSPPGLTVAVAKDRAIEALMQVEDRFVLNVLREDNHQPLLRHFLKRFPPGADRFAGVNVLEGVADGGPVLTDALAYLSCRVEQRMEGPDHWIIYAVVEQGNVADAEASTAVHHRKVGNHY

SEQ ID NO: 45334 - DNA, 1803 bp, Synechococcus sp. WH 8102
  CDS (1)..(1803)
atgagcgtgaccagcacccgcaccgagcgacgcacgcttcaaattccgatcgacactggtgtggtggctctgcgcggtctgagcccccaacgccatcgcttcgagctggaatatgccctggaacgcggcagcaccgccaacagtgtgctgtttgccgccggggacgaccaacccgcagttctggtgcatccccccggagcggcctacagcgctgtcttccttccggcgctggcgaagctgctgccagacgcatcccatcccttgctggtggtagtgggtcacgtcaaccccaaccgcgtggcgctgctgcgcagcctcgctgagacctactcagggctggagctgatcacctccaacgctggcgccaaattgcttgaggaactctggacgcagcggaagccatcccctcctggagaagagcaagagcaaccgccgttgccggatctgccatcgctgcgggtgattcgccacgagcaaaccctggccatggcccatgggcgcagcctgcagctgatcgccacaccgacaccccgctggccagggggcctgctcgcatttgagcaaagcctggggctgctgatgagcgacaagtttttcagcgcccatctgtgcacagaggaatgggccgaaaccaaccgcaccagcacggaggaagaacgacgccacttctacgactgcttgatggcaccgatggcccgtcaggtggaaggggtggtggaacgtctggaggagctggacattcgcaccattgccccgggccacggacctgcgatcgaagacagctggcgcagcctgctgagtgattaccgccgctggggagaaggccagcagaacgccagcctgaatgtggctctgctgtttgccagcgcttacggcaacaccgccgctattgccgatgccctggcccagggtgtgagccgcaccggcatccgggtgaacagtctcaactgtgagttcacttcagcggatgaactgatcgggactattcagcaggctgacgcggttctgatcggatcacccaccctgggcggccatgcacccactccgatcgtctcggccctgggcacccttctggcggaaggcgatcgcaataaacccgttggcgtgttcggcagcttcggctggagcggtgaagctgtggacctgctggaaaccaagctccgcgatggcggcttcagcttcggattcgagccgatccgggtgaaattcagccccgacgccatgaaagtgaaggagctcgaggaaatcggcacccgctttggtcgacagcttctgcaggctcagaaaaaagcgcagcggcgcagtgctggcggcctcagtgaaagccgaagcgatccggcggtcctggccctcggtcgggtcatcggctccctttgtgtgctcaccacccgcaagggagagctcagtggcgccatggtggcgagctgggtcagccaggccagcttcactcctccggggatcaccgtggccgtggccaaggacagggccgtggaagcactccttcacaagggcgaccgctttgcgttgaacgtgctggctgaaggccgtgaaacggctccgatgaagcaattcctgcagccttttgcaccgggtgcggaccgctttgccggacttgagctccaggagagccctggtgatcaaccgctgttgccggagtcactggcgtggttagagggcagcgtgaagcagcgcatggaatgcggcgaccactggctggtgtacgcggaagtgctccatggaggcctgttcgatccagccggatcaaccgccgtgcaccaacgccgcagcggggccaactattaa

SEQ ID NO: 45335 - protein, 600 aa, Synechococcus sp. WH 8102
MSVTSTRTERRTLQIPIDTGVVALRGLSPQRHRFELEYALERGSTANSVLFAAGDDQPAVLVHPPGAAYSAVFLPALAKLLPDASHPLLVVVGHVNPNRVALLRSLAETYSGLELITSNAGAKLLEELWTQRKPSPPGEEQEQPPLPDLPSLRVIRHEQTLAMAHGRSLQLIATPTPRWPGGLLAFEQSLGLLMSDKFFSAHLCTEEWAETNRTSTEEERRHFYDCLMAPMARQVEGVVERLEELDIRTIAPGHGPAIEDSWRSLLSDYRRWGEGQQNASLNVALLFASAYGNTAAIADALAQGVSRTGIRVNSLNCEFTSADELIGTIQQADAVLIGSPTLGGHAPTPIVSALGTLLAEGDRNKPVGVFGSFGWSGEAVDLLETKLRDGGFSFGFEPIRVKFSPDAMKVKELEEIGTRFGRQLLQAQKKAQRRSAGGLSESRSDPAVLALGRVIGSLCVLTTRKGELSGAMVASWVSQASFTPPGITVAVAKDRAVEALLHKGDRFALNVLAEGRETAPMKQFLQPFAPGADRFAGLELQESPGDQPLLPESLAWLEGSVKQRMECGDHWLVYAEVLHGGLFDPAGSTAVHQRRSGANY

SEQ ID NO: 45336 - DNA, 1209 bp, Porphyromonas gingivalis W83
  CDS (1)..(1209)
atgtatcaagttcctcaagtaacagactccgtttactacgtgggcgtgaatgaccgctcgaaaagtctcttcgagaatatgtggccgttgccatacggtgtatcgtacaattcatatctcatcgtggacgaaaaagtagccctcatcgacacagtagatgtttgctattcggagattttcttcaagaagttggatacagtcctcaaaggacgccctatcgactatcttatcgtcgatcacatggagccggaccatagtggctcgataggcctgctgcgccaacgctatcccaatatgcaaatcgtcggcaacaagaagactcatgggatgctcgaaggctaccaccacattaccgaaggacttctagaggtaaaagaaggcgacaaactctccctcggcaaaaatgagcttactttcattttcgctccgatggtacactggccggaagtaatgttcacctacatgccaacccaacaggtcttgttctctgccgatgctttcggtacgttcggtacactcgacggacatatattcgacaaggatatggatctctctttccgctgggaggagatgtaccgctactacgcctgcattgtgggcaagtacggcagctttgtacagaaagtactcaccaagttcaaggaagccaatctgcctgttcaatatatatgctctacgcacggccccgtttggacaccggcacacttctctgaagccttcgacctctacgatcggatgagccgctacgaagccgaagaaggtgcagtgattctctacggcactatgtacggcaatacggaagtattggcagatacgatcgcacagggcattgctgcaggaggcatccgcaacgttgtatgccacaatgtagcattcagtccggcatctaacatcctgcgcgacatctttaagtacaaggcagtgataatcggtagccccacatacagcaatgagatcttttcaccgatcaagaatatcatggaaatgatccgtcttcgcgaggtaaaagatcgctatctgagcgtgttcggctcctttacatgggccggtcaggctgtgaaaaagatagttccttttgcagaagaaatgggttgggaaatggtaggcgaacctttggaacaaaagatgtctaccacggatgaactgtacgagaagggttgggagcttggcaataaaatagccgaacgtctgaaagccgatcgtcagtaa

SEQ ID NO: 45337 - protein, 402 aa, Porphyromonas gingivalis W83
MYQVPQVTDSVYYVGVNDRSKSLFENMWPLPYGVSYNSYLIVDEKVALIDTVDVCYSEIFFKKLDTVLKGRPIDYLIVDHMEPDHSGSIGLLRQRYPNMQIVGNKKTHGMLEGYHHITEGLLEVKEGDKLSLGKNELTFIFAPMVHWPEVMFTYMPTQQVLFSADAFGTFGTLDGHIFDKDMDLSFRWEEMYRYYACIVGKYGSFVQKVLTKFKEANLPVQYICSTHGPVWTPAHFSEAFDLYDRMSRYEAEEGAVILYGTMYGNTEVLADTIAQGIAAGGIRNVVCHNVAFSPASNILRDIFKYKAVIIGSPTYSNEIFSPIKNIMEMIRLREVKDRYLSVFGSFTWAGQAVKKIVPFAEEMGWEMVGEPLEQKMSTTDELYEKGWELGNKIAERLKADRQ

SEQ ID NO: 45338 - DNA, 1212 bp, Wolinella succinogenes DSM 1740
  CDS (1)..(1212)
atgagaacccttctagccccttccgtccactgggtcggcgtcaaagaccctgaattggcaatctttgacattgtagtccccaccgaacatggaaccacctacaacagctatctaatccaaggcagcgaaaagtgtgcgctcattgacacctccaaagccaacttctccaaagagtatttcacccaccttgaaaagcaccttcccctccaaaaaatcgactacatcgtcgtccaacacaccgaacctgatcatgcagggtgcctgagggagtttttggagcgccatccagaggtcacgcttatccactccaaaccctgtaagcgcttcatccagaccctcaccaatctccccttcaactccatggcgattgaaagcggagatgagcttgatcttggcggcaagacgctacgattcttctccactcctttcttgcactggcctgacacgatgatgagctacttagtggaagataagattctcttctcttgcgatgtgatgggctcccatttcaccagcgaaaccaatcccgaaatcttcaactcccttttggatgagaaggattatctcgcctccatcgaagccttcaaatactactatgctatgatcatgcgcccctacaaagagcatatcatcaaggcgtttgagcttcttgaaaagcttgatgttcagatgatcgccccttctcatggaccgattttggacatggagcctcgattcttctttgactggtatagagcacgtgccaaaaactacctcctgcgcctcaatgggcagaaggtgaccatcatctacgcctccgcctatggaaacaccgccaaaatgatggaatcagtcaaagcggggttgcttgatgcaggagtagaggttgctgtttttgatgcctccagcagtgcaatggcggagatgatcgatagcatcgagctctccacgggaatcttgcttggcacctccaccatcaatgccaaagcacccgagcccattcttcacctcatcgccaatcttgttgtcttgagcatgaatggtcgcaaagcaggggtctttggctcttttggctggagcggagaggggattgcgatgacggagcggatctgcgaagtgatgaagatgaagatcgtccaagaaccctacaaagtccaaatggcgccctctagcgctcagcttgaagaggggcgagagtggggatataacttcggactcaaaatcattgagtag

SEQ ID NO: 45339 - protein, 403 aa, Wolinella succinogenes DSM 1740
MRTLLAPSVHWVGVKDPELAIFDIVVPTEHGTTYNSYLIQGSEKCALIDTSKANFSKEYFTHLEKHLPLQKIDYIVVQHTEPDHAGCLREFLERHPEVTLIHSKPCKRFIQTLTNLPFNSMAIESGDELDLGGKTLRFFSTPFLHWPDTMMSYLVEDKILFSCDVMGSHFTSETNPEIFNSLLDEKDYLASIEAFKYYYAMIMRPYKEHIIKAFELLEKLDVQMIAPSHGPILDMEPRFFFDWYRARAKNYLLRLNGQKVTIIYASAYGNTAKMMESVKAGLLDAGVEVAVFDASSSAMAEMIDSIELSTGILLGTSTINAKAPEPILHLIANLVVLSMNGRKAGVFGSFGWSGEGIAMTERICEVMKMKIVQEPYKVQMAPSSAQLEEGREWGYNFGLKIIE

SEQ ID NO: 45340 - DNA, 1755 bp, Gloeobacter violaceus PCC 7421
  CDS (1)..(1755)
atgcagcagacgatccaaaaaaggttgacggtccagtccggagcggtggcacctgagacggtggcgatgcgctgcctcgactgggatcgcgaccgcttcgacatcgaatttggtctgcaaaacggcacgacctacaactcgtacctgatcgagggcgagcaggtagccctggtggataccagccacgaaaagttccgctccctttatttagatctgctcaaaggccacatcgatcccaagcggatcgactatctggtgatcagccacaccgaacccgaccacagcggtctggtggcggacgtgctggcgctcgctccccaggcgacggtggtcgcttcgcgcatggcgctgcagtttctggcgaacatggtgcaccgccgctttccgcagcgggcggtcaaaagcggcgacaccctcgatctcggaggcgggcatgtgctcgaatttgtctcggcccccaacttgcactggcccgacacgatgttcacgttcgaccggggcacgggggtgctctacacctgcgacgcttttgggatgcactactgcaacgagcggatgttcgatgaggacttgagtgccatcgagcccgattaccgtttttattacgagtgcctgatggctcccaacgcccgctcggtgctcaccgccctcaagcgcatggagcctctgggggagatcaccgccattgccaccggccacgggccgatgctcaagctgcacctgggcgagttggtcgatcggtaccggcgctggagccaggagcagagcgaggcgaccaccagcgtggcagtcttctatgtctcggactacggctacagcgaccggctatcccaggcgattgcccagggaatcaccaagtcccacgtcgccaccgaactggtggacctgcgcgccacgcccctcgccgagatccaggaaatcgtccgccagagcgccggggtggtgattggcaccccccccacggcggggccggccgcccaggcgacccaggcggctttgggcgtgattctggccaacgtcaaagaaaagcaggcttttggcatctacgaagcctgcggtgggttcgacgagcccgcctttccgctttcgagccgatttgccgatctgggcctggtgcgggcctttgcccccattcgcatccccgggcgcgaaggggcgctggccgaggccgaggcgaccggcacacccaccccggcgctgtacaagctctgcgaagagtccgggaccgacctggcccaatggctcacccgcgaccgcaccgtccagcagatgaaggcggtcgcggtcgggctcgacaaggcgatgggccgtctgtcgggcgggctgtacgtgctcaccgccgccaaaggcgaactcaaaggcgccatgctcgcctcctgggtcaaccaggcgagctttgcccccctgggcgtcacgatcgccgtcgccaaggaccgggccatcgaagcgctgatgcaggtgggcgacctgtttgccctcaatgtgctcgaagaaggcaagtacgctccgctgatgcgccactttctgaagcgctttgcccccggcgaggaccgcttcgtgggtgtggaaacgctcaccggcacgggcggcacgccaattctggccgatgccctcgcctatatggagtgccgggtcgccagccgcatggagtgttccgatcactggctggtctacggcgtggttgaggatggccgcgtctccaacctggaaggactgaccgccgtccaccaccgcaaagtcggcaaccactattaa

SEQ ID NO: 45341 - protein, 584 aa, Gloeobacter violaceus PCC 7421
MQQTIQKRLTVQSGAVAPETVAMRCLDWDRDRFDIEFGLQNGTTYNSYLIEGEQVALVDTSHEKFRSLYLDLLKGHIDPKRIDYLVISHTEPDHSGLVADVLALAPQATVVASRMALQFLANMVHRRFPQRAVKSGDTLDLGGGHVLEFVSAPNLHWPDTMFTFDRGTGVLYTCDAFGMHYCNERMFDEDLSAIEPDYRFYYECLMAPNARSVLTALKRMEPLGEITAIATGHGPMLKLHLGELVDRYRRWSQEQSEATTSVAVFYVSDYGYSDRLSQAIAQGITKSHVATELVDLRATPLAEIQEIVRQSAGVVIGTPPTAGPAAQATQAALGVILANVKEKQAFGIYEACGGFDEPAFPLSSRFADLGLVRAFAPIRIPGREGALAEAEATGTPTPALYKLCEESGTDLAQWLTRDRTVQQMKAVAVGLDKAMGRLSGGLYVLTAAKGELKGAMLASWVNQASFAPLGVTIAVAKDRAIEALMQVGDLFALNVLEEGKYAPLMRHFLKRFAPGEDRFVGVETLTGTGGTPILADALAYMECRVASRMECSDHWLVYGVVEDGRVSNLEGLTAVHHRKVGNHY

SEQ ID NO: 45342 - DNA, 1740 bp, Gloeobacter violaceus PCC 7421
  CDS (1)..(1740)
atgacccctgcccaaacgcctgtgcgcgatatccagacggtggcggtggcccccgatacttgggcgctgcgctcccgcagcttcgtgcggctcaaattcgaggtcgagtacgcccggcagcggggcaccacctccaacgcctttctgtttcaggggccggatcgaacggtgctgctctccccgccgggcgaaacgttcactgccctgtttcttgcggagttggagcggctcattgccctggagcagatccacgcggtagtgctgggtcacatcaaccccaaccgcgccaaaaccctgattgccctgctggcgcgcgctccccgcctggagataatctgctccaaccccggggccatcgcccttagacctttgcttgaaggtgaagcggccgacctgcaaacgcaaatccggatcgtccgcggccaagaagtcctggaactgggcggcgatcggcggctgcagtgcattcccgctccgacgccgcgctggcccgacgggctgtgcctctttgatcaaaagcactcggcactttacaccgacaaattttttgccgcccacgtcgcggacgatgccctcttcgacgagagcggcaccgccacgggcgaggacgcccgttacttttatgattgtctgatggcaagccaggcgcgccaggtcgaagcggtgctcgaccggcttgccgagtggcccgcccgggtgattgccccggtgcacggaccgctgttgcgctcgggcgggctggatcttatctcccattaccgccgctggaaccgcgctcagattgaaaagacgctcaccgtcgccttgctctacgcctcggcctacggctccaccgccaccctcgcccaggcgcttgcccacgggatcaccaaggccggggtgggtgtggagaccatcaactgcgaattcgccaccccggaggagatccgcgaggtggtctcgcgcgccgacggctttgtgatcggctcgcccaccctgggcggtcacgcccccacccagatccagacggccctgggcattgtgcttgccaccgctcccaaatcgcaactgaccggggtattcggctccttcggctggagcggcgaagcgatcgacctgctggagggcaaactgcgcaacgctggatattccttcggcttcgagactattcgcgtcaagttcaaacccaacgccggcaccttgcaggagtgcgaggaggcgggcaccgattttgcccagacgctcaagaagacgcgcaaagcccgtcagggtcgcgctcctgccgcctccacccccgtcgagcaagccgcgggccgcatcgtcggttcgctgtgtgtcgtcacggcccggcgtgaagaggtcagcagtgcgatgctcgcctcctgggtcacccaggccaccttcaatccgccggggctcaccgtggccgtcgccaaggagcgggccatcgagtcgctgctgtacccgggtgacgccttcgtgctcaatatccttgaagacgggcagcacctgcctttgatgaagcactttctcaaacccttcgctcctggccaggaccgttttgcgggggttgccacgcgcgcggcggccaacggctcgcccatcctctcagaagcgctcgcctacctcgaatgccgtgtggaggggcgcatggactgcggcgatcactggctggtctactgcgtggccgaggggggagatgtgctcaacccgaacggcaagacggccgtgcactttcgctcgaccggtacgcactactga

SEQ ID NO: 45343 - protein, 579 aa, Gloeobacter violaceus PCC 7421
MTPAQTPVRDIQTVAVAPDTWALRSRSFVRLKFEVEYARQRGTTSNAFLFQGPDRTVLLSPPGETFTALFLAELERLIALEQIHAVVLGHINPNRAKTLIALLARAPRLEIICSNPGAIALRPLLEGEAADLQTQIRIVRGQEVLELGGDRRLQCIPAPTPRWPDGLCLFDQKHSALYTDKFFAAHVADDALFDESGTATGEDARYFYDCLMASQARQVEAVLDRLAEWPARVIAPVHGPLLRSGGLDLISHYRRWNRAQIEKTLTVALLYASAYGSTATLAQALAHGITKAGVGVETINCEFATPEEIREVVSRADGFVIGSPTLGGHAPTQIQTALGIVLATAPKSQLTGVFGSFGWSGEAIDLLEGKLRNAGYSFGFETIRVKFKPNAGTLQECEEAGTDFAQTLKKTRKARQGRAPAASTPVEQAAGRIVGSLCVVTARREEVSSAMLASWVTQATFNPPGLTVAVAKERAIESLLYPGDAFVLNILEDGQHLPLMKHFLKPFAPGQDRFAGVATRAAANGSPILSEALAYLECRVEGRMDCGDHWLVYCVAEGGDVLNPNGKTAVHFRSTGTHY

SEQ ID NO: 45344 - DNA, 1215 bp, Geobacter sulfurreducens PCA
  CDS (1)..(1215)
gtgaaagctgttgaaataaaacaaggtgtgttctgggtgggcgctgttgactgggcggtgcgcgacttccacggttatgaaaccccgcgcggcaccacttataataacttcctcatcatggacgaggaaatcaccctcatcgatacggttaagtacgatttcgccgaccttacaatcaagaacatcgccggaattgtcgatccggcgcggatcaaaaacatcatcatcaaccacatcgaaaacgaccatgcgtccagcctcgaccggatcatggcgctggccccccaggcaactatctatatttccgacaaggggcggaaaggaatcgaacggttcttcgatctctccaactggaacgtgaaatcggtcaagaccggcgacaccctctgtatcggagcccgcaccctcgagttccttgaaaccccgatgctccactggcccgattcaatggtgacctattcgcgccacgaccgcatcctgttcacccaggacgcgttcggccagcacgtggcctcggccagccggttcgacgacgaattcgagaagagcgattcggccgccgaactcgaggatgcggtcgtcgactactatgccaacatcctgatgcctttcggccagatgatcaaaaccaagatagcggagatccaggccaagggattcgacatcgacatcatcgcaccggaccacggtctcatctggcgagccaatcccggcaaggtcctcagcatgtatatggacatggccaacgggaaggcgaacgagtcggttgccatcatctacgacaccatgtggcaaagcaccgagaagatggcggtccccattgccgagggaatcagggccgaagggctcgactgccgcgtcgtaaagctgcgggccacccccatgagcgtcgccatcaaggagttctggaaatcgcgcggcgcccttatcggctcgccaaccctcaacaacatcctctacccctccgtggcagaattcttgacccacctgcgggggctgcggcccaaaaacaggatcgtgggggcattcggcagctacggctggggcggcggcgcggtaagagacgcctacgaagaattcaagaagatgggacttcaggcagtcgagccgggattccagataccctatcgtccttcccgggccgacgaggagggcgccttcgaattcggccgcaacttcgcccggcaggtcatcgagtaccacaaggggttctga

SEQ ID NO: 45345 - protein, 404 aa, Geobacter sulfurreducens PCA
MKAVEIKQGVFWVGAVDWAVRDFHGYETPRGTTYNNFLIMDEEITLIDTVKYDFADLTIKNIAGIVDPARIKNIIINHIENDHASSLDRIMALAPQATIYISDKGRKGIERFFDLSNWNVKSVKTGDTLCIGARTLEFLETPMLHWPDSMVTYSRHDRILFTQDAFGQHVASASRFDDEFEKSDSAAELEDAVVDYYANILMPFGQMIKTKIAEIQAKGFDIDIIAPDHGLIWRANPGKVLSMYMDMANGKANESVAIIYDTMWQSTEKMAVPIAEGIRAEGLDCRVVKLRATPMSVAIKEFWKSRGALIGSPTLNNILYPSVAEFLTHLRGLRPKNRIVGAFGSYGWGGGAVRDAYEEFKKMGLQAVEPGFQIPYRPSRADEEGAFEFGRNFARQVIEYHKGF

SEQ ID NO: 45346 - DNA, 1227 bp, Treponema denticola ATCC 35405
  CDS (1)..(1227)
atggaagcaaaaaaacttacggaacgcgtttattgtattcatgcagatatacatgacagaactgcacgctttgaaggtatatggttattgccccacggcgtttctataaattcttatgttgtaaagggagaaaaaaccgcccttatagatatagtaaaagactgggacggctcggtagactcttacagaaagcagctcgaatccatagggctttcattttcttcttttgactatgtaattttaaaccaccttgaacctgaccatgcagaccttataaaccttgtgaaggaagaaaatccaagggctgaaatcttggcttcttcaaaaggcgttgcccttatcaaaaacttttttaagataaacgagggtgtaagggccgtaaaagacggagaggttttggatctaggcggagggaaaaaacttgtattttatgagactcccaatatccactggcccgaaactatgatgacctatgaccctgacgataaaattttattttcttgcgatgctttcggctcatacggctgtataggcgaaaaaatattcgatgatcagcacacggaagatgaacttaaattttttgaaaatgaggcccttaggtactatgcaaatattgtggccagctttagcagctttgtaaacaagggaatagaaaaactcgccgcccttgagcttaaatttatttgtccgagtcacggtctgctttggcggggaaatccttcgagaattgtaaatctttataaaaaatttgcagattataataccggaaccggaagcgggttggaaaagaccatctgtattatttggggctcaatgtacggttataccaaggccggtcttgatgcggttattgaaggcatagatgaagaaggcgtaccttattctatctatagaattcccgacacggatgctacctttattttaggagaagcctaccgctctgcaggtcttttattggcaatgcctacctatgagtacaagatgttcccgcccatggcccatatccttgacctttttgaaagaaagcactttgtcaataaaaaggtgttccgcataggaagctggggctgggtagggggagccaaaaaagaatacgaggaaaaaatagaaaaatttaagtggaccaatatcgaatcccatgaatggcagggtaagctcagcgatgaggataagcggatattaaaagaaagaggcagggaattggcaagggccgtaaaaaacggataa

SEQ ID NO: 45347 - protein, 408 aa, Treponema denticola ATCC 35405
MEAKKLTERVYCIHADIHDRTARFEGIWLLPHGVSINSYVVKGEKTALIDIVKDWDGSVDSYRKQLESIGLSFSSFDYVILNHLEPDHADLINLVKEENPRAEILASSKGVALIKNFFKINEGVRAVKDGEVLDLGGGKKLVFYETPNIHWPETMMTYDPDDKILFSCDAFGSYGCIGEKIFDDQHTEDELKFFENEALRYYANIVASFSSFVNKGIEKLAALELKFICPSHGLLWRGNPSRIVNLYKKFADYNTGTGSGLEKTICIIWGSMYGYTKAGLDAVIEGIDEEGVPYSIYRIPDTDATFILGEAYRSAGLLLAMPTYEYKMFPPMAHILDLFERKHFVNKKVFRIGSWGWVGGAKKEYEEKIEKFKWTNIESHEWQGKLSDEDKRILKERGRELARAVKNG

SEQ ID NO: 45348 - DNA, 1224 bp, Methanococcus maripaludis S2
  CDS (1)..(1224)
atgaaagcagatgcagtgaaaattagcgaaggagtctactgggttggaacctacgactgggatatcagatcataccacgggtacacactaaaaggaactacatataacgcgtaccttgtatttggggatgaaaaagttgcagtaatcgataacgtatatcctggaacctctgcccaaatgtggggaagaattaaagacgcttttgaaaaagaaggaagagaatttaaaattgacgtgattgttcaaaaccacgttgaaaaagaccacagtggagcacttgttgaaattactaagaagtttccagacgctccaatctactgtaccgaagttgcagttgaaggtttgaaaaaacactacgcaggacttaaaaatgcaccatttaaagttataaaatcgcttgaaagtgttgatttgggtggaaaaacacttacattcttagaagctccgcttttacactggcctgacagcatgtttacactttacggtgaagctggaattttattctcaaacgatgcattcggacagcacttgtgtcttaccaaaagatttgacaacgaaattcctgaaaatattttaatggatgcaaaccagaaattctatgcaaacttaattactccgctttcaaaacttgtattaaagaaatttaacgaagtgatttcactaggattacttgaaaaaataacgatgatcgcaccatcccacggccagatctggactgatcctatgaaagtaatttctgcataccaaaattttgcaacaggacagtgcaaagacaaagctacaattgtatatgatacaatgcactactccactcaaaaaatggctcatgcatttgcagaagggcttttatccgaaggaattgaagttgtaatttataacttgcacagtgatgaaagaagtgaaattgtaaaagatattcttgacagtaaagccgttttatttggaattccaacgattaatgatcaaccattcccaagtatcggggatttaatgtactacttaagaggacttagatttgataggactggatttaagaaattggctttaacctttggttctatgggcggaagaggcggtgcaatcgaaaaaattgcaaacgaactgggcagttccggttttgacgtggttaatgaatatgaattatactacattccaaacgaagacgaacttgaaaaatgctattcccttggaaatgagcttgggaaaaacataaaatccatttaa

SEQ ID NO: 45349 - protein, 407 aa, Methanococcus maripaludis S2
MKADAVKISEGVYWVGTYDWDIRSYHGYTLKGTTYNAYLVFGDEKVAVIDNVYPGTSAQMWGRIKDAFEKEGREFKIDVIVQNHVEKDHSGALVEITKKFPDAPIYCTEVAVEGLKKHYAGLKNAPFKVIKSLESVDLGGKTLTFLEAPLLHWPDSMFTLYGEAGILFSNDAFGQHLCLTKRFDNEIPENILMDANQKFYANLITPLSKLVLKKFNEVISLGLLEKITMIAPSHGQIWTDPMKVISAYQNFATGQCKDKATIVYDTMHYSTQKMAHAFAEGLLSEGIEVVIYNLHSDERSEIVKDILDSKAVLFGIPTINDQPFPSIGDLMYYLRGLRFDRTGFKKLALTFGSMGGRGGAIEKIANELGSSGFDVVNEYELYYIPNEDELEKCYSLGNELGKNIKSI

SEQ ID NO: 45350 - DNA, 1221 bp, Methanococcus maripaludis S2
  CDS (1)..(1221)
atgaaagcagatgcagtgaaaattagcgaaggagtctactgggttggaacctacgactgggatatcagatcataccacgggtacacactaaaaggaactacatataacgcgtaccttgtatttggggatgaaaaagttgcagtaatcgataacgtatatcctggaacctctgcccagatgtggggaagaattaaagacgcttttgaaaaagaaggaagagaatttaaaattgacgtgattgttcaaaaccacgttgaaaaagaccacagtggagcacttgttgaaattactaagaagtttccagacgctccaatctactgtaccgaagttgcagttgaaggtttgaaaaaacactacgcaggacttaaaaatgcaccatttaaagttataaaatcgcttgaaagtgttgatttgggtggaaaaacacttacattcttagaagctccgcttttacactggcctgacagcatgtttacactttacggtgaagctggaattttattctcaaacgatgcattcggacagcacttgtgtcttaccaaaagatttgacaacgaaattcctgaaaatattttaatggatgcaaaccagaaattctatgcaaacttaattactccgctttcaaaacttgtattaaagaaatttaacgaagtgatttcactaggattacttgaaaaaataacgatgatcgcaccatcccacggccagatctggactgatcctatgaaagtaatttctgcataccaaaattttgcaacaggacagtgcaaagacaaagctacaattgtatatgatacaatgcactactccactcaaaaaatggctcatgcatttgcagaagggcttttatccgaaggaattgaagttgtaatttataacttgcacagtgatgaaagaagtgaaattgtaaaagatattcttgacagtaaagccgttttatttggaattccaacgattaatgatcaaccattcccaagtatcggggatttaatgtactacttaagaggacttagatttgataggactggatttaagaaattggctttaacctttggttctatgggcggaaacggtggagctacaaaacttatcggaaacgatctaaaagaatgcggatttgaagtccttgatgattcttacgaagtactttacgttcctgaagaggatgaacttgaaaaatgctacaacgcaggaaaaagacttggaatgaaactaaaataa

SEQ ID NO: 45351 - protein, 406 aa, Methanococcus maripaludis S2
MKADAVKISEGVYWVGTYDWDIRSYHGYTLKGTTYNAYLVFGDEKVAVIDNVYPGTSAQMWGRIKDAFEKEGREFKIDVIVQNHVEKDHSGALVEITKKFPDAPIYCTEVAVEGLKKHYAGLKNAPFKVIKSLESVDLGGKTLTFLEAPLLHWPDSMFTLYGEAGILFSNDAFGQHLCLTKRFDNEIPENILMDANQKFYANLITPLSKLVLKKFNEVISLGLLEKITMIAPSHGQIWTDPMKVISAYQNFATGQCKDKATIVYDTMHYSTQKMAHAFAEGLLSEGIEVVIYNLHSDERSEIVKDILDSKAVLFGIPTINDQPFPSIGDLMYYLRGLRFDRTGFKKLALTFGSMGGNGGATKLIGNDLKECGFEVLDDSYEVLYVPEEDELEKCYNAGKRLGMKLK

SEQ ID NO: 45352 - DNA, 1164 bp, Methanococcus maripaludis S2
  CDS (1)..(1164)
atggcagttactttaaaagaaggcgtctattgggtaggggcgatcgactggaatatcagagaatttcacggctatgaaactaaagacggttccagctacaattcctatcttattgaagatgaaaaaattgttttaatagatactgtaaaaaaatatctttttgatgaattctacgggagaattaaaaaagtcgttgatcctgaaaaaatagactatatcgttgtaaaccacgttgaaatggatcacagcagttctttagaaaaaattatggaaatttcaaaagctaaaatcataacaaaccaaaaagcaaaagaacatcttgaattacactacaatacaaaagattgggaatatataatcgttgattctggagattcagtaaatattggaaaaagaaatttaacgtttgtaaaaactccaatgcttcactggcctgacaacatggtaacatactctcctgaagataagatactcttttcaaacgatgcattcggtcagcacatcgcatcaagtgaaaggtttgactttgaaatcgattatacacttgattctgcaaaagagtattttgcaaatatcctgcttccatacaggacgcttattccaaatgcagtcaaaacggtcgatactcttgaaacagatctaatatgtccatcacacggcatcatctggaaagaaaatatttcaaaaattaaagaaaaatatctcgaatttgcatcaaacaacgttattaataaggcggttattgtatacgacaccatgtacagctcaactgaaaaaatcggactcgctattgcagaaggattaattgaaagcggtgttgaagttaaagtttttaaaatatccaaaactcctgtaagtaaaataatagctgaaattttggatgcaaaatacgtgcttgtaggctccccaacgctaaatattaacttataccctgaagttgccagatttttaaaatacatggaaggtttaaaaccaaacaaaaaaattgcggctgcttttggttcttacggttgggcagaaaatgctacaaaacatattaaaaatacgtttgacatattatcttttgacaccgtggatgacgaatgcctaacatgcagatttgttcctaatgaagaacacctcaaaaaatgtcaagaatttggaaaaaaacttgctaaaatgtaa

SEQ ID NO: 45353 - protein, 387 aa, Methanococcus maripaludis S2
MAVTLKEGVYWVGAIDWNIREFHGYETKDGSSYNSYLIEDEKIVLIDTVKKYLFDEFYGRIKKVVDPEKIDYIVVNHVEMDHSSSLEKIMEISKAKIITNQKAKEHLELHYNTKDWEYIIVDSGDSVNIGKRNLTFVKTPMLHWPDNMVTYSPEDKILFSNDAFGQHIASSERFDFEIDYTLDSAKEYFANILLPYRTLIPNAVKTVDTLETDLICPSHGIIWKENISKIKEKYLEFASNNVINKAVIVYDTMYSSTEKIGLAIAEGLIESGVEVKVFKISKTPVSKIIAEILDAKYVLVGSPTLNINLYPEVARFLKYMEGLKPNKKIAAAFGSYGWAENATKHIKNTFDILSFDTVDDECLTCRFVPNEEHLKKCQEFGKKLAKM

SEQ ID NO: 45354 - DNA, 1155 bp, Anopheles gambiae str. PEST
  CDS (1)..(1155)
atggactgggaggtacgcgacttccacggtaccgagtacaagacccacaagggcaccagctacaacagctatctcatccgcgaagggaagaacgtgctgatcgataccgtcgatcacaagttcagccgcgagttcgtgcagaacctggcggcggagatcgatctcgccgccatcgactatgtggtgatcaaccacgccgaggaggatcacgccggtgccctgaccgagctgatggcccgcatccccggcacccccatctactgtacccacaacgccatcgactccatcactggccatcatcaccacccggagtggaacttccacccggtcaagacaggggacagcctggacatcggcaacggcaagcagctggtatttatcgagacccccatgctgcactggcccgacagcatgatgacctacatgacagaggatgcggtgctcttctccaacgacgccttcggccagcactactgcgacgagcacctgttcaacgacgaagtggatcagaccgagctgatggagcagtgccagcgctattacgccaacatcctcacccccttcagcccgctggtgaccgccaagatcaaggaagtgctgggcttcaacctgccggtgagcatggtggccacctcccacggcatcgtctggcgcgaggaccccacccagatcatcctgaaatacctggagtgggccgaccactatcaggaagatcgtatcaccctcttctacgactccatgtccaacaacacccgcatgatggccgacgccatcgcccagggcatccacgaggtggatccgggcgtggcggtgaagatctacaacgtggcgcgccacgacaagaacgagatcctgacccaggtgttccgctccaaggggatactggtgggctcttccaccatgaacaacgtcatgatgcccaaggtggcgggcatgctcgaagagatcaccggcctgcgttttcgcaacaagcgggcctcggccttcggcagctacggctggaccggcggcgcggtggaccggatccagacccggctgatggatgcgggctttgacatcagcatctccctcaaggccaagtggcgcccggatggttccgccttggcggaatgccgcgagcacggccgccagctcgcccgtcagtgggcgctgtga

SEQ ID NO: 45355 - protein, 384 aa, Anopheles gambiae str. PEST
MDWEVRDFHGTEYKTHKGTSYNSYLIREGKNVLIDTVDHKFSREFVQNLAAEIDLAAIDYVVINHAEEDHAGALTELMARIPGTPIYCTHNAIDSITGHHHHPEWNFHPVKTGDSLDIGNGKQLVFIETPMLHWPDSMMTYMTEDAVLFSNDAFGQHYCDEHLFNDEVDQTELMEQCQRYYANILTPFSPLVTAKIKEVLGFNLPVSMVATSHGIVWREDPTQIILKYLEWADHYQEDRITLFYDSMSNNTRMMADAIAQGIHEVDPGVAVKIYNVARHDKNEILTQVFRSKGILVGSSTMNNVMMPKVAGMLEEITGLRFRNKRASAFGSYGWTGGAVDRIQTRLMDAGFDISISLKAKWRPDGSALAECREHGRQLARQWAL

SEQ ID NO: 45356 - DNA, 1176 bp, Desulfovibrio vulgaris subsp. vulgaris str. Hildenborough
  CDS (1)..(1176)
atgagaaaaattgtagaatcagtgtattgggttggtgcagtggattgggacaggcgtctgttcgactccttggttccgctccccgatgggacaacctacaacgcctatctcgtggaaggcagcgagaagaccgctctcatcgacgccgtggacccggatatggtcgatacgttacttgggcatctggatggggtggaaaagcttgattacgtaatatcccagcatgcggagcaggatcattccgggaccattgccctggtgctggacctgtaccctgaggccaaggtcgtcaccaacgccaaggccaagtctatgctcatggatcttttgctcatccccgacgacaaattcatcgttgtcggggatggcgaaaccctttcccttggcgacaagacgctcacattcattctcacgccttgggtgcactggccggaaaccatgtccacctacttggccgaagacaagattctgttcagttgcgacttttttggctcgcacatcgcaacgagcgatctctttgtgcgcgatcaaggccgggtacatgaagcggcaaaacgctatttcggcgagatcatgatgccgtttaggaccataatcgccaagaacctggaaaaactcggcccctatgacatacgcatgatcgcccccagccacggccagatttacgacagccccggctggatcattgacgcctacagggactgggtttcaggcgtggcgcacaacctggtggcctttcccttcgtgtccatgcacggcagcactaggctcatggtcgaccacttggcggcagctttgtccgaacgcgatgtgagggtggaactctttaaccttgccgtgaccgacatcggcaagctggctatgtccctcgtggatgcgggcaccatcgtgctcggcacccccacagtgcttgccggtccgcatcccatggccgcctacgcggcatttttggccaacgccctgcggcccaaggccaaatatctgtccatagtcggttcatacggctggggcggcaagacagtggaaactctggccggcatgattcccaatctgaaggtcgaggtgctggatcctgtgctgtgtaaggggttgcccacagacgacacgtacggtgccctggatcgtctggcggatgccattgccgccaagcacaaggaaagcggctttcagaggtag

SEQ ID NO: 45357 - protein, 391 aa, Desulfovibrio vulgaris subsp. vulgaris str. Hildenborough
MRKIVESVYWVGAVDWDRRLFDSLVPLPDGTTYNAYLVEGSEKTALIDAVDPDMVDTLLGHLDGVEKLDYVISQHAEQDHSGTIALVLDLYPEAKVVTNAKAKSMLMDLLLIPDDKFIVVGDGETLSLGDKTLTFILTPWVHWPETMSTYLAEDKILFSCDFFGSHIATSDLFVRDQGRVHEAAKRYFGEIMMPFRTIIAKNLEKLGPYDIRMIAPSHGQIYDSPGWIIDAYRDWVSGVAHNLVAFPFVSMHGSTRLMVDHLAAALSERDVRVELFNLAVTDIGKLAMSLVDAGTIVLGTPTVLAGPHPMAAYAAFLANALRPKAKYLSIVGSYGWGGKTVETLAGMIPNLKVEVLDPVLCKGLPTDDTYGALDRLADAIAAKHKESGFQR

SEQ ID NO: 45358 - DNA, 1209 bp, Desulfovibrio vulgaris subsp. vulgaris str. Hildenborough
  CDS (1)..(1209)
atgcatcctatcgaaatcaaaaaggatatattctgggtcggcgtcgtcgaccacaacagccgcgacttccacggctattcgctttccccgcagggcacgacctacaacgcctatgtggtcaaggacgagaagaccgtgctgttcgacaccgtcaagcacgacttcaccgacaccatgctctgccgtctctcgcgcgtggtggaaccctgcaagatagactacatcgtctgcaaccacctcgaaccagaccacgccggtgccctgcccgaactgatagcccgctgcaagcccgagaagatcttctgctcgcccatgggcctgaaggccatggaagcccacttcgacaccaccgggtggcctgtcgaagtggtcaagacgggcgattccatctccatcggcaagcgcaccatccatttcgtcgagacgcggatgctccactggcccgatagcatggtgtcgtacatccccgaagacaagcttctcatctgcaacgacgccttcggccagaacatcgcctccaccgaacgctacgccgacgagatcgaccgctcagccctgttccacgccatgaaggagtactaccacaacatcgtactgcccttctcgcccatcgtcctcaagacactggcgcagatcgaacagctcggcctcgacatcgacatgctggcccccgaccacgggctcatcttccgtggctatgacgatgtgaagtacgccctcgacacctaccgcatcttcgcggagcagaagccgcagaagcgcgccgtcatcgtgtacgacaccatgtggcacagcaccgagaagatggcctccgccatcgccgaagggctggagtccgtgggcgtgcccacccgcgtcatgtggctcaaggccaaccaccacagcgcggtcatgaccgaactggccgactgcggtgccgtgctcgtgggttcgcccacgcacaacaacggcattcttcccgccgttgccgccatgctcacctacatgaagggattgcgcccccagaaccgcatcggtgcggctttcggctcgttcggctggtctggcgaatcggtgaagagcatcaccgaatggctgcaatccatgggcatggaaaccccggtggacccggtgaaggtcaagcacgtgcccacgcacgacacctaccgccagtgcttcgaaatggggcaggcagtgggccgcgccctcatcgaaaagtgcggggggtag

SEQ ID NO: 45359 - protein, 402 aa, Desulfovibrio vulgaris subsp. vulgaris str. Hildenborough
MHPIEIKKDIFWVGVVDHNSRDFHGYSLSPQGTTYNAYVVKDEKTVLFDTVKHDFTDTMLCRLSRVVEPCKIDYIVCNHLEPDHAGALPELIARCKPEKIFCSPMGLKAMEAHFDTTGWPVEVVKTGDSISIGKRTIHFVETRMLHWPDSMVSYIPEDKLLICNDAFGQNIASTERYADEIDRSALFHAMKEYYHNIVLPFSPIVLKTLAQIEQLGLDIDMLAPDHGLIFRGYDDVKYALDTYRIFAEQKPQKRAVIVYDTMWHSTEKMASAIAEGLESVGVPTRVMWLKANHHSAVMTELADCGAVLVGSPTHNNGILPAVAAMLTYMKGLRPQNRIGAAFGSFGWSGESVKSITEWLQSMGMETPVDPVKVKHVPTHDTYRQCFEMGQAVGRALIEKCGG

SEQ ID NO: 45360 - DNA, 1530 bp, Erwinia carotovora subsp. atroseptica SCRI1043
  CDS (1)..(1530)
atgactattcacgtaaagaataacatccactgggttggacaacgcgattgggaagtccgtgattttcacggcacagaatacaagacgctgcaaggtagcagctacaacagctacctgatccgcgaagagaaaaccgtgctgatcgataccgtcgatcacaaattcagccgtgaatttgtgcagaatctcatggcggaagtggatctgaacacgattgattacatcgtgatcaaccacgccgaagaggatcacgccggggcgctgagcgagctgatggcgcgtattcccaacaccccgatttactgcacctataacgcgatcgattcgattaccggccatcaccatcaccctgagtggaatttccacacggtcaaaaccggcgacacgttggatatcggcaacggcaagcagttgatctttattgaaacgccgatgctgcactggccggacagcatgatgacctacatgaccgaggatgccgtgctgttcagtaacgatgcgttcggtcagcactactgcgatgaacacctgtttaacgatgaggtggatcaaaccgaactgttcgagcagtgccagcgctatttcgccaatattctgacgccgttcagccgcttagtgacggccaaaatccacgaagtactgggcttcaacctgccgctgtcgatggtcgcgacctcgcacggcgtggtgtggcgcgacgatcctgcacaaatcatccacctgtatctgaagtgggcggacagctatcaggaagatcgcattacgctgttttacgacaccatgtccaataacacccgcatgatggccgacgccattgcgcaaggcatcaacgatgtcgatcccggtgtcgcggtgaaaatctataacgtcgcccgccatgacaagaacgaaatcctgacgcaagtcttccgctcaaaaggcgtgttagtcggttcatccaccatgaataacgtgatgatgccgaaagtcgctgccatgctggaagagatcaccggactgcgtttccaaaacaagaaagcctctgcgttcggtagctacggctggaacggcggtgcggtagaccgcgttcaaacccgcctgatggacgccggttttgaaaccacgctggcgttgaaaaccaagtggcgtcctgacggttcagcgttggaagtttgccgcgagcacggtcgcgaaattgcacgtcagtgggcgctgcatccgctggataatacgcctgcccgccgtgtcatctcgccagtgaaaccggcggctaccgcaccgcaagttaccactgcggcacagccgatgagcgcttctgctgagagcgcctgcggatgcaacgaagtcgctgcgccgcagtcagcaacacagccaacggtacagtcagaaagcggctgtatgcagtgcagcgtctgccagtggatctacgatccggcacttggcgaacccatgcaggatgtcacacctggcaccatgtggtcggatgtacccgacagcttcctctgcccagaatgcgggctgggtaaagacgttttcaatccaattcgctaa

SEQ ID NO: 45361 - protein, 509 aa, Erwinia carotovora subsp. atroseptica SCRI1043
MTIHVKNNIHWVGQRDWEVRDFHGTEYKTLQGSSYNSYLIREEKTVLIDTVDHKFSREFVQNLMAEVDLNTIDYIVINHAEEDHAGALSELMARIPNTPIYCTYNAIDSITGHHHHPEWNFHTVKTGDTLDIGNGKQLIFIETPMLHWPDSMMTYMTEDAVLFSNDAFGQHYCDEHLFNDEVDQTELFEQCQRYFANILTPFSRLVTAKIHEVLGFNLPLSMVATSHGVVWRDDPAQIIHLYLKWADSYQEDRITLFYDTMSNNTRMMADAIAQGINDVDPGVAVKIYNVARHDKNEILTQVFRSKGVLVGSSTMNNVMMPKVAAMLEEITGLRFQNKKASAFGSYGWNGGAVDRVQTRLMDAGFETTLALKTKWRPDGSALEVCREHGREIARQWALHPLDNTPARRVISPVKPAATAPQVTTAAQPMSASAESACGCNEVAAPQSATQPTVQSESGCMQCSVCQWIYDPALGEPMQDVTPGTMWSDVPDSFLCPECGLGKDVFNPIR

SEQ ID NO: 45362 - DNA, 1203 bp, Desulfotalea psychrophila LSv54
  CDS (1)..(1203)
atgaataagaataaacttgccaagggcatatattgggtaggagcagttgactgggacgtacgggattttcacggatactccacctataggggatcaacctataactcttttttagtcatcgatgaaaaggtgaccctctttgacaccgtgaaacattcccacatggatcaactgctctacaatataggaaaaataattgatccaaaggagattgactatattgtcgttaaccacgtagaactcgatcactctggctccctaccgaagatgatggagatcgtccaacctgaaaagctcatctgctcacccatgggagaaaaggcactgatcgcccactttcatagggaagactggccctaccatatagtaaaatccggcgatgaaatttccctcggggcccgcaccgttcagtttctggaaacacgaatgctgcattggcccgactccatgttttcctacctacaggaagatggcatcctcttcaccagcgacgcctttggccaacatcttgccagtacagaacgttttgacgatgaacttgagttggacgaaatcatgcaggagagcgctaaatactatgctaacatcctcaatctcttctccccgctgataagaaagttgctgcgcaccatcaaagaaatggacctggatttaaaaataatcgccccggaccacggccttatctggcgtagccaccaggataaaatccttgccgcctacgagaaatggagcaatcaggaacattctaacagggctctgataatctacgacagcatgtggcactccaccgaggagatggccaagtccatctccataggacttgaagaggagggtgtaccggcagagcttatcaatatgcaggttcatcaccgcagtgatgtggtaacaaaagtgcttgatgcccgggccctcatccttggcagcccaaccctgaacaacggcatcctgcctcgtatggcagggcttttgagctatatgaagggactgaaaccggcgagaaagttgggggcggcctttggctcctatggttggagcggcgaggcagtggcccaactcaacaccataatggatgagatgaaaatagagcggataaatgatggtctgcgcctcaaatatgttcccaccgaggagagccttgaccagtgtcgtgaatatggtcgtgaacttggccggagcatcctcgcgagtgaagagggaaaatag

SEQ ID NO: 45363 - protein, 400 aa, Desulfotalea psychrophila LSv54
MNKNKLAKGIYWVGAVDWDVRDFHGYSTYRGSTYNSFLVIDEKVTLFDTVKHSHMDQLLYNIGKIIDPKEIDYIVVNHVELDHSGSLPKMMEIVQPEKLICSPMGEKALIAHFHREDWPYHIVKSGDEISLGARTVQFLETRMLHWPDSMFSYLQEDGILFTSDAFGQHLASTERFDDELELDEIMQESAKYYANILNLFSPLIRKLLRTIKEMDLDLKIIAPDHGLIWRSHQDKILAAYEKWSNQEHSNRALIIYDSMWHSTEEMAKSISIGLEEEGVPAELINMQVHHRSDVVTKVLDARALILGSPTLNNGILPRMAGLLSYMKGLKPARKLGAAFGSYGWSGEAVAQLNTIMDEMKIERINDGLRLKYVPTEESLDQCREYGRELGRSILASEEGK

SEQ ID NO: 45364 - DNA, 1275 bp, Desulfotalea psychrophila LSv54
  CDS (1)..(1275)
ttgcagaatgcccttgggcatctgtctattggtgaagggcatggggctcttccaccggctacgacttttgttttaacagggggaaatctgtctatgaaggtgaaaaataatatccactgggtgggaaaaattgactgggagttacgaaaattccacggcgatgagtactccactcacaagggttcttcctacaacccctatctgatcaaggaggagaaggtggtcctgatcgatacggtctggggaccctttgctcaggagtttgtcgagaacctcaggcgggagatcgatcttgaccagattgattatattgttgcctgtcacgccgagaatgatcatagcggggccctgccggagttgatgcgtcatattcccgatgtgcccatctactgcagcaaaaactgcgccaaatttcttaaggggctctaccatcaggattggaacttccaggtggtcaagagcggggatcggttgagtcttggctccaaagagctggtctttatcgaagcccccatgctccactggccagacactatgtttgtctatctcacaggagacgctgtcctcttcagtaatgatggttttggccaacattatgcctcagcgcatatgtttaacgacctggtagatcaggctgatctttttcaagaatgtctgaaatactatgccaatatccttacccccttcagtcccatggtcaccagaaagatcaaggagattctggacatgaacctgcccttggagatgatctgtaccagccatgggatcatctggcgtgataatccatcccaaattgtagaaaagtatttgcaatgggctgataactatcaggaaaaccagatcagcatcctctacgataccatgtgggagagcacccgggtcatggccgagcagattgccgccggaattagagaggtcgacgaggaggtgacggtgaagctctacaacctggccaagagcgacaagaacgacgtcatcaccgagatcttcagatcaaaggccattcttatgggctctcccacactcaacaatggcattctggtctcggtggcgggcctgctggaggagataaaggggctcaaattcaagggcaaaaaggcaggcgcctttggtagctatggctggagcggtgaggcggtaaaaaatatttctcagcgcctgactgattccggttttgaactggtcgatgagggtctgcgtctgacctggtcaccggatgaggagggtaaaaagacctgcagagagtacggcaaaagctttgtccagagtctatag

SEQ ID NO: 45365 - protein, 424 aa, Desulfotalea psychrophila LSv54
MQNALGHLSIGEGHGALPPATTFVLTGGNLSMKVKNNIHWVGKIDWELRKFHGDEYSTHKGSSYNPYLIKEEKVVLIDTVWGPFAQEFVENLRREIDLDQIDYIVACHAENDHSGALPELMRHIPDVPIYCSKNCAKFLKGLYHQDWNFQVVKSGDRLSLGSKELVFIEAPMLHWPDTMFVYLTGDAVLFSNDGFGQHYASAHMFNDLVDQADLFQECLKYYANILTPFSPMVTRKIKEILDMNLPLEMICTSHGIIWRDNPSQIVEKYLQWADNYQENQISILYDTMWESTRVMAEQIAAGIREVDEEVTVKLYNLAKSDKNDVITEIFRSKAILMGSPTLNNGILVSVAGLLEEIKGLKFKGKKAGAFGSYGWSGEAVKNISQRLTDSGFELVDEGLRLTWSPDEEGKKTCREYGKSFVQSL

SEQ ID NO: 45366 - DNA, 1200 bp, Bacteroides fragilis YCH46
  CDS (1)..(1200)
atggaacagaaaacaagaattaaaggaaacgttcattatgtgggagttaacgaccgtaacaagcacctctttgagggaatgtggcctttgccctatggagtttcgtataactcttatctgattgatgatgaaatggtggcactgatcgatacagtggatatttgctatttcgaagtatatcttcgaaaaatcagaaatatcataggcgaccgtcctatcaactatttgattataaatcacatggaaccggaccattcaggttctatccgattgattaagcaacactatcccgacattgtgatcgttggcaataaacagactttcggtatgatcgaaggtttttatggtgtgaccggcgagcaatatctgattaaggatggtgattttctcgctcttggacgtcataaactgcgcttttacctgactccgatggtacactggccggaaacgatgatgacatttgacgaaacagatggcatactcttctccggtgatggtttcgggtgttttggtacgctggatggcggcttcgtggatacacgcatgaatatcgaccattattggggcgaaatggttcgttattattcgaacatcgtcggcaaatacggttcaccggtacagaaagctttgcaaaagttgggtggacttcctatctcggctatttgttctacgcacggtccggtatggactgagaatatcacgaaagtggtaggcatttatgataaactgagccgttatgacgcagatgaaggtgtggtaattgcatacggcagtatgtacggtaataccgaacaaatggcagaagccattgcagctgagctttcggcacagggcatcaaaaacattgtgatgcacaatgtcagcaaaagtaatccctcttatatccttgccgatatattccgttataaaggattgattatcggtagccctacttacagtaaccagattttcccggaagtggagtcgcttctgtccaagatattggttcgtgaattgaaaggacgttatctggggtatttcggttcgttcacgtgggcaggtgctgccgtgaaacgtatggccgagtttgcagagaaaagtaaatttgaattggtcggtgatcctgtagaaatgaaacaggccatgaaggagatcacatatcaacagtgtgagaacctggcacgtgctatggccggccgtttaaaaaaagacagagtataa

SEQ ID NO: 45367 - protein, 399 aa, Bacteroides fragilis YCH46
MEQKTRIKGNVHYVGVNDRNKHLFEGMWPLPYGVSYNSYLIDDEMVALIDTVDICYFEVYLRKIRNIIGDRPINYLIINHMEPDHSGSIRLIKQHYPDIVIVGNKQTFGMIEGFYGVTGEQYLIKDGDFLALGRHKLRFYLTPMVHWPETMMTFDETDGILFSGDGFGCFGTLDGGFVDTRMNIDHYWGEMVRYYSNIVGKYGSPVQKALQKLGGLPISAICSTHGPVWTENITKVVGIYDKLSRYDADEGVVIAYGSMYGNTEQMAEAIAAELSAQGIKNIVMHNVSKSNPSYILADIFRYKGLIIGSPTYSNQIFPEVESLLSKILVRELKGRYLGYFGSFTWAGAAVKRMAEFAEKSKFELVGDPVEMKQAMKEITYQQCENLARAMAGRLKKDRV

SEQ ID NO: 45368 - DNA, 1545 bp, Photobacterium profundum SS9
  CDS (1)..(1545)
atgtctattcacgttaagaacaatattcactgggttggtcagcgcgattgggaagttcgagattttcatggcactgaatataaaacattgaaaggaacgagctataacagttacctgatccgtgaaggtaaaaacgtgttaattgataccgttgatcataagtttagctacgatttcgtccaacaactagaacaagaaattgacctaaacgagattgatcttatcgtcatcaatcacgctgaagaagatcatgctggtgctttatctgttttacttagcaaaattccaaacactcctatttattgtactgaaaatgccattgactctattactggtcaccaccatcaccctgaatggaatttcaatgtagtcaaaactggcgatagcattgatattggtaatggtaaatctctcgtctttatagaaacacctatgctgcactggcctgatagcatgatgacgtacatgacaggtgacgcggtacttttcagtaacgatgcctttggtcaacactactgtgacgaacgtctgttcaacgatgaagttgagcaaaacgaactgatggaacaatgcttacgctactatgccaatatcctaacgccatttagcccgcttgttactgccaagattcatgaagtgttaagctttaatcttcctgttgatatggttgcgacatctcatggtgttatctggcgtgataacccaactcagataatcgaacaatatcttgagtgggccaatgaatataaagaagacaaaatcactatcttctacgattcaatgtctaataatacccgcatgatggcagatggtatcgcccaaggtatcaccgaaacagatccaaacgttgcggttaaaatcttcaatgtttctcgtcatgataagaatgaaatactgactaatgtatttggttctaaaggtattcttgtcggttcatcaaccatgaacaatgtgatgatgccaaaagtcgcaggcatgttagaagaaattacgggcttacgctttaaaggtaaaaaagcaggtgcatttggtagttatggttggaacggtggtgctgtcgatcgtattcattctcgtttaaccgatgctggattctttactaccgtcggattaaaaaccaaatggcgaccagactcaaatgcgatggaagaatgtcgcgaacatggccgtaaaattgctcgtgaatgggcattacagcctcttaccgtagcgactacacgcgccgttattaacgaactcaatgttgcacctcgcagcgttgtagcatcacaatcagttgtaacaccacagccagttgtagaaactgtaacaccagcaacaaatgaagcggcagtcgtgcaacaagaagtaaccagtaccacaacggctagcagcacagatcaaaaacagaaacaaatttgtactgtgtgccagtggatttacaatccagagttaggcgagcctaatcaaggtgttgagccaaagacagcatgggaagaagtacccgattcattcttatgtcctgaatgtggtattggcaaacaagtattcgaacccactaactaa

SEQ ID NO: 45369 - protein, 514 aa, Photobacterium profundum SS9
MSIHVKNNIHWVGQRDWEVRDFHGTEYKTLKGTSYNSYLIREGKNVLIDTVDHKFSYDFVQQLEQEIDLNEIDLIVINHAEEDHAGALSVLLSKIPNTPIYCTENAIDSITGHHHHPEWNFNVVKTGDSIDIGNGKSLVFIETPMLHWPDSMMTYMTGDAVLFSNDAFGQHYCDERLFNDEVEQNELMEQCLRYYANILTPFSPLVTAKIHEVLSFNLPVDMVATSHGVIWRDNPTQIIEQYLEWANEYKEDKITIFYDSMSNNTRMMADGIAQGITETDPNVAVKIFNVSRHDKNEILTNVFGSKGILVGSSTMNNVMMPKVAGMLEEITGLRFKGKKAGAFGSYGWNGGAVDRIHSRLTDAGFFTTVGLKTKWRPDSNAMEECREHGRKIAREWALQPLTVATTRAVINELNVAPRSVVASQSVVTPQPVVETVTPATNEAAVVQQEVTSTTTASSTDQKQKQICTVCQWIYNPELGEPNQGVEPKTAWEEVPDSFLCPECGIGKQVFEPTN

SEQ ID NO: 45370 - DNA, 2664 bp, Azoarcus sp. EbN1
  CDS (1)..(2664)
atgtcgtttgctgtgaaaagtaatatcacgtgggtcggaaaacaggattgggagctgcgggaattccatggtgccgaatactcgacgcacaagggttcgagctataacagctatctcgtgcgtgaggaaaaggtcgcgttgatcgataccgtgtggagcccgtacgcacaggagttcatcgacaatctggaaaaggaaatcgatcttcacaagatcgactacatcatcgcgaaccacgccgaaatcgaccacagcggcgcattgccggcattgctggcgaggattcccgacacgccgatctactgcacagaaaacggcgtcaagtccctgaaaggacattttcacaaggactggaatttcaaagtcgtcaagaccggggatacgctggatctgggcaatggcaagcagttcgtattcgtcgaggccccgatgctgcactggccggacagcatgatgacgtacctcgccggggatgcagtgctgttcagcaatgacgccttcggccagcattacgccagcgagcagatgttcaacgacctcgtggaccaggaggaactgcgcgccgagtgcctcaagtattatgcgaacatcctgacgccgttcagtgcgcgtgttgccgcgaaaatccacgaagtgctgtcgttcaagctgccgctggaaatgatctgcacggcccacggagtcatctggcgcgacaatccggcgcagatcgtcgagcagtacctggcgtgggccgacgattaccaggaaaaccagatcacgctgatctacgacacgatgtggaacggcacccggcagatggcggaggcgatcacgaaagggattcgttcggccgacccgtcggtggaagtgaagatgttcaacctcgccatctcggacaagaacgacgtgctgacgcaggtgttcaagtcgaaaggcattctggtcggctctccgaccgtcaacaacggcatgctgccccatgtcgcggcgctgctcgaagaaatgcgcggcctgcgtttccgcggcaagcacgcggcctcgttcggcagccacggctgggccggcggcgccgtggaccggatcgctcagcggctggaggaggcgggcttcaaggtcagcggcgggatcgaagcggtctggaagcccaccgacggcgcgctcgacgaatgcctcgcgttcggccggcgcgttgcgcagcaatggcgtggcgattacgtccctgtcgaggccggggatagcgctcctgcgtcagcgttcgcccgacaaccggtccgcccggccgcaaagcccgttgcagcagcgactgcgaccccgaacgtcgcggaggctgacggcggttcgatgaggtgccggacctgcggctgggtttatgacccggccaagggagaatcggggcagggcgtccatgccggcacgccatggtccgaggtgccggaaacgttcctgtgccccgaatgcctcctcggcaaaaccgagttcgagcccctgcatccgcgtcgggacggcgcggcggacgcttcccggggggacggactgcagcccgcgccggtcgtgatcatcggcggcggcagcgccacttaccaactggtccgggctttccgcgcacaggatcaggacactccggtgctggtgatcaccgcggacgctggcgcggactatccgaagccccaactggtccatggcttcagccgcaagctcgggccatcggatctggtgcagcgttcaccagaagagctcgcccgcgagttcaacgtcacgatcaagacgcatacgcgggtggattcgatcgacgccgaagcgaagacgatcagtttcgcgggcgaaatccagccttacagggatctcgtcctcgcgctcggtgcaactccgtggatccctccgctcgaaggaaacgctgtcgatcgggtgatcacgctgaacaatctcgcggactacgaaacgtatctgcaccagctctcgcagggaaagcgggtgctggtgatcggagcgggcctgaccggcaccgaggttgcgctcgatctggccgaaggcgggcagcaggtgtggctgaccgacatcgccccccgtacgcttgccaaggtgttgcccgagttcgtcagccaggaactggaagccaggctggtgcagaaagggtgccggctgcatctgggccaaaacatcgtgtcgatcgactcgagcgccggaggggccaccgtgcggctttcggacggggaaacgtttgaagtggatacggtggtgtcggcggcgggcgtgcggccgcgcactgaactcgcggaggcagccggcctccaggtcaatcggggaatccgggtcgatccgcagttgcagagcagcagcgcgcatatctatgcgctgggcgactgcgccgagatcgaaggacgggtgctgccgttcatgcatccgctgtcgctggcggcccaggcgctggcgaaaacgctcgctggcgagcgcaccgggttgcgcctgccggcgatgccgacgatggtgaaaacgcccgcgatgccgatccaggtcggcggcgtgacggtcgccgacggccttcaatggacggtggatgccgatgaaaccggcctgacgggcaaggcggtcaatgacgagggcgaactggtgggatacgtcgtgaccggcaagcatctcggcaacggcatggcgctgctgcaacagttgccggcactgctctga

SEQ ID NO: 45371 - protein, 887 aa, Azoarcus sp. EbN1
MSFAVKSNITWVGKQDWELREFHGAEYSTHKGSSYNSYLVREEKVALIDTVWSPYAQEFIDNLEKEIDLHKIDYIIANHAEIDHSGALPALLARIPDTPIYCTENGVKSLKGHFHKDWNFKVVKTGDTLDLGNGKQFVFVEAPMLHWPDSMMTYLAGDAVLFSNDAFGQHYASEQMFNDLVDQEELRAECLKYYANILTPFSARVAAKIHEVLSFKLPLEMICTAHGVIWRDNPAQIVEQYLAWADDYQENQITLIYDTMWNGTRQMAEAITKGIRSADPSVEVKMFNLAISDKNDVLTQVFKSKGILVGSPTVNNGMLPHVAALLEEMRGLRFRGKHAASFGSHGWAGGAVDRIAQRLEEAGFKVSGGIEAVWKPTDGALDECLAFGRRVAQQWRGDYVPVEAGDSAPASAFARQPVRPAAKPVAAATATPNVAEADGGSMRCRTCGWVYDPAKGESGQGVHAGTPWSEVPETFLCPECLLGKTEFEPLHPRRDGAADASRGDGLQPAPVVIIGGGSATYQLVRAFRAQDQDTPVLVITADAGADYPKPQLVHGFSRKLGPSDLVQRSPEELAREFNVTIKTHTRVDSIDAEAKTISFAGEIQPYRDLVLALGATPWIPPLEGNAVDRVITLNNLADYETYLHQLSQGKRVLVIGAGLTGTEVALDLAEGGQQVWLTDIAPRTLAKVLPEFVSQELEARLVQKGCRLHLGQNIVSIDSSAGGATVRLSDGETFEVDTVVSAAGVRPRTELAEAAGLQVNRGIRVDPQLQSSSAHIYALGDCAEIEGRVLPFMHPLSLAAQALAKTLAGERTGLRLPAMPTMVKTPAMPIQVGGVTVADGLQWTVDADETGLTGKAVNDEGELVGYVVTGKHLGNGMALLQQLPALL

SEQ ID NO: 45372 - DNA, 1266 bp, Rhodobacter sphaeroides 2.4.1
  CDS (1)..(1266)
atgccgccccttcccgcagaagggccggtcgagatcgtgcccggcgtgcactggatcggtgccttcgacccggggctgcgcagcttcgacacgctgatgaagacggccaacggcacgagctacaacgcctacaccgtccgcggcgcggcgggcgtggcggtgatcgacacggtgcatgcggatcatgccgagaccttcttcgcgcgcctcgaagccgtggcccgctacgacgagatcacgcagatcgtgctcaaccacctcgagcccgaccattccggcgccctgcccgagctgctgcgccgggcgccgcaggccgagatccgcctctcgccccgcggcctgccgatcctgcgcgccctcctccgcgatgccttcgagacggcccggatcctgcccgtcaccaccggcgccgaagcggatctgggcggccggcggctgcgcttcctgaccacgcccaacgtccactggcccgacacgcaatgcacctatctcgtcgaggaggggatcctcttcacctgcgatctcctcggcagccactattgcgacgagcggctcttcgacgaccgggtgggcgatttccgcttcgccatggaccattatttcgaccggctgatgcggcccttccgcagcttcgtcacccaggcgctcgacctgatcgagccgctcgacctcaccgtcatcgccccctcgcacggccccgtgctgcgcaccgatccgcgcgcctatctgcgccagtatcgcaggctcgcggggccgcgctcggcccccggacccgaccggacgctggccatcctctacatctccgcccatggcgcgaccgcacggctcgcgcaggcgatccgggacggcgcggccggagagccgggcgtgcgcgtctcgctcttcgatctcgaagggggcgagcttcatcccttcctcgacctgatcgaggaggtcgacgggatcgcgctcggcacgcccaccatcaacggcgatgcggtccgcgcgatctgggagcttctggccatgctcgtggacatcgagacccgcggcaagctcggcgcggtcttcggctcctacggctggtcgggcgaggcggtccgtcaggtcgaggcgcggcttcaggggttgaagatgcgcctgcccgagccggggctgaaggtgaagctcgagcccaccgacgaggatcttcaggaggcgcgcgccttcggccgccgcctcgccgcccatctcaccggccgcgccccgccgcgcgaggtcgatctggccgatctggcctcccgctga

SEQ ID NO: 45373 - protein, 421 aa, Rhodobacter sphaeroides 2.4.1
MPPLPAEGPVEIVPGVHWIGAFDPGLRSFDTLMKTANGTSYNAYTVRGAAGVAVIDTVHADHAETFFARLEAVARYDEITQIVLNHLEPDHSGALPELLRRAPQAEIRLSPRGLPILRALLRDAFETARILPVTTGAEADLGGRRLRFLTTPNVHWPDTQCTYLVEEGILFTCDLLGSHYCDERLFDDRVGDFRFAMDHYFDRLMRPFRSFVTQALDLIEPLDLTVIAPSHGPVLRTDPRAYLRQYRRLAGPRSAPGPDRTLAILYISAHGATARLAQAIRDGAAGEPGVRVSLFDLEGGELHPFLDLIEEVDGIALGTPTINGDAVRAIWELLAMLVDIETRGKLGAVFGSYGWSGEAVRQVEARLQGLKMRLPEPGLKVKLEPTDEDLQEARAFGRRLAAHLTGRAPPREVDLADLASR

SEQ ID NO: 45374 - DNA, 1725 bp, Nostoc punctiforme PCC 73102
  CDS (1)..(1725)
atggtagcactcaccgaaaaaactgaaaaacggctcaccatacagactgtggaaatcgctcaagagacgacggcaattcgctctttggactgggatcgcgatcgcttcgatattgagtttggtttgcaaaacggtactacttataactcgtttctcatccgtggcgaacagactgccttagttgatacctcccacgaaaagtttcgtcaactatacttcgatacgcttaccggactaattaagccaacagagattgattatttgattatcagccatactgagccagaccatagcggtttagttaaagatttgctgcttatggctccagaaattactgttgtcggttctaaggtggcgattcagtttcttgaggatttcgtacatcagccatttaagcggcggattgtgaaaaatggcgatcgcttggatttaggcaatgggcatgaatttgaatttgtgattgccccaaatttacattggccagataccattttcagcttcgaccacaaaaccaaaactctctacacctgcgacgcttttgggctgcactattgctcagatagcacctttgatgaagacttggtagcgatcgaagaagactttcattactactacgattgcttgatggggccaaatgcgcggtcggttttgtctgccctgaaacggatgggggaacttaaaaccatcgatatgattgccacaggacacggaccattattgtctcacaatgttgaggaactagttggacgttaccgcatttggagtcaaacccaagccaaaccagaaacggtaattgggatattttacgtttccgaatacggatatagcgatcgcctcgtgcaagcaattgccaacggcatcgggaaaactggtgtcgccgtggaaattgtcgatttgggatctgaagtcgatttacaagaactgcgggaactagttagtcgttgtgcagggctaattgttggtctacctccggcttctggtgctgcgagcatccaatctgcactcagcacagttttaggatctgccaaagaaaagcaagcgatcggtgtgtttgaaaccggcggtggcgatgatgagccgatagatcctttgctgagtaaattccgcaatttgggtttgacaacagtttttccagcgattcggattaaacaaacacctacagaaaatacctacaagctttgtgaagaagcgggtacagacttagctcaatgggtaacacgcgatcgcagcatcaaagcgatgaaatctcttggtgctgacttagataaagcattaggtagacttagcggcggcttatatatcatcactgccaaaaaaggcgatgtatccagtgcgatgttagcctcgtgggttgctcaagccagcttcaaacccttgggattctccattgcagtcgccaaagatcgggcgattgaatcactcatgcaagtaggcgatcgctttgttctcaacattttagaagaaggcaatttccaaccactaatgaagcactttttgaagcggttcgcccctggtgccgatcgctttgaaggagtgagaacccagccagccgaaaatggtgcgcctattcttaacgatgccctcgcctacatggagtgcgaagtcgtcagtagaatggattgcggcgaccactgggcagtatacagcaatgtctacgccggacgggtttctaagccagatgctttaacagctgtgcatcaccgcaaagttggtaatcattattag

SEQ ID NO: 45375 - protein, 574 aa, Nostoc punctiforme PCC 73102
MVALTEKTEKRLTIQTVEIAQETTAIRSLDWDRDRFDIEFGLQNGTTYNSFLIRGEQTALVDTSHEKFRQLYFDTLTGLIKPTEIDYLIISHTEPDHSGLVKDLLLMAPEITVVGSKVAIQFLEDFVHQPFKRRIVKNGDRLDLGNGHEFEFVIAPNLHWPDTIFSFDHKTKTLYTCDAFGLHYCSDSTFDEDLVAIEEDFHYYYDCLMGPNARSVLSALKRMGELKTIDMIATGHGPLLSHNVEELVGRYRIWSQTQAKPETVIGIFYVSEYGYSDRLVQAIANGIGKTGVAVEIVDLGSEVDLQELRELVSRCAGLIVGLPPASGAASIQSALSTVLGSAKEKQAIGVFETGGGDDEPIDPLLSKFRNLGLTTVFPAIRIKQTPTENTYKLCEEAGTDLAQWVTRDRSIKAMKSLGADLDKALGRLSGGLYIITAKKGDVSSAMLASWVAQASFKPLGFSIAVAKDRAIESLMQVGDRFVLNILEEGNFQPLMKHFLKRFAPGADRFEGVRTQPAENGAPILNDALAYMECEVVSRMDCGDHWAVYSNVYAGRVSKPDALTAVHHRKVGNHY

SEQ ID NO: 45376 - DNA, 1737 bp, Nostoc punctiforme PCC 73102
  CDS (1)..(1737)
atgtctgttgcaacattaacgcccaatcatagcagagatgtacaagttgctgaaattggtaaaaatactctgattctgcgatcgcggacttgggacagactaaaatttgaggtggagtattcccgtcaacggggaactacagcaaattcttatctgattcaaggtgagaaaaaggctttaattgaccctcccggcgaatcttttaccgaaatttaccttgagcaactagcacaatatctagattttatctccctcgattacattgttctcagtcatgtcaacccgaaccgtagagcaactctgcaagtattactctctctggttcctcaagctactctaatttgttctcgccccgccgccaatgctctaaaaactgcctttcccgaattggaatcacctattcaagcggtgcgatcgggggatactttagatttaggacaaggacatcatctatcatttgtcaccgtaccaactccccggtgggctgatgggctttgtacttatgattatgcaacaaaaattctctacacagacaaacttttcggcgctcatatttgcgaagacactttgtttgatgaagattggaagggattagacgcggaacgtcgttattattttgaatgtcttcatgcaccccaagccaaacaagtcgaagtagtcttagataaattgtcacttttgggagccagatgttatgccccagcccacggcccagttgtccgttacagcctgagtcgttttacttatgattaccgtcaatggtgccaagggcaaaaatctcaagaattgagtgtcgctttgctttatgcttctgcttatggaaatacagcaattatggcgaatgcgatcgctcaaggtttgattcaaaatggagttaatgtagaatcaatcaactgtgaactagccgattctgcggagattaaccgtattgtagaaacttgcgatggcttaattatcggctcacccactttaggcggccatgcaccaactcaaattcaaactgctttaggaatagtcctctcggtggcggctaaaactaagttagcaggggtgtttggttcctacggttggagtggagaagcaatagatttaattgaaagtaagctcaaagatgcaaattatcaactagggtttgaaacaattcgggtgcgttttagccctacttctgaaattcttcagcagtgtcaagaagcaggtgctttttttgcccaaaacttgaagaaaaccaaaaaacttcgtagttcccgccagattgtgacagaaacccatgtagatcgtaccgaacaagcggtggggcgaatcattggttctctgtgtgttgtgacaactcgtgatgaagaaactcacaaaggggttttaacttcttgggtatcgcaggcaacttttaacccgccaggaattatgattgcgatcgctaacgagcagaatgcagatttaatgcatcatcctggggataaatttgtgctaaatatccttaaagaaggaagaaatgtgcgccgctatttttctcgtcatagcactttaggcgataatccctttgcaaatctagccacaaaaactgctctgaatggttgcttgattctgaatgaggcattagcctatttggaatgtacggtgcaaaatcagcttgaatgtggcgatagatggttaatttatgccgtcatcgatcgcggtgaagtgttggaaaatgatggtatcactgctttggagcatcggaaatctggcagctattattaa

SEQ ID NO: 45377 - protein, 578 aa, Nostoc punctiforme PCC 73102
MSVATLTPNHSRDVQVAEIGKNTLILRSRTWDRLKFEVEYSRQRGTTANSYLIQGEKKALIDPPGESFTEIYLEQLAQYLDFISLDYIVLSHVNPNRRATLQVLLSLVPQATLICSRPAANALKTAFPELESPIQAVRSGDTLDLGQGHHLSFVTVPTPRWADGLCTYDYATKILYTDKLFGAHICEDTLFDEDWKGLDAERRYYFECLHAPQAKQVEVVLDKLSLLGARCYAPAHGPVVRYSLSRFTYDYRQWCQGQKSQELSVALLYASAYGNTAIMANAIAQGLIQNGVNVESINCELADSAEINRIVETCDGLIIGSPTLGGHAPTQIQTALGIVLSVAAKTKLAGVFGSYGWSGEAIDLIESKLKDANYQLGFETIRVRFSPTSEILQQCQEAGAFFAQNLKKTKKLRSSRQIVTETHVDRTEQAVGRIIGSLCVVTTRDEETHKGVLTSWVSQATFNPPGIMIAIANEQNADLMHHPGDKFVLNILKEGRNVRRYFSRHSTLGDNPFANLATKTALNGCLILNEALAYLECTVQNQLECGDRWLIYAVIDRGEVLENDGITALEHRKSGSYY

SEQ ID NO: 45378 - DNA, 1488 bp, Nostoc punctiforme PCC 73102
  CDS (1)..(1488)
atgggattaattgatccgactaaaatagattacttgattattagccatacggaaccagaccacagtggcctagtaaaaaatattttgcaactagctccatccattactgttgttggtgctaaggtagctattcaatttttagaaaatatggttcaccagccctttaattcaaggcaggtgaaaagtggagagcgattaaatttaggcaacggacacgaattagaatttatctctgcacccaacttacactggcctgacacaatctttacttatgaccacaaaactagcactctctacacctgtgatgtgtttggaatgcactactgtgatgaccacacttatgatgaaaatatcaccttacttgaggaagattttcaatattattatgattgtcttatgggccccaatgcccgctctgttttggcagctttaaagcggattgaaaagttagaaataggaacagttgctacgggacatggacctttattacaacactatattccagactggctcggacggtatcaaaactggagtttagaacaagcaaaaacagagactttagtggctctattttatgttgaagattacgggcatagcgagcagttagtccgtaccatagctcatggatgtgcgaaaacaggcgcagcagtggaattatttcctctcaatagttctgaacctcaagaagttagagaattagttgcacaatcttctggtttagtaattgcaatgccaccccaatcttcggtgatagctcaagcttctttaagcactattttagctgctgttcacaaaaagcagtcaattggtttattagagtcgggaggtggagaagatgaacctatttatcctttacgcaataagtttcaagaactgggattaactgaagcctttccacctattttagttaaggaaattcctacccaagcaacggaacagctttgtgatgaagcggggacagatttgggtcaatggttgaaccgcgatcgcaccattaaacaaatcaaatctatcaatacggagctagagaaggctttaggtcgtcttagcacaggcttatacattatcactgccaaaaaaggagaaattcagagtgcaatgttggcttcttgggtgacacaagcgagtcttgagcctttaggagttgcgatcgcagtatccaaagatcgggcaattgaatctttgatgcacgttggcgatcgcttcgttctaaacgttttagaagaaggcaaatatcaaggattaatgaaacatttcctcaagcgttttgctcctggtgtagaccgatttgccggagtgaagacatatccagcaaaaaatgaatcgcccgttttagctgaagctttggcttatatggaatgcgaaatcactagccgcatggactgtggagatcattgggtaatttatagcacagtccaaactggaagagttgccaagttagatgcacttaccgccgcccatcaccgcaaaattggcaatcattattaa

SEQ ID NO: 45379 - protein, 495 aa, Nostoc punctiforme PCC 73102
MGLIDPTKIDYLIISHTEPDHSGLVKNILQLAPSITVVGAKVAIQFLENMVHQPFNSRQVKSGERLNLGNGHELEFISAPNLHWPDTIFTYDHKTSTLYTCDVFGMHYCDDHTYDENITLLEEDFQYYYDCLMGPNARSVLAALKRIEKLEIGTVATGHGPLLQHYIPDWLGRYQNWSLEQAKTETLVALFYVEDYGHSEQLVRTIAHGCAKTGAAVELFPLNSSEPQEVRELVAQSSGLVIAMPPQSSVIAQASLSTILAAVHKKQSIGLLESGGGEDEPIYPLRNKFQELGLTEAFPPILVKEIPTQATEQLCDEAGTDLGQWLNRDRTIKQIKSINTELEKALGRLSTGLYIITAKKGEIQSAMLASWVTQASLEPLGVAIAVSKDRAIESLMHVGDRFVLNVLEEGKYQGLMKHFLKRFAPGVDRFAGVKTYPAKNESPVLAEALAYMECEITSRMDCGDHWVIYSTVQTGRVAKLDALTAAHHRKIGNHY

SEQ ID NO: 45380 - DNA, 1374 bp, Nostoc punctiforme PCC 73102
  CDS (1)..(1374): n means a or g or c or t/u
atggactcttgtgtgcaacctgcatctcggatnctagnagaatccccctggttatgcggggtggaagattctctaaatttgggtaacgggcataatttacaatttattcccacccccaatccccgctatgcagatcaactttgcacctacgatccgcaaacagaaattctctatacagataagttatttggggcgcacgtttgtggagatcaggtatttgatgaaggctgggaagtctataacgaagatcggcgctattattttgattgcctcatggctccccacgctcgtcaagtagaaacagcgctggaaaaactagccgattttcccgtgagaatgtatgccaatggacacgggcctttagtacgttatggcttaatcgaactgaccaaatcttatcgagaatggagtcaacagcaaacttctgctgacttgacagtggcgttaatttatgcatcagcttatggaaatacagcaaccttagcccaagcgatcgctcgtggcatcaccaaagctggtgtcgccgtagaatcgattaactgcgaatttactgaaccagaagaaattcgggcggctgtagaaaaagccggtggtttcatcatgggttctccaactctcggcggtcatgcaccgacacctgtgcaaacagctttaggaattgtgctatccaccgcgactaacaacaaactcgctggtgtttttggttcctttggctggagcggggaagcagttgatttaattgaaggtaaattaaaagatgctggttatcggtttggttttgacaccatccgcgtgaaatttaaacccgacgatgccaccttacaattgtgtgaagaagccggaaccgactttgcccaagcactaaagaaagctagaaaagtgcgatcgccaagtcaacccgctacgactgtagaacaagcagttggtcgtattgttggttctctgtgcgttctaactgccaaagaaggcgatcgctcaagtgccatgttagcctcttgggtagctcaagcaagttttagtccacctggtttaaccatagctgtcgctaaagaacgggcagtagaaacactgacccatacaggaaacaaatttgtcctcaatattcttaaagaagggaatcatttggggttgatgaagcactttctcaaaccctttggcccaggacaagatagatttgccgatgtcgccgcccaagaagctgaaaacggttctcccatacttacggaagccttggcatatctggaatgttctgtacaaaaccggatggaatctggcgaccattggctagtttatgccactgtcgagaatggcaaattgttagataatgatggcatcacagccgtgcatcatcgcaagtcggcaactcattattaa

SEQ ID NO: 45381 - protein, 457 aa, Nostoc punctiforme PCC 73102
  misc_feature (11)..(11): Xaa can be Ile or Met
  misc_feature (13)..(13): Xaa can be Glu or Ala or Gly or Val
MDSCVQPASRXLXESPWLCGVEDSLNLGNGHNLQFIPTPNPRYADQLCTYDPQTEILYTDKLFGAHVCGDQVFDEGWEVYNEDRRYYFDCLMAPHARQVETALEKLADFPVRMYANGHGPLVRYGLIELTKSYREWSQQQTSADLTVALIYASAYGNTATLAQAIARGITKAGVAVESINCEFTEPEEIRAAVEKAGGFIMGSPTLGGHAPTPVQTALGIVLSTATNNKLAGVFGSFGWSGEAVDLIEGKLKDAGYRFGFDTIRVKFKPDDATLQLCEEAGTDFAQALKKARKVRSPSQPATTVEQAVGRIVGSLCVLTAKEGDRSSAMLASWVAQASFSPPGLTIAVAKERAVETLTHTGNKFVLNILKEGNHLGLMKHFLKPFGPGQDRFADVAAQEAENGSPILTEALAYLECSVQNRMESGDHWLVYATVENGKLLDNDGITAVHHRKSATHY

SEQ ID NO: 45382 - DNA, 1713 bp, Nostoc punctiforme PCC 73102
  CDS (1)..(1713)
atgaccaattccaagccacgcgacgtacaagttctaccaattgctacaaatactaaggcgatcagagcacgtagttggtcacgtctgcggtttgaaattgaatatgcacttgaaagaggtactacctccaattgctatttaattgaagctgataaaaccgcacttatcgatccaccgccagaaagctttaccgaaatttatttagaggcattgcggcagactttagatttacaaagtttggattatataatcctgggtcattttagtcccaatcgagttgcaaccctcaaagcaattttagaactggcaccacaggtaacttttgtctgttctcttcccggtgcgaacaatttgcgtgctgctttcctagagcaagatttgaaagtcttggtaatgcgggggaaagaaactctggatttaggcaaaggtcatgttttgaaattcctgcccactcccagtccgcgttggccagaaggactttgtacctacgatcggcaaacccaaattctctacacagataagttatttgcaactcatctctgtggtgatgaagtgtttgatgataattgggaagcgcttaaagaagaccagcgttactactttaactgcctgatggctccccaaactcctcatgtgcaagcagctttggagaaaatatcagatttgcaggtgagaatgtatgctgtaggtcatggacctttagtacgcaccagcttaatcgaactcaccaaagcttatggagagtggagccgttctcataacgatcgcgagatttccgttgccctactttacgcttcagcttacggcaatacggcgactttagcacaagcgatcgctctgggattaactaaaggtggagttgcagtcaaatcaattaactgcgaatttgccacccctgatgaaattcgcatcaacttagcacagtcagaaggttttatcatcggttctcctaccatcggtggtcatgcgccgactcccattcatactgctttagggattgtgatctcaagcggtgacaacagcaaactcgctggagtctttggttcttatggctggagtggcgaagcttttgacttaatagaaggtaaactccgggattctggataccgttttggctttgacacattgaaggtcaagtttaaacctgatgatgtcactctcaagttctgtgaagaactaggtacagactttgcccaagcactgaaaaaagctaaaaaggtacgtgtaccacaacaagccgctactccagtagaacaggctgttggtcgcattgttggttctgtatgcgtggtgacagcgaaacaaggagaagtgtctaccgcaatgttaggcgcttgggtttctcaagctacctttaacccaccgggaataaccgtggcgatcgccaaagagcgagcgatcgaatctttgatgtatccaggcggtaaatttgccttaaatattctacctgaaggcaatcatcaagactacatgaagcatttccgtaaatctttcgcgcccggggaagatcgatttgctaactttagtacagcagttgcggataacggctgtaccgttcttactgatgcattggcatatttagaatgctcagtcaatcaacgtctggaatgcggcgatcattgggttgtatatgcaactgtggacgaaggtaaattactcaaacctgatgctgttactgccatcaaccatcgcaaaactggcactcattattag

SEQ ID NO: 45383 - protein, 570 aa, Nostoc punctiforme PCC 73102
MTNSKPRDVQVLPIATNTKAIRARSWSRLRFEIEYALERGTTSNCYLIEADKTALIDPPPESFTEIYLEALRQTLDLQSLDYIILGHFSPNRVATLKAILELAPQVTFVCSLPGANNLRAAFLEQDLKVLVMRGKETLDLGKGHVLKFLPTPSPRWPEGLCTYDRQTQILYTDKLFATHLCGDEVFDDNWEALKEDQRYYFNCLMAPQTPHVQAALEKISDLQVRMYAVGHGPLVRTSLIELTKAYGEWSRSHNDREISVALLYASAYGNTATLAQAIALGLTKGGVAVKSINCEFATPDEIRINLAQSEGFIIGSPTIGGHAPTPIHTALGIVISSGDNSKLAGVFGSYGWSGEAFDLIEGKLRDSGYRFGFDTLKVKFKPDDVTLKFCEELGTDFAQALKKAKKVRVPQQAATPVEQAVGRIVGSVCVVTAKQGEVSTAMLGAWVSQATFNPPGITVAIAKERAIESLMYPGGKFALNILPEGNHQDYMKHFRKSFAPGEDRFANFSTAVADNGCTVLTDALAYLECSVNQRLECGDHWVVYATVDEGKLLKPDAVTAINHRKTGTHY

SEQ ID NO: 45384 - DNA, 1719 bp, Nostoc punctiforme PCC 73102
  CDS (1)..(1719)
atggtagcgatcgcagagaacgttcaacatcggctaactatacaaactgtagaaattgcccctaacacaacggcgattcgctctcttgattgggaccgcgatcgcttcgatatcgaattcggactgcaaaacggcacaacctacaattcatatttaattaggggcgaacaaacagttttgattgatacttctcaccagaagtttcgcgatctgtatttagagactctaaaaggtcttgttaaccccaaaacaattgattacataattgtcagtcacacagagccagaccatagcggcttagtagaagatgtcctgcaattagctcctagagccaccgtcttagcctcaaaagttgcgctacagtttttggaaggcttagtacacgatccattttctaagcgggttgtcaaaactggcgatcgcatagatatcggcaaaggacatgaaatggaattcgtgagtgcgcctaacctgcactggccggatacaatctttagctttgaccgcaaaacccaaattctctacacctgtgatgcttttgggatgcacttttgtgacgatcgcacctttgacgaagatttagaagcgatcgaagctgactttagattttactacgactgcttgatgggtcctaatgctcgttccctgctgaatgccatgaagcggatgggcgatctaggaaagattaatataatagccaatggtcacggtcctttattataccaccatctagatgttctaactgggtgctacgaaaattggagccagagacaagctaaagcagaaaccacagtaggcttgttttttgtctcagattacggttatggcgagcgccttggtcacgcaattgccgaaggtatcctgaaaactggggttggagtagaagtactagatttaagtactgctgagagccaagaaattcaagaactagctggtagagcagctggcatcattattggtatgcccccaagtaccgctgccgccgcccaagctagtatcagctcagtgctagctgtcgccaaaaacaagcaatttgttgggctatttgaatgttacggtggggatgatgaacccattgatacactccgcagaaaatttatcgattctggcatcaaagaagccttcccagccattcgaattagagaggctcccaccgcatcaacattccagttgtgtgaagaagcaggtaaagacttgggacaattgctggtgcgcgatcgcaacatcaagcaaatcaagtctcttgatgtcaacatggaaaaagcgctgggtcgcattagtagtggactgtatatagtcaccactaaaaaagataatgcctcaagtgcaatgctggcatcctgggtaacgcaagcgagtttgcaaccattaggattaacaattgccgttgcgaaagaccgcgccattgattccttaatgcaagtaggcgatcgcttcgtcctcaacgttttggaagaaggcaattatcaagaattgaaaaagcattttctcaagcgtttgcatccaggtgctgaccgctttgcaggagtgaaaactcaaaccgcgaaaaacggttctccgattctaactgatgctttggcatacatggaatgtgaaatacagagcagcatggaatgcagcgaccactggattttatactgcacagtccaagaaggtcgtgtctctaaaaacgatggattgacagccgttcgccatcgcaaagtaggtaattactactaa

SEQ ID NO: 45385 - protein, 572 aa, Nostoc punctiforme PCC 73102
MVAIAENVQHRLTIQTVEIAPNTTAIRSLDWDRDRFDIEFGLQNGTTYNSYLIRGEQTVLIDTSHQKFRDLYLETLKGLVNPKTIDYIIVSHTEPDHSGLVEDVLQLAPRATVLASKVALQFLEGLVHDPFSKRVVKTGDRIDIGKGHEMEFVSAPNLHWPDTIFSFDRKTQILYTCDAFGMHFCDDRTFDEDLEAIEADFRFYYDCLMGPNARSLLNAMKRMGDLGKINIIANGHGPLLYHHLDVLTGCYENWSQRQAKAETTVGLFFVSDYGYGERLGHAIAEGILKTGVGVEVLDLSTAESQEIQELAGRAAGIIIGMPPSTAAAAQASISSVLAVAKNKQFVGLFECYGGDDEPIDTLRRKFIDSGIKEAFPAIRIREAPTASTFQLCEEAGKDLGQLLVRDRNIKQIKSLDVNMEKALGRISSGLYIVTTKKDNASSAMLASWVTQASLQPLGLTIAVAKDRAIDSLMQVGDRFVLNVLEEGNYQELKKHFLKRLHPGADRFAGVKTQTAKNGSPILTDALAYMECEIQSSMECSDHWILYCTVQEGRVSKNDGLTAVRHRKVGNYY

SEQ ID NO: 45386 - DNA, 1257 bp, Desulfovibrio desulfuricans G20
  CDS (1)..(1257)
atgcaagctgcacgcattatcagcagcaaaacacatacacaggacgaaacaatgaaagcactggaaataaaaaaggacgtgttctgggtaggcgcggtggattacgacagccgcgactttcacggatattcgctgtcgccgcagggcaccacatacaatgcctacgtggttaaagacgaaaaaaccgttcttttcgacaacgtgaaagaaggctttctgcccaccatgctgtgccgcctgtctcaggtgaccgagctggaaaagatagactacattgtctgcaaccaccttgagcccgaccatgccggttgcctgcccgaactcatcgaacgctgcaagcccgaaaaaatttactgctcgcccatgggcaaacgttccatggaagcgcacttcgacaccaccggctggcccgtggaagtggtgaaaacaggcgattccatcaatatcggcaagcgtgacatccagttcgtggaaacccgcatgctgcactggcctgattccatggtgtcctacattccgcaggacaagctgctcatctgcaacgacgccttcggccagaacatagcctgcaccgaacggttcgccgatgaaatcgaccgtgcccatctggcccacgccatgaaggaatattaccacaacatcgtgctgcctttctcgcccattgtcatcaagacgctggacctgctggccgaactgaagctggacatagacatgctggcccccgaccacggtcttattttccgcggcgaagacgtgcagtatgcactggactcgtaccgcagctttgcccagcagaagccccgcaaacgggctgtaatcgtatttgacaccatgtggcattccaccgagaaaatggcccgcgccattgccgacgggctggaagccgaaggagtgcctgcccgcctgatgtggctgaaggccaaccaccacagcgccgtgatgacagaactggcagactgcggcgccgtgattgtcggctcgcccacccacaacaacggcatcatgcccaacgtggcaaaaatgctcacctacatgaaaggtctgcgtccgcagaacaaggtggccgcagcgttcggttcgttcggctggtccggtgaatccgtcaaaaacatcaccggatggctggaagacatgggctttgaagtgcccgctgaaggcgtgaagtgcaaacatgtgcccaagcacgaaacgtatgaagaatgctacaatcttggcaaggcagtcgctcaggcgctcaaggccaagtgcgaagcctag

SEQ ID NO: 45387 - protein, 418 aa, Desulfovibrio desulfuricans G20
MQAARIISSKTHTQDETMKALEIKKDVFWVGAVDYDSRDFHGYSLSPQGTTYNAYVVKDEKTVLFDNVKEGFLPTMLCRLSQVTELEKIDYIVCNHLEPDHAGCLPELIERCKPEKIYCSPMGKRSMEAHFDTTGWPVEVVKTGDSINIGKRDIQFVETRMLHWPDSMVSYIPQDKLLICNDAFGQNIACTERFADEIDRAHLAHAMKEYYHNIVLPFSPIVIKTLDLLAELKLDIDMLAPDHGLIFRGEDVQYALDSYRSFAQQKPRKRAVIVFDTMWHSTEKMARAIADGLEAEGVPARLMWLKANHHSAVMTELADCGAVIVGSPTHNNGIMPNVAKMLTYMKGLRPQNKVAAAFGSFGWSGESVKNITGWLEDMGFEVPAEGVKCKHVPKHETYEECYNLGKAVAQALKAKCEA

SEQ ID NO: 45388 - DNA, 1218 bp, Fusobacterium nucleatum subsp. vincentii ATCC 49256
  CDS (1)..(1218)
atgcataatgttagaaatataactgaggatctttattggattggagcaaatgaccgtcgtcttgcactttttgaaaatatacaccctattccagaaggagtgtcatataactcatatatgttattggataaagaaacagtggtttttgatactgttgactggtctgtaacaagacaatatatagaaaatatagaatatttattaaatggtagagaacttgattatttagtagttcaccatatggaaccagatcactgtgcttcaatagaagaattagcatttcgttacccaaaaatgaaaattatttcttctgaaaaaggatttatgttcatgagacagtttggatataaaagcataaatggtcaccaattaatagaagcaaaagaaggagataagtttaaatttggtaagcatgaaatagtatttttagaagcacctatggttcactggccagaagtattagtaagtttagatataacaaatggagctttattctcagctgatgcctttggttcttttaaatctcttgatggaagattattcaatgatgaagtaaattgggatagagattggttagatgaaggtcgtcgttacctaacaaatattgttggtaaatatggaccacatattcaacatctattaaaaaaggcaggtccagttgtagataaaattaaatttatttgtccactacatggtgtagtttggagaaatgattttggatatatcattgataagtatgataaatggagtagatatgagccagaagaaaaaggtatattaattgcctatgcttcaatgtatggtaatacagaaaatgctattgaaatcttagcaaagaaattagctgaaaaaggaattacaaatattaagatgtttgatgtgtctaatactcatgtatcttatttgatttcaaatttattcaagtatagccatttagttatagcttctcctacatataatttaggaatttaccctgttatccataactttgtaatggatatgaaggctttaaatttacaaaatagaacagttgcaatagttgaaaatggttcttgggcaagaaaatctggagatttattacaagaattctttgaaactcaaataaaagatataactgttttaaatgaaagagtaggattaacttcatcagctaacaatgtaaatcttgatgaaatggatgcacttgttgatgcattagttgaatctttaaataaataa

SEQ ID NO: 45389 - protein, 405 aa, Fusobacterium nucleatum subsp. vincentii ATCC 49256
MHNVRNITEDLYWIGANDRRLALFENIHPIPEGVSYNSYMLLDKETVVFDTVDWSVTRQYIENIEYLLNGRELDYLVVHHMEPDHCASIEELAFRYPKMKIISSEKGFMFMRQFGYKSINGHQLIEAKEGDKFKFGKHEIVFLEAPMVHWPEVLVSLDITNGALFSADAFGSFKSLDGRLFNDEVNWDRDWLDEGRRYLTNIVGKYGPHIQHLLKKAGPVVDKIKFICPLHGVVWRNDFGYIIDKYDKWSRYEPEEKGILIAYASMYGNTENAIEILAKKLAEKGITNIKMFDVSNTHVSYLISNLFKYSHLVIASPTYNLGIYPVIHNFVMDMKALNLQNRTVAIVENGSWARKSGDLLQEFFETQIKDITVLNERVGLTSSANNVNLDEMDALVDALVESLNK

SEQ ID NO: 45390 - DNA, 1215 bp, Methanococcoides burtonii DSM 6242
  CDS (1)..(1215)
atggatctgataaatgatactcttgaaattgccaaaggtatctactgggtaggtgtagttgactggaatctgcgcgatttccacggctatgcgactccacggggtggcacttacaatgcgtatctgatagttgatgataaggtcactcttattgatactgtcaagggtgactttgcaccggagatgatcaagaggatccgaaaggtcgtaaacccttcgaagatagatcatatcatctgtaatcatgtggagatggaccattcaagtggtttgcctgctatcatggagttagcaaaggatgcgaagatcttctgtactaagcgtggtaaggtcgggcttgaagagcactatgaagctaacggctgtagtgcgtgggattttgaaatagttgatactggctatgagcttgacatcggctcacggacacttatgtttcttgagactcccatgttgcactggccggatagtatgcagacatatttgaaagaagatcggatattgttctccaatgatgcatttggccagcatttagccacttcggtgaggttcgaggatgaggtggaatgtggtgctttggaagatgctgcaatatattatgcgaatatccttcttccatttggttctaaggtgctaaagtatgctgataagatcgcagaacttgggcttgaattcgatatgatagctccttctcatggggttatatggcgaaaggaacctatgagggtggtagaagcttatatcaaatgggctaaaggagaagctgttccaaaggtcttggttatctatgacactatgtggggtagtactgagatcatggcaaaggagatcgttgaaggtgtctctgaatgtggtgttgaagccagaatgttccaccttcggaaaaatgattggagtatgatgttacgggaactcctgtcttctcctgtcattgctgttggttctcctaccatgcatggtaccatgttctttacgatatccggtttccttacataccttaaagggcttcgcccgaagggtaagagtgctgttgctttcggttcatttggctggggtggcggtgcggttaagcatgttgaggaaatgatggcatctgctgggcttgaggtaattgaaccaggacttcaggcaaagtatcggccatatgaagatgatcttaaggcgtgtcgggaactcggagtcaggctcgcacagcttgcattggataaagctgaatga

SEQ ID NO: 45391 - protein, 404 aa, Methanococcoides burtonii DSM 6242
MDLINDTLEIAKGIYWVGVVDWNLRDFHGYATPRGGTYNAYLIVDDKVTLIDTVKGDFAPEMIKRIRKVVNPSKIDHIICNHVEMDHSSGLPAIMELAKDAKIFCTKRGKVGLEEHYEANGCSAWDFEIVDTGYELDIGSRTLMFLETPMLHWPDSMQTYLKEDRILFSNDAFGQHLATSVRFEDEVECGALEDAAIYYANILLPFGSKVLKYADKIAELGLEFDMIAPSHGVIWRKEPMRVVEAYIKWAKGEAVPKVLVIYDTMWGSTEIMAKEIVEGVSECGVEARMFHLRKNDWSMMLRELLSSPVIAVGSPTMHGTMFFTISGFLTYLKGLRPKGKSAVAFGSFGWGGGAVKHVEEMMASAGLEVIEPGLQAKYRPYEDDLKACRELGVRLAQLALDKAE

SEQ ID NO: 45392 - DNA, 1272 bp, Dechloromonas aromatica RCB
  CDS (1)..(1272)
atggcagctgcggccatcactgacagtgctgtagaaattgccccgggcgtccactgggtgggcgccctcgacccgcatctgcggagtttcgacatcatcctcaaaaccgccaacggcacgagctataacagctatgtcgtacgcggcgacaacggcgtggcgatcatcgacacggtcaaggaaaacttcgccgacgatttcttccgccgccttgaatcggtggcggagtacgaagaaatcaccaccatcgtgctcaaccatctcgagccggaccacagcggcgccctgcccgaactgctcaaacgcgccccgcaggccaaggtgtatttgtcgagtcgcgcccagatgatgctcaaggcgctgttgaagccgaccggcgagaaagcgcccgaatacatcccggtgaccaccgacgacgaggtcgatctcggcggccgcaccctgcgcttcctgcatacgccctatctgcactggccggatacgcaatgcacctatctggtcgaggatggactgctgttcaccggcgacattttcggctgccacttctgcgacaaccggctgttcaacgacaccgtcggcgatttccgcttctcgttcgagtactactacgcccacatcatgcggcccttccgcgagtatgtgctcgacgccatcgcgctgatcgaaccgctagacatccagctgatcgccccggcccacggtccggtactgcgccacaagccgcgcgattacgtgcatcgttaccgcgaactggccacaccgcgccttttcaacgaagcacgcagcgagaaaacgctggtcgtcttctatctttccgcctacggcaacacccggcgcatggccgaagcgctggccgccggtgccgaatcgctcggtggcgtccgcgtctcgctgtacgacctggaagggggcgaagcggaaatttttaccgatctggtcgaggaagccgatggcctcgccttcggcagcccgaccatcaatgccgacgccgtcaagccgatctgggatctgttgtcgtcactgaccaccgtcaacatcaagggcaagcttggtgccgcttttggctcctacggctggagcggcgaggccgtacgtttgattgaggaccgcctgcgtgggctgaagctgcgcgttccggtcgacggcctgcgcatcaagctggtgccggatgccagcgaactggagcaatgccgccttctcggcgaaaacctggcccgtcacctgaccggccggatcgaacaccgcgagatcgacatggcggctcttgcgtag

SEQ ID NO: 45393 - protein, 423 aa, Dechloromonas aromatica RCB
MAAAAITDSAVEIAPGVHWVGALDPHLRSFDIILKTANGTSYNSYVVRGDNGVAIIDTVKENFADDFFRRLESVAEYEEITTIVLNHLEPDHSGALPELLKRAPQAKVYLSSRAQMMLKALLKPTGEKAPEYIPVTTDDEVDLGGRTLRFLHTPYLHWPDTQCTYLVEDGLLFTGDIFGCHFCDNRLFNDTVGDFRFSFEYYYAHIMRPFREYVLDAIALIEPLDIQLIAPAHGPVLRHKPRDYVHRYRELATPRLFNEARSEKTLVVFYLSAYGNTRRMAEALAAGAESLGGVRVSLYDLEGGEAEIFTDLVEEADGLAFGSPTINADAVKPIWDLLSSLTTVNIKGKLGAAFGSYGWSGEAVRLIEDRLRGLKLRVPVDGLRIKLVPDASELEQCRLLGENLARHLTGRIEHREIDMAALA

SEQ ID NO: 45394 - DNA, 1713 bp, Anabaena variabilis ATCC 29413
  CDS (1)..(1713)
atgtcagaaaccaaaccaagagacgtgcaagtcctacctattggtacagatacaactgtaatgcgatcgcgcagttggacaagattaagatttgaaattgagtacgctttagctaagggaaccacggctaactcttatttaatccaaggtaataagctagcgctgattgaccctccaggggaaaccttcacacagatttatctggatgcgttgcaaaaacgactagatgtcacagaaatcgattatgttattctcggtcacgttaaccccaaccgggccgcgaccttaaaagctttactagaaatagcaccgcaaattacctttgtctgttctaatccaggggcgattaatttgcgcggggtgctagaaaacccggatttaccaatactgattatgcggggtgaggaaaccctcgatttagggaaaggacatgatttacaattcatccccacacctaacccccgctacgccgatgaattgtgtacctacgacccccaaaccgaaattatctatacagataagctatttggggcgcacatttgcggagaccaagtatttgatgaaggttgggaagcaatcaacgaagaccgccgttactattatgattgcttgatggctccccatgcccgacaagtggaaacagccttagataaacttgcagatttcccggcgcgagtgtacgccactggtcacggccccttggtgcgttacggcttaattgaacttacccacgcctaccgcgaatggagtcaacaacaaacttctgctgacttgacagtagctctaatttatgcttcagcttatggcaacacagctactttagcccaggcgatcgctcgtggcattaccaaagccggtgttgcggtagaatcaattaactgtgaatttgccgacccagaagaaattagtgcagccgtagaaaaatctgctggttttgttatgggttctcctacccttggtggtcatgcacccacaccagtgcaaacagctttaggtattgtcttatccaccgctactaataataaattagctggtgtgtttggttcctttggttggagtggtgaagccgttgatttaattgaaggtaagctcaaagatgccggttataggtttggttttgactccatccgcgtcaagttcaaacccaacgaagtcaccttgcaaatgtgcgaagaagccggaaccgactttgcccaagccttgaagaaagccaggaaagtccggactcaaagtgtaccagccacaaatgtagaacaagccgtaggacgaatagtcgggtcactttgcgttgttaccgccaagcaaggggaagtatccagcgccatgttagcctcttgggttgcccaagccagctttaatcctcccggcttaaccattgccgtagccaaagaccgtgcagtagaaaccctgacccataccgggaataaatttgttctcaatgttttaaaagagggaaatcacctgggattgatgaaacacttcctcaaaccctttagccctgcacaagatagatttgctgatgtggcgacagcagaggctgaaaacggtagtcctatactgaaagatgctttagcatatttggaatgttcagtccaaaaccgcatggaatcaggtgaccactggctagtttatgcaactgtagagaatggcaaagtcctaaatcaggacggtgttacagccgtgcatcatcgcaaatcaggtaaccattattaa

SEQ ID NO: 45395 - protein, 570 aa, Anabaena variabilis ATCC 29413
MSETKPRDVQVLPIGTDTTVMRSRSWTRLRFEIEYALAKGTTANSYLIQGNKLALIDPPGETFTQIYLDALQKRLDVTEIDYVILGHVNPNRAATLKALLEIAPQITFVCSNPGAINLRGVLENPDLPILIMRGEETLDLGKGHDLQFIPTPNPRYADELCTYDPQTEIIYTDKLFGAHICGDQVFDEGWEAINEDRRYYYDCLMAPHARQVETALDKLADFPARVYATGHGPLVRYGLIELTHAYREWSQQQTSADLTVALIYASAYGNTATLAQAIARGITKAGVAVESINCEFADPEEISAAVEKSAGFVMGSPTLGGHAPTPVQTALGIVLSTATNNKLAGVFGSFGWSGEAVDLIEGKLKDAGYRFGFDSIRVKFKPNEVTLQMCEEAGTDFAQALKKARKVRTQSVPATNVEQAVGRIVGSLCVVTAKQGEVSSAMLASWVAQASFNPPGLTIAVAKDRAVETLTHTGNKFVLNVLKEGNHLGLMKHFLKPFSPAQDRFADVATAEAENGSPILKDALAYLECSVQNRMESGDHWLVYATVENGKVLNQDGVTAVHHRKSGNHY

SEQ ID NO: 45396 - DNA, 1725 bp, Anabaena variabilis ATCC 29413
  CDS (1)..(1725)
atggtagcactcaccgaaaaaactgaaaaacggctcaccatacagactgcggaaattgctcaagataccacagcaattcgctctctagattgggaacgcgatcgctttgatattgagtttggtctgcaaaatggtactacttataactcatttctcatacgcggtgagcagatagccttagttgatacttcccatgaaaagtttcgtaaactttattttgataccctgacagggttaattaatcccacagatatcaactatttgattgtcagtcataccgagccagaccacagtggcttagtcaaagatttgttacagatggctccagatattacagtcgtcgcctcaaaagttgccatccagtttctcgaagatttagtacatcaaccatttaagcggaaaatcgttaagaacggcgatcgcttagatttaggtaacggtcacgaatttgagtttgtcattgcccccaatttacactggccagacaccatctttagttttgaccacaaaacccaaaccctatacacctgcgacgctttcggaatgcactactgttccgatattgtctttgatgaagacttaaaaaccatagaaccagactttcattactattatgaatgcctgatggggccaaatgcgcgatcggtactatctgccctcaagcgcatgggagaattgccaagcgtgaaaatgattgccactggtcacgggccactactctaccataacgtcgaggaactcaccggacgttatcgcacttggagccaaaaccaaagcaaagcagaaaccagcataggtgtattttacgtttccgagtatggctatagcgatcgcctagcccaaggaattattaacggtattagcaaaactggtgtcggtgtagaagttgtagacttgggttcagcagtagatttacaagaattacgcgaactagttgggcgttgtgctggactggtaattgggatgtctccggctgctagtgcagctagtattcaaggcgcactcagcaccattttagggtctgccaacgaaaaacaagccgtaggtatatttgaaaccggtggcggcgatgatgaacccatagacccgctattaagcaaattccgtaacctgggcttaacaaccgccttccccgccattcgcattaaacaaacacccacggaaaacacctacaaactgtgtgaagaagcaggcacagatttgggacaatgggtaacacgcgatcgcagcatcaaagccatgaaatccttgggtgctgacctagataaagcactaggaagactgagtggcggcttatatatcatcacagccaaaaaaggcgacgtttccagcgccatgttagcctcatgggtaaatcaagccagcttcaaaccattaggattttccattgccgtagccaaggatagagctattgaatcactaatgcaagtaggcgatcgtttcgtcttaaatgtattagaagaaggcaattatcagccactcatgcgccacttcttaaaacgattcgcccctggtgcagaccgttttgaaggagtcaaaacccagcccgccgaaaacggcgcacccatcctcggcgacgctttagcatacatggaatgcgaagtagtcagccgtatggactgcggcgaccactgggcagtatacagcacagtctacgccggacgcgtttccaaacccgaatctctaacagcagtccaccaccgcaaggtaggaaatcattattag

SEQ ID NO: 45397 - protein, 574 aa, Anabaena variabilis ATCC 29413
MVALTEKTEKRLTIQTAEIAQDTTAIRSLDWERDRFDIEFGLQNGTTYNSFLIRGEQIALVDTSHEKFRKLYFDTLTGLINPTDINYLIVSHTEPDHSGLVKDLLQMAPDITVVASKVAIQFLEDLVHQPFKRKIVKNGDRLDLGNGHEFEFVIAPNLHWPDTIFSFDHKTQTLYTCDAFGMHYCSDIVFDEDLKTIEPDFHYYYECLMGPNARSVLSALKRMGELPSVKMIATGHGPLLYHNVEELTGRYRTWSQNQSKAETSIGVFYVSEYGYSDRLAQGIINGISKTGVGVEVVDLGSAVDLQELRELVGRCAGLVIGMSPAASAASIQGALSTILGSANEKQAVGIFETGGGDDEPIDPLLSKFRNLGLTTAFPAIRIKQTPTENTYKLCEEAGTDLGQWVTRDRSIKAMKSLGADLDKALGRLSGGLYIITAKKGDVSSAMLASWVNQASFKPLGFSIAVAKDRAIESLMQVGDRFVLNVLEEGNYQPLMRHFLKRFAPGADRFEGVKTQPAENGAPILGDALAYMECEVVSRMDCGDHWAVYSTVYAGRVSKPESLTAVHHRKVGNHY

SEQ ID NO: 45398 - DNA, 1794 bp, Anabaena variabilis ATCC 29413
  CDS (1)..(1794)
atgaacttaatccaatcaattaaagactgggcaaaatctacccggtttttgcaattttttgacaaacctaaaacaaaatctatgagcgattccaagccccgtgacgtacaggttttgccgattgctacaaacacgaaagttctcagagcgcgtagttggtcacgtttgcggtttgaaattgaatatgctttagaaagaggtactacctctaactcttatgtaattgaaggtgataaaacagcaattattgacccgcctgttgaaagctttatgggaatttatctcgaagcattgcaacagacgatcaatttgaaaaaattggattatgttattttgggtcactttagccccaaccgcatacctactttcaaggcgctgttagaattggctccccagattacctttgtctgttccctaccggcggctggtgatttacgggcggctttccctgatgacaacttaaatattttggcaatgcggggtaaggaaaccctggatttaggtaagggtcatgtgttgaagttcttgccaattcctagcccccggtggccggctggactttgtacttacgatgtgcaaacccagattctctacacagataagattttcggcgctcatatctgtggcgatgatgtatttgatgataactgggaatccttcaaggaagaccaacgttattactacaactgtttgatggctccccatgctatccatgtggaagcagcattagagaaaatctctgatttacaagtgcggatgtatgctgtgggtcatgggcctctggtacgtaccagtttaatcgccctcacccaagcctatgcagattggagtaaagcccaaaaagagcgagaaatttccgtcgccttactctatgcttcagcttacggtaatactgcaactatagcgcgggcgatcgctctcggattaactaaaggcggtgttgcggttaaatctatcaactgcgaatttgccacaccggaagaaattcaaagcaatttagaacaagtcgatgctttcctcatcggttctcctaccatcggtggtcatgcaccaacccccattaatactgctttgggtattgtcctcaaagttggtgataacaacaaactagccggggtgtttggttcctacggttggagtggtgaagccttagacatgattgaaggtaaactgcgggatgcgggatatcgctttggtttagaaaccttgaaggtgaagtttaaaccagacgatgttaccctcaagttctgtgaagaagttggtacagacttcgcccaaaccttgaagaaagccaaaaaagtccgcgtaccccaacaagccgctacccctgtagaacaagctgttggtcgcattgtcggctcagtttgtgtcattaccgccaaacaaggcgatgtgtctacaggaatgcttggttcttgggtatctcaagccacctttaacccaccaggtttaactgtcgccattgccaaagaacgggcgattgaatccctcatgtatcccggtggtaaatttgccttgaatatcttacctgaaggcagtcatctggaatacatgaagcatttccgcaaaaacttcgcgccaggggaagaccgttttgccaacttcaccactacagaagctgacaacggttgtacagtcctcgctgacgctttagcttatgtggaatgctcggttgaccaacgcctagaatgtggcgaccactgggtagtatatgcaactgttgacaacggtaagttactcaagcccgatgatgtaactgcgattaatcatcgcaaaaccggtactcattattaa

SEQ ID NO: 45399 - protein, 597 aa, Anabaena variabilis ATCC 29413
MNLIQSIKDWAKSTRFLQFFDKPKTKSMSDSKPRDVQVLPIATNTKVLRARSWSRLRFEIEYALERGTTSNSYVIEGDKTAIIDPPVESFMGIYLEALQQTINLKKLDYVILGHFSPNRIPTFKALLELAPQITFVCSLPAAGDLRAAFPDDNLNILAMRGKETLDLGKGHVLKFLPIPSPRWPAGLCTYDVQTQILYTDKIFGAHICGDDVFDDNWESFKEDQRYYYNCLMAPHAIHVEAALEKISDLQVRMYAVGHGPLVRTSLIALTQAYADWSKAQKEREISVALLYASAYGNTATIARAIALGLTKGGVAVKSINCEFATPEEIQSNLEQVDAFLIGSPTIGGHAPTPINTALGIVLKVGDNNKLAGVFGSYGWSGEALDMIEGKLRDAGYRFGLETLKVKFKPDDVTLKFCEEVGTDFAQTLKKAKKVRVPQQAATPVEQAVGRIVGSVCVITAKQGDVSTGMLGSWVSQATFNPPGLTVAIAKERAIESLMYPGGKFALNILPEGSHLEYMKHFRKNFAPGEDRFANFTTTEADNGCTVLADALAYVECSVDQRLECGDHWVVYATVDNGKLLKPDDVTAINHRKTGTHY

SEQ ID NO: 45400 - DNA, 1740 bp, Anabaena variabilis ATCC 29413
  CDS (1)..(1740)
atggtatcgatgtctacgaccggcaacgcccacacagaaaatgttcagcatcgtctgactgtagaaactgtagaaattgcccctaacactacggcgattcgctgtctagactgggatcgcgatcgcttcgatatcgaattcggactacaaaacggtacgacttataattcatatctaattagaggcgaacagacagttttagttgatacttctcaccagaagttccgccagctgtatttagaaacactaaaaggtctaattaaccccaaggctattgattacattattgtcagtcatacagaaccagaccacagcggtttggtggaagatgtgctgcaattagcaccaagagcaactgtcttggcttctaagattgctttgcaatttttggaaggtttagtacacgatcctttttctaagcggattgtcaaaagtggcgatcgcatcgatattggtaaaggtcacgaaattgagtttgttagtgcgcctaatctgcactggcctgataccatttttagctatgatcgcaaaaccgaagttatctatacttgtgatgcttttgggatgcacttttgcgacaaccgcacttttgatgaagacttagaagcgattgaagctgatttcagattttactacgactgtctcatggggccaaatgcgcgatcgctattgaacgcgatgaagcgcatgggtgaactgggcaaaattaagataatcgctaacggtcacgggcctctgttgtaccatcatttagatgtgttgactgagtgttaccaaagctggagccaaagacaagccaaagcggaaaccaccgttggtttattctatgtcgccgactatggctatagcaacttactagttcaagccatcggcgagggtattcaaaaaactggtgttgctgtagaaatgatcgacctcagcacagcagaaattcaagaaattcaagaattggcaggtagggcagctggtttaattattggtatgcctcccacaacatcggtagcagctcaagctggtattagttccctgctatctgtagttaaagataagcaagcagtcggcttgtttgaatgcttcggtggcgatgacgaacccgttgataccatccgccgcaaatttattgatttgggtgtgaaagaagccttcccggcgattcggattaaagatgttcctggcgcatccgcataccaattatgtacagaagcgggtacagacttgggacaactgctgacacgggaacgtaacatcaagcaaatcaagtccctcgatgtcaacatggaaaaggcattgggacggattagcaacggtctgtatatcgtcacaaccaaaaaaggtgatgttagcagcgccatgttagcttcctgggtatcccaagccagcttgcaaccattgggctttacgattgccgtagctaaagatagagctattgataccttaatgcaagtaggcgatcgcttcgttctcaatgtcttagaagaaggcaattaccaagaactgaaaaaacaattcctcaagcgcctccatcccggtgcagaccgctttgccggagtaagaacccaaattgccaaaaacggctcccccatcctcacagacgctctagcatacatggaatgcgaagtccaaagcagcctagaatgcagcgatcactacattttatactgcaccgtggaagatggtcgcgtttccaagcccgatggactaacagcagttcgtcaccgcaaagtaggcaactattactaa

SEQ ID NO: 45401 - protein, 579 aa, Anabaena variabilis ATCC 29413
MVSMSTTGNAHTENVQHRLTVETVEIAPNTTAIRCLDWDRDRFDIEFGLQNGTTYNSYLIRGEQTVLVDTSHQKFRQLYLETLKGLINPKAIDYIIVSHTEPDHSGLVEDVLQLAPRATVLASKIALQFLEGLVHDPFSKRIVKSGDRIDIGKGHEIEFVSAPNLHWPDTIFSYDRKTEVIYTCDAFGMHFCDNRTFDEDLEAIEADFRFYYDCLMGPNARSLLNAMKRMGELGKIKIIANGHGPLLYHHLDVLTECYQSWSQRQAKAETTVGLFYVADYGYSNLLVQAIGEGIQKTGVAVEMIDLSTAEIQEIQELAGRAAGLIIGMPPTTSVAAQAGISSLLSVVKDKQAVGLFECFGGDDEPVDTIRRKFIDLGVKEAFPAIRIKDVPGASAYQLCTEAGTDLGQLLTRERNIKQIKSLDVNMEKALGRISNGLYIVTTKKGDVSSAMLASWVSQASLQPLGFTIAVAKDRAIDTLMQVGDRFVLNVLEEGNYQELKKQFLKRLHPGADRFAGVRTQIAKNGSPILTDALAYMECEVQSSLECSDHYILYCTVEDGRVSKPDGLTAVRHRKVGNYY

SEQ ID NO: 45402 - DNA, 1731 bp, Anabaena variabilis ATCC 29413
  CDS (1)..(1731)
atggttgcactcaccgaagatacacaagctaatgccaacagaggacgtttgacagtgcaaactgtggaaattgcagctgaaacaactgctattcgctgtctggattgggatcgagagcgtttcgatattgaatttggtttacgtaacggcaccacatataattctttcttaattcaaggtgaaaaaattgctttagttgacacttcacaccgcaagtttgagaaactctatctagagatagttgctggattaattgacccaaacacaatagactatttgattattagtcacacagaaccagaccatagcggcttagtgaaggatattttgcaactagctccctctatcactattgttggggctaaagtcgcaattcaatttttagaaaatatggttcaccaaccatttaaatcccttcaggtgaaaagtggagaacgcttagatttaggtaatggccacaacttagaatttgtttctgcacctaatttacattggccagatacaattttgacctatgaccacaaaacagggattctctacacttgtgatgtgtttgggatgcactattgcgatgatcagacttatgatgaaaatttcttcgccattgaagaagattttaaatattactatgattgtctgatggggccgaatgctcggtctgtgttggcagctttaaaacgcattgaaaacttaacaatcaacacagtggctacaggacacgggcctctactacaaaatcatattagcgaatggttaggtaagtatcaaaactggagtttagaacaagctaaaacagagacattagttgctttgttttatgctgaagattatggctatagtgaacatttagtacatactttggggcatggatgtactaaaacaggtgtggcggtagaactgatagacttaaatactgctgaaccacaagaagtaagagaattagttgctcaagcatctggcttagtcatcgccatgccatcccaatattcactgacagcccaggcagcattaaatactatcttggcggctgtacatcataaacaggccataggcttattagagtctggtggtggagaagatgaacctgtttttcctttacggaataagtttcaagaattgggactagttgaagctttccccccaattttaattaaagaagctcccacacaaaccacagaacaactttgtgaggaagctggtacagatatagggcaatggttgacacgcgatcgcaccatcaaacaaatcaaatccatcaacaccgacttagagaaagccttaggacggattagcactggcttatatatcatcactaccaaaaaaggagaaattcaaggtgccatgttcgcctcatgggtgacacaagctagcctcaatcctttaggagtagccattgctgtctccaaagaacgcgccattgaatccttaatgcacgtaggcgatcgctttgttttgaacgttctggaagaagataactatcaaggattgatgaaacatttcctcaaacgctttgcccctggtgcagaccgctttgcaggcatcaaaacctacccagccaccgacggttcccccattcttgcagaatccctagcttacacagaatgcgaaatcaccagccgtatcgactgtggcgaccattggattatctacagcactgttcaagtcggcagagttgctaacgtccatgcaatgacagccgttcatcatcgcaaagttggcaatcattactaa

SEQ ID NO: 45403 - protein, 576 aa, Anabaena variabilis ATCC 29413
MVALTEDTQANANRGRLTVQTVEIAAETTAIRCLDWDRERFDIEFGLRNGTTYNSFLIQGEKIALVDTSHRKFEKLYLEIVAGLIDPNTIDYLIISHTEPDHSGLVKDILQLAPSITIVGAKVAIQFLENMVHQPFKSLQVKSGERLDLGNGHNLEFVSAPNLHWPDTILTYDHKTGILYTCDVFGMHYCDDQTYDENFFAIEEDFKYYYDCLMGPNARSVLAALKRIENLTINTVATGHGPLLQNHISEWLGKYQNWSLEQAKTETLVALFYAEDYGYSEHLVHTLGHGCTKTGVAVELIDLNTAEPQEVRELVAQASGLVIAMPSQYSLTAQAALNTILAAVHHKQAIGLLESGGGEDEPVFPLRNKFQELGLVEAFPPILIKEAPTQTTEQLCEEAGTDIGQWLTRDRTIKQIKSINTDLEKALGRISTGLYIITTKKGEIQGAMFASWVTQASLNPLGVAIAVSKERAIESLMHVGDRFVLNVLEEDNYQGLMKHFLKRFAPGADRFAGIKTYPATDGSPILAESLAYTECEITSRIDCGDHWIIYSTVQVGRVANVHAMTAVHHRKVGNHY

SEQ ID NO: 45404 - DNA, 1716 bp, Synechococcus elongatus PCC 7942
  CDS (1)..(1716)
atggtcgccactaccccagcgcctcgcctcagcttggccgttgaagccattggacctcagaccaccacgattcgctctttggactgggatcgcagccgttttgatatcgagtttgggctccagaacggcacgacctacaactcttttctgattgaagccgatcgcaaagcactggtcgacacctcccacgccaagtttcaggccacctatgttgaccagctgcgggaactgaccgacctgagcacactggattacctgatcatcagtcacacggagccggatcacagcggtctagtcggcgatattctcgcgatcgcgccgaatgtaacggtcgtcggttctaaagtggcgctgcagttcctcgagaaccaagtccatcgccccttccaaaagctgcaagtcaaaaacggcgatcgactcgaccttggccagggtcacgagctcgagttcgtcagcgcgccaaacctgcactggccggacacaatcttcacttacgatcccgctagccaaatcctcttcacctgcgatgcctttggcatgcacttctgcgacgagcgcaccttcgatgaagatctgcagcagatcgaaggcgattttcagtactactatgaatgcctgatggctcccaatgcgcgatcggtgttggcggcattgaaacggatgaaagccctcggcgaaatcaccacgatcgccacgggtcatgggcccttgctgcgccgtaacctgcaagagtgggtcgatcgctatcagcattggagcgagcaaaaagcgactgctgaaaccagcgttttgattggctacctgtcggactatggctacagcgatcgcctttcgcaagcgatcggtcgcggcttggtcaaaacaggcgtcgcggtggaaatggtcgatctgcgagccgtcgatccgcaggagttgattgaagccgtcagcagtgcgcgggggattgtgttgggtacgccgcccagtcaaccttccgaggcagtcgcaacagccctaagcacgatttttgccgctgcccacaataagcaagcgatcggcctgttcgattcctacggtggcgatgacgagccgatcgatgctctgctagcccagttccgtaatctaggtctgcatacggctttcccacccatacgtgtcaaggatcagccgacggaggcgatctaccagcagtgcgaagaatcgggcacagacttaggccaatggttgactcgcgctgacgctatccagacgatgaagtcgctgaacagcgacctcgataaagcgctgggacggctgagtggtgggctctacatcatcacagcgcgtaagggcgaagtcagcggtgccatgctggcctcgtgggtggtgcaagccagctttaagccactgggctttaccgtcgcggtcgccaaggatcgggcaatcgagtcgctgatgcaggtgggcgatcgatttgtcctcaacatcctaggtgaagacaactatgcaccgctgatgaagcatttcctcaagcgtttcccacctggggccgatcgctttgccggtgtcgaaacccaaaccgccagcaacggcagccccattctgacagcagccttggcctatctggagtgcgaagtggccagccgcatggattgcagcgatcactggctggtgtactgccaagttgaacaaggccgtgtctcgcgggccgatgttcgcaccgccgttcaccaccgcaaagtcggcaaccactactag

SEQ ID NO: 45405 - protein, 571 aa, Synechococcus elongatus PCC 7942
MVATTPAPRLSLAVEAIGPQTTTIRSLDWDRSRFDIEFGLQNGTTYNSFLIEADRKALVDTSHAKFQATYVDQLRELTDLSTLDYLIISHTEPDHSGLVGDILAIAPNVTVVGSKVALQFLENQVHRPFQKLQVKNGDRLDLGQGHELEFVSAPNLHWPDTIFTYDPASQILFTCDAFGMHFCDERTFDEDLQQIEGDFQYYYECLMAPNARSVLAALKRMKALGEITTIATGHGPLLRRNLQEWVDRYQHWSEQKATAETSVLIGYLSDYGYSDRLSQAIGRGLVKTGVAVEMVDLRAVDPQELIEAVSSARGIVLGTPPSQPSEAVATALSTIFAAAHNKQAIGLFDSYGGDDEPIDALLAQFRNLGLHTAFPPIRVKDQPTEAIYQQCEESGTDLGQWLTRADAIQTMKSLNSDLDKALGRLSGGLYIITARKGEVSGAMLASWVVQASFKPLGFTVAVAKDRAIESLMQVGDRFVLNILGEDNYAPLMKHFLKRFPPGADRFAGVETQTASNGSPILTAALAYLECEVASRMDCSDHWLVYCQVEQGRVSRADVRTAVHHRKVGNHY

SEQ ID NO: 45406 - DNA, 1755 bp, Synechococcus elongatus PCC 7942
  CDS (1)..(1755)
atgagcgaaggacgtcaccgcgatatccaaccgagctgggtggctgcaggactgatggtgctgcgggctcgaagctgggaacgtctgcgctttgaagtggagtatggccttgggcatggcacaaccagcaatgcctaccttgtgcagggcgatcgcacgattctgatcaacccgcccggcgcttcctttactgaaattttcctcaatcgccttgaagctcaatgcccgattggtgagctcgatgcggtgctcctcagtcacgtcaaccccaaccgcgttagcaccctcaaggagttgatgcgtctcaatcctgggttgcaggtgatcgtctcgaatccagccgcccaagcccttgaaaagctctggcaagtcgaggcacaagaagcccccatcccacccttagatctaaagattatccggacagaagaaagtcttgatctcggacggggcaaggttctgcaactgctgccgacgccgattccgcgctggccggatgggctttgcgttttggatgagcaaacaggttggctgctctctgataagttctttgcggcacacctatgccaagaccaaatttttgatcaaggctggacttcgttccgcgaggatcagcgctactactttgactgcgtcatggcaccccaagtccgccaagtgcagacggtgttggctaaatttagccgcctacctatccaagggtatgctcccagccatggtccgctgattcgctacggcctgcacgatttgacagcggcctatgtcagttggagcgatcgccaacttcaacaaccacagatggtagcgctgctctatgcttcggcctatggcagcactgccacgatcgcagaggcgatcgcccaaggaattaccaaggcgggcgttcgggtggaagctttaaattgcgaagttgaaagcatggatgacatccgccgaacactggaaaggtgcgacggcgttgtgattggatccccaactttgggaggccatgcacccacacccatccaaacggcgttggggacaattttggcaaccgttgcgcgcgataagccggtcggtgttttcggctcatttggctggagtggtgaagcgatcgatcttctggaaagcaagttaaaagatgctggttttcgccttgcctttgaaccgattcgcgttcgctttaaaccaacaacagcaaccctaaaaatctgtgaagagtcaggcaccgatctcgcccaagccctgcaacgacagcgccgccaagtgagtcgccaaagcagctccaaactacaagacagtgaaactgaagcaaccgcacaagcagtaggacgcatcctcggatcactctgtgttttgacgactcaaaaagaggatgtccgcagtggcatgctagcttcgtgggtctcacaagcaacctttaatccaccagggattagtgttgcagttgcgcgcgatcgcgccgtcgagtcactcttgcatcaaggcgatcgctttgtcctcaatgtccttggcgaggacaaaaatctagcaattcaaaagcattttctcaaacccttcagccctggagccgatcgtctagagggtattgagtctagccccagtgatcaagggcatcctatcttggctgaggccatcgcttggttagaatgtcgcgtcgctaatcgcatggaatgtggcgatcattggctggtctatgcagtcgttgaatcaggtcaagttcaagatcctgaggttcggacagccatccatcatcgcaagagtggcagctactactaa

SEQ ID NO: 45407 - protein, 584 aa, Synechococcus elongatus PCC 7942
MSEGRHRDIQPSWVAAGLMVLRARSWERLRFEVEYGLGHGTTSNAYLVQGDRTILINPPGASFTEIFLNRLEAQCPIGELDAVLLSHVNPNRVSTLKELMRLNPGLQVIVSNPAAQALEKLWQVEAQEAPIPPLDLKIIRTEESLDLGRGKVLQLLPTPIPRWPDGLCVLDEQTGWLLSDKFFAAHLCQDQIFDQGWTSFREDQRYYFDCVMAPQVRQVQTVLAKFSRLPIQGYAPSHGPLIRYGLHDLTAAYVSWSDRQLQQPQMVALLYASAYGSTATIAEAIAQGITKAGVRVEALNCEVESMDDIRRTLERCDGVVIGSPTLGGHAPTPIQTALGTILATVARDKPVGVFGSFGWSGEAIDLLESKLKDAGFRLAFEPIRVRFKPTTATLKICEESGTDLAQALQRQRRQVSRQSSSKLQDSETEATAQAVGRILGSLCVLTTQKEDVRSGMLASWVSQATFNPPGISVAVARDRAVESLLHQGDRFVLNVLGEDKNLAIQKHFLKPFSPGADRLEGIESSPSDQGHPILAEAIAWLECRVANRMECGDHWLVYAVVESGQVQDPEVRTAIHHRKSGSYY

SEQ ID NO: 45408 - DNA, 1728 bp, Crocosphaera watsonii WH 8501
  CDS (1)..(1728)
atggtagcaactcccatcaaaacaaaaaagcgtttaagcatacaaactggtgatattgccgaaaatacaactactattagatccttagactgggatcgagatcgcttcgacatagagtttggtctgcaaaatggaaccacttataactcctatattattaggggtgagaagatcgccttaatagacacttctcatgttaagtttcgacagttatacatcgataccataaccggactcattgaccccaaaaccatcgattatttagtggttagtcacaccgaaccggatcatagtggtttggttaaagatatcttagaactagctccccaagcaactatagtagggtcaaaagtagcgattaattttctaaaaaactttatccatcaaccctttgaatacattgccgtcaaaacgggggatagtttggacttagggaaaggtcatgttttagaatttgtcaacgcccctaatctacattggcctgatacgattttaacctatgatcaaggtaccgaaaccttatacacctgtgatgtatttgggatgcactattgttctgatgtgctatacgacgaacacttagaggatattgccccagactatcacttttattatgagtgtttgatgggtcccaacgcgagatcggtgctttcggccttaaaacgcatggacaagttaggtcatttttccttagtagccaatggtcacggtcccttgctgcgctacaatgtccatgagttagtagaacgttatcgtacttggagcgaggaacaaagcaaagccgataaaagcgttgctgtgttttatatttctgattatggatatagcgatcgcctctcccaagctattgccaaaggtatcaccaaggccggtgtagcagtagaaatggttgatctaaaatcagccgatgctcaagatgtccacgagatcgtcagtggttccgccggtttagtggtgggaatgccccccttagaaggcactcatagcaacgaaaccaccagcaacatcggaaccattctcgccgcagctaaaaataagcaatatatagggatgttcgagtcttatggtgacaacgatgaacccatcgaccccttattaaccaggttccgagaagctggcttaaacaaagggtttaatcctattcgggttaaagatacccccacagaagctatttatcaactctgtgaagaagcaggagtcgacttaggacaagcgttaacccaagccaaaaaagtcaagcaaaggaagtccttagatagcgacttagataaagccatcggtcgtattagtggcggtttatatattctcaccgctaataagagagaactcaacggggccatgttagcctcttgggtaacacaagcaagttttgaccccccagggtttactgttgccgtagccaaagatcgggcgatcgagtctttgatgcaggtaggagatagtttcgttttaaacatcctcgaagaagggaaatatcaacccctgatgaagcatttcctgaaaagattccgtcctgggtccgatcgctttgaaggggttaatgtccaaaccgctaacaatggatcacctatcctagtggatgctttagcctatttagaatgcgaagttgtcagtcggatggaatgtagtgatcattggatcgtttatagcaaagtgagcaatgggcgagtttctaaccccgatgggttaaccgctactcaccaccgaaaagtcggtaactattactaa

SEQ ID NO: 45409 - protein, 575 aa, Crocosphaera watsonii WH 8501
MVATPIKTKKRLSIQTGDIAENTTTIRSLDWDRDRFDIEFGLQNGTTYNSYIIRGEKIALIDTSHVKFRQLYIDTITGLIDPKTIDYLVVSHTEPDHSGLVKDILELAPQATIVGSKVAINFLKNFIHQPFEYIAVKTGDSLDLGKGHVLEFVNAPNLHWPDTILTYDQGTETLYTCDVFGMHYCSDVLYDEHLEDIAPDYHFYYECLMGPNARSVLSALKRMDKLGHFSLVANGHGPLLRYNVHELVERYRTWSEEQSKADKSVAVFYISDYGYSDRLSQAIAKGITKAGVAVEMVDLKSADAQDVHEIVSGSAGLVVGMPPLEGTHSNETTSNIGTILAAAKNKQYIGMFESYGDNDEPIDPLLTRFREAGLNKGFNPIRVKDTPTEAIYQLCEEAGVDLGQALTQAKKVKQRKSLDSDLDKAIGRISGGLYILTANKRELNGAMLASWVTQASFDPPGFTVAVAKDRAIESLMQVGDSFVLNILEEGKYQPLMKHFLKRFRPGSDRFEGVNVQTANNGSPILVDALAYLECEVVSRMECSDHWIVYSKVSNGRVSNPDGLTATHHRKVGNYY

SEQ ID NO: 45410 - DNA, 1725 bp, Crocosphaera watsonii WH 8501
  CDS (1)..(1725)
atgatgaataaacccagagacgtacaagtttatcccattgcttctgataccatggccataagatcacggacatgggatcgcttaaaatttgaaatcgaatatgggctaaaacgaggaactacagctaattcttatcttattcaaggggataaaattgctttaatagatcccccaggagagtcctttactgagatatttttaaaagccttacaagaaagaattgatccgacaacaattgattatttaatcttgggtcatattaaccccaaccgaggggaaactatcaaagcattaatgaaaattgctccccagattaccattgtttgttctaatactggggcattactattacctaatattttattacctgaatttccaccccagttaaaagtagttaaaggagaggacatcttagacttagggaaagggcatcaactagaatttactccaaccccgaaccctcgttatcctgcacaaatgtgtacttatgaccccaaaacagaaattctctacaccgataaattatttgggtctcatgtttgtggggatcaaatttttgatgaagggtggcaagtttatgccgaggatagacgctattattttgattgtgtcatcgccccttatgccaaacaaataaataacgcgctggaaaaattaagccgtaaacctgctaagatttacggaaccggtcatggtcccttggtacgttatgggttaaaagagttgacggtttcctatcaacaatggttagaggcacaaaaagcccaaaccttaagcgttgcccttgtttatgcctcagcttacggcaataccgccaccttagcccaagcgatcgcccgtgggatcactaaagcaggggtcagggttgagtctatcaacgcagaagttgccgaagcagatgacatcaaagaagctattaataactgttccgggtttatttttggttcccctactctgggaggccacgcccccacccagatccaaactgcgttggggatcaccttagccaacgccgataaagggaaactggctggcgtatttgggtcttacggctggagtggagaagccatagacctcttagaaaacaaatttcgggatggggggtatcagttcggtttcgaccctataaaggtgaaatttaaacctactcaggcaacattaaaaacctgtgaagaagcaggaacagactttgctcaggcggtgaaaaaggcacaaaaacgccgtcaaccgagaaattccgtgaatcagtcccagacagatcgcttacaacaggctttagggcgtattgtggggtcattatccattgttacctgtcaagaagaagagttaagcggggcgatgttggcctcttggatctctcaagcgacgtttaaccctcctgggtttaccgtagcagtggccaaggaacgggcgatcgagtctttgttacatcaaggtagttactttgttttaaatattctcaaagaaggggatcatctgggtttgatgaagcattttctgaggcccttttctcctgggcaagatcgttttgacggtttgaaaacccaggtagctgataatggttgtcctattttagaggatgctttggcttatttggagtgtaaagttggcgatcgcatggaatgtggagatcattgggtgatttatgcgatcgttaccaaaggagaagttttacaggatggagtaaccgctattcatcatcgcaagtcaggcagtcattattaa

SEQ ID NO: 45411 - protein, 574 aa, Crocosphaera watsonii WH 8501
MMNKPRDVQVYPIASDTMAIRSRTWDRLKFEIEYGLKRGTTANSYLIQGDKIALIDPPGESFTEIFLKALQERIDPTTIDYLILGHINPNRGETIKALMKIAPQITIVCSNTGALLLPNILLPEFPPQLKVVKGEDILDLGKGHQLEFTPTPNPRYPAQMCTYDPKTEILYTDKLFGSHVCGDQIFDEGWQVYAEDRRYYFDCVIAPYAKQINNALEKLSRKPAKIYGTGHGPLVRYGLKELTVSYQQWLEAQKAQTLSVALVYASAYGNTATLAQAIARGITKAGVRVESINAEVAEADDIKEAINNCSGFIFGSPTLGGHAPTQIQTALGITLANADKGKLAGVFGSYGWSGEAIDLLENKFRDGGYQFGFDPIKVKFKPTQATLKTCEEAGTDFAQAVKKAQKRRQPRNSVNQSQTDRLQQALGRIVGSLSIVTCQEEELSGAMLASWISQATFNPPGFTVAVAKERAIESLLHQGSYFVLNILKEGDHLGLMKHFLRPFSPGQDRFDGLKTQVADNGCPILEDALAYLECKVGDRMECGDHWVIYAIVTKGEVLQDGVTAIHHRKSGSHY

SEQ ID NO: 45412 - DNA, 1182 bp, Methanosarcina barkeri str. fusaro
  CDS (1)..(1182)
atggatatctacagtgttcctgaaattgctaaagatgtattctgggttggggcaaaagactggagccgcagaatgtttgatgctctagttccgctgcctcaggggacaagctacaacgcgtatcttgtgaaaggagaagaaaaaacagcacttattgataccgtgaaccctggtttcgaagaggagttcgaagagaaaataaatctggtttccagcctggaaaaactggactacctgattatgaatcatgccgaacccgaccacgccagtgcaattcgttatattatggatcgggctcctggctcggtgcttgttaccacggaaagaggcgtgaaaatggcaagcctttaccatgacctgccagacgatcggattaaagtcgttgccgatggagatactattgatttgggaggaaaaaatctgcactttattgaggctccctggctccactggcctgaaaccatgttcacatacctacctgaaggcagggtccttttcccatgtgatttctttggggctcatacggcccagggcgtttatgatgaggacctagaagaccttattcctcttgcaaaaagctattatggggaaatcatgatgccttttggaaaaatgggagcaaaggcccttgaaaaaattaaggatctggatatcgcagttattgctccgagtcacgggcctatttataaaaaccctcagcgtatacttgagccctacgcaaaatggactgcaggaaagaccgaaaataaagcccttattgtctatgtgagtatgtggggctccacaaaactaatggttagaacaatcgcagaaaccttactgaaagaaggtgtagatgtcagaatctatgaccttgaagttgcgaatacaggagatattgcaagagaactggttgattcccgcgctgttatccttggaactccaaccgtccttgcaggcatgcatcctcttgccctttacggcacttacctagtaaaagctctcaagccgcctgcaaaatatggggttatacttggatctttcggctggggtggaggcgctctgaagcaagcaggagaaattctggttccctcaaagatggaaattgttggaacgcttcaggtaaagggcaaacccagagaagaagatttgaataaaattgagggaatcggccgagaactcgccaggaaaatgaaagcataa

SEQ ID NO: 45413 - protein, 393 aa, Methanosarcina barkeri str. fusaro
MDIYSVPEIAKDVFWVGAKDWSRRMFDALVPLPQGTSYNAYLVKGEEKTALIDTVNPGFEEEFEEKINLVSSLEKLDYLIMNHAEPDHASAIRYIMDRAPGSVLVTTERGVKMASLYHDLPDDRIKVVADGDTIDLGGKNLHFIEAPWLHWPETMFTYLPEGRVLFPCDFFGAHTAQGVYDEDLEDLIPLAKSYYGEIMMPFGKMGAKALEKIKDLDIAVIAPSHGPIYKNPQRILEPYAKWTAGKTENKALIVYVSMWGSTKLMVRTIAETLLKEGVDVRIYDLEVANTGDIARELVDSRAVILGTPTVLAGMHPLALYGTYLVKALKPPAKYGVILGSFGWGGGALKQAGEILVPSKMEIVGTLQVKGKPREEDLNKIEGIGRELARKMKA

SEQ ID NO: 45414 - DNA, 1137 bp, Clostridium thermocellum ATCC 27405
  CDS (1)..(1137)
ttgtctgtcttaatttttggtatcattatagaaaagccgaccgtaattgatactgtggatatcgaattcggaaaagaatatgttgacaacttaagtaaaattattgatccggaaaatatcgaatatatcgtaatcaaccacgtagagcccgaccatgctggggcactgcctgctttggcggctaaagcaaaaaatgcaaaaatagtgactaccaaattagcctcagaactgcttaaggacatgtttaagcttcataatagagaatttgccataatcaaagacggggatacattggatataggcggcaagacattaagctttttcgaaacaccttatctgcacaccgaagagacaatgataacctacgtgaacgagaataaaatccttttcccctgcgatatcttcagcacccacatagcaaactacgaactgtttaatgatttggcaaaaggcgaatatatcgaagacttcaaagtgtactacaggcttatcatggcaccccacagaccttatgtaagagacatgctggaaaagattaaaaagctcaatatagaggtaattgctccttctcacgggtatatcctgcgtgaaaatactgcaaagtttattcaaatgtatgatgaaatgagcagtcttgcggctttgaaacagccgaaaaaagttacaattgtatattccaccatgacgggaaataccgcaaagatagcgcaaaaactcgtccaagggcttgaaagtgcaggagtggaaacatcagtattcaaccttaaaaattctgatttggctgaagtcaggaaaaaaattacggaaagtgacggcattttggtgggaagctccacaaggtatgccgatatggttggaaatgttgaggaactccttaaattgttagaaggagaagaagtgaagaataaatttgcagcggctttcggttcctacggttggagcggggaagcaatcatgcacattgaaaattatcttgataaaatcggctttaacgtaattaaccaaaaatatctcatcggcagtgcaggtattgatataccgttattccctctgcgcattaagtttgcccgccaggaaggcctggaacttgctgaggaggcaggcagagtttttggagaacaagtattaacccattga

SEQ ID NO: 45415 - protein, 378 aa, Clostridium thermocellum ATCC 27405
MSVLIFGIIIEKPTVIDTVDIEFGKEYVDNLSKIIDPENIEYIVINHVEPDHAGALPALAAKAKNAKIVTTKLASELLKDMFKLHNREFAIIKDGDTLDIGGKTLSFFETPYLHTEETMITYVNENKILFPCDIFSTHIANYELFNDLAKGEYIEDFKVYYRLIMAPHRPYVRDMLEKIKKLNIEVIAPSHGYILRENTAKFIQMYDEMSSLAALKQPKKVTIVYSTMTGNTAKIAQKLVQGLESAGVETSVFNLKNSDLAEVRKKITESDGILVGSSTRYADMVGNVEELLKLLEGEEVKNKFAAAFGSYGWSGEAIMHIENYLDKIGFNVINQKYLIGSAGIDIPLFPLRIKFARQEGLELAEEAGRVFGEQVLTH

SEQ ID NO: 45416 - DNA, 1254 bp, Clostridium thermocellum ATCC 27405
  CDS (1)..(1254)
atggactatgaaatacgaggaggatgcaatatgaagaagctaaagattgcagatggaatacacatgcttacaatgaatgttgaagacatactgtttgaaggaatatgggagcttgcaaacggagtcactcttaattcctatatagttcagggagaaaaaactgcaataattgacggtgtgattggatgggacggaatacctgaaactctttataaaaatttggaagatataggcgttgatccaaagaatattgattatttgattgttaatcatatggaaccggaccattcaggctggatttcaaactttagaaaaattaaggatgattttacggtgatatgtaccgacaaagctgcaaagatggtagcatccttctatggtgaggacaagataagggttgtcaaggagggggatactctggaccttggaaacggaaaggtactaagtttccatccggtaccgaacgttcactggccggacacgatgtacacctatgaaagagaaacaaaaaccctcttctcatgtgacatgtttgggacatttggcaggatgggagagcattgttttgatgacgagctgacacctgaagaagtggatttctttgaactcgaaggaatgagatattactccaatgtaatggcaactttcacacccagtttgaagaaggccattgaaaaagcgaaggagctggaaataaatgttatagcacccggtcacggcccagtttatagaaaaaacccgcaaaaaattatagatgattattccaggtttgccctctatgcagaaggaacgggcaaaaatgaagttactatattgtggggctccatgtatggaatgactgaaaaagtggttaattacgttgaaagcatacttcaaagggaaggaattaaatataacaagctgaaaatgccccttgcaaccgaaagtgaaatggttgcaaccgtgtttaggtccgcaggtgtgattattggagcgcctacttatgagtacaagcttttcccgccggttgcatcggctttgaatgagcttggcagaaagaggattacaggtaagacggcattcagattcgggtcatacggatggtccggcggagcagagaaagagcttgctgaaataattgaaagaaacaacatgaaatggaattttatcgaatccgtggagtttgaaggagcaccaaaggatgaagaccttgccagagtggaggaaagagtgttggagtttataaagaagatgagggagaaggttgcagaatag

SEQ ID NO: 45417 - protein, 417 aa, Clostridium thermocellum ATCC 27405
MDYEIRGGCNMKKLKIADGIHMLTMNVEDILFEGIWELANGVTLNSYIVQGEKTAIIDGVIGWDGIPETLYKNLEDIGVDPKNIDYLIVNHMEPDHSGWISNFRKIKDDFTVICTDKAAKMVASFYGEDKIRVVKEGDTLDLGNGKVLSFHPVPNVHWPDTMYTYERETKTLFSCDMFGTFGRMGEHCFDDELTPEEVDFFELEGMRYYSNVMATFTPSLKKAIEKAKELEINVIAPGHGPVYRKNPQKIIDDYSRFALYAEGTGKNEVTILWGSMYGMTEKVVNYVESILQREGIKYNKLKMPLATESEMVATVFRSAGVIIGAPTYEYKLFPPVASALNELGRKRITGKTAFRFGSYGWSGGAEKELAEIIERNNMKWNFIESVEFEGAPKDEDLARVEERVLEFIKKMREKVAE

SEQ ID NO: 45418 - DNA, 1725 bp, Trichodesmium erythraeum IMS101
  CDS (1)..(1725)
atgctagaaaccacaaaaaaaaaagacgttcaagttgtcataattggtcaagatacaaaagtactaaggtctcgcacctgggatagactaaaatttgaagtggaatattccctgcaaaaaggtaccactgccaactcctatctcattcaaggagaaaaaaccgcagttatcgacccccccggagaatcatttactcaaaattatttagaatcattacaactacgcttagatttgcatcgtcttgactatgtgattctcggtcactttaatgctaatcgtggagggaccctaaaagaattgttagcaatagcaccatctgttacctttgtctgctcaaaccctagtgttttaaacctaaaagactattttaaagatgaagaattgaaaattaaggtagtaaaaggagaagatacccttgacttaggtagtggccataaattgcagttactcaccactcccagtcctaaatggccagatggcctaatgacctatgacccccaaactcaaattctgtttacagataaatttttcggcgctcatgtttgcggagaccaagttgctgatgaagggtggactatttatagcgaagatagacgcttttattatgattgtctccatgcagctcaagccaaacaagtactttctaccctggaaaaaatttctgagttaacagtgaaactctatgctcctggtcacgggccactggtacgttatgggatgatggagttaaccaatctgtatcggaagtggagtcaggaacagagttcgcgagacttaaatgtagttttactttatgcttcagcttatggtaacacagctattgttgcccaggcgatcgctagaggcttaactaaagcaggggtagctgtagaatcaattaactgtgaagttgccacatctaatgaaataagggaagtagtagaaaaatgcgatgggtttattattggttcccccactctcggcggtcatgcaccaactcaaattcaaacagctttgggtattgtattaaatacagcttctaaggataaattagcaggagtatttggttcctttggttggagtggtgaagcaatagattttttggaaagtaagttaaaagatacaggctataaatttggttttgagcctattagagtaaaatttaagccagatgatgtgatgattcaaacttgtcaggaagctggtattgattttgcccaagctttgattaaatcacaacaacgtcgttcacctaaagcttctgtaagaggctcgggaagcgatcgcaccgctcaagcagtgggaagggttgtgggttctttatgtgtgatgtctgccaaacgtggggatgtcactagtgctatgttagcttcttgggtatctcaagcaagttttaatcctcctggtgtaactgttgctgttgctaaagaccgggctttagaatctttgacccatacaggcgatcaatttgtgttgaatatattagctgaggaaaagaagaatttacaaaggcattttattaaaacttttacaccgggagaagatcgttttattggcattcagacaaaggaagctaataatggttgcccaattttagaagatgctcttgcttatctagaatgtaaagtagtcaaacggatggaatgtggcgaccattggttagtttatgctctggtagagaatggtcaactattaaatgatggagtgactgctgttcacttccgcaaaacaggcattcattattga

SEQ ID NO: 45419 - protein, 574 aa, Trichodesmium erythraeum IMS101
MLETTKKKDVQVVIIGQDTKVLRSRTWDRLKFEVEYSLQKGTTANSYLIQGEKTAVIDPPGESFTQNYLESLQLRLDLHRLDYVILGHFNANRGGTLKELLAIAPSVTFVCSNPSVLNLKDYFKDEELKIKVVKGEDTLDLGSGHKLQLLTTPSPKWPDGLMTYDPQTQILFTDKFFGAHVCGDQVADEGWTIYSEDRRFYYDCLHAAQAKQVLSTLEKISELTVKLYAPGHGPLVRYGMMELTNLYRKWSQEQSSRDLNVVLLYASAYGNTAIVAQAIARGLTKAGVAVESINCEVATSNEIREVVEKCDGFIIGSPTLGGHAPTQIQTALGIVLNTASKDKLAGVFGSFGWSGEAIDFLESKLKDTGYKFGFEPIRVKFKPDDVMIQTCQEAGIDFAQALIKSQQRRSPKASVRGSGSDRTAQAVGRVVGSLCVMSAKRGDVTSAMLASWVSQASFNPPGVTVAVAKDRALESLTHTGDQFVLNILAEEKKNLQRHFIKTFTPGEDRFIGIQTKEANNGCPILEDALAYLECKVVKRMECGDHWLVYALVENGQLLNDGVTAVHFRKTGIHY

SEQ ID NO: 45420 - DNA, 1728 bp, Trichodesmium erythraeum IMS101
  CDS (1)..(1728)
atggtagcaataacagatccagtcaaaaatagactgacaatagagacaaataaaattgcctctgatacaatggccattcgttctctagattgggaccgcgatcgctttgatatagaatttggtctacagaatggtaccacatataactcctttatcattcaaggagaaaaaactgctttggtggatacatcccatggaaagtttcgccaattgtacctagatactctattgggtctgatcaaacctaccgaaatagattacttaattattagtcatactgaacccgatcatagtggtttagctaaagacattattgaactagctccacaaattacagtagttggggcaaaaatagcaattcaatttttagaaaatttaactcatataccatttaaaaaacaaattgtcaaaaatggagatcaactggatttaggtaatggtcacgttttagaatttgtttcagctcccaatttacattggcctgatacaatatttagctatgatcgtaaaacccaaaccctatttacctgtgatgcttttgggatgcactattgctcagacaaaacttatgatgaaactctcagtgatatagaagcagattataaattctattatgaatgtctcatggcccccaatgctcgctcagttttaaatgccatgaaacgcatgaaggcactgggagatatcaatactattgcgacaggtcacggtcctctcctacgtcataacttagtagaactaacaaaccgttatcaggagtggagtcaagcaaaaagcaaagcagaaaaaacagtagcagtattctacatttctgattatggttatagcgatcgcctctcccaagctattgcccatgggataatcaaaacaggggtagctgtagaaatgatggacttaaagtctgctgatccccaagaggttagagaactggtagaaatggccaaaggaattgtgattggagctcctcccagtacaggtcctatcgctactactgcggaaataggcatcagcactattttagcagcagctaataaaaaacaaacatttggcttatttgaatcaggtggaggggatgacttatctatttatcctcttgctatccagtttaaaggactagggctcaagcaagcatttcctaatattacaatcaaagaaacaccctcagaattaacttacaagttgtgtgaagaagctggaacagatgcaggacaacttttgagtatcaaggaaaatattaagcagatgaaatcccttgatagtggcctggataaggctttaggtcgcctgagtggaggtttgtatattattactgctagtaaaggtgaggttagtagtgccatgttagcttcttgggtagtgcaagctagttttaaaccattgggagtttctatcgcagtagcaaaggatcgagctattgaggcactaatgcaagtaggcgatcgctttgtcttaaatgtattgcgagaagataactatcaatatttgatgcgacattttttgaagcgctttaaacctggtgcagaccgttttgcaggggtaaatactcaaactgctaataatggtagccccattttgagtgatgctctagcttatttagagtgtgaagtggcaactcggatggaggcaagtgaccattggattatttatgcgactgttgataatgggcgagttagtgactcagatgttttgcctgcagtgcatcatagaaaagtaggtaatcattattaa

SEQ ID NO: 45421 - protein, 575 aa, Trichodesmium erythraeum IMS101
MVAITDPVKNRLTIETNKIASDTMAIRSLDWDRDRFDIEFGLQNGTTYNSFIIQGEKTALVDTSHGKFRQLYLDTLLGLIKPTEIDYLIISHTEPDHSGLAKDIIELAPQITVVGAKIAIQFLENLTHIPFKKQIVKNGDQLDLGNGHVLEFVSAPNLHWPDTIFSYDRKTQTLFTCDAFGMHYCSDKTYDETLSDIEADYKFYYECLMAPNARSVLNAMKRMKALGDINTIATGHGPLLRHNLVELTNRYQEWSQAKSKAEKTVAVFYISDYGYSDRLSQAIAHGIIKTGVAVEMMDLKSADPQEVRELVEMAKGIVIGAPPSTGPIATTAEIGISTILAAANKKQTFGLFESGGGDDLSIYPLAIQFKGLGLKQAFPNITIKETPSELTYKLCEEAGTDAGQLLSIKENIKQMKSLDSGLDKALGRLSGGLYIITASKGEVSSAMLASWVVQASFKPLGVSIAVAKDRAIEALMQVGDRFVLNVLREDNYQYLMRHFLKRFKPGADRFAGVNTQTANNGSPILSDALAYLECEVATRMEASDHWIIYATVDNGRVSDSDVLPAVHHRKVGNHY

SEQ ID NO: 45422 - DNA, 1254 bp, Trichomonas vaginalis
  CDS (1)..(1254)
atgctcagcacttctagcgctcgctcattctctgctcttgacttaggtgtcacaaaggttgccgatgatgttctctggatcggtgtcaatgactgggatcttcgtgaattccactcaatgcaatccccagttggcacatcttacaactcttacttaattcaatcatctgagccaacaattgttgatgcagttaaatacacaatggcccatgcatggattgatcgccttaaatcaatcggtggtgatgatcttaagggcatcaagagaatcatcgttcagcacgctgaaccagatcactcctctggcacagccatgcttgtcaaggaagccccacacattgaggttgttatgacaaagcaatgctacaacacaatggccagattctacgatgtttccaagtggaacgttaagattgtcaagcttggcgaaaagatcaaccttggtgatcgcgttgccgtcatggctggcgttccaatggctcactggccagagtcagctgttacatatcttccagctcagaagattctcttctcatccgactgcttcggccagcacatcgcttccaacaagcgtttcgtcgatgaagtcgatcagggcctcttcctcacagaaatcaagtcatactacgctaatattcttcagcgccttggcaagccagttcttaaggctcttgctacagcctccaagctcccaggacttgacattgtcctcccagctcacggtgttggcttccgccgcaaggaagatctcgagcaggccatcaagctctacacacaatgggccacatacaagccaaatccaaaggtttccgtcatctatgactgcaactggtacggcactgagaagatggccgaggccgtcgcttctggtatttgcaaggagaagcttgagtgcatcatgatgaacgcccgtaagacacacatcacacgctctgctacagaagttatggattctgctgctgtcgcatttggctcatccacacttcacgaatgcatccttccagatatcgctatgcaccttaactacctccgctgccttggcatccatgataagccagtaggtctcttcggcacattcggctggcaggagaagatcgttccaaacgagctccgcaacgccatcgtcaagccatgcaagatcccagaagtcgctgaaccagtcatggctcactggaatccaaaggaagctgaccttgccaagtgcgaggaattaggcagaaagctcgctcttgctgccatcgagaagtgcaagtaa

SEQ ID NO: 45423 - protein, 417 aa, Trichomonas vaginalis
MLSTSSARSFSALDLGVTKVADDVLWIGVNDWDLREFHSMQSPVGTSYNSYLIQSSEPTIVDAVKYTMAHAWIDRLKSIGGDDLKGIKRIIVQHAEPDHSSGTAMLVKEAPHIEVVMTKQCYNTMARFYDVSKWNVKIVKLGEKINLGDRVAVMAGVPMAHWPESAVTYLPAQKILFSSDCFGQHIASNKRFVDEVDQGLFLTEIKSYYANILQRLGKPVLKALATASKLPGLDIVLPAHGVGFRRKEDLEQAIKLYTQWATYKPNPKVSVIYDCNWYGTEKMAEAVASGICKEKLECIMMNARKTHITRSATEVMDSAAVAFGSSTLHECILPDIAMHLNYLRCLGIHDKPVGLFGTFGWQEKIVPNELRNAIVKPCKIPEVAEPVMAHWNPKEADLAKCEELGRKLALAAIEKCK

SEQ ID NO: 45424 - DNA, 1394 bp, Giardia lamblia ATCC 50803
  CDS (81)..(1325)
gtttgatgtataaagcaatggtggccacaactgttgatccatcattgaagtatgtagaccagggctaaaaaaagtatatcatgtcttctaagcccaagtatgtgcaggatcaggagatgattccaggcgtttactgggtcgggatcgtcgactggatggtcaggatctttcatgggtaccacacagacgaggggagctcgtacaactcgtacttcatagatgacgaatgccctacggtgatcgactctgtaaagtaccccttcgccgaggaatggctctctcgtattgcggcatgctgcccgctcgacaagatcaagtacgtcgtcatgaatcatgctgaaggcgaccacgcgtcctctcttaaagaccactaccataagttcacaaacgcgacgtttgtctgtacaaagaagtgccaggaacacctgaagattctttatggcatggagaaggcaacgtggctcattgtcgacgacaagtacacgctcaagattggcaagaggacgctgaagttcatcccggttcccttgcttcattggcctgactccaccttcacctactgccccgaggataagattctcttctccaatgacggctttggtcagcattatgccacctcaaggaggtgggcggacgagtgcgacgtttcgcacgttatgcacctctttaaggagtacactgccaacatcttgggcttgttcagtgctcagatgcgtaaagcacttgaagtcgcaagcaccgtcgaaatcaagtacatcctctccgctcacggcgtttcgtggcgtggcgacgcgatgggccttgcgattgctgagtatgacagatggtctaagggccagcactgccagaagaaggtcacagtcgtccttgacagcatgtatggaaccacacaccgcatggcgctcgccctccttgatggtgctcggagcacgggctgcgagacagttcttcttgagatgactagctctgatatcacgaaggttgcgctccacacgtacgactctggagctgtggcctttgcaagcccgacactcaacaacacgatgatgccctccgtcgctgccgctcttaactacgtcagaggactgactcttatcaaggggaagcctgcgtttgcatttggtgcctttgggtggagcaacagggctgtcccagacatagtagccgaactcagggacgggtgcaaagctgacgtatacgatgagaagggtattacgtttaagtttaactacacagaggagcttcttgaacaagcgtacaatgctggcgttgaccttggaaagagagctattgcatactgcgagaagaacgcccctaagcagtaaatgatgtgagcgagattttacgttgcctcctcgacttatggcctgcaggcctatttcgtcgtctgctgc

SEQ ID NO: 45425 - protein, 414 aa, Giardia lamblia ATCC 50803
MSSKPKYVQDQEMIPGVYWVGIVDWMVRIFHGYHTDEGSSYNSYFIDDECPTVIDSVKYPFAEEWLSRIAACCPLDKIKYVVMNHAEGDHASSLKDHYHKFTNATFVCTKKCQEHLKILYGMEKATWLIVDDKYTLKIGKRTLKFIPVPLLHWPDSTFTYCPEDKILFSNDGFGQHYATSRRWADECDVSHVMHLFKEYTANILGLFSAQMRKALEVASTVEIKYILSAHGVSWRGDAMGLAIAEYDRWSKGQHCQKKVTVVLDSMYGTTHRMALALLDGARSTGCETVLLEMTSSDITKVALHTYDSGAVAFASPTLNNTMMPSVAAALNYVRGLTLIKGKPAFAFGAFGWSNRAVPDIVAELRDGCKADVYDEKGITFKFNYTEELLEQAYNAGVDLGKRAIAYCEKNAPKQ

SEQ ID NO: 45426 - DNA, 1716 bp, Synechococcus elongatus
  CDS (1)..(1716)
atggccgtcactatcaccaaacgtccaccccgcttaacgcttcaggtgctggacattgcccccgagacgacggcaattcgttgcctagattgggatcgcgatcgctttgatattgagtttgcccttgaaaacggcaccacctataactcgtttctaatcaagggtgaacgcattgcccttgtggacacttcccatgccaaatttggcgatcgctacctcgagcaactctggcaactcgtgaaccccagtgacttggactatcttatcgtcagccacaccgaacccgatcacagtggcctcgtcaaggacgtattagtcaaagccccccatgtaaccgtggtggcctcgaaggtggcattgcagtttcttggggatttgatccatcagccctttactcagcagcaggtgaaaaatggcgatcgccttgatttagggaaggggcatgttcttgagtttgtcatggcaccgaatctccactggccagacaccatcctcacatttgatcacggcacccagacgctctttacctgtgatgtctttggtgctcacttctgcaacgatgatccctttgacagcgagccagaactgctggcgccggacttcaaattctactacgactgtctcatggggcccaatgcccgctctgttctctccgccttcaagcgcctagaatccctgccgccggtgcagcttgttgccaccggtcacggtccgctgttgcgccatcatttggatcaatggcttgagtcctaccgcaattggagccaagagcaggctaaggccgccacaaccgtggccattttctatgctgccaactatggctatagcaatgccttggcagaggccattgaacggggtaccgccaaaacaggggtggtggttgaaaaaatggatctgctcacggctgaacctcaagatattcgtgaactgacagagattgccgctgggattattatcggcaccccaccgacgaccgccgtagctaaaacagctctgagtacaattcgcgctgctgcccatgccaagcaggccattggggtctttgaaagtggcgtggccgatgctgaacctgcctatccgctgctgaaccagtttcgggatgctggtcttgtgccctcatttccagtcattcgggtaaccgccgcccccactgatgccctatttcaagaggcagaagaagcgggcactgacatggggcaatggctgttgcgcgatcgcaccgtcaagcagatgaaggccttggataccgacttagataaagcccttgggcgactcagtggcggcctgtacattattacggcgcaaaagggggccattaatagtgccatgttggcctcttgggtagcacaggccagtaccgaaccccttggggtttcgattgcggtggctaaagatcgggccattgagtctttcctccacgtcggggatacctttgtcctcaatgtgcttgaggcggagaattatcagcccctgatgcgccacttcctgaagcgatttccgccgggggctgatcgctttgcccatgtgaaaacctatcccgccagtaatggcagtccaattttggccgacgcccttgcctatatggaatgcactgttgtcagtcgtctggatgcccacgatcactggattgtctatagcaccgttgacagtggccgggtttccaagcccgatggcatgaccgctgttcaccatcgcaaagtggggaaccactactaa

SEQ ID NO: 45427 - protein, 571 aa, Synechococcus elongatus
MAVTITKRPPRLTLQVLDIAPETTAIRCLDWDRDRFDIEFALENGTTYNSFLIKGERIALVDTSHAKFGDRYLEQLWQLVNPSDLDYLIVSHTEPDHSGLVKDVLVKAPHVTVVASKVALQFLGDLIHQPFTQQQVKNGDRLDLGKGHVLEFVMAPNLHWPDTILTFDHGTQTLFTCDVFGAHFCNDDPFDSEPELLAPDFKFYYDCLMGPNARSVLSAFKRLESLPPVQLVATGHGPLLRHHLDQWLESYRNWSQEQAKAATTVAIFYAANYGYSNALAEAIERGTAKTGVVVEKMDLLTAEPQDIRELTEIAAGIIIGTPPTTAVAKTALSTIRAAAHAKQAIGVFESGVADAEPAYPLLNQFRDAGLVPSFPVIRVTAAPTDALFQEAEEAGTDMGQWLLRDRTVKQMKALDTDLDKALGRLSGGLYIITAQKGAINSAMLASWVAQASTEPLGVSIAVAKDRAIESFLHVGDTFVLNVLEAENYQPLMRHFLKRFPPGADRFAHVKTYPASNGSPILADALAYMECTVVSRLDAHDHWIVYSTVDSGRVSKPDGMTAVHHRKVGNHY

SEQ ID NO: 45428 - DNA, 1722 bp, Synechocystis sp
  CDS (1)..(1722)
atgttcactacccccctccccccccaaaagcggctttctacccaaactgaggcgatcgccaaaaatattactgctatccgttctttggactgggaccgggaccggtttgatattgaattcggcctacaaaacggcaccacttacaattcctatctaatccaagcggataaggttgccctagtagatagctcccacgagaaattccgccagttatatctagatttattacagggattaatcgatccccagcgcattgattacctaatcgtcagccacactgagccagaccacagtgggttagtaaaagacattttgcaactcaatccccgcattacggtggtggccaccaaagtagcgttgcaatttctcgacaattttgtccatcaaccctttgagcgtattcaagttaaaagtggcgatcgcctggatttgggccagggccatgatttggaatttgtcagtgctccgaatctccactggccggacaccatgctcacctatgaccccgccacggaaattctcttcacctgcgacgtgtttgggatgcactattgctccgatgcagtttttgacatcgatttgggcaaaatcgcaccggattaccagttttactacgattgcttgatgggtcccaacgcccgttccgttctcgccgccatgaaacgcatggataatctgggcaccattagcaccgttgccaatggccatggccccctattgcgccataacgttggcgaattattacatcgctaccgccattggagcgagtcccaaagtaaagcagaaaaaaccgtggtggttttctatgtggctgattatggctacggcgatcgcctttcccaggccattgccaagggaattactaaaaccggcgtgggggtggacatggtggacctaagctccgccgatcctcaggaaatccaggaactggtgggccatgccagcggggtagttctgggaatgccgcctttacaggctaacgctgatctaagcaccaatttcggcgcagtgttggccgccatgcaaccgaaacaggtctttggtttatacgaatcctatggtggggacgacgagcccattgaccccctccgcaccaaatttttagacctgggtttgcgggaggctttcaaagtgatcaaggtcaaagacacccccagcgaaagcacctatcagctttgtgatgagtccggcactgacttgggtcaaaatctcatccaggcggccaaaataaaacaactcaaatccctggacagcgatctggaaaaggcgatcggtcgcattagtggggggctgtatatcatcactgcccaaaagggagaggttaaaggggccatgcttgcctcttgggtttcccaagccagctttaatccccctggtttcaccgttgctgtggccaaggaccgggccattgaatccctcatgcaagtcggtgatcgctttgtgttgaacattttggaggaaggcaactatcaaattttgatgaaacatttcctcaaacgtttcccccctggtgctgatcgttttgctggagtaaaaacccaaaccgcaagcaacggatcgcctattttgaccgatgcgctagcctatttggagtgtgaagtagctagtcggatggaatgtagtgatcactggattgtttacagccaagtaaccaatggtcgggtagctaaagcagaagggttaaccgccgtacaccatcgcaaagtcggcaattattactaa

SEQ ID NO: 45429 - protein, 573 aa, Synechocystis sp
MFTTPLPPQKRLSTQTEAIAKNITAIRSLDWDRDRFDIEFGLQNGTTYNSYLIQADKVALVDSSHEKFRQLYLDLLQGLIDPQRIDYLIVSHTEPDHSGLVKDILQLNPRITVVATKVALQFLDNFVHQPFERIQVKSGDRLDLGQGHDLEFVSAPNLHWPDTMLTYDPATEILFTCDVFGMHYCSDAVFDIDLGKIAPDYQFYYDCLMGPNARSVLAAMKRMDNLGTISTVANGHGPLLRHNVGELLHRYRHWSESQSKAEKTVVVFYVADYGYGDRLSQAIAKGITKTGVGVDMVDLSSADPQEIQELVGHASGVVLGMPPLQANADLSTNFGAVLAAMQPKQVFGLYESYGGDDEPIDPLRTKFLDLGLREAFKVIKVKDTPSESTYQLCDESGTDLGQNLIQAAKIKQLKSLDSDLEKAIGRISGGLYIITAQKGEVKGAMLASWVSQASFNPPGFTVAVAKDRAIESLMQVGDRFVLNILEEGNYQILMKHFLKRFPPGADRFAGVKTQTASNGSPILTDALAYLECEVASRMECSDHWIVYSQVTNGRVAKAEGLTAVHHRKVGNYY

SEQ ID NO: 45430 - DNA, 1737 bp, Synechococcus elongatus
  CDS (1)..(1737)
atgctaacggaaacgcgtccgcgggacgtccaagtggcggaaattgcaccgggggttttggtcttgcgatcgcgcacttgggatcggctgaagtttgaagtggagtacggccgccagcagggaaccacctccaactcctacctcattcaagctcctcagccggcgctcctggatccaccgggtgaatcctttacccagatttatttacaggaactgcagcgccacattgatctcaatcaactgcggtacctgatcctcagtcatgtcaactccaatcgccttgccaccgtcaaggtcctgctggaaaaagcaccccagatcactcttgtctgctctaaggccggggcagtgacattgcgctctgctattggcgagcagttgcatctctggattgcgcgggcggacacccccttggagttggggggcgatcgccaactcatgtttattgccgctgctacgccccgctggcccgatggtctcattaccgttgatccccaaaatcaaattgtcttcagcgacaagctctttggcgcccatgtctgtggcgacagtctctacgatgagcagtggaaaaaactggatgaggatcgtgcctactattttgaatgtttgcatgcggcacaaacccgccaagtggaaagtattttggatcgcttggcagaactgacaccgccaccgcgcctctatgccccggcccacggcccgattgtcaagtttagccgtagccgcctcttccaggactatcgcgactggtgccaagcccaagcggaacaggaaaccaaagtggcattgttctatgcctctgcctatggcaatacggcaattctggccaatgcgatcgcccaaggcctaaccgccgccggtgtgcaagtggaagccgttaactgtgaaaccacaccccctgcggaaatgcaagccttgatccacagtagcgacggctttatcattggctcccccaccctagggggacacatgcccacccaagtccagaccgccttggggtttatcttggcggagggcagccaaacaaagctggcgggagtctttggctcctacggctggagtggtgaggccattgatgacattgagcaaaagctcctcgatgctggctatacccttggctttgaaaccctgcgggtgaaatttacccccacagccacggacttggaaaaatgtcaaattgccgccaacgagtttgcccaagccctgaagaaactgcgcaagagccgcactgtccgcccttccagcctagcggaggcacaagtggatcgcaccgaacaggcggtgaatcgggtggtcggttccctgtgtgttctgaccaccctacccgaagggtgttttcaccttacccaagcggcggctattttggtgtcgtcggtctcccaagcctcctttaatccccccggcatcaccgtctccttgcctcaggaatgggcagaaagcctctgcctagtgggcgatcgctttgtcttgaatatcctcaaggaaggcagtcccctcgtacgtcaatttcagcaggcacaacgcttgggtgagcaacagctagctacccttggcctcaaaagcgctgagagtggtgcccccattttgctcgatgcccttgcctatttggagtgcaccgtagagtcccgcatgaactgtggcaaccactggctcatctatgccgtggtcgagagtggcgagttgctgcaaaccagtggcttaacggccatccaacatcgcaaaaccagcagttag

SEQ ID NO: 45431 - protein, 578 aa, Synechococcus elongatus
MLTETRPRDVQVAEIAPGVLVLRSRTWDRLKFEVEYGRQQGTTSNSYLIQAPQPALLDPPGESFTQIYLQELQRHIDLNQLRYLILSHVNSNRLATVKVLLEKAPQITLVCSKAGAVTLRSAIGEQLHLWIARADTPLELGGDRQLMFIAAATPRWPDGLITVDPQNQIVFSDKLFGAHVCGDSLYDEQWKKLDEDRAYYFECLHAAQTRQVESILDRLAELTPPPRLYAPAHGPIVKFSRSRLFQDYRDWCQAQAEQETKVALFYASAYGNTAILANAIAQGLTAAGVQVEAVNCETTPPAEMQALIHSSDGFIIGSPTLGGHMPTQVQTALGFILAEGSQTKLAGVFGSYGWSGEAIDDIEQKLLDAGYTLGFETLRVKFTPTATDLEKCQIAANEFAQALKKLRKSRTVRPSSLAEAQVDRTEQAVNRVVGSLCVLTTLPEGCFHLTQAAAILVSSVSQASFNPPGITVSLPQEWAESLCLVGDRFVLNILKEGSPLVRQFQQAQRLGEQQLATLGLKSAESGAPILLDALAYLECTVESRMNCGNHWLIYAVVESGELLQTSGLTAIQHRKTSS

SEQ ID NO: 45432 - DNA, 1737 bp, Synechocystis sp
  CDS (1)..(1737)
atggttaccctaattgattctccaacctctgctgctgtccagccccgcttaacactccaaaccgcggacattgcagcccacaccacagcgattcgttgccttgactgggatcgggatcgctttgatattgagtttgagttacgccatggcacaacctacaactcatttttaatccgaggggaaaaaacggccctcatcgacacgtcccatcgcaagtttgaggccgtctacttgcaactgttgcaggatctagttgatctcagaagtctcgactatttgatcgtcaatcatacagaaccagaccacagtggactgattccagacctcttagaactggccccccaggtgacggtggtgggctccaaggtggccatccaattcttggaaaagctcgtacaccgaccttttgagtcacagattgtcaaaagtggccacagcctggatttgggccagggccatgagttgcaatttatttcagcgcccaatttgcattggcccgacacaattttgacctatgactcgggtacccaggtactctatacctgcgatgtttttggcatgcactattgcgatgattcccttttcgatgaaacgccagaacgactcgaacctgatttccaatactattacaattgcttgatgggctccaatgcccgctcggtgttgatggcattaaaacgcattgcaccgctgcaggttgttctagtggcaacgggccatgggccgctattgcaacatcacatttcccattggcttggacagtacgatgcctggagtcaaaaccaggtcaaagctgaaacctttgtggccctattttatgtagatgggtatggggtgagcgatcgcctggtgcagaccattgccgatggcatcagtaaaaccggtgtggccattgaactagtcgatctaagtgtggcggatacccacgaggttcgtaccctggcccaatgtgcggcaggcctggtggttggtatgcctccccaatcttccacttcaaccaccctagaccctttgttgggcaccattttagcggcggtacatcccaaacaagttatcggcctgtttgaaagcgggggaggacaggatgagcccatttaccccctccgcaatcgcttccaggaattgggtttgcaagaagcctttgagccaattttgctcaagaccgaaccaacggccgccacggatcagctttgccgtgaagcgggtaccgatctgggccagtacctcacccagaaacaatcccagcaggcaaatacagaccttgatccagaactcaatcaggcgatcggtcgcctcagcactggactgtatattttaaccgctcaaaagggagatgtgcggagtgccatgttagcttcctgggtgattcaaggcagctttgaacccctgggcattgtcattgcagtggccaaagaccgggcgatcgaatcattactccatcccggcgatactttcgtgctcaatgtgctggaagaggacaactatcaaagcctcatgcgccatttcctcctccgttttcccccaggggcagaccgctttgccggagttaacacctatcctgcccagaacggttctccgatcctgttggaaaccctagcttatctggaatgtgaggttacctcccgtcttgatggcaatgaccattggttggtctacagcaccatacaaactggacgagtcgccaaattgaatgccctaaccgccactcaccaccgcaaactgggcaaccactactaa

SEQ ID NO: 45433 - protein, 578 aa, Synechocystis sp
MVTLIDSPTSAAVQPRLTLQTADIAAHTTAIRCLDWDRDRFDIEFELRHGTTYNSFLIRGEKTALIDTSHRKFEAVYLQLLQDLVDLRSLDYLIVNHTEPDHSGLIPDLLELAPQVTVVGSKVAIQFLEKLVHRPFESQIVKSGHSLDLGQGHELQFISAPNLHWPDTILTYDSGTQVLYTCDVFGMHYCDDSLFDETPERLEPDFQYYYNCLMGSNARSVLMALKRIAPLQVVLVATGHGPLLQHHISHWLGQYDAWSQNQVKAETFVALFYVDGYGVSDRLVQTIADGISKTGVAIELVDLSVADTHEVRTLAQCAAGLVVGMPPQSSTSTTLDPLLGTILAAVHPKQVIGLFESGGGQDEPIYPLRNRFQELGLQEAFEPILLKTEPTAATDQLCREAGTDLGQYLTQKQSQQANTDLDPELNQAIGRLSTGLYILTAQKGDVRSAMLASWVIQGSFEPLGIVIAVAKDRAIESLLHPGDTFVLNVLEEDNYQSLMRHFLLRFPPGADRFAGVNTYPAQNGSPILLETLAYLECEVTSRLDGNDHWLVYSTIQTGRVAKLNALTATHHRKLGNHY

SEQ ID NO: 45434 - DNA, 1794 bp, Synechocystis sp
  CDS (1)..(1794)
atgggaatccatgcaaaactggagacagtccaactaccgttgttggtcagttgtcttttccctcccctcaccatgcctgccaaagacgttcaaatctgcccgatcgccgttgacaccactgtgtttcgctcccgcacctgggacaggttgaagtttgaaattgagtatggtttgcaacggggcaccactgccaatagttacctgatcagtgctgataagattgccctctttgacccgccgggggaatccttcaccgataattttgtcggcaccctaattcaacggttagacctcaacagcctggattacgtcattttgggccacgtcaacgccaaccgggcccataccctgaagcttttgttgagcctagctccccaggcaaccattatctgctctaaccccgccgctcaaaatttagaaaaattgctggcggatgctgaagtcaataatcctatccaagtgatgaaaggtaatgaccacctggatttgggccggggccatgaattgacctttatccccacccctagcccccggtacccagggcaactctgcacctacgatccccgcaccgaaattttattcaccgataaactgttcggggcccacgtttgtggtgaccaagtgttcgatgaaggttggactatttaccaagaagaccgccgctattactttgattgtctgttggcccccgccgccgcccaggttagtgccgccctgaataagttagaagcctatccagcccagacctatgcccccagccatggccccctggtgcgctacggtttgcgggagttgacccgtaactatcagcaatggctcagtgaacaacaggcccaagctttgaacgtggccttaatttacgcttctgcctacggtaataccagcaccctggcccaggcgatcgccagaggcattactaaagctggggtagcggtaacggccatcaatgcggaaactagcaacgcagaggaaattaaggaggcgatcggtaaatccgctggctttatttttggttcccctactctgggcggccatgcccccacccccattcaaacggccctgggcatcaccctggccaatgcgtccaaaacccaactgtgcggcgtgtttggttccttcggttggagtggagaggcgatcgatatgctggaaaacaaatttcgggatgcgggctttagctttggctttgacaccatccgggtgaaatttaagcccaccgaccaaactttgaaaatgtgcgaagaggccggtacggattttgcccaagctctgaaaaaggcagaaaaacgccgtcaacctaaatctgctctgccggagtcggaatctgcccgcaccgaacaagcgttaggccgtttagtgggttccctctgtgtggttaccgcccagcaaggggaattgagcagtgccatgttagcttcctgggtttcccaagctaccttttccccccctggtttgaccgttgccgttgccaaagaaagggcgatcgaatctttgctacacaaaaacagttgctttgtgttgaatattttgcaggaaggcaaccatctgggactgatgaaacattttctcaaaccctttgcccccggcggcgatcggtttgcagacgtggccacggaaacggcggaaaatggcgcaccaattttgacggaatccctggcttatttggaatgtcgggtacaacaacggctggagtgcggtgaccattgggttctttacgccgtgactgaccggggtgccctactcaaagatggggtaacggcggtgcatcaccggaaatctggcgatcattattag

SEQ ID NO: 45435 - protein, 597 aa, Synechocystis sp
MGIHAKLETVQLPLLVSCLFPPLTMPAKDVQICPIAVDTTVFRSRTWDRLKFEIEYGLQRGTTANSYLISADKIALFDPPGESFTDNFVGTLIQRLDLNSLDYVILGHVNANRAHTLKLLLSLAPQATIICSNPAAQNLEKLLADAEVNNPIQVMKGNDHLDLGRGHELTFIPTPSPRYPGQLCTYDPRTEILFTDKLFGAHVCGDQVFDEGWTIYQEDRRYYFDCLLAPAAAQVSAALNKLEAYPAQTYAPSHGPLVRYGLRELTRNYQQWLSEQQAQALNVALIYASAYGNTSTLAQAIARGITKAGVAVTAINAETSNAEEIKEAIGKSAGFIFGSPTLGGHAPTPIQTALGITLANASKTQLCGVFGSFGWSGEAIDMLENKFRDAGFSFGFDTIRVKFKPTDQTLKMCEEAGTDFAQALKKAEKRRQPKSALPESESARTEQALGRLVGSLCVVTAQQGELSSAMLASWVSQATFSPPGLTVAVAKERAIESLLHKNSCFVLNILQEGNHLGLMKHFLKPFAPGGDRFADVATETAENGAPILTESLAYLECRVQQRLECGDHWVLYAVTDRGALLKDGVTAVHHRKSGDHY

SEQ ID NO: 45436 - DNA, 1785 bp, Synechocystis sp
  CDS (1)..(1785)
atgatttctccaattggtggtctttcccaagctttgcatagtccgtcagattcaattttcgttgcttccctgcctcgggatattcaggttgcggaaattgcccctcaaaccaaagtgttacggtctcgcctctgggatcgacttaaatttgaggtggaatatggtcgccgtcggggcactacttctaattcctatctgattcaggccgaccatacggcattgattgatcctccgggagagtcattttgtgatttgtatctagcggaattacccaaatatttggatttagcccagcttgactacattgttgcaagccatgttaatcccaatcgcatggttaccctggagcaattactgcgtcgggcaaccaaggccaagcttatttgttctcgtcctgcggcgaaggtgcttaaagccacctttccccattgggaagaaagattccagaccgtgcggtcccaggacatgctggatttgggccggggccataagctccagttgatgaccttgcctaccccccgctggcctgacggtttatgtgcctacgatgcaggtagccagattctttttagtgacaagttgtttggcacgcatgtttgtggcgatgccatttttgatgaggactggcgacaattaggcggcgatcgccgtttttactttgattgtttgcatgctccccaaactagacaggtcgaaacagcactggatcagtttgatccgttaacgctgaaaatgattgcccctggccatggccccttggttcgttttagccttagtcgtctgtacagtgattatcgccaatggtgtcaacaacaacctagccagaccctcaaagtagcattgatctatgcttccgcctatggcaatacagcaaccatggcccgggcgatcgcccaaggattagtcaaggccggtgttgccgtcgaaacaattaactgtgaaatcgcagaaccaaacgaaattgtcgaagcaattcaggcctgtgatggttttattgtcggttctcctaccctggggagccatgcccccgttcaaatccaaacggcattagggattgttttatcttccgcaaccaaaactaaattggccggagtctttggttcctatggctggagcggtgaagctattgatttgattgaaaataagctaaaagatggcggctatcgcttcggctttgaggccatccgcatccaattcagtcccaatctcgatgccctagatgtttgcacaacctctggcgcaaatttcgcgcggcaactccgtacccacaagcgtcagaggattgcccgtcaagccactaccgaaacccaggctgaccgcactcagcaggcagtgggacgtattatcggctccattggtgtggttacaacccaaacaactggccgccatcaagggattttgacctcctgggtttcccaagccagcttcactccccctggcattatgctcgcaattccgggcgaatttgatgcctacggtttggccggacaaaataaggcttttgtgctcaatcttctgcaggaaggtaggagtgtacggcgtcattttgatcaccagcccctgccgaaagatggggataatcccttcagcagattggaacattattcaacccagaatggctgtctgattctagcggaggcgctggcttatcttgaatgcctcgtccaatcttggtcgaatataggcgatcatgtcctggtttatgcaacagttcaggccggacaagtgttacaacccaacggcatcactgccatacgacaccgcaaatcggggggacaatattag

SEQ ID NO: 45437 - protein, 594 aa, Synechocystis sp
MISPIGGLSQALHSPSDSIFVASLPRDIQVAEIAPQTKVLRSRLWDRLKFEVEYGRRRGTTSNSYLIQADHTALIDPPGESFCDLYLAELPKYLDLAQLDYIVASHVNPNRMVTLEQLLRRATKAKLICSRPAAKVLKATFPHWEERFQTVRSQDMLDLGRGHKLQLMTLPTPRWPDGLCAYDAGSQILFSDKLFGTHVCGDAIFDEDWRQLGGDRRFYFDCLHAPQTRQVETALDQFDPLTLKMIAPGHGPLVRFSLSRLYSDYRQWCQQQPSQTLKVALIYASAYGNTATMARAIAQGLVKAGVAVETINCEIAEPNEIVEAIQACDGFIVGSPTLGSHAPVQIQTALGIVLSSATKTKLAGVFGSYGWSGEAIDLIENKLKDGGYRFGFEAIRIQFSPNLDALDVCTTSGANFARQLRTHKRQRIARQATTETQADRTQQAVGRIIGSIGVVTTQTTGRHQGILTSWVSQASFTPPGIMLAIPGEFDAYGLAGQNKAFVLNLLQEGRSVRRHFDHQPLPKDGDNPFSRLEHYSTQNGCLILAEALAYLECLVQSWSNIGDHVLVYATVQAGQVLQPNGITAIRHRKSGGQY

SEQ ID NO: 45438 - DNA, 1251 bp, Methanococcus jannaschii
  CDS (1)..(1251)
gtgaaaaaatatgaaagcagacgcagcaaaatagctgatggtgtatattgggtgggggttttagactgggacataagaatgtatcacggctacacattaaaaggaacaacatacaatgcctatttagtctttggagatgaaaaagttgctttaatagacaacacatacccaggaacctccgctcaaatgtgggggaggataaaagatgcatttgaaaaagaggggagggaatttaaaattgatgtaatcgttcaaaaccacgtagaaaaagaccacagtggagctctccctgaaatacacaaaaaattcccagatgcaccaatatactgtactgaggtagctgttgagggacttaaaaagcactatccatcattaaaagacgctcaatttaaggttgttcatacaggagatacagttgatttaggaggaaagacattaacattcttagaagctcctctattacactggccagatagtatgtttaccttctacaacgaagggggaattttattctcaaacgatgcatttggacagcatctctgcttcccagcacacaagagatttgataaagatattccagagtatgtgttaatggatgcaaaccagaagttttatgctaatttaattactccactgtcaaagcttgtattaaagaaatttgaggaagttattcagttgggattattagaaaagataaaaatgattgccccatcacacgggcagatatggacagacccaatgaaagttattaaggcatatcaagactttgctactggtaaagcagctaaggataaggcagttatcgtttatgatactatgcactactcaacacaaaagatggctcatgcatttgcagagggtttaatgagtgagggaattgatgttgtaatgtatttcttacactacgatgagagaagtgagattgttaaagacatcttagatgctaaggcagttctctttggaattccaacaatctatgatgagccatatccatcaattggagatatcatatactacttgagaggattgaaatttaacagaacaggatttaagagattggcggttacttttggttcaatggggggagaaggtggagcagttgctaagattgctgaagacttggcgaaatgtggatttgaagttattaatcaatatgaactctactatgtcccaacagaggatgaattaacaaactgctacaatatgggtaaagaattggctaagagaattaaagagatgaagattgaatga

SEQ ID NO: 45439 - protein, 416 aa, Methanococcus jannaschii
MKKYESRRSKIADGVYWVGVLDWDIRMYHGYTLKGTTYNAYLVFGDEKVALIDNTYPGTSAQMWGRIKDAFEKEGREFKIDVIVQNHVEKDHSGALPEIHKKFPDAPIYCTEVAVEGLKKHYPSLKDAQFKVVHTGDTVDLGGKTLTFLEAPLLHWPDSMFTFYNEGGILFSNDAFGQHLCFPAHKRFDKDIPEYVLMDANQKFYANLITPLSKLVLKKFEEVIQLGLLEKIKMIAPSHGQIWTDPMKVIKAYQDFATGKAAKDKAVIVYDTMHYSTQKMAHAFAEGLMSEGIDVVMYFLHYDERSEIVKDILDAKAVLFGIPTIYDEPYPSIGDIIYYLRGLKFNRTGFKRLAVTFGSMGGEGGAVAKIAEDLAKCGFEVINQYELYYVPTEDELTNCYNMGKELAKRIKEMKIE

SEQ ID NO: 45440 - DNA, 1215 bp, Methanobacterium thermoautotrophicum
  CDS (1)..(1215)
atgaaggccgcagcaaaaagaatatccgatggagtatactggactggagtcctggactgggatcttagaaactaccatggatacaccctgcagggcaccacatacaacgcctaccttgtctgtggagatgagggggttgcactgatagacaactcctaccccggcacctttgatgagctcatggcaagggttgaggacgccctgcaacaggtgggaatggagagggttgactacataatccagaaccacgttgaaaaggaccacagcggtgtcctggtggaactccacaggaggttccctgaagctcccatctactgcacagaggtggctgttaaggggctcctgaaacactacccctccctcagggaagcagagttcatgaccgtgaaaacaggggatgtgcttgatcttggcgggaagacactgacattcctggagaccccgctgctccactggccagacagcatgttcaccctacttgatgaggatgggatactcttctcaaacgacgcctttggacagcacctctgctgcccccagcgccttgacagggagataccagaatacatcctcatggatgctgccaggaagttctatgcaaacctcataaccccactctcaaagctggtactcaaaaaattcgacgaagttaaggagcttgggctcctcgaaaggatccagatgatcgccccatcccatgggcagatctggacagaccccatgaagatcatagaggcctacacaggctgggccacaggcatggtggatgagagggtcacggtgatctacgacaccatgcacggttcaaccaggaagatggcccatgccatagcagagggagctatgagtgagggggtcgatgttagggtctactgcctccatgaggatgaccggagcgagatcgtgaaggacatacttgaaagcggcgccatagcacttggagcccccaccatatacgacgagccctacccaagcgtcggagacctcctcatgtacctcaggggcctcaaattcaacagaaccctcaccaggaaggcccttgtattcgggtcaatgggtggaaatggtggtgccacaggcaccatgaaggagctccttgcagaggcgggattcgatgttgcctgcgaggaggaagtgtactacgtgcccacaggtgatgaactcgacgcctgctttgaggccggtagaaaacttgcagctgaaatccggaggtga

SEQ ID NO: 45441 - protein, 404 aa, Methanobacterium thermoautotrophicum
MKAAAKRISDGVYWTGVLDWDLRNYHGYTLQGTTYNAYLVCGDEGVALIDNSYPGTFDELMARVEDALQQVGMERVDYIIQNHVEKDHSGVLVELHRRFPEAPIYCTEVAVKGLLKHYPSLREAEFMTVKTGDVLDLGGKTLTFLETPLLHWPDSMFTLLDEDGILFSNDAFGQHLCCPQRLDREIPEYILMDAARKFYANLITPLSKLVLKKFDEVKELGLLERIQMIAPSHGQIWTDPMKIIEAYTGWATGMVDERVTVIYDTMHGSTRKMAHAIAEGAMSEGVDVRVYCLHEDDRSEIVKDILESGAIALGAPTIYDEPYPSVGDLLMYLRGLKFNRTLTRKALVFGSMGGNGGATGTMKELLAEAGFDVACEEEVYYVPTGDELDACFEAGRKLAAEIRR

SEQ ID NO: 45442 - DNA, 1200 bp, Moorella thermoacetica
  CDS (1)..(1200)
atgagccagcctgtcgccattaccgacggcatctactgggtaggggccgttgactggaacatccgctacttccacggtcccgctttttccacccaccgcggtacaacttataatgcctatctgattgtcgacgataaaaccgccctggtggatactgtctatgaaccctttaaagaagaactcattgccaaactaaagcaaataaaagatccggttaaactcgactacctggtggtcaaccataccgaaagcgatcatgccggcgccttcccggccatcatggaactctgtccagacgcccacgtcctctgcacccagcgggcctttgacagcctgaaagcccattatagccacatcgatttcaactataccattgtcaaaactgggaccagcgtcagcctgggtaaacgctccctgaccttcatcgaggcgcccatgctccactggcccgacagcatgtttacctatgtaccggaagaagccctgctccttcccaatgatgccttcggccagcatatcgccaccagcgtccgcttcgacgaccaggtggatgccggcctgattatggacgaggcggccaagtactatgccaatattctcatgcccttcagcaacctgattaccaaaaagctggatgaaatccagaagataaacctggccatcaaaaccatagcccccagccacggcattatctggcgtaaagatcccggccgaatcatcgaagcttacgcccgctgggccgagggtcagggtaaggccaaagccgtcatcgcctacgacaccatgtggctgagcacagaaaagatggcccacgccctgatggacggcctggtggccggcggctgcgaggtcaagctcttcaagctgtccgtatccgaccgcaacgatgtgatcaaagaaattctggacgcccgagccgtcctggtcggctcgccgacgatcaataacgatatcctgccggtggtctcgccgctcctggacgacctggtaggattaaggcccaagaataaagttggcctggccttcggcgcctatggctggggcggcggcgcccaaaagatcctggaagaacgcttgaaggcagctaaaatcgaactgatagccgagcccggccccaccgtccaatgggttccccgtggcgaggacctgcagcgctgctacgagctgggccggaaaatcgcagcgcgcatagccgattaa

SEQ ID NO: 45443 - protein, 399 aa, Moorella thermoacetica
MSQPVAITDGIYWVGAVDWNIRYFHGPAFSTHRGTTYNAYLIVDDKTALVDTVYEPFKEELIAKLKQIKDPVKLDYLVVNHTESDHAGAFPAIMELCPDAHVLCTQRAFDSLKAHYSHIDFNYTIVKTGTSVSLGKRSLTFIEAPMLHWPDSMFTYVPEEALLLPNDAFGQHIATSVRFDDQVDAGLIMDEAAKYYANILMPFSNLITKKLDEIQKINLAIKTIAPSHGIIWRKDPGRIIEAYARWAEGQGKAKAVIAYDTMWLSTEKMAHALMDGLVAGGCEVKLFKLSVSDRNDVIKEILDARAVLVGSPTINNDILPVVSPLLDDLVGLRPKNKVGLAFGAYGWGGGAQKILEERLKAAKIELIAEPGPTVQWVPRGEDLQRCYELGRKIAARIAD

SEQ ID NO: 45444 - DNA, 1308 bp, Rhodobacter capsulatus
  CDS (1)..(1308)
ttgtccgttccgcctttcaccatccgcccggccgcgccccgccttgacggccccaccggccctgtcgcggtggcgcccggcgtgcattgggtgggggcgctcgatccggggctgcgcaatttcgacgtgatcctgaaaaccgcgaatggcaccacctacaatgcctatgccgtgcgcgggtcagagggggtcgcggtgatcgacacggtcaaggccgaattcgcgggcgacttctttgcccggctggaagccgttgcccgctatgacgaaatccgcctgatcgtgctgaaccatctggagcccgatcacaccggcgccgtgcccgaactcttgcgccgcgcaccgcaggcgcaggtccggctgtcgccccgcggcctgccgatgctgcgcgcgcttttgaaggacgacttcgagcgttacgacatcaagggcgtcaccaccgggcaatcggtcagcctgggcgaccgcgatctgcagttcttcaccacgcctttcgtgcattggcccgacacgcaatgcacctggctggcggcggaacgggtgctgttcacctgtgacctgttcggcagccattattgcgacgggcggctgttcaatgaccttgtcggcgatttccggttttcttttgagtattacttcgaccggatcatgcgccccttccgcagtttcgtggcgcaggcgctcgacctgatcgagccgctcgatttcggcatcatcgcccccgcgcatgggccgatcctgcgcagccatccgcgcgattatctgacccatacgcggcggctgatttcctcgcggctcgccgccgaaaccggcagcgaaaagacgctgctgatcttttacgtctcggcctatggcgccaccgcgcagctggcgcaggcgatccatgacggtgccgccgaaagccccgatgtgcgggtgtcgctctttgatctggagggcggcgagatcacccccttcctggatctgatcgaggaggccgacggcattgcgctgggcacgccgacgatcaacggcgatgcggtgcgcacgatctgggaaatgctggcggcgctggtcgatatcgaaacccgcggcaagctgggggcggctttcggctcctatggctggtcgggcgaggcggtgcggctggtcgaaacccggctgcaggggctgaagatgcgtctgccggaaccggggttgcgggtgaagctgcacccctccgcggcggaactgaaagaggggcgggccttcgggcgccgccttgccgatcacctgaccggccgggccgcgccccgcgaggtcgacttcgccgaaatcgcggcgcgctga

SEQ ID NO: 45445 - protein, 435 aa, Rhodobacter capsulatus
MSVPPFTIRPAAPRLDGPTGPVAVAPGVHWVGALDPGLRNFDVILKTANGTTYNAYAVRGSEGVAVIDTVKAEFAGDFFARLEAVARYDEIRLIVLNHLEPDHTGAVPELLRRAPQAQVRLSPRGLPMLRALLKDDFERYDIKGVTTGQSVSLGDRDLQFFTTPFVHWPDTQCTWLAAERVLFTCDLFGSHYCDGRLFNDLVGDFRFSFEYYFDRIMRPFRSFVAQALDLIEPLDFGIIAPAHGPILRSHPRDYLTHTRRLISSRLAAETGSEKTLLIFYVSAYGATAQLAQAIHDGAAESPDVRVSLFDLEGGEITPFLDLIEEADGIALGTPTINGDAVRTIWEMLAALVDIETRGKLGAAFGSYGWSGEAVRLVETRLQGLKMRLPEPGLRVKLHPSAAELKEGRAFGRRLADHLTGRAAPREVDFAEIAAR

SEQ ID NO: 45446 - DNA, 1440 bp, Salmonella typhi
  CDS (1)..(1440)
atgtctattctggttaaaaataatattcattgggttggccaacgcgactgggaagtacgtgattttcacggcactgaatacaaaacgctgcgtggcagcagctataacagctatctcattcgtgaagaaaagaatgtgctgatcgataccgtcgatcataagtttagccgtgagtttgtgcaaaatctgcgcagtgaaatcgacctcgcggacatcgactacatcatcattaaccatgccgaagaagaccatgcaggcgcgctgaccgaactgatggcgcagatcccggacacgcctatctactgtaccgccaacgccattgactctatcaacggccatcaccatcacccggaatggaattttaaggtggtgaaaaccggcgatacgctggatatcggcgacggcaagcagttgatcttcgtggaaacgccgatgctgcactggccggacagcatgatgacctatatgaccggcgacgcggtgttattcagcaacgacgcctttggtcagcactactgcgacgagcacctgttcaatgatgaagtggaccaaactgaactgtttgaacaatgccagcgctactacgccaatatcctgacgccgttcagccgtctggtaacgccaaaaattaccgaaatcctcggcttcaacctgccggtggatatgattgccacctcacacggcgtggtatggcgcgacaacccaacgcaaatcgtggagctgtatctgaaatgggcggcagattatcaggaagatcgtatcactattttctacgataccatgtcgaacaatactcgcatgatggcggatgccatcgcacagggtatcaatgaagtggaccccaacgtggcggtcaaaatctttaacgtcgcccgcagcgataaaaatgaaatattgaccaacgtcttccgttcgaaaggcgtgctggtcggcacttctaccatgaacaacgtgatgatgccgaaaatcgctggtctggtggaagagatgaccggcctgcgctttcgcaacaaacgcgccagcgccttcggttctcatggctggagcggcggcgcggtggatcgactgtccacgcgcttacaggatgccggttttgaaatgtccctgagtctgaaagcgaaatggcgtccggatctggatgcgctggagttgtgccgtcagcatggtcgcgacatcgcccgtcagtgggcgcttgctccgctgccggaaaccacacagaaaaccgcgccagtcgaagaaaccacaacctgcaccgccgcagacctcggccccaaaatgcaatgcagcgtatgccagtggatttacgaccctgcgctgggcgagccgttgcaggatgtcgcgccgggtacgccgtggagcgacgtgccggataacttcctgtgcccggaatgttcattaggtaaagacgtgttcgacgtactggcgacggaggcaaaatga

SEQ ID NO: 45447 - protein, 479 aa, Salmonella typhi
MSILVKNNIHWVGQRDWEVRDFHGTEYKTLRGSSYNSYLIREEKNVLIDTVDHKFSREFVQNLRSEIDLADIDYIIINHAEEDHAGALTELMAQIPDTPIYCTANAIDSINGHHHHPEWNFKVVKTGDTLDIGDGKQLIFVETPMLHWPDSMMTYMTGDAVLFSNDAFGQHYCDEHLFNDEVDQTELFEQCQRYYANILTPFSRLVTPKITEILGFNLPVDMIATSHGVVWRDNPTQIVELYLKWAADYQEDRITIFYDTMSNNTRMMADAIAQGINEVDPNVAVKIFNVARSDKNEILTNVFRSKGVLVGTSTMNNVMMPKIAGLVEEMTGLRFRNKRASAFGSHGWSGGAVDRLSTRLQDAGFEMSLSLKAKWRPDLDALELCRQHGRDIARQWALAPLPETTQKTAPVEETTTCTAADLGPKMQCSVCQWIYDPALGEPLQDVAPGTPWSDVPDNFLCPECSLGKDVFDVLATEAK

SEQ ID NO: 45448 - DNA, 1209 bp, Desulfovibrio gigas
  CDS (1)..(1209)
atgcaagcgactaagattattgacggcttccacctcgtgggcgccattgactggaacagccgcgacttccacggctatacgctttcgcccatgggcaccacgtacaacgcctatctggtggaagacgaaaagaccacgctcttcgacacggtgaaggccgagtacaaaggcgagctgctctgcggcatcgccagcgtcatcgatcccaaaaagatcgactatctggtgatccagcacctggagctggaccatgccggcgccctgcccgccctcatcgaagcctgccagcccgagaagatcttcacctcctccctgggccagaaggccatggaatcccacttccattacaaggactggcccgtgcaggtggtcaagcacggggaaacgctctccctgggcaagcgcacggtcacgttctacgaaacccgcatgctgcactggccggacagcatggtctcctggttcgccgacgaaaaggtgctcatcagcaacgacatcttcggccagaacatcgccgccagcgagcgcttcagcgaccagatcccggtccacaccctggaacgggccatgcgcgaatactacgccaacatcgtcaacccctacgccccgcagaccctcaaggccattgagaccctggtgggcgcaggcgtggcgccggaattcatctgcccggaccacggcgtgatcttccgcggcgcggaccagtgcaccttcgccgtgcagaagtatgtggaatacgccgaacagaagcccaccaacaaggtggtgatcttctacgactccatgtggcattccacagaaaagatggcccgtgtgctggccgaatccttccgcgatgaaggctgcaccgtgaagctcatgtggtgcaaggcctgccatcattcgcagatcatgagcgaaatcagcgatgccggcgcggtgatcgtcggttctcccacccacaacaacggcatcctgccgtatgtggccggtacgctgcagtacatcaagggcctgcggccgcagaacaagatcggcggcgcattcggctccttcggctggagcggggaatccaccaaggtcctggccgaatggctcaccggcatgggcttcgacatgccggccaccccggtcaaggtcaagaacgtccccacccatgcggactacgaacagctcaagaccatggcgcagaccatcgccagggccctgaaggccaagctggccgcctag

SEQ ID NO: 45449 - protein, 402 aa, Desulfovibrio gigas
MQATKIIDGFHLVGAIDWNSRDFHGYTLSPMGTTYNAYLVEDEKTTLFDTVKAEYKGELLCGIASVIDPKKIDYLVIQHLELDHAGALPALIEACQPEKIFTSSLGQKAMESHFHYKDWPVQVVKHGETLSLGKRTVTFYETRMLHWPDSMVSWFADEKVLISNDIFGQNIAASERFSDQIPVHTLERAMREYYANIVNPYAPQTLKAIETLVGAGVAPEFICPDHGVIFRGADQCTFAVQKYVEYAEQKPTNKVVIFYDSMWHSTEKMARVLAESFRDEGCTVKLMWCKACHHSQIMSEISDAGAVIVGSPTHNNGILPYVAGTLQYIKGLRPQNKIGGAFGSFGWSGESTKVLAEWLTGMGFDMPATPVKVKNVPTHADYEQLKTMAQTIARALKAKLAA

SEQ ID NO: 45450 - DNA, 1176 bp, Methanococcus jannaschii
  CDS (1)..(1176)
gtggtgaaatatatggtgcttaaaataaaagataatatttactgcatgagttttatagaatggaaaattaaagagtataggggattagacattgaaaaagggactacatataactcatatctaatcttagataaaaacaatgttataatcgatactacaagaataaagtattttgatgaattattgtcatatttgaaagacgtagctaatttgaaattagattatattatctcaaaccatattagtcctgaccataacgaatgcatagaaaaacttattgagcttacagaagcgaagattgtgactacaaaaattagaaaatattatttagatgctcaatttaatacaaaagattgggaatttgtcattgtaaaaaatggagatgaattaaatattggaaatagaacattaaaatttataactgatgacaagtgtgaatatatgctaacatactgtgtagaagataaaattctgttttcaaatgatttatttagtcaacatgtggtttataaagagaaaatagacagtgatattggtcataaaattatgctggatgctaaggagtattttgccaatattttattaccatatagaaaaagcatcttaaaaattctaaatatcttgaaggatttggatttagagtatatatgtccatcacatggtgttatttggcatataatgattgatgaaattttaacaaaataccgtatgtggtgttctgattcatataaaaatactgcagtcattgtatatgcaactatatactcttcaacagaaaaaatagccaaagcccttggagagggattatctgaagaaggagttgatgtaatataccacagattagatacttccccattgaacattataatgagagatatcttagacgcaaaatacgtattggttggttctccaacaataaatatgaatgtgcatccaaaggttggaatgttattaacttatatagaaggattaaagccaagtaataaaaagattggcgtagcctttggctcctatggttggaaagaatgtgcgactaaaaaaataattgaggcttttaaaaggttagggtttaaaattgttgatgataagatattgacatttagatttgctccaaaagaaaatgatattaaaaaaattaaagagtttggtagaaagttagcaaaaattaacgtctaa

SEQ ID NO: 45451 - protein, 391 aa, Methanococcus jannaschii
MVKYMVLKIKDNIYCMSFIEWKIKEYRGLDIEKGTTYNSYLILDKNNVIIDTTRIKYFDELLSYLKDVANLKLDYIISNHISPDHNECIEKLIELTEAKIVTTKIRKYYLDAQFNTKDWEFVIVKNGDELNIGNRTLKFITDDKCEYMLTYCVEDKILFSNDLFSQHVVYKEKIDSDIGHKIMLDAKEYFANILLPYRKSILKILNILKDLDLEYICPSHGVIWHIMIDEILTKYRMWCSDSYKNTAVIVYATIYSSTEKIAKALGEGLSEEGVDVIYHRLDTSPLNIIMRDILDAKYVLVGSPTINMNVHPKVGMLLTYIEGLKPSNKKIGVAFGSYGWKECATKKIIEAFKRLGFKIVDDKILTFRFAPKENDIKKIKEFGRKLAKINV

SEQ ID NO: 45452 - DNA, 1182 bp, Methanococcus jannaschii
  CDS (1)..(1182)
gtgatcttaatggtattagaaataaaaaatggaatatactgggttggagtgattgattgggaaattagagattttcatggctatggaactccctacggatcaacctataactcttatttgataaaagataagaaaaatgttttaatagacactgcaaaggattacatgttcaatgaacttatttatggcatatcaaaatttatagatcccaaagatctcgattatattatagttaatcacgtagaaaaagaccacagtggttgtgttgataaattggttgagatcagcaatgccacaataataactaatgaaaagggaaaggagcatttatctctctactacgatacaaaagattgggattttatcattgtagatactggagatgagataaacataggagacagaactctaaagttcataagaactccaatgctccactggccagataatatgctaacttactgtaaagaagagaaaattttattctcaaacgatgcatttggacagcatatagcaagttctgagagatttgattacgagataggagaaggaatttttgaacatgcaaaggattatttcgctaatatattgatgccctataaaatgcttattcctgatgcaataaaagccgttaaaaacttagatattgagcttatttgcccttctcatggagtaatttggaaggaatacataaacgaaataattgaaaaatataacgaatgggcaatgaacaaaacaaagaataaggcagttattgtctatgatacaatgtataactcgaccaaaaaaatggctcatgcgattgctgaaggtttaatggagaaaggagtagaagtaaaaatttatagagtttgtgaaacctctctaagtagaataatgacagaaatcttagatgcaaagtatgttttagttggctcaccaactgtaaatagaaatctctacccagaagttggtaagttccttgcatacatggattgcattagaccactcgacaagatcggtgttgcctttggttcttatggttggatggaatgcgcaactgaaaaaattaaagagatattcaaaaacctgggctttaagatagttgatgatgaatgtttaacagtaagatttgctccaaaagaggaacatctaaaaaaatgttatgaatttggtaaaagattagcagatattggcttctga

SEQ ID NO: 45453 - protein, 393 aa, Methanococcus jannaschii
MILMVLEIKNGIYWVGVIDWEIRDFHGYGTPYGSTYNSYLIKDKKNVLIDTAKDYMFNELIYGISKFIDPKDLDYIIVNHVEKDHSGCVDKLVEISNATIITNEKGKEHLSLYYDTKDWDFIIVDTGDEINIGDRTLKFIRTPMLHWPDNMLTYCKEEKILFSNDAFGQHIASSERFDYEIGEGIFEHAKDYFANILMPYKMLIPDAIKAVKNLDIELICPSHGVIWKEYINEIIEKYNEWAMNKTKNKAVIVYDTMYNSTKKMAHAIAEGLMEKGVEVKIYRVCETSLSRIMTEILDAKYVLVGSPTVNRNLYPEVGKFLAYMDCIRPLDKIGVAFGSYGWMECATEKIKEIFKNLGFKIVDDECLTVRFAPKEEHLKKCYEFGKRLADIGF

SEQ ID NO: 45454 - DNA, 27 bp, Primer
atgtctattgtggtgaaaaataacatt

SEQ ID NO: 45455 - DNA, 25 bp, Primer
ttattttgcctccgatgccagttct

SEQ ID NO: 45456 - protein, 428 aa, consensus
  MISC_FEATURE (1)..(428): consensus for the disclosure of xaa see table XV
FXXXXXXXXXGXXXNXXXXXXXXXXXXXXXXXXXXDXXXXXXXXXXXXXXXXXXXXXXXXXXXXXXXXXHXEXDHXXXXXXXXXXXXXXXXXXXXXXXXXXXXXXXXXXXXXXXXXXXXXXXXXXXXXXXXXXXXXXXXXXGXXXXXXXXXXXXFXXXPXXHWPXXXXXXXXXXXXLXXXDXFGXHXXXXXXXXXXXXXXXXXXXXXXXXXXXXYXXXXXXXXXXXXXXXXXXXXXXXXXXXXXXXXXXHGXXXXXXXXXXXXXXXYXXXXXXXXXXXXXXXXXXXXXYXXXXXXXXXXXXXXXXXXXXXXXXXXXXXXXXXXXXXXXXXXXXXXXXXXXXXGXXTXXXXXXXXXXXXXXXXXXXXXXXXXXXXXXXXXXXXGXXXXXXXXXXXXXXXXXXXXXXXXXXXXXXXXXXXXXXXXXXXXP

SEQ ID NO: 45457 - protein, 9 aa, consensus
  MISC_FEATURE (1)..(9): consensus for the disclosure of xaa see table XV
GXXXNXXXX

SEQ ID NO: 45458 - protein, 16 aa, consensus
  MISC_FEATURE (1)..(16): consensus for the disclosure of xaa see table XV
XXXXXXXXXXXXXXXX

SEQ ID NO: 45459 - DNA, 3369 bp, Escherichia coli
  CDS (1)..(3369)
atgttaagggtctaccattccaatcgtctggacgtgctggaagcgttgatggagtttattgtcgaacgcgaacggctggacgatcctttcgaaccagagatgattctggtgcaaagtaccggtatggcacagtggctgcaaatgaccctgtcgcaaaagtttggtattgcggcaaacattgattttccgctgccagcgagctttatctgggatatgttcgtccgggtgttaccggaaatccccaaagagagcgcctttaacaaacagagcatgagctggaaactgatgactctgctgccgcaattgctggagcgcgaagactttaccctgttgcggcattatctgactgacgatagcgacaagcgaaaactgttccagctttcctcaaaagcggcggacctgtttgaccagtatctggtctatcgtccggactggctggcacagtgggaaacaggacatttggttgaagggctgggagaagcacaggcctggcaagccccgttgtggaaggcgctggtggaatatacccatcaactcgggcaaccgcgctggcaccgcgccaatctctatcagcgctttatcgaaacgctggagtccgcgacgacctgcccgccggggttaccttcgcgcgtctttatatgcggtatttccgcgttaccgcctgtttatctccaggcgctacaggcgctgggtaaacatattgaaatccatctcctgtttaccaacccctgccgttattactggggcgatattaaagatcctgcttatctggcgaaactgctgacccgtcagcgtcgacacagttttgaagatcgcgaattgccgctatttcgtgatagcgaaaatgccgggcagctctttaacagcgatggtgaacaggatgtcggcaacccgctgctggcttcatggggtaagcttgggcgcgactacatttatctcctttctgacctggagagcagccaggagctggacgcctttgtcgatgtcacgccagataacctgctgcataacattcagtctgacattctggaactggaaaaccgcgccgttgctggtgtgaacatcgaagagttttcccgtagcgataacaaacgcccgcttgatccactggatagcagtatcaccttccacgtttgccatagcccgcagcgtgaagttgaagttttacacgatcgcctgctggcgatgctggaggaagacccgacacttactccgcgcgacatcatcgtgatggtggctgatatcgacagctacagtccgtttattcaggctgtgtttggtagcgcacctgcggatcgttacctaccttacgccatttccgaccgtcgtgcgcggcagtcacatccggtactggaagcgtttatcagcctgttatcactgcctgacagtcgttttgtgtcagaggatgtgctggcgttgctggatgtgccggtgctggcggcgcggtttgacatcaccgaagaagggctgcgttatttacgccagtgggtcaacgaatccggcattcgttggggcatagatgacgacaacgttcgcgagctggaactccccgccaccggacaacacacctggcgatttggcctgacgcgtatgttgttgggctacgcgatggagagcgcgcagggcgagtggcaatcggttctaccttatgatgaatcgagcggcttaattgcagaactggtggggcatctggcttcactgctaatgcagctaaacatctggcgtcgcgggctggcacaggagcgtccgctggaagagtggttgccggtttgtcgcgatatgctcaacgccttcttcctgccggatgcggaaaccgaagcggcgatgacgctgatcgaacaacaatggcaggcgattatcgccgaaggtttaggtgcgcagtatggcgacgcggtgccgctgtcactattgcgtgatgaactggcacagcgtctggatcaagaacgtatcagccagcgttttctcgccggaccggttaacatttgtactctgatgccaatgcgttcaattccgttcaaagtggtttgcctgctgggaatgaacgacggcgtttatccacgtcagcttgcgccattgggctttgacctgatgagccagaaaccgaagcgtggcgaccgtagccgtcgcgatgacgaccgctatctgttcctggaagcgttaatttccgcgcagcaaaaactctatatcagctatatcggtcgttccattcaggataacagtgagcgtttcccgtcggtactggtgcaggaactgatcgactacatcgggcaaagtcattatctaccgggcgatgaagcgctcaactgtgatgaaagcgaggcaagggtaaaagcgcatcttacttgcctccatacccggatgccgtttgatccacaaaactaccagccaggcgaacgacaaagctatgctcgtgaatggctacctgcggccagccaggctggtaaagcacattctgaatttgttcagccgctgccgtttaccttaccggaaaccgtgccgctggaaacgctacaacgattctgggcacatccggtgcgggcatttttccagatgcgtttgcaggtgaacttccgtactgaagacagcgaaatccccgacaccgagccatttattctggaaggacttagccgttatcaaatcaatcagcagttattgaatgcactggttgagcaggatgatgccgaacgcttgttccgccgcttccgagcggcaggggatttaccgtatggcgcttttggtgaaattttctgggaaacacagtgccaggagatgcagcagcttgccgacagagtcattgcctgtcgccagccggggcagagtatggaaattgatctcgcctgcaacggtgtgcagataactggctggttgccgcaggtgcagccggatggcctgttgcgctggcgtccctctttattaagtgtggcccagggaatgcaactttggctggaacaccttgtctactgtgccagcggtggtaatggtgaaagtcgcctttttctacgcaaagacggcgagtggcgttttccgccgcttgcagccgaacaggctttgcattacctctcacaactgattgaggggtatcgtgaaggaatgtccgcgccattgctggtgttacctgaaagtggcggcgcgtggctaaaaacctgttatgacgcgcaaaacgatgccatgctggatgacgattccacgttgcaaaaagcccgtacgaaattccttcaggcttacgaaggcaacatgatggtgcgtggcgaaggtgatgatatctggtatcaaaggctctggcggcaattaacaccagagacaatggaggccatcgttgaacagtcgcaacgtttcctgttaccgctgtttcgctttaatcagtcatga

SEQ ID NO: 45460 - protein, 1122 aa, Escherichia coli
MLRVYHSNRLDVLEALMEFIVERERLDDPFEPEMILVQSTGMAQWLQMTLSQKFGIAANIDFPLPASFIWDMFVRVLPEIPKESAFNKQSMSWKLMTLLPQLLEREDFTLLRHYLTDDSDKRKLFQLSSKAADLFDQYLVYRPDWLAQWETGHLVEGLGEAQAWQAPLWKALVEYTHQLGQPRWHRANLYQRFIETLESATTCPPGLPSRVFICGISALPPVYLQALQALGKHIEIHLLFTNPCRYYWGDIKDPAYLAKLLTRQRRHSFEDRELPLFRDSENAGQLFNSDGEQDVGNPLLASWGKLGRDYIYLLSDLESSQELDAFVDVTPDNLLHNIQSDILELENRAVAGVNIEEFSRSDNKRPLDPLDSSITFHVCHSPQREVEVLHDRLLAMLEEDPTLTPRDIIVMVADIDSYSPFIQAVFGSAPADRYLPYAISDRRARQSHPVLEAFISLLSLPDSRFVSEDVLALLDVPVLAARFDITEEGLRYLRQWVNESGIRWGIDDDNVRELELPATGQHTWRFGLTRMLLGYAMESAQGEWQSVLPYDESSGLIAELVGHLASLLMQLNIWRRGLAQERPLEEWLPVCRDMLNAFFLPDAETEAAMTLIEQQWQAIIAEGLGAQYGDAVPLSLLRDELAQRLDQERISQRFLAGPVNICTLMPMRSIPFKVVCLLGMNDGVYPRQLAPLGFDLMSQKPKRGDRSRRDDDRYLFLEALISAQQKLYISYIGRSIQDNSERFPSVLVQELIDYIGQSHYLPGDEALNCDESEARVKAHLTCLHTRMPFDPQNYQPGERQSYAREWLPAASQAGKAHSEFVQPLPFTLPETVPLETLQRFWAHPVRAFFQMRLQVNFRTEDSEIPDTEPFILEGLSRYQINQQLLNALVEQDDAERLFRRFRAAGDLPYGAFGEIFWETQCQEMQQLADRVIACRQPGQSMEIDLACNGVQITGWLPQVQPDGLLRWRPSLLSVAQGMQLWLEHLVYCASGGNGESRLFLRKDGEWRFPPLAAEQALHYLSQLIEGYREGMSAPLLVLPESGGAWLKTCYDAQNDAMLDDDSTLQKARTKFLQAYEGNMMVRGEGDDIWYQRLWRQLTPETMEAIVEQSQRFLLPLFRFNQS

SEQ ID NO: 45461 - DNA, 3375 bp, Pasteurella multocida subsp. multocida str. Pm70
  CDS (1)..(3375)
gtgtttacaatttattattctaatgatcttgatgtacaaaaaaatattttgctcacgttaatgcaagatacactggatgatccctttcagtcagacgtgattttagttcaaagtccaggcatggcacagtggttgcaatggaaaattgcggagcagcaagggatttcgagtaatattaagtttcctatgcctgcgagctttatttggcaacaatacgtagacaatttaccgaatacagaggaacaaagccaatttaataaagcgtcgatgacatggcgtttaatgcgtttaattcccgaacatcttgaacaagtcgaatttcaatcacttcgtcattatttatcttcttctcatcaaacagaacaacaaaagttgtaccaattagcctaccaaattgctgatttatttgaccaatatcttgtttaccgcccagaatggatcgcttgttgggagcgtggtgatgaagccactatgatggcacagttagaacgcaagctaaaagatacacgcctaccaataggcaacgctttttctcaagatgttaaatggcaagcgatactatggcgtgctctagtggcggatattttggctgaaagcggtcagactgttcccttacatcgtgcttatttacaaacacaatttttgcagttcttacagacccagcatcctgtcaatttacctccacgtcttttcatttttggtatctcagcgttgccaaaaggctatttagaaattttttatgccatgagtcagtattgtgaagtacatttattttttaccaatggctgtcgtgaatattggggtgatttaattgatccgcgttttatgcaacgcttaagccaaatgcaacgaactggctaccataccgctttacctatacctgtttttcaccatacagataatgcccgatttgaatcaagttatgatcatgagcatttatttgaggggcatcctttgctgtcaagctgggggaaattgggacgagattttttatatttattaacagaattagaacagctcgaaggcgtacgaagtattgatgcgtacaccgagttaacttcccaacatctcttatctcaggtacaagcgcgtattttacatttagaaggcaagcaaggtttaaatttggctgaaaatgaccgctctttaacgttccattcttgccatagccctatgcgtgaagttgaagttttacatgactatttgcttcatttatttcagcaagactcgacacttactccaaaagatattgtggtgatggtagcggatattgataaatatacaccctatattcaagctgtatttggacagtacaatcaggtcgcacagcggcagattcctttttctatttcggataaccgtctttctgaaaatgacgtgttaatagcaagttttattcacttacttgctttaaaagagagtcagtttagcgcagaagatatcttagctttattagatattcctgcgattcggaataggtttcagattgagttaatggagttagagcagattcggcattgggtcgcacatgctggcatacgttttggtgtagaaaaagaacaaggtaaacaagaaaagaacactaactcatggcaagctgggctggagcggatgctgcttggttatgcgatgcgtgaggaaaatgggatttggcaagggaatttaggctttgatccttgttatggactacaagggcaattagccggacgcttggcggagtttattgcaagattatcagcatggtatcagtttttacaaacgcctcagcctattgaaaaatggcaacagcatttacttacgcttttaacagatttcttcgctgaggatgaaacgaatattaccactttgcgatatattcaagaaacgatagtgcaaatggtaacagatattcaacaaacacattttgatcaaccgttaagtagtgaagtggtttctgatgtcctgtcggcattattagaagatgatccgaatagcatgaagtttctggcagggaaagtgaatttctgcaccttgctaccgatgcgttcgattccctttaaagtagtgtgtttactggggatgaatgaaggtgattatcctcgtcaacaaacgccaaatagctttgatttgatgcaatatgatcgacgtaaagccgaccgttttcgccgtgacgatgattgttatttgttccttgaagcgctgctgtcagcacaagaggcattttatgtgagttttgtgggacgttccattgtggataaccaaagcaaacctccgtctgtgttagtcagtcaattgattgactatttagtagataagttatcaagcgctgaaacacaagattggcaggctcgattaattgaacagcatccgatgacagcatttagtccagataatttccgaggagaaaacggatcttttgctaaccaatggttacccctagcaaatattcagaaacaagagagggcggattttgtccaacctatcgcacaaacagtgttagccgaggatcgtgaaattgtgttagcggatttaattgcctttattcagcaccctgttgcgtttttctttaaacgtcatttaggcgtttcttttgctaaacaagaagaacgtattgaagacagcgaaaattttactttagatggcttaatgcgctatcaaattaatgagcaattgctttattgtgatgaggaaaaaagcgcggaggttctcgctcaattaaaagtaaaaggtatgctaccgcgtggtgaatttgcccagatctttgcgttacaacaacaagaagacattgccgcgttaaaaacaaccgttgccgattatttaaaacaagaggcgcatgtcgtcgaagtggatttgactatcccgagtggctatggcgatattcgtctgattgggctgctagatcagttgtatgcacagcgtagagtgatgtggcgagtgggacaaattcaggaaaaacatttaattgaaaattgggtgtattaccttattcaatgtgcaatgttagcacagcatgaacctcctatttattatggtaagaatgggcaagcgacctttcaagcgttgtgtgctagcgagtcgttaagtgtaaaagaaatcgcgttagcacaattacaaatctatgttgaaagttatttgcagggctatcagcagatgcaaatggttccgatgaaaaatattcaacgttatttagaagcatatggacatactgagacgccagattttgagatgattcggacattgttacatcatctagcggaaggggattatgcttcggatggggatatttattggcaacgagtacttgcacaacaagtactcgatgaggagaggctcaacgcgataggcgaacggacaacatcgtggtttaagcttatgtttgagcagcttgaaaaatag

SEQ ID NO: 45462 - protein, 1124 aa, Pasteurella multocida subsp. multocida str. Pm70
MFTIYYSNDLDVQKNILLTLMQDTLDDPFQSDVILVQSPGMAQWLQWKIAEQQGISSNIKFPMPASFIWQQYVDNLPNTEEQSQFNKASMTWRLMRLIPEHLEQVEFQSLRHYLSSSHQTEQQKLYQLAYQIADLFDQYLVYRPEWIACWERGDEATMMAQLERKLKDTRLPIGNAFSQDVKWQAILWRALVADILAESGQTVPLHRAYLQTQFLQFLQTQHPVNLPPRLFIFGISALPKGYLEIFYAMSQYCEVHLFFTNGCREYWGDLIDPRFMQRLSQMQRTGYHTALPIPVFHHTDNARFESSYDHEHLFEGHPLLSSWGKLGRDFLYLLTELEQLEGVRSIDAYTELTSQHLLSQVQARILHLEGKQGLNLAENDRSLTFHSCHSPMREVEVLHDYLLHLFQQDSTLTPKDIVVMVADIDKYTPYIQAVFGQYNQVAQRQIPFSISDNRLSENDVLIASFIHLLALKESQFSAEDILALLDIPAIRNRFQIELMELEQIRHWVAHAGIRFGVEKEQGKQEKNTNSWQAGLERMLLGYAMREENGIWQGNLGFDPCYGLQGQLAGRLAEFIARLSAWYQFLQTPQPIEKWQQHLLTLLTDFFAEDETNITTLRYIQETIVQMVTDIQQTHFDQPLSSEVVSDVLSALLEDDPNSMKFLAGKVNFCTLLPMRSIPFKVVCLLGMNEGDYPRQQTPNSFDLMQYDRRKADRFRRDDDCYLFLEALLSAQEAFYVSFVGRSIVDNQSKPPSVLVSQLIDYLVDKLSSAETQDWQARLIEQHPMTAFSPDNFRGENGSFANQWLPLANIQKQERADFVQPIAQTVLAEDREIVLADLIAFIQHPVAFFFKRHLGVSFAKQEERIEDSENFTLDGLMRYQINEQLLYCDEEKSAEVLAQLKVKGMLPRGEFAQIFALQQQEDIAALKTTVADYLKQEAHVVEVDLTIPSGYGDIRLIGLLDQLYAQRRVMWRVGQIQEKHLIENWVYYLIQCAMLAQHEPPIYYGKNGQATFQALCASESLSVKEIALAQLQIYVESYLQGYQQMQMVPMKNIQRYLEAYGHTETPDFEMIRTLLHHLAEGDYASDGDIYWQRVLAQQVLDEERLNAIGERTTSWFKLMFEQLEK

SEQ ID NO: 45463 - DNA, 3366 bp, Xylella fastidiosa 9a5c
  CDS (1)..(3366)
atgtcccagatgatggtcaccactgactttcgcctataccactccaatgcactcgacgttctggcgggattgctggccgaaacgttgcggtccccggtgccgggccagtcgttgttggtcccagacataatattgattccacaagcggccatgcggcgttggttgcaagccacgttggccaccacgcatggtgtcgtggccaatctggaatttttgactccgggcgagttcgttgcccgtgcattggatgccaatcttggtgccgtgccgaacgctttggatacggccgtgttgcattggcgactatatgcagcgttgtgcgatccagcattactgacgcaaccagcgcttgctgaattacatgcttacctggcggatggcgacctcttcaaaccttggacattggccgaagcactgagtgcggcattcgaaaaataccaggcttggcgttgcgactggttgctacgctgggaggcgggcgcagatccggacgatccacaggccatcctatggcggcatagtgtcaacggtgccacgcaccgcgcacgccgcatccacgactacctgaaccgttatgggtcagggacagaacaccccccccaaggactgccagcgcgactctttattttcgccaccctcaacatctccccagatgtattacgtgtcctggcgacccaggcacaggttggcacactgcacttttacctgccgaccccgaccaaagaatattggggtgatgcgcaacccttcacgcaacgcttgcatcagcccaccgactgcgtcacccagaccggagaaaaccgcctactccatgcctggggtgctgccgggcgtgatttcatgactgtgttggggagctacgaagtcgtccatccctccggcgaaatcaccgcatacgatgatccggaacaacgtctaggcaccaccctggatgaaggcggcctgcgcgatagcctattgcagcgcatgcatgcggatctattccataaccgttcggcacccgtccccgcccccttgcccgcaccacgtctggaagatcccagtctccagtttcacgcctgtcatacccgactgcgtgaactccaggtccttcatgaccggctccgtgccttgctggaacctaactcaccggagggccagcgttttaaccctcccttacaaccgcgtgagattgccgtattggcaccggacatcgacctctacatcccctatctagaagccgtgttcggtggacacgcccatagcgaccccttgccatacacactggctgatgccagcccactgattgatgaaccgctggctgaagtcttcttgcgtctcctcgacttgcccctatcccgctttggcctgcacgaaatattggacctcctggccatcctgccgatggccacccttgctggctttgacacacagaccttagagagcctacggagctggctgaccgccgccggcgcacgctggggattggatgctgcccaccgtgccgaacaccaagccccggctgacgacgcctacacctggagctttgcactggaccgcctcctcctgggtcacgccagcggcgcagatgccgatattgctggcgtcgctgcttggccggatctggaaggcagcatgctgaccgcattggacaccctgatccgattactgcgcgtcctcgccaatacccgacaacgcctgagtgaggccctattaccgacacagtggcgagaacgcttactgagcctgcttgatgcactcctgcctgacatccccaccgcaccatccggtatccagcgtcccttagaacgcttacgcagactgatcgacaccttcgccaccgatgccacacgcgccggagtggccttacccgtgccagccgaagtcgtgcgtatgcactttgccgctttactgggcgacactgatacccgcgccccactgctcacaggtggcatcagtattggccgcatggttcccatgcgactgctccccttccgcgtcatttgtttattaggcatgaacgacggcgacttcccgcgccgcgatcctgcggctggcctcaatcgcctcaccgccgaacttggcaccgcacagcgtcgccctggtgatcgctcccgacgtgatgacgactgcctcctatttctacagctattcagcgccgcccaagacgtcttctacgtcagctaccttggcgctgatcctcacgacggcagcctacgcgaaccctcaccgctgctcacagaactacttagcaccgcagtcacctaccatgccgaccccagtacagccgccaaaacactgctattgcggcattcattacagccattctcccccactgcctttggcgccgacggcgacccacgccgattcagctaccaccccttatggcatgccgccgccgcgagtattgaaggacagcgccaccctctggacccctggtgtccccgccgactcccagcgcttcccgaccccgaacccgccctgccactgcacagcctgcggcgcttctttagcgcccctgcagaacagtttctacaacagcgcctgggcctacgcctgcccgaaccccctcagaccaccgatgaatgcgaccccctctggcttcccagccacggcctggaacgccatcgactcgacaccctgatatttgcctccctactccatgaggctgacgacaccctctacccacaactacgcgcccgtgcattactcccctcaggtcccttaggccgacagcaactccacgaacgcattgaacacctgcgcccctatgcccaagcatttgcacactggcgcggtaccgcccccccgcagtcccagtaccttgaagtgatgatcgacggcattcgtctccacgcacacattcaggacctctacccccacggaatcgcccgcctgcgcctgggtccccctaacggccccgcggtactgcgccacggattagattggctgctggccagcgccgccggccacccctggcccctggtccgctttgaagatgcaggcgttgcgggcctaggtccccatctacagccatccttgcccagttcccaagcacagaccgcactgagcctactcctccgcctgcgcacggctggcctgcgccagcccctaccctttgccccctacagcgcctgggagtactacacccagcgcgacacccccgaacgtgccttgcagaccgcccgcgcccgctggcgtggtaacgaccaccaatggggcgaaagcaaccatgcagcgatccaattagcactgcgtaaccacgatccctttgccaccccgcagaccgctgcccactttgcacagctcgcaacactgatatttgacctactcaccaccggtcaggccgacccagaacccttgacctggctgcaactgcacccatga

SEQ ID NO: 45464 - protein, 1121 aa, Xylella fastidiosa 9a5c
MSQMMVTTDFRLYHSNALDVLAGLLAETLRSPVPGQSLLVPDIILIPQAAMRRWLQATLATTHGVVANLEFLTPGEFVARALDANLGAVPNALDTAVLHWRLYAALCDPALLTQPALAELHAYLADGDLFKPWTLAEALSAAFEKYQAWRCDWLLRWEAGADPDDPQAILWRHSVNGATHRARRIHDYLNRYGSGTEHPPQGLPARLFIFATLNISPDVLRVLATQAQVGTLHFYLPTPTKEYWGDAQPFTQRLHQPTDCVTQTGENRLLHAWGAAGRDFMTVLGSYEVVHPSGEITAYDDPEQRLGTTLDEGGLRDSLLQRMHADLFHNRSAPVPAPLPAPRLEDPSLQFHACHTRLRELQVLHDRLRALLEPNSPEGQRFNPPLQPREIAVLAPDIDLYIPYLEAVFGGHAHSDPLPYTLADASPLIDEPLAEVFLRLLDLPLSRFGLHEILDLLAILPMATLAGFDTQTLESLRSWLTAAGARWGLDAAHRAEHQAPADDAYTWSFALDRLLLGHASGADADIAGVAAWPDLEGSMLTALDTLIRLLRVLANTRQRLSEALLPTQWRERLLSLLDALLPDIPTAPSGIQRPLERLRRLIDTFATDATRAGVALPVPAEVVRMHFAALLGDTDTRAPLLTGGISIGRMVPMRLLPFRVICLLGMNDGDFPRRDPAAGLNRLTAELGTAQRRPGDRSRRDDDCLLFLQLFSAAQDVFYVSYLGADPHDGSLREPSPLLTELLSTAVTYHADPSTAAKTLLLRHSLQPFSPTAFGADGDPRRFSYHPLWHAAAASIEGQRHPLDPWCPRRLPALPDPEPALPLHSLRRFFSAPAEQFLQQRLGLRLPEPPQTTDECDPLWLPSHGLERHRLDTLIFASLLHEADDTLYPQLRARALLPSGPLGRQQLHERIEHLRPYAQAFAHWRGTAPPQSQYLEVMIDGIRLHAHIQDLYPHGIARLRLGPPNGPAVLRHGLDWLLASAAGHPWPLVRFEDAGVAGLGPHLQPSLPSSQAQTALSLLLRLRTAGLRQPLPFAPYSAWEYYTQRDTPERALQTARARWRGNDHQWGESNHAAIQLALRNHDPFATPQTAAHFAQLATLIFDLLTTGQADPEPLTWLQLHP

SEQ ID NO: 45465 - DNA, 3372 bp, Yersinia pestis CO92
  CDS (1)..(3372)
atgttcacggtttatcattctaatcaactggatttactcaaagcgctcaccactgcgctgatagaaagagaaccgttggataatcctttccagcaagaagtggtgttagtacaaagccccggcatggcccaatggttacaaatgcaactggctcaacagttcagtattgctgccaatatagtgtttcctctacccgctacttttatctgggatatgtttacccgcgttctgcctgatattcctaaagaaagtgcattcagcaaagaggctatgacatggaaacttatgtggctactgccagatttattggagaatccactattttctcccatgaagcgctatttaagtgatgatggggatcggcgtaaaattcaccaactcgcggcacgggtagccgatctttttgaccaatatctggtgtatcgtccggaatggctggaaagttgggaacgtgggcaattgattgaggggcttgatgatgcacagcaatggcaagcattactgtgggttgaactgacccgctatactcgccaattggaacaaccggaatggcaccgggcaaacctctatcagcgttttatccaccaactactcaagtcggacgtttgcccgcaagggttaccgaaacgggtatttatatgtggtatatcggcgttgccacctatctatttacaggccctacaagcattaggtaaacacattgatatccatttgatgtttactaacccctgccgttacttctggggagatattcaggattacactttcctcgctaaattacaaagccgtaaacgtcggcattaccgtgaatcgattgaactaagtctgtttcgccacccgcagcaggcagagcaactatttaataccgatggtgagcagaacctcagtaacccactcttggcctcatgggggcgattagggagggatcacatgtatttgctctctcaaattgatgaaattcaagaggttcatgcttttgtcgatatcgagccagataatcttttgcatggcattcaacacgatatgctggagttggaagatcacgcggttattggcacaaccccagaaaccttagcgcgtagtgatcaaaaacgccgattagatctggatgatcgttcacttagtttccatgtctgccacagcccacaacgagaagttgaggtgctgcaagatcatttacttgggctattagccgcagaccctgaattgaccccgcgcgacatcattgtgatggtggtggatatcgacagttatacaccgtatattcaagctgcgtttggtaatgctccgtctgagcgttatctgccgtttgcgatttctgatcgcaaagccagtcaggctcatcctgcgttgcacgcctttattaccctacttgatttaccccagagtcgctttacggctgaacaagtcttagcactgttggaagtccctgctttggcgaccaaatttggtatcactgaagatggtttacggcgcctgcgacaatgggttggtgagtcaggcatccgttggggattggatgatgataatgtgcgggagctatccttacctgctacgggtcaacacacctggcgttttggtttgacccgcatgctactgggttatgcgatggacagtaccgcaggggattggcaaggtattctgccttacgatgaatccagcgggctggcagcggaactcgccgggcagttggccgatatgctgatgcacctgagtcaatggcggcaacaattaggtcagccccgagaacttagtgaatggttaccaatatgtcgtcaattattggatacgttcttcgatcaagacaatgacactgaggccgctctggtgctgattgaacaacagtggcagaaagtgatcggctacggtattgcagcccaatatccagacgttgtgccacttaatctgctacgagacgaattggcggcacgtttagataatgaacgtattagccaacgttttctcgccgggcctatcaatttctgtaccttaatgccaatgcgctccatcccatttaaagtggtttgtctattgggcatgaatgatggggtatacccgagaacattgcccccccagggatttgatctaatggccaagaaggttcgtcggggtgaccgtagccgccgcgacgatgatcgctatttgttcctagaggctctgctatctgctcagcaacagctttatatcagctacattgggcgttctattcaagacaacagtaagcgttatccttccgtgctggtaagcgagttaattgaatatgtcgcacaaagctatcatttaccgggcgatgaaaaactcagtgctgatgacagtgcacaacgggtgacgcagcacttattatgttggcatgcccgtatgccattctccgctgaaaattttattaaaaatagcgaattacagagctatgccgctgaatggctgccttctgccgagtcgaaggggcatgcacacccaaattttaaccaaccgctacaggctgagccgctggctgaaattacactggatgaattagtgcgtttttaccgccatccagtgagagcatttttccaactgcggctaggggttaattttgttattgaagaaacagaattacctgacgaagagccatttactttggataaccttagccgttatcaatttaatacccagctacttaatgcgctgataaatgaggacgatattaatagcgtctttgccagagccagagctgccggcgtactgccatatggatcttttggtgaactttattgggagagtcaacaagatgagatggtacccttggctgaacaaatccgcagtgaacgtaaagagaatcacagtattgaactcaacattgaattcgctgacatcacggttacgggatggattcatcaggttcaggacgatggtttggtccgttggcggccatcaatattaaccgccgtcgatggccttttattgtggcttgaacatctcgtgtactgttcggcgggtggtgagggagaaagccggatatatggacgaaaagggactgcctggcgttatgcccctatggcggctgatgaagcccggccctatttacaacaactcattaaaggttatcaacaaggtttatgtgagccattgatgctcttgagtaaaagtggatgggcgtggttgagccaatgctttgatcgtgagtcaggccaaattttgtgggacgaagagacgcaaggtaaagcacggatgaaacttttacaggtttggcaaggtgatcagagagtgacaggcgaaggtgaagaccactatatacaaagggtttgcagacgaatggacaaccaacatttggacataattttacatgaaactgaacgttatttgttaccgatagctcgccataataaggcgtga

SEQ ID NO: 45466 - protein, 1123 aa, Yersinia pestis CO92
MFTVYHSNQLDLLKALTTALIEREPLDNPFQQEVVLVQSPGMAQWLQMQLAQQFSIAANIVFPLPATFIWDMFTRVLPDIPKESAFSKEAMTWKLMWLLPDLLENPLFSPMKRYLSDDGDRRKIHQLAARVADLFDQYLVYRPEWLESWERGQLIEGLDDAQQWQALLWVELTRYTRQLEQPEWHRANLYQRFIHQLLKSDVCPQGLPKRVFICGISALPPIYLQALQALGKHIDIHLMFTNPCRYFWGDIQDYTFLAKLQSRKRRHYRESIELSLFRHPQQAEQLFNTDGEQNLSNPLLASWGRLGRDHMYLLSQIDEIQEVHAFVDIEPDNLLHGIQHDMLELEDHAVIGTTPETLARSDQKRRLDLDDRSLSFHVCHSPQREVEVLQDHLLGLLAADPELTPRDIIVMVVDIDSYTPYIQAAFGNAPSERYLPFAISDRKASQAHPALHAFITLLDLPQSRFTAEQVLALLEVPALATKFGITEDGLRRLRQWVGESGIRWGLDDDNVRELSLPATGQHTWRFGLTRMLLGYAMDSTAGDWQGILPYDESSGLAAELAGQLADMLMHLSQWRQQLGQPRELSEWLPICRQLLDTFFDQDNDTEAALVLIEQQWQKVIGYGIAAQYPDVVPLNLLRDELAARLDNERISQRFLAGPINFCTLMPMRSIPFKVVCLLGMNDGVYPRTLPPQGFDLMAKKVRRGDRSRRDDDRYLFLEALLSAQQQLYISYIGRSIQDNSKRYPSVLVSELIEYVAQSYHLPGDEKLSADDSAQRVTQHLLCWHARMPFSAENFIKNSELQSYAAEWLPSAESKGHAHPNFNQPLQAEPLAEITLDELVRFYRHPVRAFFQLRLGVNFVIEETELPDEEPFTLDNLSRYQFNTQLLNALINEDDINSVFARARAAGVLPYGSFGELYWESQQDEMVPLAEQIRSERKENHSIELNIEFADITVTGWIHQVQDDGLVRWRPSILTAVDGLLLWLEHLVYCSAGGEGESRIYGRKGTAWRYAPMAADEARPYLQQLIKGYQQGLCEPLMLLSKSGWAWLSQCFDRESGQILWDEETQGKARMKLLQVWQGDQRVTGEGEDHYIQRVCRRMDNQHLDIILHETERYLLPIARHNKA

SEQ ID NO: 45467 - DNA, 3405 bp, Xanthomonas campestris pv. campestris str. ATCC 33913
  CDS (1)..(3405)
atgcatgccacgtccgcgcccgatttccgtctgtacccgtccaacgcgctggataccctggccgccttgctcgccgaagaactgcgccggccggtgccggaacaaccggtgttgcagccggaggtggtgctgattccgcaggtggcgatgcggcgctggctgcagtccacgctggcggccgagcacggggtggcggcgaatctggaattcctcacgcccggcgaattcgtcgcgcgcgcgctggagcgcaatctcggcccggccgacgacgacctggacatggccaccacgcagtggcgcctgtaccagaccctgcaaggcgagctgggcagcgatgcggcgttggcgccgttggccgggtatctggccgatggcgatgcgctcaagccgtgggcgctggccggcgagctgggcagcgtgttcgagaaataccaggcctggcggcgcgactggttgctgcgctgggaaagcggtgccgacgcggacgacccgcaggcgcggctgtggcgcagcatcgccggcgggcggcagtaccgtgcgcgccgcatcggccagtatctggaccgttatgcgcgcccggacggcccgctgccgcagggtttgccgaagcggttgtttgccttcgccatcctcaatgtgtccccggacgtgctgcgcgtgctggccacgcaggcgcgggtgggtacgctgcatttctatctgcccacgcccacgcaaggctattggggcgatctgcagacgctgtggcagcgccgccgcgagggcggggcggtggcgttgttcgccgagcaggtgcaggaaaacccgttgctgcaggcctggggcgcggccgggcgcgatttcatggcattggtcggcgattacgaagtggtgcacccgctggccgagatcgccgcctacgccgacccgctggacgccggccgtcgcacgctggccgagggtggcctgggcgacagcctgctgcggcgcatgcagagcgacctgttccatcgccacgccccggccgtgccgcccgtgttgccggcggtgaacctgcacgaccccagcctgcaggtgcacgcctgccacacgcggttgcgcgagctgcaggtgctgcacgaccaactgcgcgcgttgctggacgatgcgcgcttcgacccgccgctgcagccgcgcgagatcgcggtgctgtcgccggacatcgacccgtacgtgccgtatctggacgcggtgttcggtggccatggcagcgatgacgggctgccgtacgcactggccgacgccagcccgctggccagcgagccgttggccgatgtgttcctcaccttgctgggcctgccgatttcgcgctttggcctgcacgagatcctggacctgctggccagtgcaccgatcgccgaggccgccgggctggacgaagccgggctggagcgcctgcgtggctggctgcacggcgccggcgcgcgctgggggctggatgcggtgcaccggcgccagcaccaggcgcctggcgacgatgcctacacctggcgctttgcgctggaccgcctgctgctcggccatgccagcggtgccgaggacgacatcgacggcgtggcgccctggccgcagctggaaggcagcgcgctggccgcgctggacaccttgctgcggctgctgcgcgtgctcgatcgccaccaggccgcgctggccgaggcgatgacgccggtgcagtggcgcgaatgcctgctcggcctgctggaggcgctgatcccggccgccccctcggcgccgcgggcgcagcgcgcgctggagcggctacgtaccttgatcgaccagttcgcccgcgacgcggtgcgcgccgagtacgccggcaacgtgccagccgaggtggtgcgtgcgcactttgccgcggtgctgggcgagtcggacacgcgcgcgccgctgctcaccggcggcatcagcttcggccgcatggtgccgatgcgcctgctgccgttccgcgccatctgcctgctgggcatgaacgatggcgacttcccgcgccgcgacccggctgccgggctcaatcgcctcaccgccgaactgggcaccgagcgccgccgccatggcgaccgctccacccgcgaagacgatcgctttttgttcctgcagttgttcgcctccgcgcaggaggtgttctatctcagctatctcggtgccgatgcgcgcgatggcacggtgcgcgaaccctcggtgctggtgagcgagctgctgggcagcgccgcgcagtaccacgccgatccaaaggcgatcgatgcgctggtggtgcgccacccgttgcagccgttcgctgccgccgcgtttggtgcggtgggcgaagacggtgccgacccgcgccgtttcagctaccgccggcaatggcggccggcggtagacagcctggccgggcaacgccagccgctggcgccgtgggtggccggtgcgttgccggccgacgccagcgtattgccggccagtgtctcgatcgacgacctgcgccgcctgttcgccgacccggccgggcagttcctgcgccatcgcctgggcatgcggctgccggacccggctggcgaagacagcgacctggagccgctgctggcgcccacccgcgggctggagcagtacggcttgcagcagcaggtgttcgaagccgccttggcgggcgatgccgacggcctgtacgagcgcttgcgtgcgcgcgcactgctgccatcgggcccattggggcggcgccagctcgatgagcgcctgcgtcagctgcgcccgtatgccgacgtatttcggcagtggcgtggcgaggcaccggcgcagtcgcagcggctgcaggtggagatcgacggtaccaacgtccacggccgcgtgcccgggtggtatgcgaacggggtagggcgtgtgcaggtgggcgcgctcagcggccgcagcgcgattcgcgacggcctggaatggctgctgctgcgcgcggccggcgagcgcgtgccgttcgtgcgtttcttcgagcacgacgacagcctgggcccgcatccgatcgaccccgagccgctgtcgcagacgcaggcacgcgcggccctgggcgaattgctgcagctgtaccggcaaggcctgcagacgccgctggcgttcgcgccgtacagcagctggaaataccaccaggccgcccgcaacgacgaactggacaaggccatcaaggacgcgcacggccagtggcaatcgagtttcggctggagcgaatcgcacagcccggagctgcgcctggtcacccgtggccgcgacccgttcggtgatgcgcagcagttcgttgacttcgcccgcaccagccatcagctgttcgcgctgctcgaagacggcagcgcgccggcaccgctggatcccgcgcgcgtgatcgagagctggcgccagtggcgtggcgcgcaggacgacgccgaatga

SEQ ID NO: 45468 - protein, 1134 aa, Xanthomonas campestris pv. campestris str. ATCC 33913
MHATSAPDFRLYPSNALDTLAALLAEELRRPVPEQPVLQPEVVLIPQVAMRRWLQSTLAAEHGVAANLEFLTPGEFVARALERNLGPADDDLDMATTQWRLYQTLQGELGSDAALAPLAGYLADGDALKPWALAGELGSVFEKYQAWRRDWLLRWESGADADDPQARLWRSIAGGRQYRARRIGQYLDRYARPDGPLPQGLPKRLFAFAILNVSPDVLRVLATQARVGTLHFYLPTPTQGYWGDLQTLWQRRREGGAVALFAEQVQENPLLQAWGAAGRDFMALVGDYEVVHPLAEIAAYADPLDAGRRTLAEGGLGDSLLRRMQSDLFHRHAPAVPPVLPAVNLHDPSLQVHACHTRLRELQVLHDQLRALLDDARFDPPLQPREIAVLSPDIDPYVPYLDAVFGGHGSDDGLPYALADASPLASEPLADVFLTLLGLPISRFGLHEILDLLASAPIAEAAGLDEAGLERLRGWLHGAGARWGLDAVHRRQHQAPGDDAYTWRFALDRLLLGHASGAEDDIDGVAPWPQLEGSALAALDTLLRLLRVLDRHQAALAEAMTPVQWRECLLGLLEALIPAAPSAPRAQRALERLRTLIDQFARDAVRAEYAGNVPAEVVRAHFAAVLGESDTRAPLLTGGISFGRMVPMRLLPFRAICLLGMNDGDFPRRDPAAGLNRLTAELGTERRRHGDRSTREDDRFLFLQLFASAQEVFYLSYLGADARDGTVREPSVLVSELLGSAAQYHADPKAIDALVVRHPLQPFAAAAFGAVGEDGADPRRFSYRRQWRPAVDSLAGQRQPLAPWVAGALPADASVLPASVSIDDLRRLFADPAGQFLRHRLGMRLPDPAGEDSDLEPLLAPTRGLEQYGLQQQVFEAALAGDADGLYERLRARALLPSGPLGRRQLDERLRQLRPYADVFRQWRGEAPAQSQRLQVEIDGTNVHGRVPGWYANGVGRVQVGALSGRSAIRDGLEWLLLRAAGERVPFVRFFEHDDSLGPHPIDPEPLSQTQARAALGELLQLYRQGLQTPLAFAPYSSWKYHQAARNDELDKAIKDAHGQWQSSFGWSESHSPELRLVTRGRDPFGDAQQFVDFARTSHQLFALLEDGSAPAPLDPARVIESWRQWRGAQDDAE

SEQ ID NO: 45469 - DNA, 3198 bp, Chlorobium tepidum TLS
  CDS (1)..(3198)
gtgcttgaaatttacaccagcaatcggctcgaaacgctcgtttcggcttttggcaaaatggtggcgtccacgctgcttgcatcgccattcgagcgggagtggatcgtcgtgcagagccggggaatgcagcggtggctttcgatgcggcttgcctcgcagtttggcgtctgggcgggggcggagtacccgtttccgaatgcactgattcagaggcttttcgagtggctggagctatccaagcaggctgacactgagcgattctcgaaggagacgatctcttggagcctgatgcgcttcctgccagatctgctcgaacgcgattcgtttgcgccgcttcgcgcctatctcgatggtgatcgtgacggcctgaagctcttccagctttcgggcaggattgctgatactttcgatcaatacacactgttccgccccgacctgcttgctgcgtgggaggcgggcggcgacgacgcggctcgtgactggcagccggagctgtggcgggcgctcgtggctgaacattcaggaaaacatcgcggccagctccagtcagcgtttctcagaaaggtgaggactacccggctgcctgccgattttccgaaacgcatttcgctcttcggcgtttcctacatgccgccctaccacatcgaaatcctccaggcgctcgccgtgcgaattccggtgaacctgttcctcttgagtccgacccgggagttctggacggacatcgtttctcggcggcggctgttccgcatgagcgagagcgaaagggcactgagcgtggagggcaatccgttgctcgcctcgctcggcaaaagcggacgcgagttcgccgaactgctgctcgacgtcggcaacgtcgaggacgagtatgacctctacgacgaccccggcacagcgacgcttctccgcgcgttgcaatccgacatactcaatctgcgcggcgacggcacggatgggcggcatccgatgcccgacgccagcgactgctcggtgcaggtgcactcgtgccacaatccgctgcgcgaagtcgaggtgctgcacgacaatctgctcgatctgctcgacaagttacccggcctcgaaccgcgcgacatcgtggtgatgacgcccgacatcgagacctacgccccctacattgccacggtattcggtgcgagcggcccggaggagccgcgcctgccgcactccattgccgaccgccggatgctcgacgaaggcggcgtcgccccggcgatactcaaactgctggagctctatggcagccgccacacagcccccgcgcttttcgacctgctctcgtcgccaccggtgagtcgccacttccggcttggcgaggaggagctcgacacggtgcgccgatggatcaaagagacgcgcatccgctgggggatggacgagggtgctcgcagcaagcttggcctgccgccgttccgcgagaactcctggcgggccgggctggagcgactcctgctcggctatgcgatgccggacgaggggcggctgttcaacggcgttttgcccttcgaggtcgcgggcgatgccgaaacactcggcaagctggcagacttcatcgacgcggtcgatcagctctcgacgcgcttcagtcgttcacgcccgctcggcgagtggcggaatcactttttctggatgcttgaaaacttcatcgaggcagacgccgattcggagcgcgaactggcacacgtcaaatcggagattgatagcctcacgtcgctggcggaaaactcgcgattcgaaggcgaggtttcggcgcaggtgatgatcgcctggctgcgcggacggctcgaacagttcgagatggggctcggtttcatgaccggtggcatcaccttctgcgcgatgctgccgatgcgcagcattccgttccgcgtggtggcaatgatcggcatgaatgacggcgcattcccgcgccagcagcgtccgccgggtttcgacctgctcgcccgcgaaccgcgcaagggcgaccgctccgtgcgcggcgatgaccgctaccttttcctcgaatcgctcctctctgcccgcgacgtgttctacctgagctatgtcggccagagtgtacgcgaaaatacgccactgccgccgtcggtactcgtgagtgaactgctcgacgccattgagcgcggcttcgagttcccggagggcgaagatgccgcgtcgcgccttgtcgtccagcaccgcctccagggctttagcccagcctacttcacgaaaggatcatcgctcttcagctactcagcggacaacttcaaagcacttgctggacgcaattcgcttgccgaacgccctttcatcgaggagccgctcaatggttttaccgacgaggatcggacggtcacgctcgacgatcttgcccgctttttcgccaaccctgcggcgtattttctcgaaaggcgtctcggcctgaagccgtcggcggcagtggagccgctcgaagagcgcgagccgttcgaggtggcgggactcgaacgctacgcgatgcgtcaggagttgctcgaagcggtgctcgaaggccacgatggatgcgcgatgctgccgctcttccgctcgcggggattgcttcctccagccacgcacggcgagctgctgttccggaagttgcttgtcgaggtcgaagagttcgccacgaaggttcaggaattgaaaggcggcggcacgttcagccagcttgacatcgatctcgacatcgggggattccgccttactggaaagctcgaccatctgctgccgaccggccaacttctctaccgatgcgcgagaatgcgtgcgcaggatcgcctccgcgcgtggctcctgcaccttgcataccatgccgtcgaaaacggtgcgacacaagaaacgtgcatcatcacgctcgaccgctcgatccgctatcgacccgtcgatgacacgaccaaacggctcgaaacgctgcttgatctctaccgcgaaggaattaccgagccgttgccattctttccccgcacctcgcttgcctgggcggagaaggccgagaaaccagaagccgaccggcgcaaagccgccctcggccagtggctcgacggcttcggcggaatcgaaggcgaggggaacgacccggccatccgccgctgcttcggccaagaaccgcccttcggcgaccgcttcaagagcatcgccgacaaattattgctgccaatgattgagcacgaaggcaaggtatga

SEQ ID NO: 45470 - protein, 1065 aa, Chlorobium tepidum TLS
MLEIYTSNRLETLVSAFGKMVASTLLASPFEREWIVVQSRGMQRWLSMRLASQFGVWAGAEYPFPNALIQRLFEWLELSKQADTERFSKETISWSLMRFLPDLLERDSFAPLRAYLDGDRDGLKLFQLSGRIADTFDQYTLFRPDLLAAWEAGGDDAARDWQPELWRALVAEHSGKHRGQLQSAFLRKVRTTRLPADFPKRISLFGVSYMPPYHIEILQALAVRIPVNLFLLSPTREFWTDIVSRRRLFRMSESERALSVEGNPLLASLGKSGREFAELLLDVGNVEDEYDLYDDPGTATLLRALQSDILNLRGDGTDGRHPMPDASDCSVQVHSCHNPLREVEVLHDNLLDLLDKLPGLEPRDIVVMTPDIETYAPYIATVFGASGPEEPRLPHSIADRRMLDEGGVAPAILKLLELYGSRHTAPALFDLLSSPPVSRHFRLGEEELDTVRRWIKETRIRWGMDEGARSKLGLPPFRENSWRAGLERLLLGYAMPDEGRLFNGVLPFEVAGDAETLGKLADFIDAVDQLSTRFSRSRPLGEWRNHFFWMLENFIEADADSERELAHVKSEIDSLTSLAENSRFEGEVSAQVMIAWLRGRLEQFEMGLGFMTGGITFCAMLPMRSIPFRVVAMIGMNDGAFPRQQRPPGFDLLAREPRKGDRSVRGDDRYLFLESLLSARDVFYLSYVGQSVRENTPLPPSVLVSELLDAIERGFEFPEGEDAASRLVVQHRLQGFSPAYFTKGSSLFSYSADNFKALAGRNSLAERPFIEEPLNGFTDEDRTVTLDDLARFFANPAAYFLERRLGLKPSAAVEPLEEREPFEVAGLERYAMRQELLEAVLEGHDGCAMLPLFRSRGLLPPATHGELLFRKLLVEVEEFATKVQELKGGGTFSQLDIDLDIGGFRLTGKLDHLLPTGQLLYRCARMRAQDRLRAWLLHLAYHAVENGATQETCIITLDRSIRYRPVDDTTKRLETLLDLYREGITEPLPFFPRTSLAWAEKAEKPEADRRKAALGQWLDGFGGIEGEGNDPAIRRCFGQEPPFGDRFKSIADKLLLPMIEHEGKV

SEQ ID NO: 45471 - DNA, 3501 bp, Oceanobacillus iheyensis HTE831
  CDS (1)..(3501)
atgggaatgcggttcatattaggacgttctgggacaaataaaagtgaagtaattttaaaagaaataaaacaaaaaatttctactaaccccataggaccttctatattttacattgttccagatcaaatgacatttcaacaagaagttgctctatttagtgattcagaaacgaatggaagtattcgagcgcaaattgtaagtttttcaaggttagcctggagagtattacaggaaacaggtggaggaacaaaacaatttataagctccgtaggtatccaaatgatgctaaggaagattattgaagaaaaacaaggggactggaacgcttttcaaaaagcgcttaaaaaacaagggtttctaggacaactagagacgatgttaaccgaattaaaaagatatgaaataacaccagatgatctacgaatgcagcagtctcatcttacagactttgtgcaccagtcaccttcagagcaggggctcacgcgtaaacttagcgatttaatttatatttatgagacatttatatatgcgttacagggaacgtatgtagacagtgaagatcaactacagctgttaattcaacaaattaaacaatcttctatattaaataatgcggacatttacatagatggttttcatagttttacacctcaagaacaatcagtacttacagaactaatgaaaacgagtaattctatcacagtcgctttaacattagatgatccgtggaaagaggatgcatctgagctggatttattttatcaaccaagccaaacgtatcatgtattgaaacaattagcttgggaagcaggtgttccggtagaagatccaattatattagatactctggaagggaattttcaaaaccgaccttattttgcgcatatggagaaatattttgattcaagaccagcaccagcgtatgaaggcgaagtcccaattgaaatatttgaagctgttcatccacgagcagaagtagaaggtatagcccagcaagtattagaattaatcagagataatcgataccgctatcgagacatcgcactgttaatacggcaaccagaagtttaccatgatttaattgaaacgattttcaatgattatgaacttcctgtttttattgatgagaaacgtccgatgcttcatcatccattaattgaattaattcgttctatattagaggttgtacaaggaaattggagaaatgatgccatttttcgagttttaaaaacaggactcataccatctgcagatgatgaatttcctctaactatggatagtattgatcaattagaaaattatgttattgaatttggtattcgatctagacatcagtggatcggtgaaaacaagtggaaataccaacgttttcgtgggtttgatagttctgctcagacagatagagaaagagaattacaagaaagtatgaatcgttatcgagatcaggttatatctgctattgcaacagtggatgaacaattaagagcagcaaccactgttaaagatctttgtatagcgatgtaccagtggttagaagagctgaaaattcccgaccaactagaagtaacgagaaagtattatgatgatcaaggattgcctgaaaaaggtagggaacaggaacaagtatgggatgcggttattcaattatttgatgaaatggtagagattgcaggggaagagaaaatggatttatcagtttttcaagttgctttagatgcgggtattgaaacgctgcaattttcccatgtccctccgagtatggatcatattattgtagggacaattgatcgatcccgaatgagtaatatacgttgtgcttttttattaggagtgaatgaaggtatttggccaatgaaaccaacatctgatggaatgattgatgaagcagaacggttactgcttgaacaaaatggattgaagttagctgatacaagcgaacggcaattattagatgattggttctatatgtacttggcttttacggttgcgaaagacagactgaaaatcagttatttactaagtgatgaagaagggaaagcaaaaatgccttctcagttgattcatcgagtcgaagagctattccctgcaaccaaaaatcatatattattacaagatccagaagatgaatcgaatacaagaaggttcgtatccaccgaactgaaatcaagatcggccttaactgcacaattagcgaagtttaaaaaagggtatccgattgatccaatttggtgggaagtatatcaatggtatgtagaacatcacccacaaggtggtacgacacatcgtgtattacaaggactacactatgaaaataaacctgagtcattacaaaaagacacggttgaacaattatatccgaagcgaattcaagcgagtgtgagtaggttagagacttattacaggtgctcttatcaacactttgctaaatatagcttgaatttagaggagagaagaacatacaaattagatgctccagatatcggtcagctgtttcatgaagcacttaagaaaataacagaatggattcatgctgaaggaaatgatttttctgcattgaccaaaagccaatcgtctcattatgcgaatcgtgctgtgactgaattatctcctgtgctacaacatcaaatattgcatagttccaatcgctatgcgtatatacagaagaaattagaagaagtcattgctcgagctacatttgtattaggtgagcaagcaaggctaagccatttttctcctgtgggattggaattaggatttggtgatggaaacaatcaaattccttcactatctatgctattagagaatggatatgaacttgtattacgagggagaattgatcgggtagacaaagcagaactggaaaacaatttatatttacgaattatagattataaatcaagctcaaaaggattagacttaacggaagtttattacggtattgctttacaaatgctcgcttacttagatgttgtattaacgcattcggagaaatggttagggcaacaggcagatccagctggagtattatatttccatgttcacaatccaatgatttctgctaaaggtagtatgacagaagcagatattgaagaagaattatttaaacaatataaaatgcaaggtttacttttatccaatgaagagatagtgaagatgatggattcatcattagaaacaggttccagtcaaattgtcccagcagcactaaagaaaaatggaggattttatagttactctaagattgcagatcaatccacatttgagacattgcaaaaccatattcatcagctgttgaaatcagccggaattgatataaccaatggttctgtagatgtaaatccttatcaacataaacaacagaaggcatgcacatactgcccgtttcattcggtatgccaatttgatccagtattagaagaaaataattatcgtaagtttgcggatatcaaagagaacgatttactgcaattgtttgagagggagggggagaacaatggttaa

SEQ ID NO: 45472 - protein, 1166 aa, Oceanobacillus iheyensis HTE831
MGMRFILGRSGTNKSEVILKEIKQKISTNPIGPSIFYIVPDQMTFQQEVALFSDSETNGSIRAQIVSFSRLAWRVLQETGGGTKQFISSVGIQMMLRKIIEEKQGDWNAFQKALKKQGFLGQLETMLTELKRYEITPDDLRMQQSHLTDFVHQSPSEQGLTRKLSDLIYIYETFIYALQGTYVDSEDQLQLLIQQIKQSSILNNADIYIDGFHSFTPQEQSVLTELMKTSNSITVALTLDDPWKEDASELDLFYQPSQTYHVLKQLAWEAGVPVEDPIILDTLEGNFQNRPYFAHMEKYFDSRPAPAYEGEVPIEIFEAVHPRAEVEGIAQQVLELIRDNRYRYRDIALLIRQPEVYHDLIETIFNDYELPVFIDEKRPMLHHPLIELIRSILEVVQGNWRNDAIFRVLKTGLIPSADDEFPLTMDSIDQLENYVIEFGIRSRHQWIGENKWKYQRFRGFDSSAQTDRERELQESMNRYRDQVISAIATVDEQLRAATTVKDLCIAMYQWLEELKIPDQLEVTRKYYDDQGLPEKGREQEQVWDAVIQLFDEMVEIAGEEKMDLSVFQVALDAGIETLQFSHVPPSMDHIIVGTIDRSRMSNIRCAFLLGVNEGIWPMKPTSDGMIDEAERLLLEQNGLKLADTSERQLLDDWFYMYLAFTVAKDRLKISYLLSDEEGKAKMPSQLIHRVEELFPATKNHILLQDPEDESNTRRFVSTELKSRSALTAQLAKFKKGYPIDPIWWEVYQWYVEHHPQGGTTHRVLQGLHYENKPESLQKDTVEQLYPKRIQASVSRLETYYRCSYQHFAKYSLNLEERRTYKLDAPDIGQLFHEALKKITEWIHAEGNDFSALTKSQSSHYANRAVTELSPVLQHQILHSSNRYAYIQKKLEEVIARATFVLGEQARLSHFSPVGLELGFGDGNNQIPSLSMLLENGYELVLRGRIDRVDKAELENNLYLRIIDYKSSSKGLDLTEVYYGIALQMLAYLDVVLTHSEKWLGQQADPAGVLYFHVHNPMISAKGSMTEADIEEELFKQYKMQGLLLSNEEIVKMMDSSLETGSSQIVPAALKKNGGFYSYSKIADQSTFETLQNHIHQLLKSAGIDITNGSVDVNPYQHKQQKACTYCPFHSVCQFDPVLEENNYRKFADIKENDLLQLFEREGENNG

SEQ ID NO: 45473 - DNA, 3813 bp, Shewanella oneidensis MR-1
  CDS (1)..(3813)
atgctgaagttaatccaatccaaccaaatggaagtgctctgtgcccatctcgctgcgtatttgcgccaaccgttgcccggtggctgtttattgcaaagcgagcatattttggtgcaaagccctgggatgtcgacttggttacgccttgagattgcaaaacaaaatggcattgccgccgcgcttgagttccctttgccatccagtttcatttggcaactgtgtcacgatttactgcccaatgtccccaaggaaaacgcctttactaaagcggcaatgacctggaaattaatgcaactactgcctcgcctacttgaggaggaatcctttgggccgctgcggcattatttaggtcatattgagtcaagcagccccgactcgaccacaaaaaataatcaacttgaagcgtcaaactcaatcgccgccgataatattaagctttatcagctctgcggtcgcatcgccgatatcttcgaccaatatttagtttaccgccccgactggattgccgcatgggaagccaatgaaccactcgatgcactcaaattaaatgaggaacaacgctggcaacctattctttggcgggcgctgattgccttcaaccgtgacgaactgcgtcaaagccattaccacagggccaatttacatcaggatttaattgccgcgctggctgatagcacccattccctcgccaaattgcctgagcgtttatttgtgtttggcatttcgtctatggccccacaaaccatagacgtgctccaccagctcgcggcccgaattgatgtcatcatccttaacctcagcccatgccagcattattggggcgatattatcgatcctcggcatcgagcgcgaatggcgctgcaatatgctggcaaacgccaattggccgagcaatgggaagataaactcgaggtcggcaatccgctgcttgccaacaatggcaaaatgggccgtgaattactcgatatgctgctcgaactcccacctgaacactgcgattttggcgacgatgtgtactgcgagccctgcggcgatcctaacgatccggattgcaacgctagcatgctggcgggggtgcaatacgatatcttagaaatgcaaaccctcgatcgcgtactcgggcctgatgccgagctatatcaagcggtgacaaaccgcagacgactaaaacgcgtcgatgattcgattcaaatcaagagctgtcacagcccgctgcgcgaagtcgaaaccttacacgatcatttactcgacctgctggatcgtgacaaccaactcacgcccaaagatattgtggtaatgatgccggatgtcgccgcctacgcgccctatattgatgcggtgtttgccgccaaacaagggctcgaatatatcccctacgccattgccgaccgcggcgcggcgcaggaatcgccactcattaatagctttttgaatttactcaatattaatcagagtcgcttcggactgaccgatattttaagcattctagaagtgccagcgattttacggcgttttcaactcgaagaagacgagctaccactgatccgccgttggttagatgaagccggtgtgcgttgggggcgcgatgagcaaagccgtgttaaacagggtgtgcccgcctttgagcaaaactcctgggcctttggtatcaaacggttaatcttgggctatgccttaaggaacgatgcacccttgtatcaagcaagcccacaggcgccaagctatttagtggtttcaggggtagaaggccaatcggcacaggcccttggcaaactgttgaactttattgaagtcctcgatgaaaccacgctgcaattagcccagcctcaagcgccttgccagcgtttatttgaactgactcaactgttaaatgctttttacgcccccgatgaggatgagcgtgagcagttacaggaagtccgcgacgccattgccaccttagagcaagagttacaggccgccagccctgctgacagctatacagcggcatacgacgttaacccctattttttagaccaaagcggcttacactcaaacgccttgaacttaagcatcgaagtactcgcacaatggtttaatcagcgcttaaccgagtcacgggttggccagcgttatctagcgggcagtgtaaatttttgtaccttaatgccgatgcgctcgattccgtttaaggtggtgtgcctactcggcatgaatgatggcatatatccgcgcatgcaacatcctgtgggctttgatctgatggcacattttggtgctcgcaaaggcgatcgctcccgcagattagacgataggtacttgtttttagaagcactactctcggcacgggaacagctttacatcagctatattggccgcagtgagcgggataactcggagcgcattccctcgatgctagtctccgagctgattgaatattgccagctgtgttatgtgccagaatcgcttacagcagaaactccagccgtgggtaatgaagccgcccaacaggccttgcttgagaccatcataagccaccagccgctacaaccttttgatcctaaactgtatcagtcaacagagccgcaagcgcaggcgataaaacaaagttacagccagcaatggtgcccaccggacatcagcacgcagtcaatccagcgtcgttttattgatgccaacacgcagatcgtgctcgaagatgacacgattggggatagtgatattcaacaaaatattgagccactaagtgaagaagagcatgtcgatatctccgcttttatccgattctttcgtcatcccgcgcaatatttctttaatcgcacattaaaggttgatttaaacctgaatattcaagcggatgataatgatgaacccttcagcctcaatgcgcttgagcgttatctgttacaggcaaggttgctcgatgatgcgctcgagcaaggagctctcgaacaaggcgctcttgaacaaggacaggcgcagcccagtagcgaactattacaacgcttaaaagccagtggtaatttacccatgcagccctttgatgatctgctgctgcgccaatatagccacgatatcgcaccattgattggcagaaccttatttatgcgcggcgatgtagctccgcgccatgcggatattcggctcgcctttgagttacctctatctcacgttgctgcaacgactaaggtgtcggtaaagcgcgtgctccttgaaggtcgcattgatgatatcagtccaaaaggcttggtcagttgtcgccctggcagtgcccatgggcgggatattttagcgctgtatctgcgccatttatgtttaatggccgcaggactgactcagcctagcgatcagcagcccagctatctacaacctagctatctactcgatatggggcattttcacgccctctcgcccattgcgccaaagcaggcccatgatcgactggttcatttgttacaacatttttatcagggacagttgcatccgctgtgttttatgcccaaaacctcccttgcctacgccagtgcagagatcaatgaggatgaaaccagtcaacttgatggtcaatacgatagccaacacagtgtgcggctcgaggcggcgcaaagcgaatggctggacgaacaaggtgaacttggcgaaggcaccgatccccattaccagcggctgtttcggtttccgcaggattttaccgaagcaaattttggcaaactggccgacgagatctatcgacccatgctgagcttgtaccataaagacaccctcgcccaacttgaggagtttgtgctcaatgctgaaccacaaaccgcaacatcagagggagcgcagcaatga

SEQ ID NO: 45474 - protein, 1270 aa, Shewanella oneidensis MR-1
MLKLIQSNQMEVLCAHLAAYLRQPLPGGCLLQSEHILVQSPGMSTWLRLEIAKQNGIAAALEFPLPSSFIWQLCHDLLPNVPKENAFTKAAMTWKLMQLLPRLLEEESFGPLRHYLGHIESSSPDSTTKNNQLEASNSIAADNIKLYQLCGRIADIFDQYLVYRPDWIAAWEANEPLDALKLNEEQRWQPILWRALIAFNRDELRQSHYHRANLHQDLIAALADSTHSLAKLPERLFVFGISSMAPQTIDVLHQLAARIDVIILNLSPCQHYWGDIIDPRHRARMALQYAGKRQLAEQWEDKLEVGNPLLANNGKMGRELLDMLLELPPEHCDFGDDVYCEPCGDPNDPDCNASMLAGVQYDILEMQTLDRVLGPDAELYQAVTNRRRLKRVDDSIQIKSCHSPLREVETLHDHLLDLLDRDNQLTPKDIVVMMPDVAAYAPYIDAVFAAKQGLEYIPYAIADRGAAQESPLINSFLNLLNINQSRFGLTDILSILEVPAILRRFQLEEDELPLIRRWLDEAGVRWGRDEQSRVKQGVPAFEQNSWAFGIKRLILGYALRNDAPLYQASPQAPSYLVVSGVEGQSAQALGKLLNFIEVLDETTLQLAQPQAPCQRLFELTQLLNAFYAPDEDEREQLQEVRDAIATLEQELQAASPADSYTAAYDVNPYFLDQSGLHSNALNLSIEVLAQWFNQRLTESRVGQRYLAGSVNFCTLMPMRSIPFKVVCLLGMNDGIYPRMQHPVGFDLMAHFGARKGDRSRRLDDRYLFLEALLSAREQLYISYIGRSERDNSERIPSMLVSELIEYCQLCYVPESLTAETPAVGNEAAQQALLETIISHQPLQPFDPKLYQSTEPQAQAIKQSYSQQWCPPDISTQSIQRRFIDANTQIVLEDDTIGDSDIQQNIEPLSEEEHVDISAFIRFFRHPAQYFFNRTLKVDLNLNIQADDNDEPFSLNALERYLLQARLLDDALEQGALEQGALEQGQAQPSSELLQRLKASGNLPMQPFDDLLLRQYSHDIAPLIGRTLFMRGDVAPRHADIRLAFELPLSHVAATTKVSVKRVLLEGRIDDISPKGLVSCRPGSAHGRDILALYLRHLCLMAAGLTQPSDQQPSYLQPSYLLDMGHFHALSPIAPKQAHDRLVHLLQHFYQGQLHPLCFMPKTSLAYASAEINEDETSQLDGQYDSQHSVRLEAAQSEWLDEQGELGEGTDPHYQRLFRFPQDFTEANFGKLADEIYRPMLSLYHKDTLAQLEEFVLNAEPQTATSEGAQQ

SEQ ID NO: 45475 - DNA, 3483 bp, Pseudomonas putida KT2440
  CDS (1)..(3483)
atgctcaacaccgcccatctccaccctggcttcatgatcgtccacggcaaccgcctcgacgacctgcgtagcctggtagtgagctggatgcgtcgctacccgctggcgcctctggaaaacgaaattgccctggtgcaaagcaatggcattgcccaatggctcaagctggccctggctgaagatccgctggaagatgaccaaggcggctgcggcatcgccgctgcaatcgatgtgcaactgcccggtagctttatgtggcagctctaccgcagcgtgcttggccgtagcgaaatccccgaagtgtctctgctcgacaaggcacccctgacctggcgcctgatgcgcctgttgccagcgctcatcgagcgcccgcatttcgagccactgcggcgcttcctcaccgatgacagtgacttgcgcaagcgctaccagctcgccgagcgcttggccgacctgttcgaccagtatcaggtctaccgcgccgattggctcaaggactgggccactggtgagcacgtcatcaacacggcccgcggcgagcgcaaagttctgccgccaggcaaccgctggcaagccgagttgtggcgagcattgctggaggatgttggcgagcaaggcatggcgcaaagccgcgccggggtacaccaacgtttcatcgagcgcatcaacagcctggagcaggcgcctgcagggctgccaccgagggtgatcgtgttcggtatctcttcgctgccggcccaggccctggaagcactggcaggcctgtcgcgtttcagtcaggtattgctgtgcgtacacaacccatgccgccaccactgggccgatatcgttgccgacaaggacctgttgcgccaccagtacaaacgccagcaacgcaagcaaggcatgcccctgcaactggacgaccagacgctgcaccagcatgcccacccgttgctggcagcctggggtaaacaaggccgcgactacatcaacctgctcgacagctatgatgacccaggcagctaccagggcgtgttcagcgacggccgcatcgacctgttcagcgacggttcgcccaccacgctgctcaacgaactgcaggacgacatcctggaattgcgcccgctcgccgagagccgcgaacggtggccggcagtcgacaccacaaaagaccgctcgatccgcttccatatcgcgcacagcccgcaacgtgaagtggagatcctccacgaccagctgttggcccgcttcagcgccgacccgactttgcgcccgcgcgacgtgatcgtcatgctgccggacatcgacacttacgcgccgcatatccgcgccgtcttcggccagttgcagcgtaacgatccacgctacatcccgttcaccctgacagaccagggccagcgtggtcgcgagcctttgctgatcgcgcttgagcacctgctcaaactgcctgacagccgcttcgcggtcagcgaagtgctcgacctgctggacgtgccggcagtccgcgcccgcttcggcatccgcgaaaacgacctgcccacgctgcaccgctggatcgagggcgctggcatccgttggggccttgacgccgcgcagcgggcgagcctgggcttgcccgccgggctcgaacagaacagttggcgtttcggcctgcgccgcatgctgttgggttatgccgtgggggtgggtgaggcctgtgatggcattgaaccctacgatgaaatcggtggcctggacgcggcactgatcggcccgctggtcgcgttgctggatgcgctcgaagtcgcctgccaggccttgtccgagcctgccaccgtcagccagtggggcgagcgactgcatgccttgctgcacgtgttcttcctcgccgaggacgagggtgatgagttcctgttgatgcagttgcaggatttgcgtgatagctggcttgaggtgtgcgagaccgtcggcctgcacgacccgctaccgcttaccgtggtgcgtgaagcctggctgtcgggcctcgatcagggcaagctgtcacaacgtttcctcgccggctcggtcaacttctgcacactcatgcccatgcgcgcgatccccttcagagtggtctgcctgctgggcatgaacgatggcgattacccgcgtgcgcagccaccgctggacttcgacctgatggccagcgactatcgccccggcgaccgctcacgccgcgaagacgaccgttacctgttacttgaagcgctactgtcagcacgtgaccaactgtatgtcagctgggtcgggcgcagtatccgcgacaatagcgaacgcccggcctcggtgctgatcggccagttgcgcgatcacatcgctgcgggctggcatttggccgacgcgcagcagggccagcccgcgagaccgggcgagcaactgttgcacgcactgacccaggagcacccgctgcagccgttcagccctcggtacttccagaagggcagcccactgttcagctatgcccatgaatggcaggtgctgcaccagcagggtgagacagacgcgcagagcgagccgggcttgccgccttatcaggacgctgaagccctgagtctgcaccagctgaatgacttcttgcgccacccggtacggcacttcttcagccagcgcttgaaggtgtactttgaggcgctggaagcgccgaccccggacgaagagcccttcgtcctcgataccctgcaacgctacggcgccagtgaaagcctgcttggcgccgccttggccgaaccggacaacgccgaacaagccttgcgcgcccaggcccgacgcctgcaggcctgcggtctgctgccgctagccggtttcggcgaactgctgcaaaacgagttgatcgaaccgctgccggacctgctgcaacgtcaccagcaattgctgcaacgctggccacagctggtcgagggcgctttgccggtgcatttcgagcacggtcagcaccgtctggagggctggctgggccgggtgttccaggcggaagatcagagccttctcagtatcaccacagtacccaacaccatcagtgccgggcgcaacaacctgaagtggcaccgccttatcgcgccctgggttacgcacctggcggcctgtgcggcgggctacccctataacagtgcattggtagccagtgacctgaccctgttgcttgcacccctgccgcaagcgcaggccgcgcaactgctgggcgacctgttggtggcccgtcaggcggcaatgaacgcgccgttgccagtcgcggccaagaccgcgttcgcctggttggcccaggacgatgcggataaagccctggccgcagcagctcgcgcctacgaaggcgacgaacgcaccagctttggcgaacggagtgaaagcattgccttggcccgccagttccgggactttgcagcactcaccgctgacgaaacgtttgaaggctggtgcgaaaccttgtatcgcccgttgtttaccgccccttggcagaccttgggcaacccggagaaaggcgcatga

SEQ ID NO: 45476 - protein, 1160 aa, Pseudomonas putida KT2440
MLNTAHLHPGFMIVHGNRLDDLRSLVVSWMRRYPLAPLENEIALVQSNGIAQWLKLALAEDPLEDDQGGCGIAAAIDVQLPGSFMWQLYRSVLGRSEIPEVSLLDKAPLTWRLMRLLPALIERPHFEPLRRFLTDDSDLRKRYQLAERLADLFDQYQVYRADWLKDWATGEHVINTARGERKVLPPGNRWQAELWRALLEDVGEQGMAQSRAGVHQRFIERINSLEQAPAGLPPRVIVFGISSLPAQALEALAGLSRFSQVLLCVHNPCRHHWADIVADKDLLRHQYKRQQRKQGMPLQLDDQTLHQHAHPLLAAWGKQGRDYINLLDSYDDPGSYQGVFSDGRIDLFSDGSPTTLLNELQDDILELRPLAESRERWPAVDTTKDRSIRFHIAHSPQREVEILHDQLLARFSADPTLRPRDVIVMLPDIDTYAPHIRAVFGQLQRNDPRYIPFTLTDQGQRGREPLLIALEHLLKLPDSRFAVSEVLDLLDVPAVRARFGIRENDLPTLHRWIEGAGIRWGLDAAQRASLGLPAGLEQNSWRFGLRRMLLGYAVGVGEACDGIEPYDEIGGLDAALIGPLVALLDALEVACQALSEPATVSQWGERLHALLHVFFLAEDEGDEFLLMQLQDLRDSWLEVCETVGLHDPLPLTVVREAWLSGLDQGKLSQRFLAGSVNFCTLMPMRAIPFRVVCLLGMNDGDYPRAQPPLDFDLMASDYRPGDRSRREDDRYLLLEALLSARDQLYVSWVGRSIRDNSERPASVLIGQLRDHIAAGWHLADAQQGQPARPGEQLLHALTQEHPLQPFSPRYFQKGSPLFSYAHEWQVLHQQGETDAQSEPGLPPYQDAEALSLHQLNDFLRHPVRHFFSQRLKVYFEALEAPTPDEEPFVLDTLQRYGASESLLGAALAEPDNAEQALRAQARRLQACGLLPLAGFGELLQNELIEPLPDLLQRHQQLLQRWPQLVEGALPVHFEHGQHRLEGWLGRVFQAEDQSLLSITTVPNTISAGRNNLKWHRLIAPWVTHLAACAAGYPYNSALVASDLTLLLAPLPQAQAAQLLGDLLVARQAAMNAPLPVAAKTAFAWLAQDDADKALAAAARAYEGDERTSFGERSESIALARQFRDFAALTADETFEGWCETLYRPLFTAPWQTLGNPEKGA

SEQ ID NO: 45477 - DNA, 3489 bp, Vibrio vulnificus CMCP6
  CDS (1)..(3489)
gtgtttactgtctatcactccaatcaagtggatgtgctcaaatctctgttggtggaactgattcgcctcaatcctttgcaaaatcccttcgacaaagagcaaatcttggtgcaaagcccaggcatgtctcaatggttgaaaatggaactggcgaaagagtttggcgtggcagcaaacatcgaatttccgctacccgcgacatttatctgggatatgtttacccacgttttggcggatgtgccaaaacgcagtgcttttaacaaagaagcgatgacgtggaagctgatgcatttgttgccgcagcaacttgcactggcggagttctcgcctttagctcgctatcttcaagacgatgaagaaggtgccaagctttaccaactgtcggaaaaaattgccgatatttttgatggctatttggtgtatcgccctgaatggatacgtgattgggaagcggggaaggccgtggctgagattggtgatgagcatccttggcagcccatgttgtggcaagcactgtatgaccataccgtcgcgcttgggcaatcgccgtaccatcgcgccaacctatacgaacatttcattgatagcttagaaaactacactggccagtttgaacacttgccgcagcgcttgtttgttttcggtatcacctcactgcctccacgttacatggacgcgcttaaaacgctcggtcagcatattgacgtgcatctgatgtttaccaacccgtgtcgatactattggggtgaagtgcgcgatcgcaaatttctggctcgtttggcggcgaaacagcgtcagcacctcgtgtggcaacaagatcattcgcagcttcagggccaaagtgagcaattgaaaggcagtattgaagacaatcttgccgatgaactgcacaccgaggtggtgggcaacagcttgctggcttcgatgggcaaacttggccgtgacaacatgtacttgttgtcacaattggaatcgcatgagattgaagcgtttgtcgatatcgaaccagactcgctattgcatcaactgcaagccgacatcctcaacttggaagagcaccaagatgacgaccatatcgagagcagccatcataaaccgctcatcgaagcgaatgatcgctctttgagcctgcacgtctgccacagcccaatgcgtgaagtggaagtgctgcacgatcaattgctggcgatgttcgatgccgacccaaccctcaaaccgcgcgatattatcgtgatggtggcggacatcaatgcctacagccctgcgattcaagcggtgtttggcaacgcgccgggtgaacgattcatcccctattccatttcagatcgaaccgccgatcaagaaagcccgattctcaacgcgtttttgacgttggtgaatttgccacaaatgcgctgtttggcgtcagagctgttggaactgctagaaacccccgcgattttgcagaaattctccttgagtgaaacggagttcttgcaagcaaaacaatgggtggaagcgtcaggtatccgttgggggctcgatgcgcaaactggatgtgagtttgacctacctcagacaagacaaaatacctggcagtttggtattcaacgcatgttacttggctacgccatgccagaatcggctggcttgttccaaagcggtgaggaatggcttgctccttacaacgaagttcagggaatgggagcggagctggcgggcaaactgagctacttcattgaaaaggtgcgctgctatcgccacgccttagctcaagcgcaaaacattgacgcatggcgacaacaattacacggtgtcttggcggatttcttcgccgtcgacttagaaggcgaagtggcattgaaatcgattcgcgatacgttgggacagttaaaagaacagttgagtgatgcggcatttgaggcggaattgtcaccgagtgtgattcgtcaatatctgctcaataaactgtccggtagtcgtgtaagccagcgttttcttgccggacaagtgaatttttgtaccttgatgccgatgcgttcgattccatttcgcaccgtctgtttattagggatgaacgatggcgtctatccacgcagtgtggcgccggaaggattcgatttaattcatggccgcgccagagccggggatcgctctcgccgcgacgatgaccgctacttgttccttgaagctctgttgtctgcgcagcaaagtgtttacatcagctatgtcggacgttccgtgcaagacaacacagagaaagtgccgtcggtgctggtggctgagttgatggagtattgtcagcaaaactactgtttagcgggggatgagcatctgggtgtggatgaatccggtgcgcatctattaaaggcgatcacctgcgagcatcccatggtgccatttagccccaaagcttttttaggtgaacctccgagcaacgcgaaaagctatgccaaagagtggattccagcggcccagcagcagagcgaaggccaagtgccatcgcagccaagtgcgccattttatcaagcccttgacgattatttactgggtgccacgttcccgcttgaactggatttggttgaactgcaacgtttctggcgactgccggtacagtacttcttcaatcgccgtttgaaagtcgttttcgagccgccaatggccgtgatggcagatgaagagccgtttgtgttggatgggctcaacagcttccaattgcgtgaacagttgttgcatcgtctcttatcggatgaaaactgcacgcctgacatggtacagccgctgattgagggcgtacgcagtgaaatgcgtgcacagggcaagttgccgatcggcgcctttggtgagttggaatttgacaccaaccgcgtgcaagctgaagcattaatagaaaaactaaccggactatctcacgctgctttggatgatctcgaagtggatctgacttttacgccatttggtgaaggcaaaacgattcatttgagcggttggttaacgcagcactatcaatcgggtctattgcgttatcgcagtggcaaaattcgctcacaagattacttagctggttggattgatcacctttcgatgtcggccatgggcgttgccaaagtgacgcatttgattggctacgacaagaaagaaggggttgtgcacctcaaatactcggcgatggcggatgctggccaggccaaatcgttgcttaacgaattgatccgcctgtatatcgaaggcatgactcagcctttggcgtatttccccaaaaccgcattggcggccatcgaagctggcataagccgcgggcaatggaacgatgatgaagagaaagcgttgaaaaaaatggcggataccttcaatgatggtttcttgggtgcaggggaaggcgctgacagttacatcagtcgtatttggccaaaatggaatgaacaactggcccatcaagtacgtttgatgagtagtttggtgctgcaaggggcaagattgtccgttgtggatgcgtcagaggaagcatag

SEQ ID NO: 45478 - protein, 1162 aa, Vibrio vulnificus CMCP6
MFTVYHSNQVDVLKSLLVELIRLNPLQNPFDKEQILVQSPGMSQWLKMELAKEFGVAANIEFPLPATFIWDMFTHVLADVPKRSAFNKEAMTWKLMHLLPQQLALAEFSPLARYLQDDEEGAKLYQLSEKIADIFDGYLVYRPEWIRDWEAGKAVAEIGDEHPWQPMLWQALYDHTVALGQSPYHRANLYEHFIDSLENYTGQFEHLPQRLFVFGITSLPPRYMDALKTLGQHIDVHLMFTNPCRYYWGEVRDRKFLARLAAKQRQHLVWQQDHSQLQGQSEQLKGSIEDNLADELHTEVVGNSLLASMGKLGRDNMYLLSQLESHEIEAFVDIEPDSLLHQLQADILNLEEHQDDDHIESSHHKPLIEANDRSLSLHVCHSPMREVEVLHDQLLAMFDADPTLKPRDIIVMVADINAYSPAIQAVFGNAPGERFIPYSISDRTADQESPILNAFLTLVNLPQMRCLASELLELLETPAILQKFSLSETEFLQAKQWVEASGIRWGLDAQTGCEFDLPQTRQNTWQFGIQRMLLGYAMPESAGLFQSGEEWLAPYNEVQGMGAELAGKLSYFIEKVRCYRHALAQAQNIDAWRQQLHGVLADFFAVDLEGEVALKSIRDTLGQLKEQLSDAAFEAELSPSVIRQYLLNKLSGSRVSQRFLAGQVNFCTLMPMRSIPFRTVCLLGMNDGVYPRSVAPEGFDLIHGRARAGDRSRRDDDRYLFLEALLSAQQSVYISYVGRSVQDNTEKVPSVLVAELMEYCQQNYCLAGDEHLGVDESGAHLLKAITCEHPMVPFSPKAFLGEPPSNAKSYAKEWIPAAQQQSEGQVPSQPSAPFYQALDDYLLGATFPLELDLVELQRFWRLPVQYFFNRRLKVVFEPPMAVMADEEPFVLDGLNSFQLREQLLHRLLSDENCTPDMVQPLIEGVRSEMRAQGKLPIGAFGELEFDTNRVQAEALIEKLTGLSHAALDDLEVDLTFTPFGEGKTIHLSGWLTQHYQSGLLRYRSGKIRSQDYLAGWIDHLSMSAMGVAKVTHLIGYDKKEGVVHLKYSAMADAGQAKSLLNELIRLYIEGMTQPLAYFPKTALAAIEAGISRGQWNDDEEKALKKMADTFNDGFLGAGEGADSYISRIWPKWNEQLAHQVRLMSSLVLQGARLSVVDASEEA

SEQ ID NO: 45479 - DNA, 3477 bp, Pseudomonas syringae pv. tomato str. DC3000
  CDS (1)..(3477)
atgtccgttacaaccccgctgagtgcaggtttcatggtggttcaaggcaaccgcccggatgaactgcgcagtctggttgtgtcctggatgcgtcgctatcccctggcaccgcttgagaacgagattgcgctggtgcagagcaacggcattgcgcaatggctcaaacttgcgctggctgaagacgctcaggacgatgacaacggcggctgcggcattgcggctgcgatagatgttcagctccctggcagtttcatgtggacgctgtatcgcagggtcctcggcagcgatgaaattcctcagacgtctctgctcgacaagaccccgctgacctggcgcttgatgcgcttgcttcccgcactgatcaatcagccccacttcgagccactgcagcgctttctgaccgacgacaccgacctgcgcaagcgctatcaattatccgaacgcttgtctgatctgttcgaccaatatcaggtctatcgcgctgactggctggaagactgggccgcaggcctacaccaattgcgcgacgcacgaggtcagccacggcccttgtccactgccaattgctggcaggccgagttatggcgcgcactgctggatgatgtcggagccaagggcatggcccagagccgtgctggcgtgcaccggcggtttatcgagcgcattggcaccatgaccgaagcgccgcctggcttgccatcgcgggtaatcgtattcggcatatcgtcactcccggcgcaggcgctggaagcactggccggcttggcgaagttcagccaggtgctgctctgtgtgcacaacccctgccgtcaccactggaccgacatcgtcgctgacaaggacctgctgcgtcatcagtacaagcgtcaggcccgcaagaccggtatgccgatgatcctcgatccgcaagcgctgcatcagcatgcgcatccgctgctcgctgcctggggaaagcagggccgtgattacatcaacctgctggacagccatgacgatccgcgcagctatcgttcgtcattcaaggacgagcggattgacctgttcagtgaggtcgagccaaccaatctgctgaaccagttgcaggacgatattctcgaactgcgcccgctggatgaaacgcgggagatatggccagccattgacccgcttgaagaccgctcgctccggtttcacgttgcccacagcgcgcagcgtgaagtggaagtgctgcatgaccagctcctggcgcggttcagcaaagaccccaacctgcgcccgcgtgatgtgattgtcatggttccggacatcgacagctacgcgccacacattcgcgctgtcttcggccagatcgaacgcgaagatcgccgttttattcccttcacgctggccgatcaggggcaacgtggtcgtgagccattgctgatcgctgtcgagcatctgcttaagctccccgacagccgcttcccggtcagcgaaattctcgacctgctggacgttccggccttgcgagcgcgctttcgcattcaggagcgcgatctgccaaccctgcatcgctggattgaaggcgcaggcatccgctggggcctcaatgcgcagcaacgcgccggtctggggttgccggatgcgctggaacagaacagctggcacttcggcctgcgccgcatgttgctaggttacgctgtgggtgccggtaccgcttatgacggcattgagccctacgacgagatcggcgggctggatgctgcattgataggcccgctggtagcgttgatcgatgggctgcaggttgcccatacagagctgtccacgcccgccaccccggagcaatggggcgcacgcttgcaagccattctccagctgttcttcattgctgaaagcgagcatgacgactacctgcttgctcagctcgaaacactgcgtgaaaactggctggaaacctgtgcagcggtaaacctgattgatgagctgccgctgaccgtggtccgtgaggcctggcttgccgggcttgatcagggccgcttgtctcagcgttttctggcaggctcggtcaacttctgcacgttgatgcccatgcgcgccatcccgttcaaagtggtctgcctgttgggcatgaacgatggcgattacccgcgcgcgcaacccccgctggacttcgacctgatgggcagtgattaccgccccggtgaccgttcgcgtcgtgaagatgaccgttatctgttgctcgaagccgtgctctcggcgcgggatcaactgtacgtcagctgggttggccgcagcattcgtgacaacagcgagcgccctgcatcggtactgattggccagctgcgtgatcacctggccagtggctggaaactggcaggcgaagccgaccctgacagcaaactggacgacggcgaacgtcttctgaaagcactgacggtgcatcacccgctgcagccgttcagcgccaattactttcatgcaggcaccggctacttcagcttcgcccgcgaatggcgcctgctgcatgaaaccgacctccaggtgcccgtgcctcaagcgcttccccctcacgagcaggaagagccactgtcgattgcgcaattgcaggacttcctgcgaaacccggtaaagcactttttcagccagcgcctgaagatctatttcgaggtcgccgaagcgccgctcgctgatgaagaaccgttcgtgctcgacgcccttgagcgctacggcctcagtgaaagcctgctcaacgcggcgatggtttcccctgacaatagtgatgtcgccctgaaagcccaggctctgaaactgcaagccagcggcctgctgcctctcgccgggttcggcacctgcatgcaggacgaactgatcgagcccttgccggacgtgctcaggcgctaccacgatctgctgacgctgtggcccgaaaccttgagcagtgccttgccgatcagtttcagccaccgtggcgtcagcatcgacggctggcttggcgggttacaccgcaacactcgcggcgagctattgctggtcacggcgattcccaacagcattggctctaaaaagacccgtaagtggcatcgactgattcgcccgtgggtgaatcatctggtggcctgcgcctgtgagctgccattgagcaccgcgctggtggccagtgacgaaaccctgatgctcgacccgctggaaaaagatgctgccatcaccacgctgaaccacctgctgatggcctggctgcgcggcatgcaacaaccgctgccggtggccgtcaaaaccgcatttgcctggctgggccaacccgccgacaaagccgaagccgccgctcgcaaagcctacgaaggtgacgggcagaccaccgatggcgaacgacgcgaaagcaccgcgctggcccggcagtttgcggacttcgacgccttgatggacagcgaggaattcgcgggctggtgcgagacactctacaagccgatttacgacgcgccctggcagtcgttgtctggcggggagggtggcgcatga

SEQ ID NO: 45480 - protein, 1158 aa, Pseudomonas syringae pv. tomato str. DC3000
MSVTTPLSAGFMVVQGNRPDELRSLVVSWMRRYPLAPLENEIALVQSNGIAQWLKLALAEDAQDDDNGGCGIAAAIDVQLPGSFMWTLYRRVLGSDEIPQTSLLDKTPLTWRLMRLLPALINQPHFEPLQRFLTDDTDLRKRYQLSERLSDLFDQYQVYRADWLEDWAAGLHQLRDARGQPRPLSTANCWQAELWRALLDDVGAKGMAQSRAGVHRRFIERIGTMTEAPPGLPSRVIVFGISSLPAQALEALAGLAKFSQVLLCVHNPCRHHWTDIVADKDLLRHQYKRQARKTGMPMILDPQALHQHAHPLLAAWGKQGRDYINLLDSHDDPRSYRSSFKDERIDLFSEVEPTNLLNQLQDDILELRPLDETREIWPAIDPLEDRSLRFHVAHSAQREVEVLHDQLLARFSKDPNLRPRDVIVMVPDIDSYAPHIRAVFGQIEREDRRFIPFTLADQGQRGREPLLIAVEHLLKLPDSRFPVSEILDLLDVPALRARFRIQERDLPTLHRWIEGAGIRWGLNAQQRAGLGLPDALEQNSWHFGLRRMLLGYAVGAGTAYDGIEPYDEIGGLDAALIGPLVALIDGLQVAHTELSTPATPEQWGARLQAILQLFFIAESEHDDYLLAQLETLRENWLETCAAVNLIDELPLTVVREAWLAGLDQGRLSQRFLAGSVNFCTLMPMRAIPFKVVCLLGMNDGDYPRAQPPLDFDLMGSDYRPGDRSRREDDRYLLLEAVLSARDQLYVSWVGRSIRDNSERPASVLIGQLRDHLASGWKLAGEADPDSKLDDGERLLKALTVHHPLQPFSANYFHAGTGYFSFAREWRLLHETDLQVPVPQALPPHEQEEPLSIAQLQDFLRNPVKHFFSQRLKIYFEVAEAPLADEEPFVLDALERYGLSESLLNAAMVSPDNSDVALKAQALKLQASGLLPLAGFGTCMQDELIEPLPDVLRRYHDLLTLWPETLSSALPISFSHRGVSIDGWLGGLHRNTRGELLLVTAIPNSIGSKKTRKWHRLIRPWVNHLVACACELPLSTALVASDETLMLDPLEKDAAITTLNHLLMAWLRGMQQPLPVAVKTAFAWLGQPADKAEAAARKAYEGDGQTTDGERRESTALARQFADFDALMDSEEFAGWCETLYKPIYDAPWQSLSGGEGGA

SEQ ID NO: 45481 - DNA, 3492 bp, Vibrio parahaemolyticus RIMD 2210633
  CDS (1)..(3492)
ttgtttactgtttatcactccaaccaagttgacgttcttaaatcactccttgtcgaactgattcgaatcagtccgctggaaaacccgttcgaaaaagaacaaattctggttcaaagtccgggcatgtcccagtggctaaaaatggaattggccaaagagtttggtgttgccgcgaacattgattttccgcttcctgctaccttcatttgggaaatgtttacgcaggtgttgccagacgtgcccaagcgcagtgcgtttaacaaagaagcgatgacgtggaagttgatgcatctgctgccggggcttctcaaccaagaggtgttttcgccgttagcgcagtacctcaaagatgacagtgaccactctaagctgtatcaactggctgagaaaattgccgatattttcgatggttacttggtgtatcgtccggaatggatcgcaagttgggaagctgggcagagtgtgccagagctggaagatgaacatccgtggcagccgatcttatggcaagcgttgtacgatcacacagtgtcattagggcagtctccatgtcaccgtgccaacctttatgagcactttatcgacacgttagcgagttttaacggcaattttgaccatttacccaagcgtttgtttgtttttggcatttcttcgttgccgcctcgctatatggatgcgctaaaagcaattggcgagcacatcgacgtgcatctgatgttcactaacccttgtcgttattactggggtgaagttcgagatcgcaaatatctggctcgtttggcggcgaaacatcgtcagcacgttgtgtggcaggacgatcactcggaagtgcaaggtgaaactgagcaactgaaaggttcattggaagataatgtgatcgatgagctgcacaccgatgtggtcggaaacagtctgttggcatccatgggtaaactcgggcgcgacaatatgtatctgttgtctcagctggaatctcatgaaattgaagcctttgttgatgttgagcgcgacagtctgctccatcaattgcaagcggatattctcaatcttgaagaacatcaagatgaccaacagattgaaaacagtcatcacaaacaagtggttagcttgggtgataaatcactgagcctacacgcttgtcacagcccgatgcgtgaagtggaagtgctgcatgatcaactattggcgatgttcgatgctgacccaacgttaaaaccgcgcgatattatagtgatggtcgcggacatcaacgcttacagccctgcgattcaggcggtctttggtaacgcaccgggtgagcgttttattccctattcgatttctgaccgaaccgccgatcaagagagcccaattctggccgcatttatgcagttggtgaacttacccaatacgcgctgtttggcatcagaactactcgaacttctggaaactccagcgatattaaagcgttttgaactcagcgaagatgatttcttacaagccaaacaatgggttgaagaatcgggaattcgctgggggttggatgccaataccggacgcgaatttgaactgccggaaacccgtcaaaacacatggcaatttggtattcaacgcatgttgcttggctacgcgatgccagaatccgcaggtttgtttgaaaccgagcaaggcagtttatctccgtacaacgaagtgcaaggcatgggtgcagagcttgcgggcaagttggcacactttatccaacaaattagcacttatcgaagcaaactttctcatgttcagacaattgatggttggcgagagactttggtttcactgctggatgacttcttctcagttgagttagaaggcgaaatggcgctcaaatccattcgcgatacgctcagccaactcaaagagcaattagctgatgccgcatttgatgatgcgttatcgccgtcgatcatcagccaataccttcaaaacaaattatctggcacacgagtcagccagcgcttcctggctggtcaagtgaatttttgtaccctgatgccgatgcgctctattccgtttagaaccgtttgtctactggggatgaatgacggcgtgtacccacgctccatgccgccggaaggctttgacttgatgacgggaagaaccaaaccgggcgaccgttcgcgccgagatgatgaccgttacctattcctcgaagcgatgttgtctgcacagcaaacgctctacatcagttatgttggccgttcaatccaagacaacaccgagcgagtgccttcggttctggtttctgagctgatggaatactgccaccaaaactattgtttaagtggtgatgaagcgttgcccgttgatgagtctggcgacaacttattaaatgcgttggtgaatacccacgccatggtgccgtttagcccaagtgcgttccaaggcacgcacgctagctacgcgaaagagtggattccagcggcattgactcaaagtagtcaatcgcaaggctatgttcgtcgtgattttaatcgggcattagacgactatctgtttggagcgacgttcccacttgagctcgacttagtcgagttgcaacgtttctggcgcttacctgtgcagtattttttcaatcgtcgtttaaaagtaatctttgaaccgccactgccggtgatggaagacgacgaaccctttgttttaggtggtttggaaagctatcaaatgcgtgatgagctgttagaaaccttgcttgaaacgacattgatgcagccagagaaaaaaacagaggtgcttaaacactttatgagtcaacagcgcgcgcaaggcaaactgccggtgggggcgtttggtgatatcgaatttgaaaccaaccgagttcaggcggaagagctggtggacaaactggcgtttttatctggtgcgcctcaagacgatttggaaatcgacctgacgtttgattccttgtttgagcgaaatgaaggcgaagagaaaaacgttcgcctaacaggttggctaacccagtgttaccaatctgggttgattcgttaccgaagcggtaagattcgctcgcaggattaccttgcagcgtggatcgatcaccttgccatgtcggcgtcgggttatgccaagaaaactcatctgattggctacgatcgtaaagaaggcgcgctgcatttgatctacccagaaattgccgatgcgcagtatgccaaacagctactgactgaattagttcgcttattcttcgaaggcatgactaagcctttgccttatttcccgaaaacggcgttggcttgtgttgaagcgggctttagccgtggtcagtgggtcgatgacgaagagaaatccttgaagaaaatggctgacgcattcaatgatggcttcatgagcccgggcgaaggcaataatgcgtacatctctcgaatttggcctgcttggaatgatgagttggcctcagaagttcgtttgctgacagcattagtactgcaaggtgcgcgcttagcggttcaagacgctgatgatgtaaaagcgtga

SEQ ID NO: 45482 - protein, 1163 aa, Vibrio parahaemolyticus RIMD 2210633
MFTVYHSNQVDVLKSLLVELIRISPLENPFEKEQILVQSPGMSQWLKMELAKEFGVAANIDFPLPATFIWEMFTQVLPDVPKRSAFNKEAMTWKLMHLLPGLLNQEVFSPLAQYLKDDSDHSKLYQLAEKIADIFDGYLVYRPEWIASWEAGQSVPELEDEHPWQPILWQALYDHTVSLGQSPCHRANLYEHFIDTLASFNGNFDHLPKRLFVFGISSLPPRYMDALKAIGEHIDVHLMFTNPCRYYWGEVRDRKYLARLAAKHRQHVVWQDDHSEVQGETEQLKGSLEDNVIDELHTDVVGNSLLASMGKLGRDNMYLLSQLESHEIEAFVDVERDSLLHQLQADILNLEEHQDDQQIENSHHKQVVSLGDKSLSLHACHSPMREVEVLHDQLLAMFDADPTLKPRDIIVMVADINAYSPAIQAVFGNAPGERFIPYSISDRTADQESPILAAFMQLVNLPNTRCLASELLELLETPAILKRFELSEDDFLQAKQWVEESGIRWGLDANTGREFELPETRQNTWQFGIQRMLLGYAMPESAGLFETEQGSLSPYNEVQGMGAELAGKLAHFIQQISTYRSKLSHVQTIDGWRETLVSLLDDFFSVELEGEMALKSIRDTLSQLKEQLADAAFDDALSPSIISQYLQNKLSGTRVSQRFLAGQVNFCTLMPMRSIPFRTVCLLGMNDGVYPRSMPPEGFDLMTGRTKPGDRSRRDDDRYLFLEAMLSAQQTLYISYVGRSIQDNTERVPSVLVSELMEYCHQNYCLSGDEALPVDESGDNLLNALVNTHAMVPFSPSAFQGTHASYAKEWIPAALTQSSQSQGYVRRDFNRALDDYLFGATFPLELDLVELQRFWRLPVQYFFNRRLKVIFEPPLPVMEDDEPFVLGGLESYQMRDELLETLLETTLMQPEKKTEVLKHFMSQQRAQGKLPVGAFGDIEFETNRVQAEELVDKLAFLSGAPQDDLEIDLTFDSLFERNEGEEKNVRLTGWLTQCYQSGLIRYRSGKIRSQDYLAAWIDHLAMSASGYAKKTHLIGYDRKEGALHLIYPEIADAQYAKQLLTELVRLFFEGMTKPLPYFPKTALACVEAGFSRGQWVDDEEKSLKKMADAFNDGFMSPGEGNNAYISRIWPAWNDELASEVRLLTALVLQGARLAVQDADDVKA

SEQ ID NO: 45483 - DNA, 3372 bp, Salmonella enterica subsp. enterica serovar Typhi Ty2
  CDS (1)..(3372)
atgttaagggtctaccactccaatcgtctggatgtgctggaagcgttgatggagttcatcgtcgaacgcgagcggctggatgatccctttgaaccagaaatgattctggtacaaagcacgggtatggcgcagtggctgcagatgaccctttcacaaaagtttggtattgcggcgaatatcgcttttccgttaccggcgagttttatctgggagatgtttgtccgcgtgttgccagatatccccaaagaaagcgctttcagcaaacaaagcatgagctggaaactgatgaccttgctgccgcagttgctggataaggatgagtttgtactgctgcgccattatctgaccgacgacaccgataaacgcaaactctttcagctttccgcgcgcgccgccgacctgttcgatcagtatctggtttatcggcctgactggcttacgcagtgggaggcgggaaaaaccgtggaaggtctgggagaggcgcaaaactggcaggcgccgctgtggaaagcattggtggaatataccgccgcgctggggcagccgcgctggcatcgcgccaatctctaccaacgctttattcaaacgctggaaagcgcgaccgcctgcccgccagggttgccgtcccgcgtttttatttgcggcatttccgcgttaccgccagtgtatctcaaagcattgcaggcgctgggtaaacatattgaaatccatctcctttttactaatccgtgtcggtattactggggggatataaaagacccagcctggctggcaaaactcatggctcgccagcgtcgtcacagttttgaagaccgtcatttaccgttgttccgtgaaaatcagaatccggaagccttatttaacagcgacggtgaacaggatatcggtaatccgctactggcctcatggggaaaactgggacgggattatatctacctgctatctgaactggaaaacagccaggagctggatgcgtttgttgatattacgccagataatcttttgcatcggattcaggcggatatccttgaactggaaagccatgcggtggcgggcgtaaatcttgaggagtattcgcgcagcgacaataagcgtctgctcgatcccgaggataacagcctctcttttcacgtttgtcacagcccgcagcgcgaggtggaaatactgcacgatcgcctgctggcgatgctggaagccgatccgacgctaacgccgcgcgacattatcgttatggtggctgatattgacagctatagcccgtttatccaggcggtatttggtagcgcgccaacggagcgctatctgccttatgctatttccgatcggcgggcgcgtcagtcacatccggtgttacaggcatttatcagtctgctttcgttaccggacagccgcttcgtctccgaggatgttctggcgttgttagacgtaccggtattggctgcccgctttacgatcaacgaagaagggctgcgttatttgcgcttgtgggtcaatgagtcaggcattcgctgggggattgacgatgacaacgtgcgcgagctggaacttcctgccacggggcagcatacatggcaatttggcctgacgcgtatgctgctggggtatgcgatggaaagcgcccagggcgagtggcagtcggttctgccttatgacgaatccagcggtctgattgctgagctggtcgggcatctggcttcgctgctgatgcagcttaatatctggcggcgcggtctggcgcaggagcgacctctggaagagtggttgcccgtttgtcgcgacatgctcaatgatttcttcctgcccgatgcggacacggaagcggcaatgacattgattgaacagcagtggcaggccattatcgccgaaggcgtcgcggcggaatatggcgacgcggtaccgatttcgctactgcgggatgagctggcgcagcgtctggatcaggaacgtattagccagcgcttcctggcgggccccatcaatatttgtacgctgatgccgatgcgttccattccgttcagagtcgtttgcctgctgggaatgaacgacggcgtatacccgcgccagcttgcgccgttgggctttgacctgatgagccaaaaacccatgcgcggggatcgtagccgtcgcgacgatgaccgctacctgtttctggaagcgttaatctcggcgcagcagacgctgtatatcagctacatcggtcgctccatccaggataatagcgaacgctttccctctgtactggtgcaagaattggtggattacatcgggcaaagccactatttgccgggcgacgaaacgctgacctgtgatgagagcgaagcacgagtcaaagcgcatattacgcgtctgcatacccgtatgccttttgatgcgcaaaattaccaacccggcgaacagcaaagttatgccagagagtggttgcccgcggcgagtcagtcgggaaaagcgcattctgactttgtgcagccgcttccttttacgatgccggaaacattgactctggaaagtctgcagcgtttttgggcccatccggtacgcgcattttttcagatgcggcttcaggttaatttccgctcggaagagagtgagattcctgatgctgaaccgtttgaattagagggattgacgcgatatcaacttaaccaacagttgctcaatacgttggttgaagaggacgatgccgaacgcttgttccgccgttttcgggctgcgggagagctgccttacggcgcgtttggcgaaatattctgggatgcgcagtgtcaggagatgcagcaactggcaagccgggttatcgcttgccgtaagccgagccaaagcctggaagtggatctgctttgcaatggagttcagctaaccggctggctaccgcaggtacaggaggatggattattgcgctggcgtcccgctttaatcagcgtggcgcaaggtgtgcaactttggctggaacaccttgtctattgtgccagcggcggtagtggcgaaagtcgcctgtttttgcgcaaagagggagaatggcgatttccgcctcttgataaaacgcaggcaatggcttacctggcgcaactgattgaaggctaccgggaaggcatgtcttctccgctattggtactgccggaaagcggcggcgcatggataaaagcctgttatgacgctgaaaatgatgtcatgttagacgacgatgatactttacagaaggccaggacaaagtttctacaggcttatgaaggcaacatgatggtgagcggcgaaggcgaagatatctggtatcaacgtctttggcgtcagctggaatcggaaacgttgcaggctatcattgcgcagtcacggcattacctgttaccgctgtttcgttttaatcagtctcgttga

SEQ ID NO: 45484 - protein, 1123 aa, Salmonella enterica subsp. enterica serovar Typhi Ty2
MLRVYHSNRLDVLEALMEFIVERERLDDPFEPEMILVQSTGMAQWLQMTLSQKFGIAANIAFPLPASFIWEMFVRVLPDIPKESAFSKQSMSWKLMTLLPQLLDKDEFVLLRHYLTDDTDKRKLFQLSARAADLFDQYLVYRPDWLTQWEAGKTVEGLGEAQNWQAPLWKALVEYTAALGQPRWHRANLYQRFIQTLESATACPPGLPSRVFICGISALPPVYLKALQALGKHIEIHLLFTNPCRYYWGDIKDPAWLAKLMARQRRHSFEDRHLPLFRENQNPEALFNSDGEQDIGNPLLASWGKLGRDYIYLLSELENSQELDAFVDITPDNLLHRIQADILELESHAVAGVNLEEYSRSDNKRLLDPEDNSLSFHVCHSPQREVEILHDRLLAMLEADPTLTPRDIIVMVADIDSYSPFIQAVFGSAPTERYLPYAISDRRARQSHPVLQAFISLLSLPDSRFVSEDVLALLDVPVLAARFTINEEGLRYLRLWVNESGIRWGIDDDNVRELELPATGQHTWQFGLTRMLLGYAMESAQGEWQSVLPYDESSGLIAELVGHLASLLMQLNIWRRGLAQERPLEEWLPVCRDMLNDFFLPDADTEAAMTLIEQQWQAIIAEGVAAEYGDAVPISLLRDELAQRLDQERISQRFLAGPINICTLMPMRSIPFRVVCLLGMNDGVYPRQLAPLGFDLMSQKPMRGDRSRRDDDRYLFLEALISAQQTLYISYIGRSIQDNSERFPSVLVQELVDYIGQSHYLPGDETLTCDESEARVKAHITRLHTRMPFDAQNYQPGEQQSYAREWLPAASQSGKAHSDFVQPLPFTMPETLTLESLQRFWAHPVRAFFQMRLQVNFRSEESEIPDAEPFELEGLTRYQLNQQLLNTLVEEDDAERLFRRFRAAGELPYGAFGEIFWDAQCQEMQQLASRVIACRKPSQSLEVDLLCNGVQLTGWLPQVQEDGLLRWRPALISVAQGVQLWLEHLVYCASGGSGESRLFLRKEGEWRFPPLDKTQAMAYLAQLIEGYREGMSSPLLVLPESGGAWIKACYDAENDVMLDDDDTLQKARTKFLQAYEGNMMVSGEGEDIWYQRLWRQLESETLQAIIAQSRHYLLPLFRFNQSR

SEQ ID NO: 45485 - DNA, 3294 bp, Mycobacterium bovis AF2122/97
  CDS (1)..(3294)
atggcgcttcacctgcaccgtgccgagcgcaccgatctgcttgccgacgggctcggcgcgctgctggccgatccccagcccgaccctttcgcgcaggaactggtgctggtcgctgcccgcggcgtggaacgctggctgagccaacggctttcgctcgtgttgggctgcgggccgggccgcgccgacggggtgtgcgccggcatcgcgttccgcaatccgcagtccctgatcgccgagatcaccggcaccctcgacgacgacccgtggtcgccggaagccctggcgtggccgctgctggcggtgatcgacgccagcctcgacgaaccgtggtgccgcacgctggcatcccacttggggcacttcgcgacgaccgatgccgaggcggagctgcgccgcggccggcgctattcggtggcgcgccggctagccgggctgttcgcgtcctatgcacgccagcgtcccgggttgctggccgcttggctggacggcgacctcggcgagctgcccggcgacttggcctggcaaccgccactgtggcgcgccctggtgaccacggtcggggccgatcccccgcatgtccgccacgacaagaccatcgcccggctgcgcgacggccccgccgacctgccggctcggctttcgctgttcggccacacccgcctggcctgcaccgacgtgcagctgctggatgcgctggccgtccaccacgacctgcacctgtggctgccgcaccccagcgacgagttgtggcgggcgctggccggcttccagggcgctgatggcctgctgccgcggcggcaggacaccagccggcgggccgcccagcacccgctgctggaaacgctgggccgcgacgtgcgcgaactgcagcgcgcgctgcccgccgcccgggccaccgacgaattccttggtgccacaaccaaacccgacacgttgctgggatggctgcaagccgacatcgccggcaacgcgccgcgacccgccgagcgtagcttgtcggatgccgaccgatcggtgcaggtccatgcctgtcacggcccggcgcggcaaatcgatgtgctgcgcgaggtgctgctcggcctcctcgaggacgacccgacgctgcaaccgcgcgacatcgtggtgatgtgccccgacatcgacacctacgcaccgttgatcgtcgccggcttcggcctcggtgaggtggccggcgactgccaccccgcacaccggctgcgggtgcgtctggccgaccgcgccctgacccagaccaatccgctgctctcggtggccgccgaactgctcaccatcgccgaaacccgggccaccgccagccaactgctcaacctcgcgcaggccgctccggtgcgcgccaaattcgggttcgccgacgacgacctggacaccatcaccacgtgggtgcgcgaatcgaacatccgctggggcttcgacccgacgcaccggcgacgctatggcctcgacaccgtcgtgcacaacacgtggcggttcggactcgaccgcatcctcaccggggtggccatgtccgaggattcccaagcgtggctggataccgcgctgccccttgatgacgtcggcagcaatcgggtcgagctggccgggaggctggccgagttcgtcgaacggttgcatcatgtcgtcggcggactcagcggtgcacggccgttggtcgcatggctggatgcgctggccacggggatcgatctgctgaccgcctgtaacgacggctggcaacgcgcgcaggtgcagcgggagttcgccgacgtgctggcgcgcgccggttcgcgcgcggcgccgctgttgcggctgcccgacgtgcgagcgcttttggacgcgcagctggccgggcgcccgacccgggccaactttcgcaccggcacgctgaccgtctgcacgatggtcccgatgcgctcggtgccgcaccgggtggtgtgcctggtgggtctggacgacggcgtgtttccgcggctgagccatcccgacggggacgacgtgctggcccgagaaccgatgacgggtgaacgtgacatccgttcggaggaccggcaattgctgctggacgcgataggtgcggccacccagaccctggtgatcacttacaccggcgccgacgagcgcaccgggcaaccgcgcccacccgcggtgccgctggccgagttgctcgacgcgctcgaccagacgacgtcagcgccggtgcgtgagcggatcctggtcacacacccactgcagccgttcgaccggaagaacgtcacccccggcgcactgctgggcgccaagccgttcacgttcgaccccgccgcgctcgccgccgcccaggccgccgccgggaagcgctgtccaccaacggctttcatctccggtcggctgcccgcaccacccgcggccgacgtgacgctggcggacctgctcgacttcttcaaggatccggtcaaggggttcttccgggcgctggactacacgctgccctgggacgtcgacaccgtcgaggactcgataccggtccaggtcgacgccttggccgagtggacggtgggcgagcggatgttgcgcgacatgctccgcggcctgcacctcgacgacgccgctcactccgaatggcgtcgcggcacgttgccgcccgggcgcctcggcgtgcgacgggcgaaggaaatccggaaccgcgcgcgcgatctggcggccgccgcgctggcgcaccgcgacggccacggccaggcgcacgacgtcgacgtcgacctcggcgacgggcggcgactgagcggcacggtgacacccgtgttcggcgggcgcacggtgtcggtgacctactcaaagctggcgcccaagcatgtgttgccggcgtggatcggcctggttacgctggccgcccaagagcctggccgcgagtggtcggcgctgtgcatcggccgcagcaagaccaggaaccacatcgccagaaggcttttcgtgccgccgccggacccggtggcggtattgcgggagctggtgttgctgtacgacgccggccggcgcgaaccactgccgctgccgctgaagacgtcctgcgcgtgggcccaggcacgccgagacggccaagacccctacccgcccgcccgcgaatgctggcagaccaacaggttccggccgggcgacgacgacgcgcccgcccacgtgcgagcctggggcccgcgcgcacccttcgaggtgttgctcggcaagccccgcgcgggcgaagaggtcgccggggaagagacccggctaggggcgctggccgcccggctatggctgccgctgttggccgccgaagggtcggtctga

SEQ ID NO: 45486 - protein, 1097 aa, Mycobacterium bovis AF2122/97
MALHLHRAERTDLLADGLGALLADPQPDPFAQELVLVAARGVERWLSQRLSLVLGCGPGRADGVCAGIAFRNPQSLIAEITGTLDDDPWSPEALAWPLLAVIDASLDEPWCRTLASHLGHFATTDAEAELRRGRRYSVARRLAGLFASYARQRPGLLAAWLDGDLGELPGDLAWQPPLWRALVTTVGADPPHVRHDKTIARLRDGPADLPARLSLFGHTRLACTDVQLLDALAVHHDLHLWLPHPSDELWRALAGFQGADGLLPRRQDTSRRAAQHPLLETLGRDVRELQRALPAARATDEFLGATTKPDTLLGWLQADIAGNAPRPAERSLSDADRSVQVHACHGPARQIDVLREVLLGLLEDDPTLQPRDIVVMCPDIDTYAPLIVAGFGLGEVAGDCHPAHRLRVRLADRALTQTNPLLSVAAELLTIAETRATASQLLNLAQAAPVRAKFGFADDDLDTITTWVRESNIRWGFDPTHRRRYGLDTVVHNTWRFGLDRILTGVAMSEDSQAWLDTALPLDDVGSNRVELAGRLAEFVERLHHVVGGLSGARPLVAWLDALATGIDLLTACNDGWQRAQVQREFADVLARAGSRAAPLLRLPDVRALLDAQLAGRPTRANFRTGTLTVCTMVPMRSVPHRVVCLVGLDDGVFPRLSHPDGDDVLAREPMTGERDIRSEDRQLLLDAIGAATQTLVITYTGADERTGQPRPPAVPLAELLDALDQTTSAPVRERILVTHPLQPFDRKNVTPGALLGAKPFTFDPAALAAAQAAAGKRCPPTAFISGRLPAPPAADVTLADLLDFFKDPVKGFFRALDYTLPWDVDTVEDSIPVQVDALAEWTVGERMLRDMLRGLHLDDAAHSEWRRGTLPPGRLGVRRAKEIRNRARDLAAAALAHRDGHGQAHDVDVDLGDGRRLSGTVTPVFGGRTVSVTYSKLAPKHVLPAWIGLVTLAAQEPGREWSALCIGRSKTRNHIARRLFVPPPDPVAVLRELVLLYDAGRREPLPLPLKTSCAWAQARRDGQDPYPPARECWQTNRFRPGDDDAPAHVRAWGPRAPFEVLLGKPRAGEEVAGEETRLGALAARLWLPLLAAEGSV

SEQ ID NO: 45487 - DNA, 3342 bp, Haemophilus ducreyi 35000HP
  CDS (1)..(3342)
atgtttacggtctatttttctcagaagctatcatcactcgctaaattatttattcaattacagcaaagcaatcctaatcctaatccatttgaagcagaaattgttttagtgcaaagtgtaggaatggcacaatggttacaaatgcaaattgccaatcaaatagggatcgcaggtaactatgaattcccttttcctacgagttttttatggcaacaatatcgtgtcctctttcctgaacttcctactgaaaatatttttgaacgtgaaacggttacttggcgtttaatacgtttaattccagattatttatctttacctgaatttcaatctttacagcactatttaactaaagattcgcgtcaataccaattaaagctttatcaattagctaaaaaagtagcggatttatttgatcagtatttagtttatcgtccacattggttggttcattgggaaaatgatcggcttgagattgttcgagatgaaattctgaaccatgcaaatttaaaagtgaaaaatagcgaagatatttggcaaaatttaagttggcaggctattttatggcgcgcattaattaatgatattaaattagattgtgatgaatcggtgtttgtgacttcacatcgtgcttatttgcaagaacagtattttaataaattagataatttaacagaaatagaaaaatcaaaattacctaagcgggtctttatttttggtatttcctctttgcccgcgacgcaattagctgttttaaaaaagctcagtgaacattgtcaaattcatctcttctttttgaatccaagtgcagaatattggggagataatgttgaagatcgggtattagagaaattagcacttaagcagaaaatgaccgctaaagaattagaagcgttatttgtacagaaaaataatcagttattatcaatgtggggtaagcaagggcgtgattttttagcacaaattcttgagcaagaacccgaccaaattcttgatgtttttgatgcttgtgaaggcgattcaaatctgattaagttaaagaacgccattctttcttttgataatcctcaacaattattgcttgcttcgcaagatgattcagtacagtttcactcttgccatagcattatgcgagaagtggaagtattgcataaccgtttattgcaaatgtttgctcaagatccaacattggctgcaaaagatattattgtcatgtcagccgatattaaccaatatgcgccttatattgaagcggtcttttcgcgttatatgaaagaagataaacgctatatcccattcgcttttgctgatcagaaggccataacggttgatccaattctgatgagttttatgagtctgcttaacttaaaggaaagcttgtttgatgcggaatcattgcttgatttattagatgtgaatgcaattagagaacgttttcagtttcagttacaagatattcatattgtacggcattgggttaatcaagcaggaattcgttttggtttaacgatcgatcaatcagaatggcaaaattataatgcgtggcaaaatggtttaactcgtttattgatgggcattagcctaagagaagaaaatggcatttggcaggatagtgtagcttttaatgaaagttatggtttatcggcagagcttgttggttatttagcaaactttattgaaaaattgagtgcttggcatcaaattattcaacaaaaacagcctattgaagtatggcaaaaacaactttcattattgattaatgatttttatcaagaaaatgaagaaagcgttcacgcaattaatttattaaatatcgccttagcagaaattatccaaaaaataacagatgcgaaatttgaacagcaaattgatattgaaattattagtttattgtttaatgaaaaattgaatagccaacaaaataacttaaatttcctggtcggtaaggtaaatttttgcactttattacctatgcgcgccattccatttaaagttgtttgcttattaggtatgaatgaaagcgattttccgcgtgcacagacggtgaatagttttgatttaatgcagtatgcctctaaaaaaggcgatcgggctcggcgtgatgatgatcgttatttatttttagaagcactattatcagcacaacaatttttctatattagttatattggacaatctaatattaataataagcaacatttaccatcggtgatggtttcgcagttactagattatttcgctgaatatcttgcgcctcaatctttagcattagtcagcccacaaggtaaattttctgaacagcacttttttgcagaaatggtgcaacaacatccattaacagtatttagcttaaacaactttagcgaaacaaattatgcctatgatcgagaatggctcaccatgacccaaacggaaaaaatgcaagagttttgcccgggtgaatttaattcaaacgctgaattgcctactgaaattcagctcgaacagttaattaagtttgtggtcaatccggtgcagtatttctttaatcagcatttaggtatttattttagggataataataaacagattgaagaaagtgaaaaatttgtattgaatgcattagatcgttataaactacgtgataaattggtttgcttagatgatgatttaattcagcaaatgtttgaacaggaaaagctgaaaggtaatttacccgcggcgaattttgctcaactagcacaacaaaaaattgtagcatcggttaacattataaaagacgaattagtgggttatttaaccgaaagtgagattttagaagttgatcagacctttttaattaatggaatcgaattacgtgttgtaggtaatatttgccataggtttggtgatgaaattgttttttggaaagtcagtggtttaaaagataaagattatattcgttattggctttattatttgtttcttcgaatacaatcacaaccgttgaaattaaagattatctatttagatgaaaataaaaagaaagtattccaatttaatgaaattagccaagatgatgcagaaaagcaattacgcatttatttaaccgattatttatccagtttttcttgtttaaaatgggctatgtttgaaggtttagatgattattttaaaaatcttaataaggctgaaaatattgagcactactgtcaggaaaacttagaaaagttaatcggaaaagaattttttaatagtcgctatttaaaacgtattttaaatcaaagcgtaatgttagattatggtagtattcacagtactacattacaatggtttgagttaatgcaaactagtaaaaaaagccctcatagtaaggaaaatgaatga

SEQ ID NO: 45488 - protein, 1113 aa, Haemophilus ducreyi 35000HP
MFTVYFSQKLSSLAKLFIQLQQSNPNPNPFEAEIVLVQSVGMAQWLQMQIANQIGIAGNYEFPFPTSFLWQQYRVLFPELPTENIFERETVTWRLIRLIPDYLSLPEFQSLQHYLTKDSRQYQLKLYQLAKKVADLFDQYLVYRPHWLVHWENDRLEIVRDEILNHANLKVKNSEDIWQNLSWQAILWRALINDIKLDCDESVFVTSHRAYLQEQYFNKLDNLTEIEKSKLPKRVFIFGISSLPATQLAVLKKLSEHCQIHLFFLNPSAEYWGDNVEDRVLEKLALKQKMTAKELEALFVQKNNQLLSMWGKQGRDFLAQILEQEPDQILDVFDACEGDSNLIKLKNAILSFDNPQQLLLASQDDSVQFHSCHSIMREVEVLHNRLLQMFAQDPTLAAKDIIVMSADINQYAPYIEAVFSRYMKEDKRYIPFAFADQKAITVDPILMSFMSLLNLKESLFDAESLLDLLDVNAIRERFQFQLQDIHIVRHWVNQAGIRFGLTIDQSEWQNYNAWQNGLTRLLMGISLREENGIWQDSVAFNESYGLSAELVGYLANFIEKLSAWHQIIQQKQPIEVWQKQLSLLINDFYQENEESVHAINLLNIALAEIIQKITDAKFEQQIDIEIISLLFNEKLNSQQNNLNFLVGKVNFCTLLPMRAIPFKVVCLLGMNESDFPRAQTVNSFDLMQYASKKGDRARRDDDRYLFLEALLSAQQFFYISYIGQSNINNKQHLPSVMVSQLLDYFAEYLAPQSLALVSPQGKFSEQHFFAEMVQQHPLTVFSLNNFSETNYAYDREWLTMTQTEKMQEFCPGEFNSNAELPTEIQLEQLIKFVVNPVQYFFNQHLGIYFRDNNKQIEESEKFVLNALDRYKLRDKLVCLDDDLIQQMFEQEKLKGNLPAANFAQLAQQKIVASVNIIKDELVGYLTESEILEVDQTFLINGIELRVVGNICHRFGDEIVFWKVSGLKDKDYIRYWLYYLFLRIQSQPLKLKIIYLDENKKKVFQFNEISQDDAEKQLRIYLTDYLSSFSCLKWAMFEGLDDYFKNLNKAENIEHYCQENLEKLIGKEFFNSRYLKRILNQSVMLDYGSIHSTTLQWFELMQTSKKSPHSKENE

SEQ ID NO: 45489 - DNA, 3312 bp, Prochlorococcus marinus subsp. marinus str. CCMP1375
  CDS (1)..(3312)
ttgttaactgtctaccgaagtaacagagctgaatggttagcagaagtgctggcagctcaattacgtctaaacaagccaaagccatttcaatcagtagaaataatggttaacacatggccaacaagcagatggttatccgaacaaattgccacattcaatggcatcagtgcgttaattgagtttcctttccctaattctcatttacgaaagtttgttcaacttttcttaggtttagaagttacatcaaaggacccatggaacaccaatcaattgacttgggaaattattgacgtactgccaaaactacttaaggaagaagaatccaagcatctgcatgaatggattcaaaaaggaagcaataacaataaagaacttgacaaaagaatatggacactagccaaaagtattgcaaatacaatcaatgaatatattttgtacagacctgatgtgatcgcgcaatggtggaatttagatagtaaaccgacaaaatcattaagagatttaccacctcacattaaatggcaacctttattattgagactgttaaaaacgaaaataaaatcagagccaatatgcctacaaataaatgaagttgtaaccaggcttaaaagaaaggagcattcctcaaaggaactcccccgtgatcttctgatatttggtgttagcagtcttgctcctattcaaattgaactcattcaagccttgtcctccgtggttaatgtccaaatatttctactaactccgggacaagatctatggaaacgttgtaaaagcagaagagaggaacttggcaatgattggaaagttcctatggatggaatgtggatgctaaaaacacctcgaatagaagcaagcttgggccgaatgggatccgagtttcaacaattattggaaggaagtggcgagtatcaattaggcgaatggcaagaaaaagacctcttttcaatgccagtaaaaatagctacatacaactcaaaagaaccaacttttttggaacaattacaagaaagtctagtagtaaataaggcatcaattcaacttcatagaaagcataaagacaattcattaatctttttagagtctccaggtcaaagaagacaagttcaattaattcgcgatcaaattattcagtggttagcaaccgacgatacgctccaacccagagacataataattatgacacctcaggtaaagagattagctcctttaatatcgtccgtatttaatgatatttctgcgactaatgttaatctcccatggaagataactgatcgttcccaaattgagaaaccaggtttaattcaatttatcttagagtttatagatattgcctctagtcgtttaaccgcattaaatcttgaccgtctattaacaaatccagctctacaaaaccaatttaagcttgatcaagatgaagtcgatagaatcacatattgcctatatgagacaggctttaggtggggcatcgacgaaaaagatcgcaatggtaatagtactcatagcttagagtggtgcttagaacgctggttacttggaattgtgcttccaaatgaaccaaatttcgtagaaggagatatagctccattttcttcaacttttactgttaacgagatcacaaaatggtggaatttactatctttattatgcaagcatctaaaagcgctgaggaattcaaggaaatctaatcaatgggtttttcaattaaagtcaatagttacagatcttttagagaatgaaagcaatagaacatgggaaggtgaattgttcaatataacgatcgaaaactggtcacaagattcaaatgattgcatcttaaatatacaaccacttgtaataaaggaaatacttacagaattattttctcttgagaacggtcggttcggtcatagaagtggaaaaataaccattagtgctctagagcctatgagagcaataccccatcgagtaattgttctcatgggactagatgaattagtttttcctcgtagcgaggaacgtccaagttttaatctgctagaacaaaaacgcctacttggtgatcccaataattgtgataaagatcgctatgtgcttctagaagcaataatgtcctgtcgacaacatcttttgatcacttggaatagtagagatgaaaaaacaggagagaagcttgaggcgccagcaccaattaatcaatgcatagattatcttaagaatgaattaagtgagagtgatcaattaggtttagtccaatcacctccacctaatccgctaagtaatgaaaatttcattgctactgaatatcaacaaccaattagttgtgataggcgtaatctagaagcaagaatatttcttgataactttactaagccaaaacaaactgctttaggaattccatttagatgggaaataaattataaattcaaagaaagtattttaacgaatgatatagttaaaagttggttgagagcacctcaaattacgtggcttgagcatttgcagcttaggtccagagaaaagaaaatctcaatcgaaactatagatacatttaatctaaatgagctccaaaggtaccaattactaaatgaagaattattcacacaaaacaaccttgaaagtgataacaacgttttgcctatcttattaggtgcagatgattggcaaaaaaagcttagagggcaaggtatacttcctccaaaatcagcagcagaattagagtgcgagatacttgaagcacgaatagcaagtctctcatcactaataagggacttgggggaattagaggaaaagaatctccaaataaacaatgaaaatataacctatctgataattcaagaggatattttagtcgtagaaatcggtaagttaaagtcagctacaattatgagtgcatggctacaacatctccaggtttgcctatatgacgataaaccaagaaagacattaataatttccagaagcactactaaatcttcacaacatcaatataagctctcagcagaattcactcctattttaaaaaaagatgcaatggaaatgcttcaaactatttatatgcttgttgagcaaggcttaaccgaatgttggccagtgcctcctcaaagtgggtgggaactatttaaggctaggtatatgaaaaaaactaattctaataattactttaaaaaaaaatggaaaggtagcttcaatcaacatggtgagaaccacaattcggaaatgatattatgttttggatatgattgtgacgctgagctatttctaggtaacaaaatatttgaaaattgcttaaatattctctaccaaccaatacttaacaacttcactgcaagatga

SEQ ID NO: 45490 - protein, 1103 aa, Prochlorococcus marinus subsp. marinus str. CCMP1375
MLTVYRSNRAEWLAEVLAAQLRLNKPKPFQSVEIMVNTWPTSRWLSEQIATFNGISALIEFPFPNSHLRKFVQLFLGLEVTSKDPWNTNQLTWEIIDVLPKLLKEEESKHLHEWIQKGSNNNKELDKRIWTLAKSIANTINEYILYRPDVIAQWWNLDSKPTKSLRDLPPHIKWQPLLLRLLKTKIKSEPICLQINEVVTRLKRKEHSSKELPRDLLIFGVSSLAPIQIELIQALSSVVNVQIFLLTPGQDLWKRCKSRREELGNDWKVPMDGMWMLKTPRIEASLGRMGSEFQQLLEGSGEYQLGEWQEKDLFSMPVKIATYNSKEPTFLEQLQESLVVNKASIQLHRKHKDNSLIFLESPGQRRQVQLIRDQIIQWLATDDTLQPRDIIIMTPQVKRLAPLISSVFNDISATNVNLPWKITDRSQIEKPGLIQFILEFIDIASSRLTALNLDRLLTNPALQNQFKLDQDEVDRITYCLYETGFRWGIDEKDRNGNSTHSLEWCLERWLLGIVLPNEPNFVEGDIAPFSSTFTVNEITKWWNLLSLLCKHLKALRNSRKSNQWVFQLKSIVTDLLENESNRTWEGELFNITIENWSQDSNDCILNIQPLVIKEILTELFSLENGRFGHRSGKITISALEPMRAIPHRVIVLMGLDELVFPRSEERPSFNLLEQKRLLGDPNNCDKDRYVLLEAIMSCRQHLLITWNSRDEKTGEKLEAPAPINQCIDYLKNELSESDQLGLVQSPPPNPLSNENFIATEYQQPISCDRRNLEARIFLDNFTKPKQTALGIPFRWEINYKFKESILTNDIVKSWLRAPQITWLEHLQLRSREKKISIETIDTFNLNELQRYQLLNEELFTQNNLESDNNVLPILLGADDWQKKLRGQGILPPKSAAELECEILEARIASLSSLIRDLGELEEKNLQINNENITYLIIQEDILVVEIGKLKSATIMSAWLQHLQVCLYDDKPRKTLIISRSTTKSSQHQYKLSAEFTPILKKDAMEMLQTIYMLVEQGLTECWPVPPQSGWELFKARYMKKTNSNNYFKKKWKGSFNQHGENHNSEMILCFGYDCDAELFLGNKIFENCLNILYQPILNNFTAR

SEQ ID NO: 45491 - DNA, 3420 bp, Candidatus Blochmannia floridanus
  CDS (1)..(3420)
atgtttatggtttatcattctaattgtttagatttatttatgagattagtaattaatgtgatgtcaaatcaaaaattatctaatcctatgaaacctgagattatcttaatagaacataagataatgtcacagtggatagaaatagaattgacaaattatttcggtatttctgcaaatattatatttatgactatacagtcatttatacgaaaaatttctatagaattgttatcagatggaatttttataagtaatttttccaaaaattttatgtattggaaatttatggaaattttgcctaaattatattctagtcaaaaatgtgctgttattcagaaatatttatgttttgacgtgaatcaaaaaaaacttggacaactttctgaacaacttgtttccttatttttggaatatttaatatatcggccagattggttagatatgtggaaatctaataaaattatagataatttaaatattgaacatcaactttggcaatctgaagtatggcgtatgtttttaacacatacacaacttcaactttatgaatttaattcggaaaatcgttgtatttttttgttacaaaataattatcagcaaattgattggactaaattacctgatagaattttcatttatggtgttacagccattgctcctatatattggaagatattgaaattattaagtgatcatattgatatatatttatgggttattaatccatgtgaaaagtattggaataatactgattacatggatgatataaataagcatgtatatcatcagtcaaataatcattcctgggaagttagaaaaaaatattattataataatagatgtaataaaagtattttaaaatcaaattattctttattgaattcatggggagaggttggttttcatacattgcatttattgagtcaattggaacgaccattatttgagatacaatcctttgtgtttcccaaaactaattcaatgttgcatattttgcaaaatgaaattttacaatttaaacaatattcatcaaatgaagtgcaaaaagagtcatctatttttaaaaaatcagcaaatatgcaaaaaaatattttaaaatcaacagatcaatcaattactattcatgaatgtcatagtctatatcgtgagatagaagtattgcatgataatttgttacgtatgttttctaatgattctgcattattacctggagaagtaatagttatggcacctaatattaattgttatacagaatctattaaatctatatttaataatatgtttaacagacaattgccattttctattttaagtgatcatagcgattatatacatcatcctattatatcaactatattgaatatattagctatacctactagtcgttttactgttgaggaaattttttcattattatcaataccatctatagcatctaaattttctatagatgatgaagcaatgaaattattgcgtttatggattgttgagtctggcgtaagatggggattagaccaggatactcaagagaattttaatttgccagttactgaatggaatacttggtattttggatttaaaagaatgttattaggttatgcaataaaaaatcaaaatggatcatggaaaaatatttttccatataattatataagcgaagaatatgtacacgttgtatctggacttggagaatttttggaaatattaaaaaaatggagaaatcgtttaaatggtgcttatacattacaaaaatggatgttatattttagagaaatgattaatgattttttcgattttagtaaattaaatgtagaagaaaatcaagcactttttttgttaaaaaactgttggactaatatattggaatcaggtattcaattaggatatattaatactgttacaataaatatattaagagataagttattaattcaattaatgaatcaaaaaaaaaattatcaatttttaccaaatgctattaatttttgtaatattactccgatgtgttttatttcgtgtaaaattttatgtatcataggtatacatgacaatgagtttcctagagatagattctcgtatgattttaatttaatatcaaaaagatttagaataggagataacaatatatgtggtcaagattattatgcatttttgctagcatgtttgttacccaaggaaaaattgtatttgagttttataaataaattggcgttttgttatggtaattctataagctcatcaatttttattgatgagcttatagaatatattgctcaaagattttatttaataggtgatcaaaatttagatattatcagtaatatcaagcgtatacgtaagtatttattgtataaatatagttgtatgccattttcttgtagcaattttattgcatattcaaaaaaacaaagttttgctaatgaatggttagctgctgcttatgctgataagaatataacagtatttactcagtctcagcaacaatttttgactacttcgttacctcacattattgtttctacgatattgttacgtgatttatatgatttttatcgacatccagtacgtatgtggtttcaaaagcgtttaaaggtatatttttatcagtgtactcatgatattttattaaatgatgaaactttttttgtaagtaatttacgtcgttttcaattgaatgttaaattaattgattattttatacataataaaaatattgatacactttatcgagaattttatgattctggaatgttgccttatggctcgtttggtcaattatattggatagaacaatgtgaaaagatgtataaattagcaagtaaaattaaacgatattattcatctaagatatttacattaaatataacttttaaaattgaaactattaaattaatcggtgaattacattcagtacaagaaaatggattaatccgttggaaaccggcttatctttcaatgagggattgttttttagtatggttggaacatttaatatattgtttttcaggagggaatggagagagttggttatttggtacagatagtacatggcattttcctaatttttctaagatacaagcgcaagaattattattttttttaatttcaggatattgtttagggatcaatgtacctttattgttgttatataagtctggtggtgcttggataaattatgtatttgattggaataatagagttatatgttcagatccagatattcataaaaaggcttgtcaaaggttgatatatacttggcagggtagtagcgatgatacacagttttcttatttaagggaaagtcaagatccatatttacgtaaacttattccattatatttaaacgaagaggatatacgtattattactgatgtttcaaaagattatttgctggatcttatgagatatagaattttatag

SEQ ID NO: 45492 - protein, 1139 aa, Candidatus Blochmannia floridanus
MFMVYHSNCLDLFMRLVINVMSNQKLSNPMKPEIILIEHKIMSQWIEIELTNYFGISANIIFMTIQSFIRKISIELLSDGIFISNFSKNFMYWKFMEILPKLYSSQKCAVIQKYLCFDVNQKKLGQLSEQLVSLFLEYLIYRPDWLDMWKSNKIIDNLNIEHQLWQSEVWRMFLTHTQLQLYEFNSENRCIFLLQNNYQQIDWTKLPDRIFIYGVTAIAPIYWKILKLLSDHIDIYLWVINPCEKYWNNTDYMDDINKHVYHQSNNHSWEVRKKYYYNNRCNKSILKSNYSLLNSWGEVGFHTLHLLSQLERPLFEIQSFVFPKTNSMLHILQNEILQFKQYSSNEVQKESSIFKKSANMQKNILKSTDQSITIHECHSLYREIEVLHDNLLRMFSNDSALLPGEVIVMAPNINCYTESIKSIFNNMFNRQLPFSILSDHSDYIHHPIISTILNILAIPTSRFTVEEIFSLLSIPSIASKFSIDDEAMKLLRLWIVESGVRWGLDQDTQENFNLPVTEWNTWYFGFKRMLLGYAIKNQNGSWKNIFPYNYISEEYVHVVSGLGEFLEILKKWRNRLNGAYTLQKWMLYFREMINDFFDFSKLNVEENQALFLLKNCWTNILESGIQLGYINTVTINILRDKLLIQLMNQKKNYQFLPNAINFCNITPMCFISCKILCIIGIHDNEFPRDRFSYDFNLISKRFRIGDNNICGQDYYAFLLACLLPKEKLYLSFINKLAFCYGNSISSSIFIDELIEYIAQRFYLIGDQNLDIISNIKRIRKYLLYKYSCMPFSCSNFIAYSKKQSFANEWLAAAYADKNITVFTQSQQQFLTTSLPHIIVSTILLRDLYDFYRHPVRMWFQKRLKVYFYQCTHDILLNDETFFVSNLRRFQLNVKLIDYFIHNKNIDTLYREFYDSGMLPYGSFGQLYWIEQCEKMYKLASKIKRYYSSKIFTLNITFKIETIKLIGELHSVQENGLIRWKPAYLSMRDCFLVWLEHLIYCFSGGNGESWLFGTDSTWHFPNFSKIQAQELLFFLISGYCLGINVPLLLLYKSGGAWINYVFDWNNRVICSDPDIHKKACQRLIYTWQGSSDDTQFSYLRESQDPYLRKLIPLYLNEEDIRIITDVSKDYLLDLMRYRIL

SEQ ID NO: 45493 - DNA, 3174 bp, Prochlorococcus marinus subsp. pastoris str. CCMP1986
  CDS (1)..(3174)
ttgcttaatatttataaatcaaacaaaattgaagttattactgagctattagcaaaagaattaataattagccccccttttataacagaaaaactagatgtagcagttcctaattattttttagggaagtggttatgggaccaaataacaataagtaatcaaataagtgctctttatgaatttaagactatatcaagttataccgaagcaatattgacaaaaattttcccggcaattgatatgggagtatggaattttgattcaataaaatggggaattatagattcatttgaagaattaaacagctatgaagaatcattaccgctaagtaattggattaataaatatttaaacaataaaaagataattgatggggatattcacaacttaatcaaaaagattgcaaataattttattgagtatttaattttcaggcctgagatgatagctaattggcatagatatgagttgagttcacgaaatctttttaataatttaaattcaaatgaatattggcaaccaattttatataaattacttgagaaaaaaatgaccgagaaaccttcatgtttattcatgattgacataataaataatattaaaaaaatacataatgaagaaaatctattacctagacaaatatatattatttctgataacaatttatcaagattacatgttagcttttattctaaattagcagaatttactaaggttaatttatacttactctctgctggagataatttgtggaatagaataaattctcttgagggagaggttgattttagttctattgagagcaaatttaatttaaatagttcaaatatcgaaaaaatatttggcaaatttggagctaattatcagaaattaattgaggaaacttctaatattgaaaatataaaaataaacaataattcaatatatattgatccaacgtttagttttacaagtgagaaggatatacctttgattaatcaaattcagaaaagattaattgataatagtcaagatgattttatgataaatgaaaaggatgagtcaattatttttagggagcattttaatcaattaagtcaattagagtatgtaagaaataaagtcatagaaatattagaagcttgcgataatgttaaatacagtgatatcgctatagtatctcctcaaactagtttaataaaaccttatcttaagtatatttttaataatgaattaataaacggacaaaagctacctcatttatttcttgaagataattttgaggattcttcaaatgtatataatttcttacttgatattattgaattagcaaatgagaaaattacgcttgaaaaaatagaatattttctttctaaaaaagttaatcagaatatttttgattttgatattgatgagaaaaatgagattattttaatactaaatgaagttggttttcattggggattagatactaacgaaaggttgggtgaagaaaaaaatactttagagtggtgtataaatagaattactttaggtctagtttatgatgaacaatttagtttaaataattctaaccttaaatcatttacccctaagaattcaagcttggacttgaataaatgggttaaaattttagttcaattaaaacaatatattaatttactaagaggatcttttaattattcagattgggttaaaaagattaaatttatacttaaaaaaattagaaattttaatgataattttaatttagatatatatgaaataaatagaattcttgataattatttaatatcttcaacatctgataaagtaattgtgttgaatgtttttagagaaatattaattacatgtataaataaacttaactatagaaatcaatcttatataaataagatattagtaagtgatattgagaaggttaggctaattcctcgtaagattatcttcttgataaatatgaatagtatttattatccaagattatcgagtaatgaaaatataaatttgctaactaaaaaataccttcttggggatccatcttcttttgatagagaaaaatactttttcctagagttattaatttcctgtagaaagcaacttatagtttcttgggttaataatgataaagataataaaatattagatatttccttccctattaaggaactaataaactatttagagagctttttatctgtaaaacaaagaaagtccataatcaaatactttgattatgagaaagaagaagttgataatcctaataatagtaattttttaaaaagtcaatattctttattaaataaaatagattgggaagaaaaaatttataaatgtaaagactttaaattatctgaattgatttattggtttaaagctcctcagctttattggctcaataaaaagaatatttctcctaaagtaatatttaatcatcatccagatgaagagtatgtaagtaatttgcagaaatttaaactagttactaaagttattcagaaactagacattgataattatgacattattgatgaattaaaaaatttaaatataaacgaacaatttcttgaaaatggaattattgcgccaagaaatagtatttttacaaaaggaaaagagatacaaaacctgttaggaagtttagttgaaaatttgagtaatgataaaaatataaaaagagtttacgttaaatcaaattcaaataaagaagaatatttaatttctgataatgttgtgattgaattgattcattccaaacttagtttgaaaagtttgtcagaagcttggattaagttactctttatttcttctttagaaaagaggataacaaagacaaaagtaatttttagaaaagaaaatcaatataaatcagaaattcttcaaacaccaggccaactccaatcaaagaaaatattagaagaatatataaatatttttaagaattactctgataaatgtttacccctccctccagaaagtacatataaatatgtagaagcaaaaaagctatttaaaaatgagaaaaaagctttttctgataaatggatagggaataaaacatttaccaaaggagaaagagataatagtgtaattaaatgtgttttggaaataaaaaagaaggagacttcttttttggaaatgataaatttgatgatttatctttcagattatatggccccttatttgaggcattaa

SEQ ID NO: 45494 - protein, 1057 aa, Prochlorococcus marinus subsp. pastoris str. CCMP1986
MLNIYKSNKIEVITELLAKELIISPPFITEKLDVAVPNYFLGKWLWDQITISNQISALYEFKTISSYTEAILTKIFPAIDMGVWNFDSIKWGIIDSFEELNSYEESLPLSNWINKYLNNKKIIDGDIHNLIKKIANNFIEYLIFRPEMIANWHRYELSSRNLFNNLNSNEYWQPILYKLLEKKMTEKPSCLFMIDIINNIKKIHNEENLLPRQIYIISDNNLSRLHVSFYSKLAEFTKVNLYLLSAGDNLWNRINSLEGEVDFSSIESKFNLNSSNIEKIFGKFGANYQKLIEETSNIENIKINNNSIYIDPTFSFTSEKDIPLINQIQKRLIDNSQDDFMINEKDESIIFREHFNQLSQLEYVRNKVIEILEACDNVKYSDIAIVSPQTSLIKPYLKYIFNNELINGQKLPHLFLEDNFEDSSNVYNFLLDIIELANEKITLEKIEYFLSKKVNQNIFDFDIDEKNEIILILNEVGFHWGLDTNERLGEEKNTLEWCINRITLGLVYDEQFSLNNSNLKSFTPKNSSLDLNKWVKILVQLKQYINLLRGSFNYSDWVKKIKFILKKIRNFNDNFNLDIYEINRILDNYLISSTSDKVIVLNVFREILITCINKLNYRNQSYINKILVSDIEKVRLIPRKIIFLINMNSIYYPRLSSNENINLLTKKYLLGDPSSFDREKYFFLELLISCRKQLIVSWVNNDKDNKILDISFPIKELINYLESFLSVKQRKSIIKYFDYEKEEVDNPNNSNFLKSQYSLLNKIDWEEKIYKCKDFKLSELIYWFKAPQLYWLNKKNISPKVIFNHHPDEEYVSNLQKFKLVTKVIQKLDIDNYDIIDELKNLNINEQFLENGIIAPRNSIFTKGKEIQNLLGSLVENLSNDKNIKRVYVKSNSNKEEYLISDNVVIELIHSKLSLKSLSEAWIKLLFISSLEKRITKTKVIFRKENQYKSEILQTPGQLQSKKILEEYINIFKNYSDKCLPLPPESTYKYVEAKKLFKNEKKAFSDKWIGNKTFTKGERDNSVIKCVLEIKKKETSFLEMINLMIYLSDYMAPYLRH

SEQ ID NO: 45495 - DNA, 3198 bp, Chromobacterium violaceum ATCC 12472
  CDS (1)..(3198)
atgctgtttctctaccaatccaaccgtctcgagcaactgggcgagctgttctgcggcatgacccaggcgatgccgctggccgacccgttcgcggccgagacagtgatcgtgcagagccggggcatggggcgctggatcacgctggacgtcgcgcgcaaggccggcatcgccgccaacatcgatttcgcgctgcccgcggccttcgcctggcggctgatgcagaaggtgatgccggatctgccgcgcaaatcggccttcgtgcccgaagtgctggcctggaggctgctggcgctgttgccgtcgctttccggcgagccgttcggcccggtgctgcattacctggagggcggcgaggccgcggctttcgagctggccggcaagatcgccgacatcttcgaccaatatctggtgttccgcccggactggattcgcgcctgggaggccggcgagctgctgggcctgggcgaggacgaggcctggcaggcctcgttgtggcggcggctggccgaaagcgacccgggccgccaccgggtgcggatgctggaccagttcttcgccgatctgaagcccgagcacctgccgccacgggtaacgctgttcggcatcgccagcctggcgccgatgtacctggcgctggtcaagcggctgtcccagctgaccgatgtctgcctgttcacgctgaacccatgcgaggcctactggggcgacatcgtcgacgcgcgccggctgctgaagctcaggcaggccggcgacctgttcgccacccagggccatccgctgctgtcgtcgctgggcaagcagggcagggacttcttcgagctgatcgccgaggacgccgagctggacgccaagccgctgttcgccgcgcccaagggcgacggcctgctggcccggctgcagcgcgacatcctgcagctcaacgatccgtcgcaactgccgcggcctttcgatccggccgacgcctcgatcgaagtgcacgcctgccatggcccgatgcgcgagctggaggcgctgaaggacaggctgctggcgatgttcgccgccgaccccaagctcagcccggccgacgtggcggtgctgacgccggacatcaacgcctacgcgccgtacatcgacgcggtgttcggccgccgcgacgacgcgcccaacattccgtacagcatcgccgaccgccgcgtcgagcgcgagcagccgctgctgtccaccttcgccgccgtgttgaagctggccgattcccgcttcgccgccgacgaggtgctggcgctgttcgactgcccggcgctgctggcgcgcttcgatctggccgacgccgatctcgccttcatccaggactgggtgcgcgacgccggcatccgctgggggcgcgacgccgcgcacaaggcgtcgctgggcctgccggccgaagccgcctatacctggcgctggggactggaccgcctgctgttgggcaccgtgctgccgccggcgctggccggcgacgacgccgggctgttcgccggcctgctgccttacaccgcggcccaagggcagctgggcgagacgctggcgcgcttcgccggcttctacgacgcgctggacgcgctggcggacgcgtggtcgcagccggccgcgccgcagcaatgggcgcaacgcttccaccaggcttgcgaccgcctgttcctggccgaaggcgacgacgaggcggcgctggagctgctgcgcgaggccttggccgaattggccgagaacgcggacctggccggcttcggccagccggtgggcctggcggtggcgcgcgactggctgctgcgcaagctgtcctcgtcttcggcccagggctttttgtccggcggcgtgactttctgcgcgatggtgccgatgcgctcgataccgttccaggcgctgtgcctgatcggcatgaacgacggcgcctacccgcgcgacgagcggccggtcagcttcgacctggtggcgcgcaatccgcgccgcggcgaccgctcgcgccgcttcgacgaccgctatctgttcctggaggccatcctgtccgcccgcggccggctgtacctgtcttatgtcggccagtcggcgcgcagcggcgagccgctgccgccgtcgccgctggtgtcggagctgctggacacgctgtcggcgatgtgcggcgaggacatggcggcgcggctgacgctgcgccatccgctgcagccgttctcgcccaaggccttcgatggcggcgacgcgcggctggccagcttcgagccggccttcgccgccgcgctggccgcgccgccggccgagcccgcgcctttcgtcgcgccgctgccggacgagggcgcggcgacggtggtcaatctgcatgatttcatccgcttctggcagaacccggcgcgggcttggctggccgaccggctggcgctgcgggtcgcctacagcggcgacgcccagccggcgcgggagccgttcgcgatggcgcgcgacgccagccacgcgctgcgccgccagctggtggaggcgatgctgcacggcaagccgccgcagccggtgcggcagcgggtggccgccgccggcctgctgccctgcggcgagctgggacaggcctggctgcaggaggaggggcgcgccagcgtgcggctggccggccgcttgccgggcgcgttgcgcggcgaggcgctgccgccgcagccggttcacctggagatcgccggcttcacgctggtgggcgagctgtatggcctgaggcccgagggccggctggacttcatcgtcggcaagatgaacgccgcccagcgcgtcgcgctgtggctgagccatctgatcctgtgcgcgtcgcggccggcgggcatcgcgccgcacagcgcctgctacgacgacgccggcagcacgctgctccatgacgagatcgacgccgccggcctgctcgtgccgtggctggcgcgctggaagcagggccaggcgcagcccttgcccttcttcggccgcaccagctgggcctatgccgaggcgttggccaagaacccggacaagccggacaaggcgctggccgccgcctggcagaagtgggagcccaatttcatcctcggcgacggcgtcgcgcagaaagacgagccggcgatcgcgctggctttccgccaccagtcgccgctggaagaccctttgttcgcccagctggcggagacgctgctgctgccgctggccgaacgcctgcagggaggcgaggcatga

SEQ ID NO: 45496 - protein, 1065 aa, Chromobacterium violaceum ATCC 12472
MLFLYQSNRLEQLGELFCGMTQAMPLADPFAAETVIVQSRGMGRWITLDVARKAGIAANIDFALPAAFAWRLMQKVMPDLPRKSAFVPEVLAWRLLALLPSLSGEPFGPVLHYLEGGEAAAFELAGKIADIFDQYLVFRPDWIRAWEAGELLGLGEDEAWQASLWRRLAESDPGRHRVRMLDQFFADLKPEHLPPRVTLFGIASLAPMYLALVKRLSQLTDVCLFTLNPCEAYWGDIVDARRLLKLRQAGDLFATQGHPLLSSLGKQGRDFFELIAEDAELDAKPLFAAPKGDGLLARLQRDILQLNDPSQLPRPFDPADASIEVHACHGPMRELEALKDRLLAMFAADPKLSPADVAVLTPDINAYAPYIDAVFGRRDDAPNIPYSIADRRVEREQPLLSTFAAVLKLADSRFAADEVLALFDCPALLARFDLADADLAFIQDWVRDAGIRWGRDAAHKASLGLPAEAAYTWRWGLDRLLLGTVLPPALAGDDAGLFAGLLPYTAAQGQLGETLARFAGFYDALDALADAWSQPAAPQQWAQRFHQACDRLFLAEGDDEAALELLREALAELAENADLAGFGQPVGLAVARDWLLRKLSSSSAQGFLSGGVTFCAMVPMRSIPFQALCLIGMNDGAYPRDERPVSFDLVARNPRRGDRSRRFDDRYLFLEAILSARGRLYLSYVGQSARSGEPLPPSPLVSELLDTLSAMCGEDMAARLTLRHPLQPFSPKAFDGGDARLASFEPAFAAALAAPPAEPAPFVAPLPDEGAATVVNLHDFIRFWQNPARAWLADRLALRVAYSGDAQPAREPFAMARDASHALRRQLVEAMLHGKPPQPVRQRVAAAGLLPCGELGQAWLQEEGRASVRLAGRLPGALRGEALPPQPVHLEIAGFTLVGELYGLRPEGRLDFIVGKMNAAQRVALWLSHLILCASRPAGIAPHSACYDDAGSTLLHDEIDAAGLLVPWLARWKQGQAQPLPFFGRTSWAYAEALAKNPDKPDKALAAAWQKWEPNFILGDGVAQKDEPAIALAFRHQSPLEDPLFAQLAETLLLPLAERLQGGEA

SEQ ID NO: 45497 - DNA, 3390 bp, Photorhabdus luminescens subsp. laumondii TTO1
  CDS (1)..(3390)
atgtttaaggtttatcattctaatcaattagatcttcttaaggaattgatagcaatattgatcgggggtaacccactgactgatccatttgcgcaggaagtcattttggtacaaagcccaggtatgtcacagtggctgcaaatccaactggccgaaagaataggcatatcagctaatatttcatttccgcttcccgctacgtttatttgggatatgtttaccaaagtattgcctgatattcctaaagaaagtgcttttagtaaagatgctatgacatggaaattgatggcgttattgcctcaattgctgcctgaagcagagtttgttggactcaggcactaccttgatcaagattttgataaacggaagattcatcaattagctggacgggttgctgatctgtttgaccaatatctcgtttatcgcccgcaatggttggaaagttggcagcaaggtcagcttattgatggtttgagtgataatcagttgtggcagaaaagattatggctggaactgacgaaatatactcaccagttacaacaacctcaatggcatcgtgctaatttgtatcagcgttttatttcgatactggaaaataatactgaacaggaaaatagtactgatttttcagcttgtttaccgaaacgggtatttatctgtggcatttctgccttaccaccggtctatttacaagctttacaggcattggcacggcacattgatattcacctgatgtttaccaatccatgtaaatattattggggagatattcagaattatgcttttttggcaaaactgagtagccgtaaaccacgtcattataagagcgaacaggagctggaatattttaaagatcctgataatgctcaatcattgtttaacggtgacggtgaacaagatgtcagtaatcccttgttggcatcgtggggacggttgggccgtgataatctctatttattgtcgcagcttgagcagagttcggatattcacgcttttgttgaattagaacaggataatctattacatcaattgcaaagggatattctctatctggaagatcatgcccaaattggttcaacaaaagaaacatttgaaaacagtttgaaaaaaagagtacttgatccgttggatcgttctttatctttccatgtttgccatagccctcaacgtgaagtggaagttttacaggatcagctattgagattattggaagataatccatcgctgacgccaagggatattattgtgatggtcgcggatattgacagttatactccctatgttcaggcagtatttggtaatgtctctgttgaacgctatattccatttgctatttctgatcgtaaagctcgtcaggcacattcgattttacaggcatttattacactgcttgatttacctcaaagccgttttacaacagagcaggttttagcattgttggaagtacccgcgctggcgaataaatttgacatacatgaagatggtttgcgtttgttaagacgttgggttgaagaatcaggtgttcgttgggggctgaatgacgataatgtcgaagagctatctttaccggtgacaggtcagcatacctggcgttttggactgacccgaatgttattgggttatgcaatggatagccgatcgggcccttggaaagaggtattgccttatgatgaatctagtggtttagctgcggagcttgccggccaattggctgaatttttaatgcaattaagctattggcgcaaaattcttgctgagagccgggcattaacgggttggttacctgtctgccagcagttgctggaaacattttttgtctcagataatgagactgaattagtactagcaatgatagaacagcaatggcagaaagtcatagtcaatggcttgaatgcccgttatcaggaaagtgtgccattggttttattgcgagatgaattggcacttcagtttgataatgaaaaaatcagtcagcgttttctcgccggatctgtcaatttttgcactctaatgccgatgcgttctattccctttaaggtcgtctgtttattgggaatgaatgatggtatttacccccgttcaattccaccgcttggatttgatctgatggcggaaaaaggtcagaggggagacagaaaacgacgggatgatgaccgttatctattccttgaagctttgatatctgccgaacggtttctttatatcagctatattggtaagtctattcgtgatgatacggaatgtaatccttccgtgctggtgaatgaattactggattatgtttgccaaagtttttgtttaccgggaaatgaaaaactgaatgttgatgaaagtgctacccatgttagaaaacatctgttgtatcttcatgcccgcgttccatttgcaccggaaaattttataccgggcagttatcagcaaagctatgccggggagtggttaccggcggcaactgaacaaggtgcagcatacgctgaattttgccaatctattgaaatggcgcaaattcaagaaattacacttgataatttgagcagtttttaccgccatcccgttcggttttttttccaacgttgcttgaaagtaaatttcgttattgaagaaacggaattaccggaggaagaacctttcgttttagataatcttcaacgttatcagtttaatcagctattgttaagtgcactaattgaacagcaatcgcctgaaccacttttcaatcggctgcgtgctgctggaggattaccttttggtgcttttggtgaggtttattggttaagacagcaaaaagagatgcagcctttggcggataaaattcgtgaacaacaaatggaaactttatctgtcgatttacatcataatttaggcccggtgattctgacagggcgtattaataaggtgcaaccggatggcttgctacgttggcggcctgccagtttgacagccaatgatggcatgcaattgtggattgagcatctggcttattgtctgacaggtggtgagggtgaaagtcgcagctatgggcgtgatggcaacgaatggcgtttcgctcctgtaccttcagagtacgctaaagattatctgaatcaattgattgaaggctatcagcgaggaatatcagcacctttaccgctgttttgtaaaagtggttgggcgtggctttcagcatgtatgaataaagagactggtgagattgatgatagtgatgaaattcaatcaaaggctgaaagtcagttattgaaagcatggcttggcgatcagggacgcagaggcgaaggggatgatccttatatccaacgagctttcaggcaagtggataaatcatttttggcaaaatttaaacaggaagcgctcagttatttgttaccgatagcgcgatatcagaatacatag

SEQ ID NO: 45498 - protein, 1129 aa, Photorhabdus luminescens subsp. laumondii TTO1
MFKVYHSNQLDLLKELIAILIGGNPLTDPFAQEVILVQSPGMSQWLQIQLAERIGISANISFPLPATFIWDMFTKVLPDIPKESAFSKDAMTWKLMALLPQLLPEAEFVGLRHYLDQDFDKRKIHQLAGRVADLFDQYLVYRPQWLESWQQGQLIDGLSDNQLWQKRLWLELTKYTHQLQQPQWHRANLYQRFISILENNTEQENSTDFSACLPKRVFICGISALPPVYLQALQALARHIDIHLMFTNPCKYYWGDIQNYAFLAKLSSRKPRHYKSEQELEYFKDPDNAQSLFNGDGEQDVSNPLLASWGRLGRDNLYLLSQLEQSSDIHAFVELEQDNLLHQLQRDILYLEDHAQIGSTKETFENSLKKRVLDPLDRSLSFHVCHSPQREVEVLQDQLLRLLEDNPSLTPRDIIVMVADIDSYTPYVQAVFGNVSVERYIPFAISDRKARQAHSILQAFITLLDLPQSRFTTEQVLALLEVPALANKFDIHEDGLRLLRRWVEESGVRWGLNDDNVEELSLPVTGQHTWRFGLTRMLLGYAMDSRSGPWKEVLPYDESSGLAAELAGQLAEFLMQLSYWRKILAESRALTGWLPVCQQLLETFFVSDNETELVLAMIEQQWQKVIVNGLNARYQESVPLVLLRDELALQFDNEKISQRFLAGSVNFCTLMPMRSIPFKVVCLLGMNDGIYPRSIPPLGFDLMAEKGQRGDRKRRDDDRYLFLEALISAERFLYISYIGKSIRDDTECNPSVLVNELLDYVCQSFCLPGNEKLNVDESATHVRKHLLYLHARVPFAPENFIPGSYQQSYAGEWLPAATEQGAAYAEFCQSIEMAQIQEITLDNLSSFYRHPVRFFFQRCLKVNFVIEETELPEEEPFVLDNLQRYQFNQLLLSALIEQQSPEPLFNRLRAAGGLPFGAFGEVYWLRQQKEMQPLADKIREQQMETLSVDLHHNLGPVILTGRINKVQPDGLLRWRPASLTANDGMQLWIEHLAYCLTGGEGESRSYGRDGNEWRFAPVPSEYAKDYLNQLIEGYQRGISAPLPLFCKSGWAWLSACMNKETGEIDDSDEIQSKAESQLLKAWLGDQGRRGEGDDPYIQRAFRQVDKSFLAKFKQEALSYLLPIARYQNT

SEQ ID NO: 45499 - DNA, 3291 bp, Mycobacterium avium subsp. paratuberculosis str. k10
  CDS (1)..(3291)
atgccgcttcacctgcaccgtgccgagcgcaccgatctgctggccgacggtctcggcgcgctgttggccaatccaccggccgacccgttcgccctcgagctcgtcgtggtgcccgcgcgtggggtggagcgctggctgagtcaacggctgtcgcatgtgctgggccgcgcccgcgacggggacggggtctgcgccggcgtgcaattccgcagtcccggctcgctgatcgccgagatcaccggcacggccgacgacgatccctggtcgccggacgccctggcctggccgctgctggaggcgatcgactgttcgctggacgagccgtggtgccgcacgctggcgacgcacctgggccacttcgacaccggcgccgaggccgagctgcgccgcacccgccgctacgaggcggcgcgccggctggccgggctgttcgccggctacgcccggcaacggccgcggctgctggtcgactggctcgacggcgacccgggcgatctggacgaggacctgcgctggcaaccgccgctgtggcgggcgctgttggcccgggtggccgccgatccaccgcacgttcggcacgccgaaaccatcgcccggctgcggcgggcgcccagcgacctgccgcagcggctgtcgctgttcgggcacacccggttggcgtgcaccgacgtggagctcctggacgcgctggccactcaccacgacttgcacctgtggctgccgcacccgagcgaccggttgtggcgcgcgctggccggcacgcacggcgtgatcccccggcgcgacgacaccagccaccgcgccgtcgcccacccgctgctggccacgctgggacgggatctgcgcgaactgcagcgcggcctgccggcggatccgcggaccgacgagtacctggccggcgacgcccgccccgacacgctgctgggctggctgcagtccgacatcgccgccaatgccgttcgcccggttggccgctcgctggccgccggggaccgctcggtgcagatccacaactgccacgggccggcccgccaggtcgacgtgctgcgcgagatgctgctgggcctgctcgccgacgacccgacgctgcagccgcgcgacatcctggtgatgtgccccgacatcgaaagctacgcgccgctgatcatggccgacttcggcctcggcgacgtggtgcacggcgcgcaccccgcccaccagctgcgggtgcggctggcggaccgttccctgatccagaccaacccgctgctcggggtggccgcgcagctgctggccctagccggcggccgggtgcgggccagcgaggtgctcaacctggcccagacgccggcggtgcgcgcccggttcggcttcaccgacgacgatctggacaccatcaccggatgggtccgccaggccaacatccgctgggggctggaccggcagcatcggcggccctaccacgtcgacttcgtgcacaacacctggcgtttcggcatcgaccggatactggccggcgtcgcgatgtccgacgactcgaacgcgtggatcgacgcgacgctgccgctcgacgacgtcagcagcaatcgtgtccaattggccggccagctcgcggaattcgtcgcccggctgcagcacgtcctggactcgctcaccggtgcccggccgctgaccgactggctcaccgccgtcgccgacggcatcgccctgctgacccgggtgcgcgatgccgacgaatggcagagcggtcagctgcagcgcgagttcgccgcggtgtccgcgcaggccggatcccgcgccgacaccgtgctgcggctgcccgacgtccgcgcgctgctgacccggcacctgtccggacgtccgacccgcgcgaatttccgcaccggcacgctgacggtgtgcaccatggtgccgatgcgttcggtaccgcaccgggtggtgtgcctggtcggcctggacgacgggctgttcccgcggctcggtgtcgtcgacggtgacgacgcactggcgcgctgcccgatgaccggggagcgcgacatccgttccgaggaccggcaattgctgctcgacgcgatcggcgcggccaccgagaagctggtgatcacctacaccggcgccaacgagtattcgggtcagccacgcccgccggcggtgccgctggccgaactgctggacaccctcgacataaccaccgccgagccggtgcgcgaccgcatcgtcgtgcgacatccgttgcagccgttcgacattcgcaacatcatccccggcgagctggtgcccggggtgccgttcagtttcgaccccacggtgctgcgcgcggcgcacgcggccaccggcgaacactgcgagccaccgaagttcatctccgcgccgctgccgcccccgccgcccgctgacgtgatcctggccgatttggtcggcttcttcaaagacccggtgcaggggttctttcgggccctgcagttcacgctgccccacgacgtcgacggagtgcaggacgcgatgccggtggacatcgacgccctacaggagtggacggtcggcgatcgcatgctgcgcgacatgctgcgcgggatgaccccggaggacgctcggcaggccgagtggcgccgcggcaccctgccgccggggcagctgggctggcgcagggtgaccgagatccgcgaccaggcagcgcgattggcattggaggcgcaccagcaccgggccgagcagccgggcggcgcccacgacgtcgacatcgatctgggccgcgggcgccggctcaccggcacggtgaccccggtctacggcgaccgcctggtcgcggtgacctattcgcggctggacggcaggcatctgctcgagtcgtggattccgttgctggcgttggccgctcacgatcgcggccgcgactggtcggcggtgtgcatcgggcggatgcgccggggcaccggcatccgggtgcagcggctcgggtcgccggacgacgatcccgtcgagctgctgcgcgagctggtgagcatttacgacgccgggcggcgcgagccgattccgttgccgctcaagacctcctacgcgtgggcggccgcccgctacggcggcgacgacccggtggccgaggcgcgctaccggtggaagtccagcgaccgctaccccggggaggaccaggcgccggcgcatgtgcgggcctggggacgcggtgcgccgctggacgacctgatgcggccggtgcgcccgggcgaggagtgcgacggcgaggacaaccggctcggcgcctacgcggcccggctgtggctgccgatgttgcgggccgagcggacgacggcgtga

SEQ ID NO: 45500 - protein, 1096 aa, Mycobacterium avium subsp. paratuberculosis str. k10
MPLHLHRAERTDLLADGLGALLANPPADPFALELVVVPARGVERWLSQRLSHVLGRARDGDGVCAGVQFRSPGSLIAEITGTADDDPWSPDALAWPLLEAIDCSLDEPWCRTLATHLGHFDTGAEAELRRTRRYEAARRLAGLFAGYARQRPRLLVDWLDGDPGDLDEDLRWQPPLWRALLARVAADPPHVRHAETIARLRRAPSDLPQRLSLFGHTRLACTDVELLDALATHHDLHLWLPHPSDRLWRALAGTHGVIPRRDDTSHRAVAHPLLATLGRDLRELQRGLPADPRTDEYLAGDARPDTLLGWLQSDIAANAVRPVGRSLAAGDRSVQIHNCHGPARQVDVLREMLLGLLADDPTLQPRDILVMCPDIESYAPLIMADFGLGDVVHGAHPAHQLRVRLADRSLIQTNPLLGVAAQLLALAGGRVRASEVLNLAQTPAVRARFGFTDDDLDTITGWVRQANIRWGLDRQHRRPYHVDFVHNTWRFGIDRILAGVAMSDDSNAWIDATLPLDDVSSNRVQLAGQLAEFVARLQHVLDSLTGARPLTDWLTAVADGIALLTRVRDADEWQSGQLQREFAAVSAQAGSRADTVLRLPDVRALLTRHLSGRPTRANFRTGTLTVCTMVPMRSVPHRVVCLVGLDDGLFPRLGVVDGDDALARCPMTGERDIRSEDRQLLLDAIGAATEKLVITYTGANEYSGQPRPPAVPLAELLDTLDITTAEPVRDRIVVRHPLQPFDIRNIIPGELVPGVPFSFDPTVLRAAHAATGEHCEPPKFISAPLPPPPPADVILADLVGFFKDPVQGFFRALQFTLPHDVDGVQDAMPVDIDALQEWTVGDRMLRDMLRGMTPEDARQAEWRRGTLPPGQLGWRRVTEIRDQAARLALEAHQHRAEQPGGAHDVDIDLGRGRRLTGTVTPVYGDRLVAVTYSRLDGRHLLESWIPLLALAAHDRGRDWSAVCIGRMRRGTGIRVQRLGSPDDDPVELLRELVSIYDAGRREPIPLPLKTSYAWAAARYGGDDPVAEARYRWKSSDRYPGEDQAPAHVRAWGRGAPLDDLMRPVRPGEECDGEDNRLGAYAARLWLPMLRAERTTA

SEQ ID NO: 45501 - DNA, 3399 bp, Leptospira interrogans serovar Copenhageni str. Fiocruz L1-130
  CDS (1)..(3399)
ttgtcgatcactcatattacaagtctatctcttgaagatataacttcggaactttctcagaatatacttaaggaaagaaaaaatttcccacttcgttctattacgatcgtagttccgagcgtgaacatgaggtcttggttaaatctgaaccttgctcgtatttccggactttgtgctaatcttagatttttgtttttagaaaaagcgcttgaagagtattttcattttagagcgggtttagattatgatccgtttcaaagaacgtttccaagtcaagatgcgattcagagaaaaattttaacctttctaatcgaaaatttaaattctgaagaaactaaatttttaggttcttttttagaaagtattccgcgcgcgttttctttaagtgcaaaactaacttcgctttataaagattacgaattaaatcgatcttcttggattcagagttgggcaaacgaaaagggtttagatattccttctatttctcatagaccgacaccgttcccaaaagaagacgaatattatctttttcaaaagaagttatatcaaaaagtttttttgaattcgaatcaaccgagtacactcattcaattttttctcaaagaagtttttaaaaaccctaggcgttcccctcaagattctttacatcttttttgtctttctaatcttgcagatacatatttaggaattttagaatccatttctaaaaaggataaacttcctatttatctctatcaatttcatactggcgcttctactaagacggaatctttagggccacaaagatggtccaatcctcagattcatatctcttctaaaatagtttctattccaggaactatttctaaaaatctagaagatactcgtatatatcccgaaaaactttccgcacttaaaaatttgctcaaaggagagataagagggcataacgtagaaaatttttcaggggacttttcggtccgtttttggaatgctccttcttcctatcgagaaatagaatcggtcgcaaatgatattctctataagatgaatcaggatcggacactaacgtatctagattttgcagttttggtcacggatatgaaggtttatcgtcccgccgtagaatgggtgtttgatggaggaattcttctacaaactaaagtggacgcagacccgattcgaaaaaaaattccatattctttgacggacatcaacgcgaacgaagcttctcttttgtatcgaggtttgatgaacttttgggaaatttgttctggaaatttcgttcgtaaaaacgatctcttaaaacttcttagaaatcctcttttgcagaaaaagattcgtattcattctgaagatgtacaggaactggaaaagctgatcgaaacttctggagtcagatacgaagaatccggaagagaaaatgatacattccaaatttcgaatggacttaaaaggattcgattgtcttcaattctttctcaagaggccgcttggacaaaatataaaatttctcagattcctttggaatctgaagaatattctttgcacctaactcttttctgggaaacggttctcaaagtaaaaaaagatattctttctttttttgcaaacgaaacgattcgatggacttccgaatatctaaaagtagtacaaacttctatcgaagaactttttgagttctcagaagaatatgaacaagaagccaaactttttcacagttggttacaatcgctttctgaatgggaaggaatccaattacaaaatccagaacaaggaatttctcttttgaaatttctcacggaacaagttttcaatcaaataccttatcgtaaaggagcttatcttactggaggagttacgatttctcttttacaaccaatgcgtcccattccttttaaacatatttacgttttaggattgggagaaggaaagtttccaggttctgacgatatttcacaattaaatttaagaaaacattttcgagaagaatgggatatttccaaaagagaaattcaagaattccttttatgggaaacgattcattctgcaaaggagtcgatcactttcagttatgtaggtaaaaatttgcaagaggataaaacgttcgaaccttgttctcactttcttgaaatcatggaatttttggaagttaaggatgttgttcgtcttccattacattcgtatagtataaaatacgaacatactcttcgagagttaaaacaaggtttggtgagttatgattttgcaagagtttgggttaacggaaaacgaaaggatcatcctgttttggatcgatttcagaatccagacgaactgataaaaaatcattctgatctttctcgttctacaattgacgtaaaagaactttctcaatttttaagcgaccctttggacacgtatctcaaaagaaaactggcgatgtatttagaagaagaatatgccgaggaaaacgaaaaagaacctttttatttggatgcgattgaagaaactcatatattaaaaaaagtgcatgcactgatgattccagatctagttttagaaaagccttgggtttgggatcaagaaaaaatcgttcaagcagttactccgattttagaaaaggaaaagttttctgcaaagttccctgcgtccgtatttggaaaaatacaagaagctgatttggttcaatatttagtaaaaactagtgaacacctttcggaatggaaacctctttttcaaggagggaagtattatccgtatttaagtttaggagatacaggattgccggatgcgatctgtaaaaaacttcctgccctaaaggttcctttagaatctggtgatttttttcttcaaggagaatgggaacacgttatcgaaaaagaagggaatttatactggttgttttctaaaagtttagaagaaaaacctagcgaggattattttggttataaggattattggaaggtgatgagttttccctttttaaccggagtcgcatttgcatcttctaacgaaaattttaagatctattcttttaagcctaggccttccgaagaatctaaaaaaaagaatattctagaatttgaatatgatataaaaagctcttctttgggaatggaatatcttactaaaatagtgacggaatatttaaaagaagaacctatcttttttcctcgtagagcatttctaagttattacgttaaaaatatacaagtaagttctggtaaaaataaaactgtcgaagacttgtcaaaatttgaagacgaaagcgtttggattcgttttcttaaagaagaattgaacggaattaaggaaaacttatctccactggtaaaactgtatcccaaaacacctgaattaattttacaatcccgaatccgatgggccaaatatttttacaaacctctcttgaattggaaaaagatttatgaacgttag

SEQ ID NO: 45502 - protein, 1132 aa, Leptospira interrogans serovar Copenhageni str. Fiocruz L1-130
MSITHITSLSLEDITSELSQNILKERKNFPLRSITIVVPSVNMRSWLNLNLARISGLCANLRFLFLEKALEEYFHFRAGLDYDPFQRTFPSQDAIQRKILTFLIENLNSEETKFLGSFLESIPRAFSLSAKLTSLYKDYELNRSSWIQSWANEKGLDIPSISHRPTPFPKEDEYYLFQKKLYQKVFLNSNQPSTLIQFFLKEVFKNPRRSPQDSLHLFCLSNLADTYLGILESISKKDKLPIYLYQFHTGASTKTESLGPQRWSNPQIHISSKIVSIPGTISKNLEDTRIYPEKLSALKNLLKGEIRGHNVENFSGDFSVRFWNAPSSYREIESVANDILYKMNQDRTLTYLDFAVLVTDMKVYRPAVEWVFDGGILLQTKVDADPIRKKIPYSLTDINANEASLLYRGLMNFWEICSGNFVRKNDLLKLLRNPLLQKKIRIHSEDVQELEKLIETSGVRYEESGRENDTFQISNGLKRIRLSSILSQEAAWTKYKISQIPLESEEYSLHLTLFWETVLKVKKDILSFFANETIRWTSEYLKVVQTSIEELFEFSEEYEQEAKLFHSWLQSLSEWEGIQLQNPEQGISLLKFLTEQVFNQIPYRKGAYLTGGVTISLLQPMRPIPFKHIYVLGLGEGKFPGSDDISQLNLRKHFREEWDISKREIQEFLLWETIHSAKESITFSYVGKNLQEDKTFEPCSHFLEIMEFLEVKDVVRLPLHSYSIKYEHTLRELKQGLVSYDFARVWVNGKRKDHPVLDRFQNPDELIKNHSDLSRSTIDVKELSQFLSDPLDTYLKRKLAMYLEEEYAEENEKEPFYLDAIEETHILKKVHALMIPDLVLEKPWVWDQEKIVQAVTPILEKEKFSAKFPASVFGKIQEADLVQYLVKTSEHLSEWKPLFQGGKYYPYLSLGDTGLPDAICKKLPALKVPLESGDFFLQGEWEHVIEKEGNLYWLFSKSLEEKPSEDYFGYKDYWKVMSFPFLTGVAFASSNENFKIYSFKPRPSEESKKKNILEFEYDIKSSSLGMEYLTKIVTEYLKEEPIFFPRRAFLSYYVKNIQVSSGKNKTVEDLSKFEDESVWIRFLKEELNGIKENLSPLVKLYPKTPELILQSRIRWAKYFYKPLLNWKKIYER

SEQ ID NO: 45503 - DNA, 3588 bp, Parachlamydia sp. UWE25
  CDS (1)..(3588)
atgttcttgctaaaattttatgttggattcaacaaaactgtatgcaaggaaggatgtaaacttctaaccctaacagttgatacaccaaaaagtgagccctttgtgagcgatttagaagttttttttagtaaccagctatcaatcctctacgagcagctgaagaataatcttttcggttttaagcaaacgcctttcaaaaagcgacttgtgattgtttatggaccagccatgcaaacatggctaactttaaaaatggcgcaagaccctgatttaggaatagcagctggaattgaatttctatatcttaatcaggcttttgaaacactcattcactattttcaattaaaaaatgaaaagataccttctattttagagctatctttggccattgaaaaagaattattaactgttttgcaagattatcatcggttaagtgatgaagaacaacaagactggttaactttgatttattatttaaaattaaattctaagcaggtgggcgaaaatcttaaattaacacgtaaaatggaaaagcgattgacaggtttaagctatcatttagctaaaatttttcaagagtatggaaaatatgcttattcattagtctctaaatgggaaaaatcagaacatagaggttggcagagtcgtttatggaaaagcctttttgggggcaatcaaggatggacttattggactaaagccttccaaaaaacacttaaattttttcctgagtgtgaagtccattttttctcaatcagttttatttctaaagctgaatttcaatttttatcgaagctggcgaatgttgcccctatttactattatttactttctccatgcgcagttttttggagtgatattcgttccgataacgagacaagatatttgcaaacctactggcagcagaaattaggctcgaaggcttctcaagttttacaattagaagaacttttaagagatcgaaatccccttttagctaattttggaaaacttggaagagaaatggcttatcaaattgaggagagtcaagctactactcacgctggttatatccttccaagtcatgtgagtgaattgaatgatgaaatattttttcaagaagatctttttttaaaggagtctttacaacctttgactcttcttcatgcaattcaagctgatatattgatgatgcgtaaccctgaaggaaagcctccttttaattttgaacgaaaagatgattcaatccaattgcacattgctccctcgattcgacgtgaaatacaaatcctttatcacaatcttttaaaattatttgaaaaagattctactttgcaacccaatgacattattgtgatggctcctcaaatttctgattacgtcccttacattcaaagtgtttttggtttagaagaaagtcaattagattttcaaattcttgatttgggcatgcaagcacaaagtgaaatcgtccaaggttttttccaattgattcggttaagtgaaagtcgttgggaagtgagtgaattattacagttgtttgggcaccgtctatttcaacgatgtcatcaattgactcaaagtgattattatctcattcaagaatggattcaacaagcaggcatccgttggggagaagattggctacatcgaaatgagttacttcagaggcatcattgtgagaaagagatggtagattctagctcagttggaacctggaattttggtttaactcgtttgttacttggattaacaacagttgtcaaatctgccgattctcattcttttgattctattccatgtgaaggaattgacttttctcaagcagaattaatggagaggtggattcgattgttgcattctttacgagatgatttatcgccattacatgatcgctctcaaatgtgtatggaagaatggtcttgttatctctcttgtttattagacacttattttaagtgtgaatttgaagattctcagtcgatagcagactacgaagaattaaaatctcaatttaagcttttaggtgattctgcaaaaacttttaaagaaacaaaattttctttccaaactattaaatttcatttgaacaatcttttacaacaaagaggaattacttatcgagaaagccacctgcaaaccatccgattttgttccatgatgcctcttcgttctattcctgccaaagtaatcgcagtactaggaatgcaagaaggagcttttccccgcgcaggctatcatacttcattgaatttaatggttgggcaagacaatcttgactataacccaaactctacagattatgatcgttatttatttttagaggctcttcaatctgttacagacgttttcatcgttagttatcaaggatatacctaccaagattccaaagtattgcagccaagtttgattattgaagagtttttcacctatttggataaatattatctcattcaaaataaaaaaatttctgaacaatgtgtaagtaaacatccatttgatgcatttgacgtctcttatttcaaaccaaattctattttaaataattactcacaattcgactatagaattgctgaacaatactaccaaactcataaaactccttctcatcgattacttaaacaatttattttaagtaactactctcttgaagatatccttccttctcacacagtgattgatttaaaaactttaaatacgttagttcgctcacctgttaaattttatttgaatagagggttagacatttatttggagggctatgaagatcggattattaaaaaccaagaagagcttggattatcagccttaaataaatatcagctcaaacaatttgcattaaaggaaccatttgaaaaagtgatgcagattgcagataaagaaggaaaacttcctttgggaatgttcaaaacagttgcgacaaaacgtttcaaagatgaaatagatgaagtgcatcaaagattgtataaacatggtattaatccttccgaactttttcaaatcgaattttgtactagttgttccgaaccttgccaaattcaaaaagatcaatggttacttccagctcttcaactgaattattctgatcaatatcaaatttctataattggaaagttgccctttgtttctaaaaaaggccttgttgttttaagtcaaggaagtggattttcagatgcttggaaagcatggccccaatttctgctttttaattatgctacaacttttaatattgaggcgattgaaagaaaccttattctttcaaaatcttcagaggtcaaaaaggctttttttaaagatagcattccttatttaaagcatttgattaattattatgcactatctatgcgcaatttttctccgctctttcctgattggattccttcccttattgaaggggatgaacaggcaattcaaaattacatgaaacaggtcttttcaaattcttttggagcttttttaaatcaagaattaaggtgggtttttaataaagaccatctaccttgcccgaaaattttaatcgaatcttggcaagagatcggtaaacaactagccggagatttgattcaattatggtatcctcctaaaaagaagaaaggggaagatgcatga

SEQ ID NO: 45504 - protein, 1195 aa, Parachlamydia sp. UWE25
MFLLKFYVGFNKTVCKEGCKLLTLTVDTPKSEPFVSDLEVFFSNQLSILYEQLKNNLFGFKQTPFKKRLVIVYGPAMQTWLTLKMAQDPDLGIAAGIEFLYLNQAFETLIHYFQLKNEKIPSILELSLAIEKELLTVLQDYHRLSDEEQQDWLTLIYYLKLNSKQVGENLKLTRKMEKRLTGLSYHLAKIFQEYGKYAYSLVSKWEKSEHRGWQSRLWKSLFGGNQGWTYWTKAFQKTLKFFPECEVHFFSISFISKAEFQFLSKLANVAPIYYYLLSPCAVFWSDIRSDNETRYLQTYWQQKLGSKASQVLQLEELLRDRNPLLANFGKLGREMAYQIEESQATTHAGYILPSHVSELNDEIFFQEDLFLKESLQPLTLLHAIQADILMMRNPEGKPPFNFERKDDSIQLHIAPSIRREIQILYHNLLKLFEKDSTLQPNDIIVMAPQISDYVPYIQSVFGLEESQLDFQILDLGMQAQSEIVQGFFQLIRLSESRWEVSELLQLFGHRLFQRCHQLTQSDYYLIQEWIQQAGIRWGEDWLHRNELLQRHHCEKEMVDSSSVGTWNFGLTRLLLGLTTVVKSADSHSFDSIPCEGIDFSQAELMERWIRLLHSLRDDLSPLHDRSQMCMEEWSCYLSCLLDTYFKCEFEDSQSIADYEELKSQFKLLGDSAKTFKETKFSFQTIKFHLNNLLQQRGITYRESHLQTIRFCSMMPLRSIPAKVIAVLGMQEGAFPRAGYHTSLNLMVGQDNLDYNPNSTDYDRYLFLEALQSVTDVFIVSYQGYTYQDSKVLQPSLIIEEFFTYLDKYYLIQNKKISEQCVSKHPFDAFDVSYFKPNSILNNYSQFDYRIAEQYYQTHKTPSHRLLKQFILSNYSLEDILPSHTVIDLKTLNTLVRSPVKFYLNRGLDIYLEGYEDRIIKNQEELGLSALNKYQLKQFALKEPFEKVMQIADKEGKLPLGMFKTVATKRFKDEIDEVHQRLYKHGINPSELFQIEFCTSCSEPCQIQKDQWLLPALQLNYSDQYQISIIGKLPFVSKKGLVVLSQGSGFSDAWKAWPQFLLFNYATTFNIEAIERNLILSKSSEVKKAFFKDSIPYLKHLINYYALSMRNFSPLFPDWIPSLIEGDEQAIQNYMKQVFSNSFGAFLNQELRWVFNKDHLPCPKILIESWQEIGKQLAGDLIQLWYPPKKKKGEDA

SEQ ID NO: 45505 - DNA, 3666 bp, Acinetobacter sp. ADP1
  CDS (1)..(3666)
atggccatacatgtaatacaaagtcagcgtattgatgttttgctacaaggcgtgtggcaatcggtgcatcaacctacacgtcagccctttgatgtgttggcaacacagcactttattgtaccaagtcctgctgtagagcaatggctgactgaaaaattatctgagttgcagggaattacagcaaactacctgtttcatcaacgtattcgtggctttcaatggtatgcctatcagcaggttttgagtgaacataaggatgatgttcgtaaagcgaatattccccgtttaattttaaagtggcgtgtctatcaggcgttatatgactttattcagcccgatcagattttaattactcaagatcatcctgcgtattcgattattgcccgtatttatgacagtgctgaccgccttgaaaatggatttgaaaaacagttaaaaaaacaaaaaatgctgtactgggtggcagagcaagtctcgcagctctttagcaactatatgatttatagggggcattgccagaaaaattgtgctggaaattgtggttgcgccagtaactggttaagtgcttggggagaaaaccgcgagctggatatcgagcaactcatcgttcagggaaacaaggagatttcggcctttcagttgcaacaggctcaggaattggaggcatggcagcgctggttgtggcatcgctattttcatcaggattttttggatattcagaacattgatgatctgttctggcaagtccttgaacagccacagacacgggatatcgcattaaaacgcttacctaaacagattgtgatgtttaccttgctggatttgccaccaagtcagttgcagtttttgcgccgtttaggccaatatttagacgtgttgatcttgcattacaacccatcacaggaatattgggcagacagtgtcgatccactttggaagcagcgttacgatgtacgtgtcaaacagcgctttattgaaaaaaatccagcggctacagatgtggatattgcccagttttttgagcagtttaccttgcatttcaatgcagaagcacgagagtccagacatccattgcttacccgactgggtaagcaggcacgcgatcatttttcattacttgccaatctatctactggtgaagaaggacgctgggtggatgcttttgttgatgactttcctgacactttgctggggcaagtacaatcagatatcttgaatctggctgagcctcaagcagggcgatatacgctagagccatcagatgaatctattcgttttcacgtgtgtcattcgagtcttagacagcttgaggtcttgcgtgatcagttgattcactggttgtcacaaaatgatgatgcttcggtgcgccgcccaaatgatattttggtggttgtaccaaatattaaagaaattgaacccctgattcggagtgtgtttccagcaacgccaagtgatgatggcgtctttttacctatcaaaatttcaggcgtggttcaactggatgtgatgaatgcctggcgtgctgtgctggggcgtatgacattattgcaaggacgtttgagctacgatgattttgcagactggttaagcctgcctgctactcaggtttgttatgatcttgaagatagtcagatcaaacgtatgctggcgttactggctggcgcaggatttaaacgtggctttgacatacaccatttacaacaaagcttaagtgccgaggatcatgatgatcgttatagttttaaatttgcgctagatcggctggcactgggtatcgcgattcctgagcataccttgtttcagggtgtattgagttatagtggcgttacacctgatgactttgaattgattggaaaactcattcagatctatcaggatattgatgcacgacgtaattgggtgcttgctcatgagcaaggcacgcagcattcagttgaagactggctcaaaatcctgatgcaggacgtgattgagtttgagcaggcgggtgtggttgctttaaaaactgcgcgcgagattatcaagaaacaagaacgaatggtcacgctggccagtttttatgcagacaaagatgcgcataccttacgtcagatcgctttgcctttgccttatattttagatgagattcaacgcaccctagaacatcaatccgctcaggctgagcctacggggcagattacctttagtcagattggacagattcgtcctttaccctatcgcttggttgtcatgctaaatctggatacaggaagatttccaaaccgagacagtcatattccttttgatttgatggatgcacttaggcaacaactgggtgatcgttctcgtctcgaagatgatcagggcgcttttttagatgcagtgttattggcacaacaagctttgtggcttttctataatggatttgacttgaatgatggagaagtacgggagccgtcaagtattttgcaggagttccgtgatcatctggctttgattgttgcaccagcagagcagatagcaaaacatgaggattccaatttaactatccagatgcaacagcaacagttcaaattgctcgatattcccaaccagttatggcctttatattgcgtgcatcctttgcaaccatttgatccgttagggtttgggaatttgcctgtagcaaaacgttatcaagatcagtggtatcaggtggcgcaaagtattcaggaggcatctgcgatattgcaaccttgggtcaatatggtgtacacgcagccacagcaagagctgagggtactcgatagccagcagtggatggcagatgtgactttccctgcgcgtttgtatttaaaaaatctgggtgtcgaaaatctggccatgaccactttgctggatcaaaatgaacctttatttctggatggtttagggcgctatgccattcgaaactttctacaaaaacaagaacaaaccacgacgccagacactttgctggatcagttgcctgttgggaaaattaaacatagtgcttggcagcaaagcttggcagagcaagagcgattactggagcgtctgcatcactatacaactcagcctacagccacaacacatcacgtctggcgggtttctaaaaccctgcacttaaatatcataatgcctgaacatgacgtacaggactgggtcagcctggaagcttccagtgcacgtgcaaaacgcatcgccaaagtctggctggaatatctgctatggttatcgtacttaaatgaaggtgacgctggacagcgtcgccgtcgtattgtggtttttagtgatcagactgtgatttgtgaaggggtgagctcgattcaggcacgggattatctcacacaatggctaaaaatgtggcaagtggcatctacacaacctgtcgtgctacccgccgccttgattctgcaacctctggaaaaagcgaaacagtatcactgggtgcagcagtcagaccaatttcagttagtagaaaaagatctgttgaatattttgaaagaatggcaagaccccaaagcgtatatgcaaatagatacctcacagcttgaaagcagccagtatcatcttgactggtcatttattttacaacagcaagatgcaactgctttattgaaagatgcattgcagcgttattcatatgatttgtatgcgccaatttttcagtatctgcgtctggagtaa

SEQ ID NO: 45506 - protein, 1221 aa, Acinetobacter sp. ADP1
MAIHVIQSQRIDVLLQGVWQSVHQPTRQPFDVLATQHFIVPSPAVEQWLTEKLSELQGITANYLFHQRIRGFQWYAYQQVLSEHKDDVRKANIPRLILKWRVYQALYDFIQPDQILITQDHPAYSIIARIYDSADRLENGFEKQLKKQKMLYWVAEQVSQLFSNYMIYRGHCQKNCAGNCGCASNWLSAWGENRELDIEQLIVQGNKEISAFQLQQAQELEAWQRWLWHRYFHQDFLDIQNIDDLFWQVLEQPQTRDIALKRLPKQIVMFTLLDLPPSQLQFLRRLGQYLDVLILHYNPSQEYWADSVDPLWKQRYDVRVKQRFIEKNPAATDVDIAQFFEQFTLHFNAEARESRHPLLTRLGKQARDHFSLLANLSTGEEGRWVDAFVDDFPDTLLGQVQSDILNLAEPQAGRYTLEPSDESIRFHVCHSSLRQLEVLRDQLIHWLSQNDDASVRRPNDILVVVPNIKEIEPLIRSVFPATPSDDGVFLPIKISGVVQLDVMNAWRAVLGRMTLLQGRLSYDDFADWLSLPATQVCYDLEDSQIKRMLALLAGAGFKRGFDIHHLQQSLSAEDHDDRYSFKFALDRLALGIAIPEHTLFQGVLSYSGVTPDDFELIGKLIQIYQDIDARRNWVLAHEQGTQHSVEDWLKILMQDVIEFEQAGVVALKTAREIIKKQERMVTLASFYADKDAHTLRQIALPLPYILDEIQRTLEHQSAQAEPTGQITFSQIGQIRPLPYRLVVMLNLDTGRFPNRDSHIPFDLMDALRQQLGDRSRLEDDQGAFLDAVLLAQQALWLFYNGFDLNDGEVREPSSILQEFRDHLALIVAPAEQIAKHEDSNLTIQMQQQQFKLLDIPNQLWPLYCVHPLQPFDPLGFGNLPVAKRYQDQWYQVAQSIQEASAILQPWVNMVYTQPQQELRVLDSQQWMADVTFPARLYLKNLGVENLAMTTLLDQNEPLFLDGLGRYAIRNFLQKQEQTTTPDTLLDQLPVGKIKHSAWQQSLAEQERLLERLHHYTTQPTATTHHVWRVSKTLHLNIIMPEHDVQDWVSLEASSARAKRIAKVWLEYLLWLSYLNEGDAGQRRRRIVVFSDQTVICEGVSSIQARDYLTQWLKMWQVASTQPVVLPAALILQPLEKAKQYHWVQQSDQFQLVEKDLLNILKEWQDPKAYMQIDTSQLESSQYHLDWSFILQQQDATALLKDALQRYSYDLYAPIFQYLRLE

SEQ ID NO: 45507 - DNA, 3399 bp, Erwinia carotovora subsp. atroseptica SCRI1043
  CDS (1)..(3399)
atgtttagaatctatcactccaatcagttggatatcttgaaaagactgatggttgagctgataaaacgtcagccgcttgtggatcctttccagcaggaagtgattttggtacaaagcccggggatggcgcagtggttgcaaattgaactggctacggactttggcattgctgccaatattcaattcccgctgcccggcgtttttttgtggaatatgtgtcgccatgtgctgccggatattccaaaagaaagcgccttcagcaaggatgcgatgacgtggaaactcatgcatttgctacccgatttgttggcacagcctgacttttcagcacttaaccactatttgcaggatgatgataaccagcgcaagttgcaccaacttgccggacgcgtggcggatcttttcgatcaatacctgatttatcgccctgattggattaaagcatggcaagaggggaaactggttgacgatctcggtggtaaccaactgtggcaatcggcgctgtggcgcgcgctggtggattacacgcgtgaactggcgcagcccgaatggcaccatgcgattctataccaacgttttattcgtgcattagagcatgcaaaaacatgtcctaaaggtctgccgccacgcgtttttatctgcggtatctccgcgttacctccgatctacttacaggcgttgaacgcactggcgcagcacattgatgtgcatctgttatttaccaatccctgccgccattactggagtgacattcaggattataaatttctggcgaagctaaaagcccgcaaccgccgcttacatcgctttgaccgcgagcagactgatgagactcgcccgctatttcgcgatctttcacaggcagaaacgctgttcaatgacgacggtaaacagtcgattaataatccgctgctggcatcgtggggcaagctggggcgcgataacctgtatctgctggccgaattggataacgttcaggaaatcgatgcctttgttgagtcggatggcgaaaacttactgcaaactttgcagcgcgacatccttgagttggaagatcatgcgatcgtagcggtaagccacgagacacagaacacaagcgctcagaaacgccgtctggaacccgatgaccgttcgattgattttcatgcctgccatagtccgcaacgtgaggttgaagtgcttcacgatcggctgttggccatgatggcagacgatcctgatctgatgccgcgcgatgtgatcgtgatgatggcggacatcgacagctataccccctttattcaggccgtgtttggcaacgcgccggacaaccgctatctgccttttgccatctccgatcagcgtgcgcgacatgcgcatcctgcgttgcaggcggtgatcagtctgttagatttgcccacaagtcgttttacggcggagcaggttttagcgttgcttgaagtccctgcgttggctgcccgtttcggtattcaagaagaagggctacggcgtctgcgcctatgggtggtggaatcgggcgtgcgctggggattggatgacgacaacgtacgcgatctgatgctaccgccaacaggccagcatacgtggcgttttggcctgacgaggatgctgctgggctatgcaatggatagccaggttggcgactggcagggcgtgctgccttatgatgaatccagcgggctgattgcggagctggctggtcaactggccgaactgctgatgcagattcatcaatggcgccagcgcctgtcccagccacgtttgcttgtcgattggttaccgttatgccgagagctgatcgaaaccttctttgatgcggatagcgagaccgaagcggcgctggcgctagttgaaaaacagtggcagcacgtgattggtatgggcacgatggcgtattatccgcaacaggtgccgatctctcggttacgtgatgaactgtcacggcgtctcgatcaagagcgactcagccagcgttttctggccggtgctatcaacttttgtacgctgatgcctatgcgttccatccccttcaaggtcgtgtgtttactgggcatgaatgatggcgtttaccctcggacgctgccaccacttgggttcgatctgatggggcggaaaatcaagcgcggtgaccgtagccgacgtgacgatgaccgctatctgtttcttgaagcgctcctgtcggcacagcataaactttatatcagctatatagggcgctctattcaggataatacgcgccgctatccttcagtattggttagcgaactgacggaatatatcgcgcagagctatgtcctgccgggcgatgaagcgctggatatcgatagcagcgcggaatgcgttgtaaagcacctctgccgtgagcatagccgtatgccttttgatgcgcataacttcttgcctacaccgcagccgttaagttttgcggcagagtggctggcggcggcgaatcgaaaaggggaagcccagcctgattttgatcgtgaagcgctgtccgaaagatcaagtgatagcgatgtcagtttggacgatctgaagcgtttttatcgccaccctgtgcgagccttttttcaactgcggcttggcgtgagttttatgctgcacagtgacgaactattggatgaagagccttttgtggttgatagcctcaaccgctatcaattgaatagcgagctgcttaataccttgattaatgaaggcgatacggaaaagctgtaccgtcgcgccagatctgcgggcgaattgccctacggcgcgtttggcgaaatttactggcaggaacagcagcaggatatggcgcagctagccgcgcgtgtgcgtgatgaattaacgccgtcgctgtcggtgagccgggaagtggatatcctccttgatggcgtgcgcgttagcggctggctgaatcaggttcagccggatggtttgctgcgctggcgtcccggtacgctttccatgaaggatggcattacgctgtggctggaacatctggcctattgtgcaacgggtgggcagggggaaagtcggctgtatgggcgggaagacaccgcgtggcgctttgccgcgttgtcggaagcgcaggccagagaacatctgagcgttatgctggatggatatcgtcagggaatgagcaagccgctgttactgctcaataaagcagggagcgcgtggctggctgaatgttatgatcgtgaaagtgatagcctgcggtcagatgaagaggcgcagaataaggcgcgcgcccgcttgctgcaagcctggcagggcaacatgggaatgcggggggaaggtgaggattattacctgcaacgcattattcgtgagttggatgaaaaacgaatgaatgaggtgattgaagcggcgcaaatctggctactgccaccgttccgctctaatctggcttga

SEQ ID NO: 45508 - protein, 1132 aa, Erwinia carotovora subsp. atroseptica SCRI1043
MFRIYHSNQLDILKRLMVELIKRQPLVDPFQQEVILVQSPGMAQWLQIELATDFGIAANIQFPLPGVFLWNMCRHVLPDIPKESAFSKDAMTWKLMHLLPDLLAQPDFSALNHYLQDDDNQRKLHQLAGRVADLFDQYLIYRPDWIKAWQEGKLVDDLGGNQLWQSALWRALVDYTRELAQPEWHHAILYQRFIRALEHAKTCPKGLPPRVFICGISALPPIYLQALNALAQHIDVHLLFTNPCRHYWSDIQDYKFLAKLKARNRRLHRFDREQTDETRPLFRDLSQAETLFNDDGKQSINNPLLASWGKLGRDNLYLLAELDNVQEIDAFVESDGENLLQTLQRDILELEDHAIVAVSHETQNTSAQKRRLEPDDRSIDFHACHSPQREVEVLHDRLLAMMADDPDLMPRDVIVMMADIDSYTPFIQAVFGNAPDNRYLPFAISDQRARHAHPALQAVISLLDLPTSRFTAEQVLALLEVPALAARFGIQEEGLRRLRLWVVESGVRWGLDDDNVRDLMLPPTGQHTWRFGLTRMLLGYAMDSQVGDWQGVLPYDESSGLIAELAGQLAELLMQIHQWRQRLSQPRLLVDWLPLCRELIETFFDADSETEAALALVEKQWQHVIGMGTMAYYPQQVPISRLRDELSRRLDQERLSQRFLAGAINFCTLMPMRSIPFKVVCLLGMNDGVYPRTLPPLGFDLMGRKIKRGDRSRRDDDRYLFLEALLSAQHKLYISYIGRSIQDNTRRYPSVLVSELTEYIAQSYVLPGDEALDIDSSAECVVKHLCREHSRMPFDAHNFLPTPQPLSFAAEWLAAANRKGEAQPDFDREALSERSSDSDVSLDDLKRFYRHPVRAFFQLRLGVSFMLHSDELLDEEPFVVDSLNRYQLNSELLNTLINEGDTEKLYRRARSAGELPYGAFGEIYWQEQQQDMAQLAARVRDELTPSLSVSREVDILLDGVRVSGWLNQVQPDGLLRWRPGTLSMKDGITLWLEHLAYCATGGQGESRLYGREDTAWRFAALSEAQAREHLSVMLDGYRQGMSKPLLLLNKAGSAWLAECYDRESDSLRSDEEAQNKARARLLQAWQGNMGMRGEGEDYYLQRIIRELDEKRMNEVIEAAQIWLLPPFRSNLA

SEQ ID NO: 45509 - DNA, 3150 bp, Propionibacterium acnes KPA171202
  CDS (1)..(3150)
atggccggtgtggtgaaggtcttccattcctggcgctgcgtcagtgacgccgtcgtagcagctttgtcggagcccaccaccgatccattcgtccggccgattctggttgctcctggcaatgctcagtctcgatctttgctgcaatcccttgcccgccgtcatggaatcgccgccggtatcgatacaacaacgccgctgggcctacgagaacgactcgaggaagatctcctgggagtcaagcgggaaaacgatccgtggcagcccgggtccctggccctgcgtatatgccgcgtcattgagaacaattcccccggttttgaggttgtttcagcccatctggaagccagccgtcggcaaggagtgccgcgtgcaacatggacaactgcacgacaagctgcagacgcgatctgcgcgctagctcgcgactctcacgacgtcttgaatgcctgggccgacggtgccacccccacaactcaccagggtgatactgaccttgcgggtgaccccctggatcccgcccgcgcgtggtgggccccgctgtggcgtacccttcttgccgaaccatgccatgttccggaccccgtgagccgacaccagctcctcgtcgacgcgatactcactcagtcacgatctgaaccgccgatcgtgtggttttcatcgacgaccacggctcagcacgacgtcagcttggcggaagcgttgtcggcctcacacgacgtcaccatcgtccatctcgatcatggcattagtggtgcggatccgtggcggacctttgaccgggcgcgctctgccacgaccgcgcgatggacatcgtcatcgatctgtacagcgcaaagcgcggttacccaccgcaaagagctgccaacagtcgaaatacaccaatgccacggagttgatcgtcaggccgaagtagtgcgtgatgttgtatgcgcagctctcgccgactacccaaccttggaacccagggacatcgtcgtcatatgttgcgggcgccaggacaccgcccaccttctttccgctgggactttggcagatatcgatcaccctgcacatcagttgcggttcacgacccctccgcaacgcgagcatgttaatcccgtcactgaagcggtaacgaccatcttgggcctggcctcctcacgtgccacgggacaagacttactcagtctgtgcgccatgcctgcggtgcagactcgattcggattctccgatgacgaccaggaggcgattgaacggctggtgagccaggccgatatccggtggggagttgaccctgccgcaagggacaaggcagggctgggccggatcaaacaatcgacctggctggctggcatcgaaaggatgattctcgccatcgcgatgtcgtctacaccaccaacttatctggggacagtgacgccgattactgacgtcggatcgacaacaatccccctcgtcgggaaactcgctgaattcgtatcccgaatgcgcaaggcgttcctcgacactgaaacacctgcaccgattgccacctggaaacgccgggtcagccagatcgttgacaaccttgctgccgctcccgcagacgctcctcgatcggcgctacagactcttgccctgctgacaggtctggaaggggtcgcagaagacagagagtttgatcgccaggagatcattgacctcctcaactggctctcaggcatccatcgtgggcggcacagctggttcgatggatcaattcaggtgtgccgtccgggtgagcttacccccgtcgaccacgaagtcgtgattgtcgtcgaccccgaccaagaagctgttcatgccgatctccttcaaggcttgcgagatgaaaacctcgatccggctgctaaagcacgacaagaccttctcgacgtcgctctgtcagccagaaccctcctggtcgtcgtgaggcaggcgcgcagccctgtgagcaacctcaccgtgctgccgggcccctttacgagaaccctctctcaagctctcaaggcgcagtccgcaacaccgcgttgcgttaaacacggtttgcaaccattctctgccgatgaattctctcatcacagtgataccgcttggagtggattcgacaacaccgcggccgcagcggcagggtgtcatcctggatcacagcctcgaccccatcgtgtcgtattgcccccggtagccaagttgcctgaatcccggatgtcccttatcgacctcactctcgccctgtctcacccggcacggacgctcttgcgagcccgtgctggtgcaccagctaatgaaagatctactgaccttccggtcgacctgccactggcaccaagctcattagacaaatactggatacgttcccggatcctggctgacctggaacacggttttctgctagacgacgccatcaatgctgaacggctccgcggctctactcctccagggcacctgggccagcacatcgtcaccaaattggctgaggacgcgatgcagatttgtcagagggccaatcggctccgtggcgaccaagacgagcagttcatcgaaattgacttcgatctcgatgagggtaacagccccccattgctatggcctgacgaactcattgtcgatcccatgcacccagttcacctgcatggtcgagtcggtgtgaggaaccatcagattgtccacgctgtcgcatcccgggcgaatgctagaccgctcctcgacctgtgggtcgatctgctcgctgtgaccgtcgccactgacgaacccggatggtttggagtcctggtcccgaacggcgacgtcctgcggatggcttccccagcgccggatcatgctcgcgacatcctggctgggctcgcccgagtcgcctggtggagcaaccagcaactcatcccgttgcctgtgaaattggcacacgcgctcgtcgagttgtcccccatggcgcataacgactatcgcaccggagccagcgccctccaagtgcagtggtcgcgagaatgggatccaaactgggcggcatttttgggaaccgatgtgggtgagctcatcgcctgctgccatgagttaggtaccaccttgacggaactttccgaatggcttttcgatccgattaagcaggcgttgagaggggctgggtcttcaccatcgacgatggcacagttttcgaattcggggaggagggcatga

SEQ ID NO: 45510 - protein, 1049 aa, Propionibacterium acnes KPA171202
MAGVVKVFHSWRCVSDAVVAALSEPTTDPFVRPILVAPGNAQSRSLLQSLARRHGIAAGIDTTTPLGLRERLEEDLLGVKRENDPWQPGSLALRICRVIENNSPGFEVVSAHLEASRRQGVPRATWTTARQAADAICALARDSHDVLNAWADGATPTTHQGDTDLAGDPLDPARAWWAPLWRTLLAEPCHVPDPVSRHQLLVDAILTQSRSEPPIVWFSSTTTAQHDVSLAEALSASHDVTIVHLDHGISGADPWRTFDRARSATTARWTSSSICTAQSAVTHRKELPTVEIHQCHGVDRQAEVVRDVVCAALADYPTLEPRDIVVICCGRQDTAHLLSAGTLADIDHPAHQLRFTTPPQREHVNPVTEAVTTILGLASSRATGQDLLSLCAMPAVQTRFGFSDDDQEAIERLVSQADIRWGVDPAARDKAGLGRIKQSTWLAGIERMILAIAMSSTPPTYLGTVTPITDVGSTTIPLVGKLAEFVSRMRKAFLDTETPAPIATWKRRVSQIVDNLAAAPADAPRSALQTLALLTGLEGVAEDREFDRQEIIDLLNWLSGIHRGRHSWFDGSIQVCRPGELTPVDHEVVIVVDPDQEAVHADLLQGLRDENLDPAAKARQDLLDVALSARTLLVVVRQARSPVSNLTVLPGPFTRTLSQALKAQSATPRCVKHGLQPFSADEFSHHSDTAWSGFDNTAAAAAGCHPGSQPRPHRVVLPPVAKLPESRMSLIDLTLALSHPARTLLRARAGAPANERSTDLPVDLPLAPSSLDKYWIRSRILADLEHGFLLDDAINAERLRGSTPPGHLGQHIVTKLAEDAMQICQRANRLRGDQDEQFIEIDFDLDEGNSPPLLWPDELIVDPMHPVHLHGRVGVRNHQIVHAVASRANARPLLDLWVDLLAVTVATDEPGWFGVLVPNGDVLRMASPAPDHARDILAGLARVAWWSNQQLIPLPVKLAHALVELSPMAHNDYRTGASALQVQWSREWDPNWAAFLGTDVGELIACCHELGTTLTELSEWLFDPIKQALRGAGSSPSTMAQFSNSGRRA

SEQ ID NO: 45511 - DNA, 3171 bp, Desulfotalea psychrophila LSv54
  CDS (1)..(3171)
atgttgcatcttcatatatctaaccacaccgaaaagcttctcgaaatcttagcggccattattaaaagagagggccgcgccaatctctttgccagagaaatttttttaattcagagcccgggggtggagaggactgtctgtcagtatctggccgatgagtttaagagctggtgtaattttgattttctcttgcctgctggtttgttgcgaaaaatagcctcaagcctctatgttgatcttgaaacagatctctttgccagccagacgaccgtctggcgacttgaggccctgttgcgggatattgatgaggatatttatctgcccttgaaaaaatatgtaagcggcgaggtggcggagctgaaaagatatcaacttgccggtcagatagctcagctctttgatcagtatcagctgatgcgtcccagcatgcttgcccgttggcgacttggccagagggtaacggaggaggattgcgaaatatggcagatgcatctctggcagagactggtggaggagttccccgctgcccggcatcagggagagatcttagaaaatattattgaaacattggaaaaagaagagtgccaacgtcgtctgcccaggcggatctttgtctttggactccataccatggccccgctctttttaaagttcctgcaggccctgtcctcccggaccgaggtgcatctctttctcctctccccctgcagagaatattggggtgaggtggggaggggaggcgatcgtcttctctctctggagggcataagggattcgggtgtcgatctctcttcctatgaggaggaagagcctcagcagttactggcctctcttggtcggcagggccgggattttcagcagatgctggtggcgtccgctggttatagtatagactctgccctctatcagggcttaggtgctggctctcccccctctcttctccacgtcctacagggggatattttagagaggggcagactggcggttacggcagcaagagacgattcccttcgcattgtctcctgccattcgcctctgcgggaacttgctgtgctcaaggatcatattcttgacctgctctataaggatgccagcctgcagctacgggacattgtggtgatggcccctgatattcaggagtatgccccgctcattcccgccctcttcgctgacattcagtactccatagccgatcgtgccacgggacagcgcaatacggtgatggctgtctttcttgattacctcaacctcttctcgggaaggttcggttggagtgaggttcttgatctgcttcgttcggagcatatttattcccagtttagccttggtgagggggattttgatctcctgcagaagtgggtgacagaatccggtattcgctggggactttcagcggagcagaggcaggagctcggcctacctcccctggagctgaatacctggttggctggcttgcagaggctgctcctgggctttgccatgtccgccgataccatggtggagggggttttggcctacagcgatatcgagggcaatagtgctcaggcacttggcggtctttgcgaatttcttcaggtgttacaggggggacaagagctctataccactccacgtcttctccatgagtgggcagagttgctccagggggatgcggagcgtctctttggcggtgaagaaaattctgcccatcaggaactacagcagattctggcagggcttggccggggcagggagtatcagggcgtccttctctacagtcagcccattgcctttcaggtggttatggcctggctccagcaggcctctgcccaggttggttccagtgcaggctttctccgggggcagttgaccttctgttctatgttgcccatgcgctctattccctttcgggtgatctgccttttggggcttaacgagggtaagtttcccaaacaggataagcaggcgacctttgatctcctcgccagcaaacccgagctgggtgatcgctcgccaagaattgacgatcgttatcagtttcttgaggccctgatctccgtgcgtgactctctctatctgagttatgtggggagatcgataaaaaataatggcgagattcctccctcggttgttctctgtgaactgcttgatctgctggagtgtaaatttgccattaagcctgaggatattgtggttgaacagcccctccatccctttagttcaaaatattttgaagggagagctgacctctttagctataacgagaactgtcttaccctggcccaaaagatctatggtggtggtggcggggaggagcgtccatggtggtcggggaacctgggacgacctcaggagaacatctacctggccgatatggtctctttttacaagaacccccaacgttggtttgtgagcagaagtcttgagattcgtctgggtgccagttcggatctacccgacgatacagagaccttctctgcctcgggccttgatcgttatctgttggaacagggtttggtagaggatctgctggcaggtagagaggtggcagatatctatcatggtctggccatagaggggcgctggccccaggggactccggggagcctcctctttaaaaaactcctgacagagttggacgaatttaccaacagcattcgtcagatagatcccggcccgattatccagacccttcccattgatcagcgtattggcccctatcgtcttttggggaaggttgccctgcgccagaatgggatttttctccatcgttatgccaatcgtaagggcaaagatctacttgaggcatggttatatcatctggtggcgggaagggagcgaccggatattatcacctggctggtctgtaaggatggggtgctgaaattttcagaacagccgtccgaggagatgctccttctctatctggagcactttgcctttggtgttaataccctctcctcctttcaagttgaggcggcctatgcctatagtttgcactgtcaaaagaagagtaagaagacaccgatgcaggtagccgaggagaccttgaaggggagcgtgacaaaggggtatgaacccgagctggcccttgccatcagcggtggagtggaggagtttttggcgggagaatttgaacgatactgtatagagctgatgttgcctatttgggagtacgccgatgagttataa

SEQ ID NO: 45512 - protein, 1056 aa, Desulfotalea psychrophila LSv54
MLHLHISNHTEKLLEILAAIIKREGRANLFAREIFLIQSPGVERTVCQYLADEFKSWCNFDFLLPAGLLRKIASSLYVDLETDLFASQTTVWRLEALLRDIDEDIYLPLKKYVSGEVAELKRYQLAGQIAQLFDQYQLMRPSMLARWRLGQRVTEEDCEIWQMHLWQRLVEEFPAARHQGEILENIIETLEKEECQRRLPRRIFVFGLHTMAPLFLKFLQALSSRTEVHLFLLSPCREYWGEVGRGGDRLLSLEGIRDSGVDLSSYEEEEPQQLLASLGRQGRDFQQMLVASAGYSIDSALYQGLGAGSPPSLLHVLQGDILERGRLAVTAARDDSLRIVSCHSPLRELAVLKDHILDLLYKDASLQLRDIVVMAPDIQEYAPLIPALFADIQYSIADRATGQRNTVMAVFLDYLNLFSGRFGWSEVLDLLRSEHIYSQFSLGEGDFDLLQKWVTESGIRWGLSAEQRQELGLPPLELNTWLAGLQRLLLGFAMSADTMVEGVLAYSDIEGNSAQALGGLCEFLQVLQGGQELYTTPRLLHEWAELLQGDAERLFGGEENSAHQELQQILAGLGRGREYQGVLLYSQPIAFQVVMAWLQQASAQVGSSAGFLRGQLTFCSMLPMRSIPFRVICLLGLNEGKFPKQDKQATFDLLASKPELGDRSPRIDDRYQFLEALISVRDSLYLSYVGRSIKNNGEIPPSVVLCELLDLLECKFAIKPEDIVVEQPLHPFSSKYFEGRADLFSYNENCLTLAQKIYGGGGGEERPWWSGNLGRPQENIYLADMVSFYKNPQRWFVSRSLEIRLGASSDLPDDTETFSASGLDRYLLEQGLVEDLLAGREVADIYHGLAIEGRWPQGTPGSLLFKKLLTELDEFTNSIRQIDPGPIIQTLPIDQRIGPYRLLGKVALRQNGIFLHRYANRKGKDLLEAWLYHLVAGRERPDIITWLVCKDGVLKFSEQPSEEMLLLYLEHFAFGVNTLSSFQVEAAYAYSLHCQKKSKKTPMQVAEETLKGSVTKGYEPELALAISGGVEEFLAGEFERYCIELMLPIWEYADEL

SEQ ID NO: 45513 - DNA, 3504 bp, Mannheimia succiniciproducens MBEL55E
  CDS (1)..(3504)
ttgcagttaaaaataaactcactgaaaataaccgcactattggttattaggaaatttattgtgtttacggtttaccattcgaatcgacttgatgttcaaaaagacatcttaattgaattaatgcagcttttgccgccggacgatccttttcaaactgaaattattcttgtgcaaagccccggtatggcgcagtggttgcagctgaaaattgcagaaaaaaaaggtattgccgctaatctcaaatttcctatgccggcaagctttatttggcagcaatatatcaatgtattagaagacgtaagccaacagacacaatttaacaaagatgccatgacctggcgtttaatgcagctaattccgcaatttctttccgaaccctgctttcaggcgttagaaaattatctgaaaaattcaccgtactccgaacagcaaaaattatatcaattagcccgtaaagtagctgatcttttcgaccaatatttagtttaccgtccaaattggattcatgcctgggaaaataatcagccggaatcaattgagcaggctatcggtacctatcaaaaagacgataatcctgaattaattacacaaatcaaacgggatattaagtggcaagggattttatggcgtgcgctaattgatgaagttcagcgcggggcgggttataaagtgcgccaccgggctaatttacatcaggcgtttattgataaattacgcagcgctaaaccggaaaatttgccgcagcgaatttttattttcggtatttccgctttgcctcaatcttatttggaaacttttgaggcaatgagtcggtattgtgatattcatttgttttttaataatccgagtcgcgaatattggggtgatattgttgatgatcgttttttacagaaattgcaaacccgccaacggtttgaccattatgaaaataatcataccgcattgctaagttcggcaaccttgacgaatatgcaacaagaaaattacgagttttctccggataacgaaaaactgctggttgggaatccgctgttagccggttgggggaaattgggtcgggatttcttctatttattaacggatttaatgactcgagcggaagaacataatcgggaaattatcgcttttgtagatcttgacgacaaaaccttgctatctcaggttcaaggtcatattttggatttaattcctatggcggtaaaaaaactgaataaaccgcaagaagataattcactgaccattcacgcctgtcacagcgttatgcgcgaagttgaggttctgcatgattatttattatcccttttcgaattggataaaaatcttaccccgaaagatattgtggtaatggttgccgatattgataaatatgcgccttatattcaggcggtcttcggacaatatcaaaaagatttgcaaactaaccaattttatcaagcggataagcgttatattccgttttcaatctcagacaataaattgactgaaagtgatgtattaatcgcctcgtttctcatgttattgaatttaaaagaaagccaattcagtgctgaagaagtgctggcttatttggatattcctgctatccgtatgcgttttcagattgaattggaagacttagaaactattcgggaatgggttaaaaattcaggcattcgcttcgggttggaaaagcgaactgataatagtcttaaaaattataatgcctggcaatcgggattagagcgaatgctgcttggttatgctatgcgcgcggaaaacggtatttggcaggatagcctaggctttgacgacagtcacggcttgcaaggcaaacttgcaggattactggctgcttttatcgagcggctttaccaatggcaacaattcttgcgtaaccctcatagttatgaagaatggggtcaagcactgctggaattggtagatcattttttcttggagaatgagcaaagcctcgaagcgatactttatcttaaagagatcattcaacaacttcatgaacaattagacgaagtcaattttaccagtaaactggaaattgacgttattgccgaagtgatggcagagcagttaaacgataaaaatacgagtctgaaatttttagtcggaaaagtgagtttttgcacgttgctgcctatgcgggcaattccgttcaaagcggtttgtttactgggcatgaatgacggcgagtatccgcgtcagcaaacgccgaatagttttgatttaatgcaatatcatcgtcaaaaaggcgatagatttcgccgtgatgacgatcgttatttatttttagaagccttactggcggcggaaaactatttttatgtgagttatgtggggcaatccatcattgataatcagcaaagagagccttcggtgcttgttagtcagttattggattatttggcggaaaatttagcgaataacgacgaagaaatcgaacaaatccgcacaagtttagttcaatatcattcaatgacgatattcagccctgataatttttctgcaatgcatcgttcttatgcaaaagaatggctgccgttagttaatcgtaatcaatatcccgtgcctgattttacccaacagattagcggtgaaattgatgaagtgagggaaatcgatattcttcagcttgtacagtttgtacaacatccggtgaaattcttttttgagaaacggttgggcgtttattttcaacaaacggacgagcaaattccggaaacggaaaatttcactttggataatctggacaattttttgataaaagacgaattgattcgttttgccgatgatgaaaccgacaactatttcgaacgcctgaagctggagggtattttgccttacggtcattttggtgacatttataagcgacgattgcaaaatgaagccgcggaattaaaaaataagattagcgcttatttaagtcaggagcccgctcatcagtttgtcgaaattacattagatatgggtgaacaaagcgttttactcaccggacatttagaccatctttatcagccttttgcacaacgggtaaaatggcgggtcggcgaagtgaaagataagcatattattgaaaactggttatattatttgctgcaactttgcaccacggataatgttaatccgcctttatattatggcaaaaacggttgtatcggtttcaaaactttggaaaaatccaccgcactttccatacttaaattatatgttaaagcctatttgcaggggctaaaacaggtacaaatcgtaccgacatataaaattgacgattatttaaaatcctgtcaaccggaaaccgaatttgacacgttgtccgcctttaataatttgcgcgatttatttaaatcatcaaacaattataccaatgaaaaagaagacatttattggacccgcgtatttcaacaggcaacggaattaaattcagacaaagaaaaattaatgcaaatccaacaaacaacccgggactggttcggtttaatgctgaattcggtggaaaaggttaaactttag

SEQ ID NO: 45514 - protein, 1167 aa, Mannheimia succiniciproducens MBEL55E
MQLKINSLKITALLVIRKFIVFTVYHSNRLDVQKDILIELMQLLPPDDPFQTEIILVQSPGMAQWLQLKIAEKKGIAANLKFPMPASFIWQQYINVLEDVSQQTQFNKDAMTWRLMQLIPQFLSEPCFQALENYLKNSPYSEQQKLYQLARKVADLFDQYLVYRPNWIHAWENNQPESIEQAIGTYQKDDNPELITQIKRDIKWQGILWRALIDEVQRGAGYKVRHRANLHQAFIDKLRSAKPENLPQRIFIFGISALPQSYLETFEAMSRYCDIHLFFNNPSREYWGDIVDDRFLQKLQTRQRFDHYENNHTALLSSATLTNMQQENYEFSPDNEKLLVGNPLLAGWGKLGRDFFYLLTDLMTRAEEHNREIIAFVDLDDKTLLSQVQGHILDLIPMAVKKLNKPQEDNSLTIHACHSVMREVEVLHDYLLSLFELDKNLTPKDIVVMVADIDKYAPYIQAVFGQYQKDLQTNQFYQADKRYIPFSISDNKLTESDVLIASFLMLLNLKESQFSAEEVLAYLDIPAIRMRFQIELEDLETIREWVKNSGIRFGLEKRTDNSLKNYNAWQSGLERMLLGYAMRAENGIWQDSLGFDDSHGLQGKLAGLLAAFIERLYQWQQFLRNPHSYEEWGQALLELVDHFFLENEQSLEAILYLKEIIQQLHEQLDEVNFTSKLEIDVIAEVMAEQLNDKNTSLKFLVGKVSFCTLLPMRAIPFKAVCLLGMNDGEYPRQQTPNSFDLMQYHRQKGDRFRRDDDRYLFLEALLAAENYFYVSYVGQSIIDNQQREPSVLVSQLLDYLAENLANNDEEIEQIRTSLVQYHSMTIFSPDNFSAMHRSYAKEWLPLVNRNQYPVPDFTQQISGEIDEVREIDILQLVQFVQHPVKFFFEKRLGVYFQQTDEQIPETENFTLDNLDNFLIKDELIRFADDETDNYFERLKLEGILPYGHFGDIYKRRLQNEAAELKNKISAYLSQEPAHQFVEITLDMGEQSVLLTGHLDHLYQPFAQRVKWRVGEVKDKHIIENWLYYLLQLCTTDNVNPPLYYGKNGCIGFKTLEKSTALSILKLYVKAYLQGLKQVQIVPTYKIDDYLKSCQPETEFDTLSAFNNLRDLFKSSNNYTNEKEDIYWTRVFQQATELNSDKEKLMQIQQTTRDWFGLMLNSVEKVKL

SEQ ID NO: 45515 - DNA, 3345 bp, Burkholderia pseudomallei K96243
  CDS (1)..(3345)
atgctccatctcttctactcgaaccgccacgaaacgctggccgacgcgttgctcgacgatctcgccttcgcgtcggacggcgcgggcccctgggccgcgcagcaggtgatcgtgccgagcgcggcgctgcgccggcggctcgagctcgacctcgcgaagcgccacggcgtgtgcgcgaacgtgcgcttcagctatctcgcgcaatggctgtgggcgcagatcggcgaagtgctgacggtgcccgcgcattcgccgttcgcgcccgatcgcctggtgtggcgctgctaccggctgctgtcggaccacggcgccgcgccgtggcgcgcatcgccgcggcttgccgcctatctggccgcggccgacgcgccgatgcgccacgagctcgcgcaccggatcgcgacggtgttcgaccactatctgacgtatcgtccggagtggctcgcgcaatggcaggacggcgaatcgatcttcgcgctcgaaggcgcgccgcgccacggcggcgaggccgcgcgcgacgacgaggcgtggcaggccgcgctctggcgcgcgctgctcgcggagctgtccgacagcggcatgccgcccgcgcaccggttcctgcgcgaggcccgcgccttcgatcccgatgtgatcgcgcgcgcgcgggcgaagtggccggatgcggtcagcgtgtttgcgttgccgacgatgccgccgctgcacatcgcgctgttgcgcgagctgtcgcgctggatcgacgtgcgcatctacgcgctcagtccgtgccgcgaattctggttcgacatcgtcacggccgcgcgcgcggagtcgctcgacgcggcggaccggctcgactatcaggaagtcggccatccgctgctcgccgaatggggcaggcagacgcaagcgcaactgcacatgctgcacgagctgaccgagagcgcggcggcgagcgatgcgtcgcgctacgcggacaatcccgcgccgacgtggctcgcgcgcgtgcagaacgcgatcctcgatctgcagccggaggctgcgctcggcgagccgcccgccgagcgcggcgtcgaagtgcacgtgtgccacagcctcgcgcggcagctcgaggtgctgcatgatcgcctgctcgcgtggttcgacgcggacccgaacctcgcgccgtcggacgtgctcgtcgcgatgccggatctcgcgacggcggggccgctcatcgacgcggtgttcggcacgcctgcgggcgccgacgccgcgcgcatcccgtactggatcaccggcctgccgccgtcgcaggcgaatcccgtcgcgcgcgtgctgctcgattggctcgcgttgcccgagcgcgacgtcggcgcgccggagctcgtcgaatggctgcgcgccgacgcggttgccgcgcgctatgggatcgacgcgacggcgctcgaaaccgtgcagacctggctggccgcatcgggcgcgcggcgcgggctcgcgcccgatgcggccgagccgccgaacccggccgtgcccgcgccgcgccacacgttcgccgacgcgctcacgcggctctttctcggctacgcgatgcccgatggcgcggcgcccgtttcgacgtggctgccgatcgcgggcgccgagggcggcgaagccgagctgctcggccgcctcgcgcgcttcaccgacgacctcgacggtttcgcgcggcgcatcgcccgcgacctcacgccgcaaggctggggcgatgtattcgccgatgcgctcgcgcgcttcttcgattcggggccggcgttcgccgacgcgctgtccggcgtgcgcgacgcgctcgacgcgatgcttgccgcgatggcggaaggcgcggcgggcgcggcgttgcccgccgcggtcgtgcgcgcgggcctcgcggccgcgctcgacgatccggcgcgcggcggcgtgccgtggggcggcgtcacgttctcgtcgctcacgagcctgcgcgggctgccgtatcgcatcgtgtgcctgatcgggatggacgacggcgtgctgccgagcctcgcgcgcgcggacgagttcgacctgatggccgtgttcgcgaagctcggcgaccgccagcggcgcgacgacgagcgcaatctgttcctcgatctgctgcttgccgcgcgcgagcgcctgctgatcgcatacacgggccgcagcatccgcgacaacgcgccgctgccgcccgcggcgctcgtcgacgaattgctcgaccatctggccgccgcgtcggccggcccggacgcgccgcccgacgcggtcgacgccgcgcgccgcgcgttcgtgatcgagcatccgctgcaaccgttctcggccgaatacttcgcgccgggcggcgcgctcttcacgtacgacgcgtcgcgcgcgacgcttgcgcgcctgctcgccgagggcgcgcgcgcgcaggcgcgcccgttcttcgccgcgccgctgccggccgagcccgagcagccggtcgcgttcgccgatttcgagcgcttctggcgccatccggcgcgttcgctgctgcgcgctcggctcggcatcgtactgttggacgcgcaggcggaactcgtcgacaccgagccgttcgagctcgattacgcgggcagcgacgcgctcgccgagcgcgtgctgccgctgttgatcgagacggccgacgcggccgcgttcgagcatgcgctgcgcgtcgccgacgcgagccccgaggtgccgggcggcgcgacgggcgcggtgcggcgcgaccatgcgctcgacgcgctcgcgcagctcgcgggcaacgtgcggcgcgcgctcgccgacggcgcgacgcgcgtgccgttcgcgttcgacgtcgcgcccgcatggcccgcggcgagcgacgcgcggtggttcggcgagcacgacgcggcgctcgccgcggcggcgacgcgcgagccgctgcgcctgcacggcgcgctcgcgcggctgacggcggcggggcaggtgatctaccgctatgcgcggccgggggcgcgcgattacctcgccgcgtggctcgcgcatctcgtctattgcgcgatcgaccccggcgggccgcgccgcacactatggttcggctccggcgacacgttcgaattcgcgcccgtcgccgcgccgctcgagcagctcgcgccgctcgccgcgctgtttcgcgccgggcggcggatgccgctcgcgtttttcccgaggagcgcgtgggcgctcgtatcggagagcgaatcgaaggcggcgggcgtgtggatcaacgatcgcgtcgcgggcgaggccgacgacgcgtcgctcgcgctcgcgtggcgcggcgcgaacccgtcgctcgacgagccgttcggcgcgctcgcgcatctcgtgttcgatccgctcgtcgagcatctgcggagggcgtcatga

SEQ ID NO: 45516 - protein, 1114 aa, Burkholderia pseudomallei K96243
MLHLFYSNRHETLADALLDDLAFASDGAGPWAAQQVIVPSAALRRRLELDLAKRHGVCANVRFSYLAQWLWAQIGEVLTVPAHSPFAPDRLVWRCYRLLSDHGAAPWRASPRLAAYLAAADAPMRHELAHRIATVFDHYLTYRPEWLAQWQDGESIFALEGAPRHGGEAARDDEAWQAALWRALLAELSDSGMPPAHRFLREARAFDPDVIARARAKWPDAVSVFALPTMPPLHIALLRELSRWIDVRIYALSPCREFWFDIVTAARAESLDAADRLDYQEVGHPLLAEWGRQTQAQLHMLHELTESAAASDASRYADNPAPTWLARVQNAILDLQPEAALGEPPAERGVEVHVCHSLARQLEVLHDRLLAWFDADPNLAPSDVLVAMPDLATAGPLIDAVFGTPAGADAARIPYWITGLPPSQANPVARVLLDWLALPERDVGAPELVEWLRADAVAARYGIDATALETVQTWLAASGARRGLAPDAAEPPNPAVPAPRHTFADALTRLFLGYAMPDGAAPVSTWLPIAGAEGGEAELLGRLARFTDDLDGFARRIARDLTPQGWGDVFADALARFFDSGPAFADALSGVRDALDAMLAAMAEGAAGAALPAAVVRAGLAAALDDPARGGVPWGGVTFSSLTSLRGLPYRIVCLIGMDDGVLPSLARADEFDLMAVFAKLGDRQRRDDERNLFLDLLLAARERLLIAYTGRSIRDNAPLPPAALVDELLDHLAAASAGPDAPPDAVDAARRAFVIEHPLQPFSAEYFAPGGALFTYDASRATLARLLAEGARAQARPFFAAPLPAEPEQPVAFADFERFWRHPARSLLRARLGIVLLDAQAELVDTEPFELDYAGSDALAERVLPLLIETADAAAFEHALRVADASPEVPGGATGAVRRDHALDALAQLAGNVRRALADGATRVPFAFDVAPAWPAASDARWFGEHDAALAAAATREPLRLHGALARLTAAGQVIYRYARPGARDYLAAWLAHLVYCAIDPGGPRRTLWFGSGDTFEFAPVAAPLEQLAPLAALFRAGRRMPLAFFPRSAWALVSESESKAAGVWINDRVAGEADDASLALAWRGANPSLDEPFGALAHLVFDPLVEHLRRAS

SEQ ID NO: 45517 - DNA, 3417 bp, Methylococcus capsulatus str. Bath
  CDS (1)..(3417)
ttgccatcccccctcaacatctttttctccaaccgcttcgaaatcctgactcagcgcctgttcgacgatctggcgcaaggaccggccgatccgttcgtggcggagcaagtcatcgtccccagcctggcggtccggcgccggctggagctggatcatgcggatcgcttcggggtgtgcgcaaacgtggagttcagttatctggcgcactggctgtgggtgcagatcgggcaggtgatcgaggtgggggcatcctcgccgttcgcgccggccaccctgacttggcgggtgttccggatgttgggcgaggaagccctggtgtcggcgcatccgcggctgaagtcttatctggcgcgggccgacggggcgatgcgcttcgatctggcgcagcgggtggcgcatttgctggaacagtacctcacctaccgcccggactggctggcggcctggctggaaggcaggccggcttccggattgccggaggcgagccgggaagacgaggcatggcaggcggcgttttggcgtacgctggtagatgagctggaggtgcggcgtgaacacccctcggcggcattcttccgggcggtagaagccatggggccggaggcgacacggcgggccgggctgccggcgcgggcccatctgttctgcctgccgaccatccccccgttgtatctggacatcctcggcaagctggcgcgctggaccgagctacatttgtacgtgctgaacccttgccgggaatattggttcgacatcgtcgatcccaggcggctgaactatctggaggttcggggtgatgcgctgtaccgcgagaccggtaaccgcctgctggcgaactggggacagcagacccaagcgcacatcgacctgctgttcgacaaggcggaaggggcggtgatcgatgatgcccagttcgagccgccggcccggatcagcctgctggcggcggtgcaggaggccatcctcgatctgcgcgatcccgagccgggctgttgcgcgtctgtggcgggggaccgcagcatcgaggttcatgtctgccattcgctggtgcgggagctggaggtgttgcatgaccagttgctggcgctgctggcccggcccgatgcacccaaggtctcggatatcctggtcgtgatgccccgcctggaggaggctgcgcctttgatcgacgcggtgttcggcacggcgccggcggcgcggcggattccttatgccatcaccggtttgcgcaggacggtggcgaatccggcggccgccgcattgctgaccctgctcggactgtttgcgtcccgctgcaaggccagcgcggtgtatgaatttttgcagcgcccgttggtgcatgcccgcttcggtctggggctggacgatctggaatgcatccacgattggttccaggcggcagggatccggtgggggctgaatggcgcgcaccggaaggcggtggggctgccggaggtggagcggcatagcttctgcgacggcctcgaccggctgtttctgggctatgcactgggggacgttccggtgcagttcgatggtcgcctgccggcgggcagccctgagggttcggaagcgctggcactgggcggattcgcccatttcgtcgatctgctgactcattggcatcgcgtctggagcacgccggcgacggcccagacctggggcgagcggctgaacgcggtggtcggggccttcctgatggagacgcccgaaaccgttcctgatctccaggaggtccgcgaagccatcgccgcgctgagccggcattggggcgaggccgccgtaaccgggacgatcgagcctgaagtggtgcgggttgctctagaatcgctgctggacgatccagcccggggtgggactccttccggtcggctgacctttaccgccatggccagtctgcgcagcctgccttaccgggtggtgtgtgtcatcggcctgaatgacggcgagtttccccatccggaccggcctgcggaattcgatttgatcgcccaggccccgcgtcgcggtgaccgccagcgacggtacgacgagcgcaacctgtttctcgacctgctgctggcggcccgcgagcggctgtatctgagctataccggccgtagcgtgcgcgacaacgcccccctgccgccgtcgacactgctgtcggaattgctggactacctgcttccgttggtggccgctgcgggagagagtccggaggaggcgcggcgccggctggtggtggagcatccgctgcaggcgttctcgcccgtgtatttcgatgccgccgtggcaaaggatccgcgactggtcagtttcaattcggaatattgcgaagctttgcgggccgctcgttcccctcgtccttcgggggagggggtgagggcttgtgaatcccactcgcaagagcctgaagaatgttccgccatccttgccgagagggagcgggcggaccacggtccagcggggccaatcgccggggaggagcagaatgatccggacttcgaacatgcccctttcttccccgccccaatggccgcaccggagccggaatggcgtgagccgaacctggacgtcttgaagcgcttcttccgcaacccctgccgctatctgctggagcaacgcctggggttgaccctggccgagggcgaggcggagctggccgacgacgagccgttccttcccgcttacttcgcccggggcgaggtcgccgagcggctgctgccgctgatgctgtccgctgccacggaggaggcggtcgaggtcgtggcgcgggcggggatcgagtttccgcaggggcagctcggtgaactgctgctcaaaggggagttgacgcggatacgggagtacgcggagcggatcgccggacagacgcaggaggagccgctgcagccgctgccgggtaggctggctttccagatcgagggcgaaacctggactttgagcggcgcgctcggccaggtgtggcggcgcgggctggtgcgctggcgctacgacgacacccggccggtggattatctgtccggctggctggatcatctgttcctgaatgcgttggcggtccgcggggtggagccgaccacgacctggatctcacgggacggcgaataccggctccggccggtggccgcagcccaggaacgattgcgcgaactggtggcgctgtaccgggagggactccgcttgccgctgcatttcttccccaggagcgcctgggcctgtgccttggggctgaaacagggcggatcccaggctgccgagcggcaggcgcggaagcgctgggagggttccggtgaccgccgcggcgaatccgaagacctcgcctaccgccaggcactgagagggcaggccgatccactggacggtgcgttcttccgcacggtccgaacggtgttcggtccgctactggatcatctggaagacgggcgcatcgcatga

SEQ ID NO: 45518 - protein, 1138 aa, Methylococcus capsulatus str. Bath
MPSPLNIFFSNRFEILTQRLFDDLAQGPADPFVAEQVIVPSLAVRRRLELDHADRFGVCANVEFSYLAHWLWVQIGQVIEVGASSPFAPATLTWRVFRMLGEEALVSAHPRLKSYLARADGAMRFDLAQRVAHLLEQYLTYRPDWLAAWLEGRPASGLPEASREDEAWQAAFWRTLVDELEVRREHPSAAFFRAVEAMGPEATRRAGLPARAHLFCLPTIPPLYLDILGKLARWTELHLYVLNPCREYWFDIVDPRRLNYLEVRGDALYRETGNRLLANWGQQTQAHIDLLFDKAEGAVIDDAQFEPPARISLLAAVQEAILDLRDPEPGCCASVAGDRSIEVHVCHSLVRELEVLHDQLLALLARPDAPKVSDILVVMPRLEEAAPLIDAVFGTAPAARRIPYAITGLRRTVANPAAAALLTLLGLFASRCKASAVYEFLQRPLVHARFGLGLDDLECIHDWFQAAGIRWGLNGAHRKAVGLPEVERHSFCDGLDRLFLGYALGDVPVQFDGRLPAGSPEGSEALALGGFAHFVDLLTHWHRVWSTPATAQTWGERLNAVVGAFLMETPETVPDLQEVREAIAALSRHWGEAAVTGTIEPEVVRVALESLLDDPARGGTPSGRLTFTAMASLRSLPYRVVCVIGLNDGEFPHPDRPAEFDLIAQAPRRGDRQRRYDERNLFLDLLLAARERLYLSYTGRSVRDNAPLPPSTLLSELLDYLLPLVAAAGESPEEARRRLVVEHPLQAFSPVYFDAAVAKDPRLVSFNSEYCEALRAARSPRPSGEGVRACESHSQEPEECSAILAERERADHGPAGPIAGEEQNDPDFEHAPFFPAPMAAPEPEWREPNLDVLKRFFRNPCRYLLEQRLGLTLAEGEAELADDEPFLPAYFARGEVAERLLPLMLSAATEEAVEVVARAGIEFPQGQLGELLLKGELTRIREYAERIAGQTQEEPLQPLPGRLAFQIEGETWTLSGALGQVWRRGLVRWRYDDTRPVDYLSGWLDHLFLNALAVRGVEPTTTWISRDGEYRLRPVAAAQERLRELVALYREGLRLPLHFFPRSAWACALGLKQGGSQAAERQARKRWEGSGDRRGESEDLAYRQALRGQADPLDGAFFRTVRTVFGPLLDHLEDGRIA

SEQ ID NO: 45519 - DNA, 3339 bp, Nocardia farcinica IFM 10152
  CDS (1)..(3339)
atgccgctgcacatccgacgggccgaacgcgcggacatcctggccgacgcgctcgccgcgcgattggccgtgccgcagccggatccgttcgcggccgaggtcgtcgcggtgcccgccaagggggtcgagcgctggctgacccagcgcctgtccgcggtactcggcgtgtccgcgggcggacgcgacggggtcgccgccaacatccgcttcccgtcacccgcggcgctggtcgccgaggcgctggccgcctgcaccggcatcgcgcccgaggacgacccgtgggcgcaccagcgggtggtgtggacgctgctgcgggtgatcgaccgcgccgtcgccgagccgtggtgcgcggtgctggcccgccacctcggcgcgccctcgcgcggccgcgaccaccggatcggcaggcgctacgccaccgccgcgcagctggccgccctgttcgacagctacgccgcgcagcgtccggccctgctgctggactgggccgccggcggcgacggcgacggcgccggcggcgaggtgcccgcggacctgcgctggcagccgcgcctgtggcggatgctgcgcgccgagatcggcagcccgagcccggccgagcggctcgcccccgcgtgcgagcggctgcgcgccgaacccggcctgctggacctgcccgagcggctctcgctgttcggcgtcacgcgcctgaccaccgatcagctcgcggtgctcgacgcggtgggcgcgggccgcgaggtcgacgtgtggctggtgcatcccagtcccgcgctgtggtcggccctggccgaccgcccgcccgcgcgtgcccgcgccgccgacaccagcgcgagcgccgtccggcatccgctgctcaccgggctggctcgtgacgtccgcgaactccagcagcggctggcgggcaccggcgcgatcgacaccgggccgctgtccgcaccggaagcgccgtccccgcagcagctttcgctgctggccggcgtgcaggccggcatccgcgacgacgcgtggccacccgcgcggctgcccgccgacggcacggtgcaggtgcacgcctgccacggtcccgcccgccaagtggaggtgctgcgcgactgcctgctcggcctgttcgccgccgatccgacgctggaaccgcgcgacgtgctgatcatgtgcccggaggtcgaggcgtacgcgccgctggtgcgggcggcgttcggcgcccggggcggcgccgacgaggccccggagtcggcccaccccgcacacctgctgcgggtgcgcctggccgaccgcggccgcggtgtgaccaatccactgctcgccgtcgtgcagaccctgctggagctggccgacgggcgcgtcaccgtgacgcaggtgctcgacctcgccgcctccgaaaccgtccgccgccggtgcggattcgacgacgacgccatcgagcggttgcgcgagtgggccgccgcggcgggcgcgcgctgggggatcgggcaacggcagcggcaggcgttcggattggccgacttcgcccagaacaccctcaacggcgccgtggaccgcatcctgctcggcgtcaccgccgacgaatccggcgacgactggctggatctcgcactgccgctggacgacgtggacagcaacgacgtcgatctggccgggcgcttcgccgaattcgtcgaccgcctcgcggtgtgcctgcgcgatctgcgcggcccgcgcccggccaccgagtgggcccaggtgctcgggcgggcgctggaactgctcaccgacgtgcccgacagccagtcctgggtgcgcaccgaggcacgcgccgagatcgcggccgccaccgagcacgccggggatgtgccgttgcggctggccgacgtcgcggtgctgttcgccgatcggctggccgcccggcccacacgcgccaacttccgcaccggggagctgacggtgtgcacgatggtgccgatgcggtcggtgccgcaccgggtggtggtgctgctcggcctggacgacgacgtcttcccgcgtaccggcggcgtcgacggcgacgacgtgctcgcccgggaaccgctgctgggcgaacgggatccgcgcagcgaggaccgccagctgctgctggacgccgtgctcgccgcccgcgagcgcctgctgatcttccacaccggcgccgacccggtcaccggctcgccgcgcccgcccgcgatcccggtcgccgaactgctcgacgtggtgcgtgcccacgtcggcgccgacgcgatggcgcaggtgctgacccggcacccgttgcagagcttcgatcgccgcaatttcgaccccgccgcgccgttcagcttcgacaccgtcgcgctggccggggcccgcgccgccgcccgggtgcccgagccggcgccgccgttcctgcccgaaccgctgccgcccgccgagcgcggcgatgtcgcactcgccgacctcatcgccttcgccgagcacccggtgcgcggattcctctggcagcgactgggtttgcgggttcccgagcacgaggaggacctcgccgacgcgttgcccatcgagctcgacggcctggccaaatgggaactgggcgaacggatgctcgcggcccggctcaccggcgcggacccggcgggactgcgcgccgcggagtggcggcgcggcaccctgccgccgttccggctcggcggtgcggtgctcgacgagatcgaacacacggtggacaccctggtgcgggtcgcgcagccggattacgcggccgcgccgcgcgcggtcgacatcgccgtcgacctcggcgacggccgccggttgaccggcacggtgccggaggtccgcggggagacgctggtgcgcaccacgttctcgcgggtcgcggccaagcaccggatcggggcgtgggtggcgctgctggcgttggccgccaccgaggaccggtcctggcgcgccgtcaccaccggccgggggaagttccgtcgcccggcgtggcgctgtgagctcaccgcaccggaccgcccggcggccgtcgcggtgctgcgcgacctggtgcgcctgcgcgacgagggcctcaccgagccgctgccgatcgcgcccgcgtcctcggccgcctacgccgaacgccgggtacgcggcggctcggccgaggacgccttcgccgcggccgagcgcgaattcgacggcggccccaacggtcccgacaaattcggcgaacacaccgaccggcacctgcggtacgtgtggggcaccgccccgcgcctggaccacctcgccgccgcccccgcgcccgcgggctcgcccggtgagccgacccgcttcggcgcgttggccgtgcggctgtggaccccgctgttggccgccgagacccaggggcaaccgtga

SEQ ID NO: 45520 - protein, 1112 aa, Nocardia farcinica IFM 10152
MPLHIRRAERADILADALAARLAVPQPDPFAAEVVAVPAKGVERWLTQRLSAVLGVSAGGRDGVAANIRFPSPAALVAEALAACTGIAPEDDPWAHQRVVWTLLRVIDRAVAEPWCAVLARHLGAPSRGRDHRIGRRYATAAQLAALFDSYAAQRPALLLDWAAGGDGDGAGGEVPADLRWQPRLWRMLRAEIGSPSPAERLAPACERLRAEPGLLDLPERLSLFGVTRLTTDQLAVLDAVGAGREVDVWLVHPSPALWSALADRPPARARAADTSASAVRHPLLTGLARDVRELQQRLAGTGAIDTGPLSAPEAPSPQQLSLLAGVQAGIRDDAWPPARLPADGTVQVHACHGPARQVEVLRDCLLGLFAADPTLEPRDVLIMCPEVEAYAPLVRAAFGARGGADEAPESAHPAHLLRVRLADRGRGVTNPLLAVVQTLLELADGRVTVTQVLDLAASETVRRRCGFDDDAIERLREWAAAAGARWGIGQRQRQAFGLADFAQNTLNGAVDRILLGVTADESGDDWLDLALPLDDVDSNDVDLAGRFAEFVDRLAVCLRDLRGPRPATEWAQVLGRALELLTDVPDSQSWVRTEARAEIAAATEHAGDVPLRLADVAVLFADRLAARPTRANFRTGELTVCTMVPMRSVPHRVVVLLGLDDDVFPRTGGVDGDDVLAREPLLGERDPRSEDRQLLLDAVLAARERLLIFHTGADPVTGSPRPPAIPVAELLDVVRAHVGADAMAQVLTRHPLQSFDRRNFDPAAPFSFDTVALAGARAAARVPEPAPPFLPEPLPPAERGDVALADLIAFAEHPVRGFLWQRLGLRVPEHEEDLADALPIELDGLAKWELGERMLAARLTGADPAGLRAAEWRRGTLPPFRLGGAVLDEIEHTVDTLVRVAQPDYAAAPRAVDIAVDLGDGRRLTGTVPEVRGETLVRTTFSRVAAKHRIGAWVALLALAATEDRSWRAVTTGRGKFRRPAWRCELTAPDRPAAVAVLRDLVRLRDEGLTEPLPIAPASSAAYAERRVRGGSAEDAFAAAEREFDGGPNGPDKFGEHTDRHLRYVWGTAPRLDHLAAAPAPAGSPGEPTRFGALAVRLWTPLLAAETQGQP

SEQ ID NO: 45521 - DNA, 3480 bp, Photobacterium profundum SS9
  CDS (1)..(3480)
gtgtttactgtttatcactccaatcaactggatttgttgaagtcactgctagtcgaattgatccgccttaaccctctagataatccttttgaaccagagcaaattttggtgcaaagcccgggaatgtcgcagtggttaaaaatggaattggcgacatcatttgggatagcggcaaatcttgagtttccactgccagcgacctatatctggaaaatgtttactcaagtattagcagatgtgcccgaacgcagtgcgttcaataaagaggcgatgacatggaagttgatggaagtgctaccaaagcagttgggtttgcctgaatttgagccattaaaacgctatttagagaatgatcccgaaagccttaaaatttatcaattggctgagaaaattgcagatatcttcgaccaatatttagtgtatcgcccagagtggattcaacaatgggaagcgggtgaaattgttgctgagttaggagatgaacacccttggcagcctattttatggcaagcgttgtacgatcaaacattggcattggggcagtcgccttatcatcgcgccaatctgtatgaacatttcattgatacgttagataattatgccagtagcggaacactgcctgctaatttaccgaaacgattatttgtgtttggtatttcatcattaccgcctcgttatcttgacgcattagcggcattgggtgagcacattgatgtacatctgatgtttactaacccttgtcgttattactggggtgatattcgcgatcgtaagcatttggctcgattggctgccaatcaacgagtgactatcaagcaactgaatgtttcaagtgatggcatcctacatggtgatgaaaacgtcagcgatgaaaatgtcgctgtgctgaaagataccgatgaaaatcattatgatgatgagatgcataatgatgttgtgggtaatagcttactggcctctatgggtaagttggggcgcgacaatatgtatttattgtcagagatgcaggtcaacgaagtggatgcgggttttgttgatattgaacctgactcgttactgcacgcgattcaggccgatattttaaatctagaagatcgtcagaacgatcagattctggattccagcgaccacaagtttccgatcagcgatggcgatatgtcattatcgatccatgcttgccacagcccgatgcgtgaagtggaagtattgcatgataatttactcgctatgtttgaaaccgaaacagccaaagggctaaaaccacgtgatgtgattgtgatggtggccgacatcaatgcgtatagcgcggctattcaatccgttttcggtaatgcgccgggtaatcgttatattccattctcgatttcagatcgaactgccgagcaagaaaaccctatcttgctagcattcatgcgtttactgactttgcctgaaagccgttgtaatgcttctgagttactggagctgttagaagttccggctgttatgaacaagtttggctttgatagtaatagcttcgaaaaaattaaacgttggatagaagaagcgggtgttcggtgggggctggatgagaaaaccgcttgccaatttgagctgccagaacaaaatcaaaatacgtggctatttggtattcagcgaatgttgctgggctatgccatgcctcatgatgcgggcttatttgatggcatctcagcctatgagcagattcaaggtttagatgcggagctagcagggcaacttgcagggtttattgatagcttgatctcttatcgtgagcagttggcacagcctcaatgcgtatcgtcttggaccgatctgctcaatcaattactagatgatttcttagccgttgaattagacggtgagctggtgctgaagtcgattcgcgataacctacatcgcttgcatgaacagcttgcagatgcgggttatcagtcattgatctcacctgctgtattgacgcagtacctgcaagataagctgtctggtgaacgagtaagtcaacgcttcttagcgggtcaggtcaatttctgtaccttgatgccaatgcgttcaattcccttcaaagtagtatgtttgctggggatgaacgatggggcttatccgcgaaatatcgcgccagaaggttttgatttaatgaatggtcgcaccaaagctggtgaccgttcacgccgtgatgacgaccgctatctgtttcttgaagccattcaatcggcacaagaaagcttgtacatcagctatgtgggtcgttcgattcaagataacgctgaaaaagtgccatcagtattagtcagtgagctgattgaatactgtcagcaaggttattgcctagaaggcgatgaagccttacccgtagatcaatctgccaaacgattgaaagaagaactgttagttcatcaccatcctctagtgccttttagtccgacggccttttctggtgataaccccagttttgctgctgaatggttaccagccgcggcgcgacacggtgaggcaaacaaagcatttcagcttactgcattagatgccgagcccatggttagtgatcaggggttagtcttagaattggctgaattgcagcgattctggcgtttaccagtacgttacttctttaatcgtcgtttaaaagttttctttgaaccacctatgggggtgatggaagatgatgagccgttcatattgaatggcttagaaagttacttactacgtgatgaactattggcattgctgcttgatgcaaaggtgagcaataagaatgaggatgccgtctttgctgcattttcagcggaacaaaaagcggctggtgggttacctgtcgcggcatttggtgagctagatttagccatgacacgtactgaagttgtgtcattagctgacaaaattgtcccactcgttaatcgcccactggatgatcatgaagttgatcttattttccacgttgatggtcatgatgtgaacctgcaagggtggctaaaacagcgttatcaatccggtttggtgcgttaccgtagcggcaaagttcgcgcgcaagatcatctaacggcttggtttgatcatttatgtttagcagcaagccactgtggtcaacagactcacctaatcggtaccgataaacaccttgtgttatttattatcgaaccggatcaagccaaggcttacctgcaagatgtgatggcgctgtattaccacggcttgaatcaacctttgccttattttcctaaaacagcgcaagcgggtattcaggcatgtatcggccgtgatggtagctggaaagatgatgaaggcaccattgataagtcactgaaaaaaatggctgattgctttaatgatgggtacttatttcctggtgaaggtgcagatagctacatcgcacgagtatggccacaatggaatgatgagcttgctgctgaagcctcacaattagcgagtcgtgttttacaggctgcgattttaaacagtgaagttgtcgaagatgagtga

SEQ ID NO: 45522 - protein, 1159 aa, Photobacterium profundum SS9
MFTVYHSNQLDLLKSLLVELIRLNPLDNPFEPEQILVQSPGMSQWLKMELATSFGIAANLEFPLPATYIWKMFTQVLADVPERSAFNKEAMTWKLMEVLPKQLGLPEFEPLKRYLENDPESLKIYQLAEKIADIFDQYLVYRPEWIQQWEAGEIVAELGDEHPWQPILWQALYDQTLALGQSPYHRANLYEHFIDTLDNYASSGTLPANLPKRLFVFGISSLPPRYLDALAALGEHIDVHLMFTNPCRYYWGDIRDRKHLARLAANQRVTIKQLNVSSDGILHGDENVSDENVAVLKDTDENHYDDEMHNDVVGNSLLASMGKLGRDNMYLLSEMQVNEVDAGFVDIEPDSLLHAIQADILNLEDRQNDQILDSSDHKFPISDGDMSLSIHACHSPMREVEVLHDNLLAMFETETAKGLKPRDVIVMVADINAYSAAIQSVFGNAPGNRYIPFSISDRTAEQENPILLAFMRLLTLPESRCNASELLELLEVPAVMNKFGFDSNSFEKIKRWIEEAGVRWGLDEKTACQFELPEQNQNTWLFGIQRMLLGYAMPHDAGLFDGISAYEQIQGLDAELAGQLAGFIDSLISYREQLAQPQCVSSWTDLLNQLLDDFLAVELDGELVLKSIRDNLHRLHEQLADAGYQSLISPAVLTQYLQDKLSGERVSQRFLAGQVNFCTLMPMRSIPFKVVCLLGMNDGAYPRNIAPEGFDLMNGRTKAGDRSRRDDDRYLFLEAIQSAQESLYISYVGRSIQDNAEKVPSVLVSELIEYCQQGYCLEGDEALPVDQSAKRLKEELLVHHHPLVPFSPTAFSGDNPSFAAEWLPAAARHGEANKAFQLTALDAEPMVSDQGLVLELAELQRFWRLPVRYFFNRRLKVFFEPPMGVMEDDEPFILNGLESYLLRDELLALLLDAKVSNKNEDAVFAAFSAEQKAAGGLPVAAFGELDLAMTRTEVVSLADKIVPLVNRPLDDHEVDLIFHVDGHDVNLQGWLKQRYQSGLVRYRSGKVRAQDHLTAWFDHLCLAASHCGQQTHLIGTDKHLVLFIIEPDQAKAYLQDVMALYYHGLNQPLPYFPKTAQAGIQACIGRDGSWKDDEGTIDKSLKKMADCFNDGYLFPGEGADSYIARVWPQWNDELAAEASQLASRVLQAAILNSEVVEDE

SEQ ID NO: 45523 - DNA, 3468 bp, Idiomarina loihiensis L2TR
  CDS (1)..(3468)
gtgagtgaattgacccccggctttattgtcgcgcatggacatcggctggaagacctaaccgatgtggcggttacattcacccaaaactacccgctggcgccgctggagcaggaaaccgtactggtgcaaagtaacggcattgctcagtggctgaaaattaatttagcccaggccagtggcattgccgccatgatagatgtcaccctgccggcacggtttcagtggaaagcatacagagccgtgctcggtgacgacattcccaaaacctctccctttgataaagaccgcttaacctggcggttaatgcgcttgttgcctgaacttattgaacataacccgcactttgcaccgcttaagcactacacctccgacgacagcgatggtcgcaagctgtatcagctaagcgggcggctggccgatttgtttgatcagtacgcggtgtaccgtgccgactggctggataactgggtgcgcggtcaggatatgctggagcaggaacagccggttgaagacgaacagttgtggcagccagaattgtggcgcgcagttagcaacgacattggcatagacgactactggaacaaccgtgccgagctgcatcagcgctttatagataccgcgcaggcgttaactgagcgtccggcgggtttgccgccacgggtggtggtgtttggtatttcctcgctgccgcagcaaatgctgcaggtgctggatgccataaaaggctacacgcaaattctgttgtgtgtgcataacccgtcgcagtaccactgggccgatattgtcgacggcaaagaagccttgcggcaggcggtcaaagcctcttcgcgcttaaaacacaaaccggaactgcccgacgatccgaacgacgacgaactgcaccagctggcgcatccgttgctggcctcctggggtaagcagggtcgtgactacattcgcctgctggatttatacgacgaaaccctggccaaacaggaagcctttaacaccattaagctggaactgtttgagccgcataacaccgaccatttattagcccagttgcaggacgacattctaaatctgcgcccggttcaggaaacccgcgagctttggcctacgccgaataccgccgataagtcactgcaatttcatgtttgccacagcccgcagcgggaactggaagtgttgcatgaccagctactggacgcgtttgccaaagacccggaactcaaaccgcgtgatgttatggtcatgctgccggacgtgaacacctacgcgccttacattgatgcggtatttggccggtaccacaaccgctttggtgagcgcgacccacgtgccattccttataccattgctgaccagggcgagcgtcatcagcggccgttaatgatagcactggaactgttgttacaagttgatcagctgcgttttactcagaccgatttattcaatttattgtcggtaccggcggtgcagcaacgctttgacatgagtgacgacgacctgccgcagttaaaacgctgggtaaaagaagccggcgcacgctgggggctgaatgctgagcagcgcgcgcagttttatatgccggcagcggaagaaaccaacagctggtggttcggcttaaaacgcatgatagccggttacgccatgggcgatttggcagacgttaatttagaaaacgattcaccctgggctaacgtagaaccttataccgaagtggccgggctaagcgccgcattagtgggttgtctggcagacgtggtgcgcacgctggaacaatggtggcagcgcgcgcagggtgaacacagcttaccggagtgggtaactcagggcgagtggctgctggaacagtttttcgaggccgaagaagacagtgaccgcttactgttagccaaactgagtgacgagctgtatcagctgcgggacatttgcgtcgaggcggataacgaatcccaattgcgcctgcccatatttaaagacgcctggttagagcgtgttgaccagcagaacctgaaccaacgttttttggcgggcgcggtaaactttgccacgctaatgcccatgcgggccattccgtttaagtacgtgtgtgtgctgggcatgaacgaaagtgattacccgcgttcaacgccgcgtgtcgattttgatttaatgaccgaccggtatcggccgggtgatcgctcgcgacgtgatgatgaccgctatttgtttctggaggccatgctttcagctcgtgactgtttttacttaagctgggtaggttacagcgctaaagacaacagcgagcgcacaccgtcggtgctggtggcgcaattgcgtgatcacctgcaacagggttgggaagtggacattaatagcctgaccgttgtgcacaaattacagccgtttaacccgtattactttaaccaggaagactcggactacttcacctatgccagtgaatgggcacaggcgcatcagggtgcggtggcttctacaagccgcacggcttcggaaaccgccgcggacgacgagctggaacgcaccctgagcattaatgatattaaacgttttattgaagagcccgcccgcctgtactttaactggcgactggatacctattttagccgcaacagcgaagacctggacgacagcgaagcctttgtcatggataacctgcaaagctggtcactgactacacgtttggtagatgcgggaaaaaaagcattgctgaatggcgctggcattgaagcctctttattaaaagagctgaaccgaattaaacgcgaaggggctctgggcattggtgcaatagccgagcaaaatggacttcagttactggagcagtcgcaggagatactggaaacctatcagcagagcattgctggttattcgggtgtgaatgagtttccggaaacggtgttttttgagcacagcgggctgactattgatgacacagtaaccgggctgcacagtaatgagaacggcgagcgcctatgggtggttacctcggccagcaatattgccgctaaaaacggaaaaggcataaatagtggcggctggaagcacgccagcgcgtattaccttggtctgttgttattgaatttacaaaagccgacacggcttttaattgtgtccaaagggggttgccagttgcaggtggccccggtgcccgctgagcttgcggtacaacaactggagcaaatactggaactggtggccctgtcagcgcagcagccgcagcccatgcatctggatgtgggcatgacctggctaagcgcaatggacaagaacagtcaggacgaagcgctggcgcatgaagcggcacggcaaaaatacgaagaagacggctttcaagaccctgcgctggtcaccaaaagtgattattgcgggcgcgtagccgaaagttacgaagctattcaggcatcaccgcatttccgccgctttatggacgaactttatgaccccatgcgcttaaccctggtgccggaggacaagtcatga

SEQ ID NO: 45524 - protein, 1155 aa, Idiomarina loihiensis L2TR
MSELTPGFIVAHGHRLEDLTDVAVTFTQNYPLAPLEQETVLVQSNGIAQWLKINLAQASGIAAMIDVTLPARFQWKAYRAVLGDDIPKTSPFDKDRLTWRLMRLLPELIEHNPHFAPLKHYTSDDSDGRKLYQLSGRLADLFDQYAVYRADWLDNWVRGQDMLEQEQPVEDEQLWQPELWRAVSNDIGIDDYWNNRAELHQRFIDTAQALTERPAGLPPRVVVFGISSLPQQMLQVLDAIKGYTQILLCVHNPSQYHWADIVDGKEALRQAVKASSRLKHKPELPDDPNDDELHQLAHPLLASWGKQGRDYIRLLDLYDETLAKQEAFNTIKLELFEPHNTDHLLAQLQDDILNLRPVQETRELWPTPNTADKSLQFHVCHSPQRELEVLHDQLLDAFAKDPELKPRDVMVMLPDVNTYAPYIDAVFGRYHNRFGERDPRAIPYTIADQGERHQRPLMIALELLLQVDQLRFTQTDLFNLLSVPAVQQRFDMSDDDLPQLKRWVKEAGARWGLNAEQRAQFYMPAAEETNSWWFGLKRMIAGYAMGDLADVNLENDSPWANVEPYTEVAGLSAALVGCLADVVRTLEQWWQRAQGEHSLPEWVTQGEWLLEQFFEAEEDSDRLLLAKLSDELYQLRDICVEADNESQLRLPIFKDAWLERVDQQNLNQRFLAGAVNFATLMPMRAIPFKYVCVLGMNESDYPRSTPRVDFDLMTDRYRPGDRSRRDDDRYLFLEAMLSARDCFYLSWVGYSAKDNSERTPSVLVAQLRDHLQQGWEVDINSLTVVHKLQPFNPYYFNQEDSDYFTYASEWAQAHQGAVASTSRTASETAADDELERTLSINDIKRFIEEPARLYFNWRLDTYFSRNSEDLDDSEAFVMDNLQSWSLTTRLVDAGKKALLNGAGIEASLLKELNRIKREGALGIGAIAEQNGLQLLEQSQEILETYQQSIAGYSGVNEFPETVFFEHSGLTIDDTVTGLHSNENGERLWVVTSASNIAAKNGKGINSGGWKHASAYYLGLLLLNLQKPTRLLIVSKGGCQLQVAPVPAELAVQQLEQILELVALSAQQPQPMHLDVGMTWLSAMDKNSQDEALAHEAARQKYEEDGFQDPALVTKSDYCGRVAESYEAIQASPHFRRFMDELYDPMRLTLVPEDKS

SEQ ID NO: 45525 - DNA, 3369 bp, Azoarcus sp. EbN1
  CDS (1)..(3369)
atgctctcgctcgccttctcgaaccgctacgaagtgctcctcgaaacgctgctcgcgcgcctcgcggtcgagcagccgggtccgttcggcgggcgcgagatcgtcgtgccgagtgcggcgctgcgccgcagtgtcgagctcgcggtggcgcgacgcgaaggcgtcgcggcgaacctgcgcttttcgtacctcgcgcaatggctgtggagccagatcgacaaggtcgtcccggtcggcgaacagtccccgttcgcgccggcgctgctcgtgtggcggattttcgagcagttccaggatgctgcctggaccggcgcgcacccgcggctctcgcgttacctcgggacagccgacacgacgatgcgcttcgaactcgccgaacgcgtcgcgcgcgccttcgatcactacctcacgtaccgcccgcgctggctcgccgaatggtccgcggggaggacagtcgccggcctgccggacgacgcgcgcgccgatgaagcttggcaagccgggctgtggcgccggctgacggcggaactggggacgcgcagcgagcacccggcggaaacttttttccgtgtcatcgccgcagccggcgatgcgttgcccggcttcctgccggagtcggtgcacgtgttctgcctgccggcgatgccgccgctgtaccgcgacgtgctgcgtgaactgtcgcaacgggtcgacgtgcgcctgtacgtgctcaatccgtgccgcgaatactggttcgagatcgtcgagccgcgacgcctcgcctggctcgccggccagcagcaggatctctatttcgaatccggcaaccggctgctcgccgcgtgggggcggcagacgcaggcgcacatcgacctgctgttcgaaggcgaaggcgcgccggagatcgaggacagcctgttcgtcccgaccggcggcgcgagcctgctggcgcaactgcacgacgcggtgctcgacctcgtcgaccctgcgccgggcagcatcgcgctcgccgacgacgaccgcagcgtcgaagtgcacgtgtgccattcaattacgcgcgaactcgaagtgctgcacgaccggctgctcgcgctgtttgccgcgccggacgcgccgcggcccgacgacatcctcgtcgtcacgcccgatctcgacgctgcggcaccgctgatcgaagcggtattcggcaccgcgccgacgttgcgccgcattccctggacgatcaccggcctcggccagacgcgcgtcaacccggtcgcgcgcgtgctcgacgcggcgctcgcgctcgcggcgagccgtttcccggcgagccgcgtgttcgacctgctgcagcagccgccggtcgcgcgccgtttcggcctcgacggcgcggatctcgagcaggtgcatgaatggctgcgtgcagccggcgtgcgctgggggctcgacggcgcacatcgccgccggctcgacctgccaagcgtcgaccgtcacagcctcgtcgaaggcctgcaccggctgtttctcgcgtatgcgctcggcgatggaagcgcatgccccggcgaggacggcgatggcagtggccccgtgctgttcggcgggcgccttggcgccggcaatcccgaaggcggcgacgcgctcgcattggggcgcttgtggcgctacgccgagacgctgcagtggctcgaagcggccacgcgccgccctctcgacgccgacggctggcgcaagctgctcgtcgaactgctcgaccgcctggtcccgcccgatgtcgagtgggccgacgaccggcgcgcggtgctcgcggcgagcgccgaactgcacgcgaacatgacggcgggggggctgcgcagcccggtgccgctcgcgctcgtgcatgacgcgctcgccgcgctgctcgacgatccggcgcgcggcggcgtgccctgcggcgcggtgacgttctcggcgatgacgagcctgcgcagcctgccgtaccgcgtcgtgtgcgcgatcggcctcgacgacggcgcgttccccggcgccgagcgggccgtcgagttcgacttgatggcgaagcacggcgcgcgcggcgaccgccagcgccgcgacgacgagcgcaacctgttcctcgacctgctgcttgccgcgcgcgactgcgtgcatctgtcgtactcgggccgcagcgtgcgcgacaacagcgaaaagccgccttcggtgctggtggacgagctgctcgactacgccgcgcgcgcgtgcgccgccgatccgctcgacgcggcgtcgctcgctgcggcgcgtcgccggctgacggtcgtccatccgctgcaggcgttctcgcgcaactattttctcgccgactcgcagcgcgacccgcggctcgcgagcttcaacgccgaatactgcgatgcgctgcgcgcgcgcctgcaggcagcggcgcgcgggctgcccgctgcgcgcgccgtctctcgtgacgacgagcgcgacgaggacgacggctgcgaatcggggctgtccggcgaagcgccgtttttcgccgcaccgctgccgctgccggccgacgaatggcgaacggtcgggctcgaccggctgattcgtttcttccgcaatccggcccgcttcctgctgcgcgaacggctcggcgtgacggtgcccgaaggcgacgaggagctcatcgacgacgaagcgttcctgccggtgtggcgcgagcgccaggcgctcgccgaacggctgctgccggcgctgctcgccggacgcgcccccgcagccgtgcgcgagctcgcgcctgccggtggcgaattccccgccgggccgctcggcgagcgcctgctcgagcgcgaactcgacgtcctccgggcctatactgacggcctgcgcgcggcgctcgcgcccgacccgctgccgccgctgcaggcccacttcgacttcgacatccgcggcgaacgctggacgctcgacgccgcgttcggcgatgtgcgcccggccgggctcgtgcgccaccgctacgacgaggcgcgcgcgaacgactatgtcgccggctggatcgcgcatctcgcgctgtgcgcggccgcgcccgaggctgcggagctgtgcaccgaatggcattcgcgcgacggcgtctatcgcctgcggcactgcgacgacgcacgcggacagctcgccgcgctcgtcgcgctgtaccgcgaaggcctgatgcggccgctgccgttctttccgaaatcggcgtgggcgtgggtcgtcaacgactgcagccgctacaaggcggagcagaaatggcgcggtggcggccggcccgagtttggcgaatgccgcgacgcggcgatccggctcgcgttccgcgggctgccggacccgctcgacgacgcgttctacgaccacgccgcgacagtgctgcagccgctcgtcgcgcatctcgacgacccgaggctgtga

SEQ ID NO: 45526 - protein, 1122 aa, Azoarcus sp. EbN1
MLSLAFSNRYEVLLETLLARLAVEQPGPFGGREIVVPSAALRRSVELAVARREGVAANLRFSYLAQWLWSQIDKVVPVGEQSPFAPALLVWRIFEQFQDAAWTGAHPRLSRYLGTADTTMRFELAERVARAFDHYLTYRPRWLAEWSAGRTVAGLPDDARADEAWQAGLWRRLTAELGTRSEHPAETFFRVIAAAGDALPGFLPESVHVFCLPAMPPLYRDVLRELSQRVDVRLYVLNPCREYWFEIVEPRRLAWLAGQQQDLYFESGNRLLAAWGRQTQAHIDLLFEGEGAPEIEDSLFVPTGGASLLAQLHDAVLDLVDPAPGSIALADDDRSVEVHVCHSITRELEVLHDRLLALFAAPDAPRPDDILVVTPDLDAAAPLIEAVFGTAPTLRRIPWTITGLGQTRVNPVARVLDAALALAASRFPASRVFDLLQQPPVARRFGLDGADLEQVHEWLRAAGVRWGLDGAHRRRLDLPSVDRHSLVEGLHRLFLAYALGDGSACPGEDGDGSGPVLFGGRLGAGNPEGGDALALGRLWRYAETLQWLEAATRRPLDADGWRKLLVELLDRLVPPDVEWADDRRAVLAASAELHANMTAGGLRSPVPLALVHDALAALLDDPARGGVPCGAVTFSAMTSLRSLPYRVVCAIGLDDGAFPGAERAVEFDLMAKHGARGDRQRRDDERNLFLDLLLAARDCVHLSYSGRSVRDNSEKPPSVLVDELLDYAARACAADPLDAASLAAARRRLTVVHPLQAFSRNYFLADSQRDPRLASFNAEYCDALRARLQAAARGLPAARAVSRDDERDEDDGCESGLSGEAPFFAAPLPLPADEWRTVGLDRLIRFFRNPARFLLRERLGVTVPEGDEELIDDEAFLPVWRERQALAERLLPALLAGRAPAAVRELAPAGGEFPAGPLGERLLERELDVLRAYTDGLRAALAPDPLPPLQAHFDFDIRGERWTLDAAFGDVRPAGLVRHRYDEARANDYVAGWIAHLALCAAAPEAAELCTEWHSRDGVYRLRHCDDARGQLAALVALYREGLMRPLPFFPKSAWAWVVNDCSRYKAEQKWRGGGRPEFGECRDAAIRLAFRGLPDPLDDAFYDHAATVLQPLVAHLDDPRL

SEQ ID NO: 45527 - DNA, 3240 bp, Francisella tularensis subsp. tularensis Schu 4
  CDS (1)..(3240)
atggcactatacacttacccatcaaataaacttgagtatcttgtacaagttctatctaaacttctagatgttgaaaaaaaagatttatttacaccaacacagttaattgttggtagccgtggtatgcaacattggttaaatatgcaactagccgaatatcgcaatattgcaatgaatctcaaatatgacatgataaatggttatatacttgatatctgctatgaactcacagcaaaacaagaatataaaaaagcatatacaaaagatattttagcttggagagtttttaggttgctatctagccaaaatcaggaaaaaaacactcattcccacgcaggtgggaatctcatagctgatggattaagttcaaaagataccagcctatgcgggtatgacaatagagatggttggagtagtaagcttaaagagtactaccaagatagtgatctcaaaaaatatcagttgtcagttaaaatagcagagaccttctcaaaatatatatcatatcgtagtgagtggctacaaaagtgggagaaggacgaatatataaatccctctaaactagagaatgatgaagattggcagatgctaatttggcagaatcttgtcaaagatattgcagaaacaccatataaagtccaattagaagcacttcaaaagcttgataaacaaaacttagaaaaattaaatatatctagtgatatttatatatttggagttaacacaatatctccaaaaaatcttaaatttatatttgaattagctaagtatattaatgtacatattctatatattaatccatgtagtgagtattggtatgatttgcataaaagtaaaatatcagcttggttagatagtgatgactatgaaattcaaccacttttggcaaatcttggacagcagggtaaagaattttttaatcagcttctagaaaatgagcaacagcaagaattagaagtattcgaaaagtttgataaagaatcattagcttttgagaaacttgccgataataatcaaacacagctagtaagcctacagcgaaacttacttgaactagattgccaaaaccataccaagcaaaaagatttaagtattagtattaactcttgtcatagtccacttagagaggtgcagattttgcatgataagcttttggatatgatcaaagcagatccaaatatcaagcctagagatatcctagtgatgtgcccaaatattgaagattattcaccatatattgatagtgttttctcaagatatccaactgataaaaaactgccatgctcaatcgcagatagaacgctacttgattcagagcctttagctgctagttttattgagcttttgcagttgcctgagagtaattttgaggttaataaaatacttgattatctagctgtaccggctatccaacagaagtttaagatcacagatgaacaattagaggctattcgctattggttaaaagagtcatgtattcatcatagcaataatgatcagacattctcatggagctggggactaagaagattaatgcttgggtttagctatagtgatagtaattacatcattgatgataaattaatgacggtaccagttattgaaggaagtgagatcgctgaacttggtggtttgtatgagttattagagctacttgaaagatattctcaaaatttgcttaaaccaagaagtcttgcaaattggcaagtttatcttttagaaatgtttgatgatgtctttgatgtcactaatgatgagcaatatattgctaaaaaaatcaaagatataatcgcaaaaacagtcactaccgctaaaaatatattgttagatcaagaaattgatttatatacaattagatattgtttaatttctcaattatcagagccaattattaataaccattttttaaatggtaaggtgactttttgttcgatgacgccgatgcgtagtgtaccatttagagttatagctatgcttggattaaataatggtaagttcccacgccaagaatctgcaattagctttgatctgatagcaaggcttggtagaaaaaaaggtgatagaaccaaacgcgatgatgatagatatttgtttttagaggctattttatctgctagagattatttgtatataagctatataggtagaagtgttaagactaatgttgagcaacagccaagtttgatacttaaagagttgactagctatttgaatttgaactacgattggggaaaggaggatataaaagagtatccattgcatgcttttagttctaaatgttattctgacagttatagaagctttgataaagcttggttgaagttgttacagtctgagccaaggggcttttatgattcagcttcattaagtaactgtgctaatttacccaaaaatctaagtatttcaaaacttgttaaagtttttgatgaccctattaaggcttatgcaaattatgctttagagctgtatttagaagatgactttgaggagctagaagatagtgagccatttgatatcaatagtttggataagcataagctcaaacaagctttgttaaaaacttttgaagatgaaaaagacaaagatttaacaataaaaacagccaaactaagtggcaagcttccggagtcagtacttactgatattgagattaaagaggaagttgagaatattcaaaagctactagacaaaatgagcttagcaagttacgagtcaaaatattttcatcaagagatattagggtatgagttagaagctaattgttatattaaaaataatcaaattatgttatctacaccatctagtttgaatataggaaaaaaatttgaattgtacttaatagctttattagtagcatattctgaacaaagagatattagcgcagtctattatggtatagaaaaaaatcaagtagaagaatttagagtagaaaatattgaatatacaacagctaaaggaatattagagcattatataaatcaagctgagcaaatagtagttaagcctcaactagcacatttatctttagctgaagctatttgtgattctaaaaataatactgataagaagaagcaacaggcttggcaaaaagtaataaaatcatcacaacataatttcaaaactctagaagataatagttatttcaagctattctataataagtttccaactgtagatgattttgagggtgaaaaaatttacaaaaagttctttgaggttatttatgaaagtcaatcatga

SEQ ID NO: 45528 - protein, 1079 aa, Francisella tularensis subsp. tularensis Schu 4
MALYTYPSNKLEYLVQVLSKLLDVEKKDLFTPTQLIVGSRGMQHWLNMQLAEYRNIAMNLKYDMINGYILDICYELTAKQEYKKAYTKDILAWRVFRLLSSQNQEKNTHSHAGGNLIADGLSSKDTSLCGYDNRDGWSSKLKEYYQDSDLKKYQLSVKIAETFSKYISYRSEWLQKWEKDEYINPSKLENDEDWQMLIWQNLVKDIAETPYKVQLEALQKLDKQNLEKLNISSDIYIFGVNTISPKNLKFIFELAKYINVHILYINPCSEYWYDLHKSKISAWLDSDDYEIQPLLANLGQQGKEFFNQLLENEQQQELEVFEKFDKESLAFEKLADNNQTQLVSLQRNLLELDCQNHTKQKDLSISINSCHSPLREVQILHDKLLDMIKADPNIKPRDILVMCPNIEDYSPYIDSVFSRYPTDKKLPCSIADRTLLDSEPLAASFIELLQLPESNFEVNKILDYLAVPAIQQKFKITDEQLEAIRYWLKESCIHHSNNDQTFSWSWGLRRLMLGFSYSDSNYIIDDKLMTVPVIEGSEIAELGGLYELLELLERYSQNLLKPRSLANWQVYLLEMFDDVFDVTNDEQYIAKKIKDIIAKTVTTAKNILLDQEIDLYTIRYCLISQLSEPIINNHFLNGKVTFCSMTPMRSVPFRVIAMLGLNNGKFPRQESAISFDLIARLGRKKGDRTKRDDDRYLFLEAILSARDYLYISYIGRSVKTNVEQQPSLILKELTSYLNLNYDWGKEDIKEYPLHAFSSKCYSDSYRSFDKAWLKLLQSEPRGFYDSASLSNCANLPKNLSISKLVKVFDDPIKAYANYALELYLEDDFEELEDSEPFDINSLDKHKLKQALLKTFEDEKDKDLTIKTAKLSGKLPESVLTDIEIKEEVENIQKLLDKMSLASYESKYFHQEILGYELEANCYIKNNQIMLSTPSSLNIGKKFELYLIALLVAYSEQRDISAVYYGIEKNQVEEFRVENIEYTTAKGILEHYINQAEQIVVKPQLAHLSLAEAICDSKNNTDKKKQQAWQKVIKSSQHNFKTLEDNSYFKLFYNKFPTVDDFEGEKIYKKFFEVIYESQS

SEQ ID NO: 45529 - DNA, 3507 bp, Azotobacter vinelandii
  CDS (1)..(3507)
atgcagggtgacgagggactgggcgccgggctgatggtggtgcacggcaaccgcctggaagcgttgcgcgaactggcggtggaatggatgcggcgtcatcccctggcgccgctggaggacgaggtggtgctggtgcagagcaacggcatcgtccagtggctgaagctggcgctggccgggcgggacggttgcggcatcgccgcggcgatccgcgtcgaactgccggcgcgctttctctggcagagctaccgcgcggtgctggggagcgccggtatcccccgcgaatcgccgctggacaaggcgccgctgacctggcggctgatgcgcctgctgccgaacctgctggaaggcgaggcgttcgctccgctgcgccgcttcctcgaagacgactccgacctgcgcaagcgccaccaactggccgagcgcctggccgatctgttcgaccagtaccaggtctaccgtgccgactggctggccgactgggccgagggccacgaccggttgcgcacctcgcgcgacggggcgaggccgctcgacgaggcggcgcgctggcagccggcactgtggcgcgccctgctggcggatgtcggccgggacacggtggccaccagccgcgccggcgtgcacctgcgtttcgtcgaacgcctgcgcggcctcgatgcgccgccgcccggcctgccgcggcgggtcatggtgttcggcatctcctcgctgccggcgcaggctctcgaggcactggccgccctggcgcgcttcagccaggtgctgctctgcgtgcacaacccctgccggtaccactggggcgacatagttcccgaccaggacctgctgcgccaccagtaccgccgccagcggcgcaaggacggtatggcgccggggctgtccgccgaggacctgcaccagcacgcccatccgctcctggccgcctggggcaagcagggccgcgactacatcaacctgctggacaggtacgacgatcccgagcattaccgcgagcgcttcgccagcctcggcgggcgcatcgacctgttcgacgaggaggacggtcccaggcccggacacctgctcggccagttgcaggacgacatcctccacctgcgcaccgtggaggaaacccgcaaggagtggccgctggtcgatccgaaggccgaccgctcgctgcgtttccacatcgctcatagcgcccagcgcgaggtcgagatcctccacgaccaactgctggcgcgcttcgccgccgaccccggcctgcgcccgcgcgaggtgatcgtcatggtcccggacgtcaacgcctacgcgccgcacatccaggcggtgttcggccagtacgcccgggacgacgaccgctacatccccttcagcctcgccgaccaggggcagcgcggctgcgatccgctgccgatcgccgtcgaacagctactgaaactgccggaaggccggctgaccgtcagcgaggtgctcgacctgctcgacgtgccggcgctgcgcgcgcgcttcgccatcgaggagagcgacctgccgaccctgcgccgctggatcgagggcgccggtatccgctggggcctggatgccgagcgccgcgccggcctcggcctgccggcgggcctggaacagaacacctggcgcttcggcctgcggcgcatgctgctcggctacgcggtgggcagcggcgcgccctgcgccggcatcgaacccttcgacgagattggcggtctggaggccgtgctgatcggtccgctggtgcgcctgctcgaggctctcgacgacctgcaccggcgcctggcccggcccgtcgcgccggccgagtggggacgcatcctgcaggccatgctgggcgatttcttcctggcccggagcgaacgcgacgaaaccctgctcggccagctcggcgaggcgctggaggaatggctggagctgtgcgccggggtcgacctggacgagcccctgccgctcggcgtggtgcgcgaggcctggctcggcctgctggaccggggccgcctgagccagcgctttctcgccggcgcggtgaacttctgcaccctgatgccgatgcgcgccatcccgttccgcgtggtctgcctgctcggcatgaacgacggcgactacccgcgcagccagacgcccctggacttcgacctgatggccggcgactaccgtccgggcgaccgctcgcgccgcgaggacgaccgctacctgctgctcgaagccctgctcgccgcccgcgagcagctctacgtcagttgggtggggcgcagcgtccgcgacaattgcgagcggccggcgtcggtgctggtcggccagttgcgcgaccatctcgccagcggctggcgcttgccggaggaataccatgaggcgagcgattcggaggccgacaaagcgaaaaggctgctcgcggcgctgaccaccgagcacccgctgcagccgttcagccgccgctacttcgagggcgacgacgccctgttcagctacgcccgcgaatgggccgcgctgcaccgccgggacgcgccggccggcgcggcgcgggcgctgccgccgttcgagccggacggcgcgctggccctggagaccctgcagaacttcctgcgcgatccggtcaagcatttcttcacccagcgcctcaaggtgcatctggacgagagcatgcaggcgcagctcgacgaggaacccttcggtctcgacggtctgcaactgcaccagttgcgccagagcctgctggacgccgccagcctggccctggaagacgatccggcgcgggtcgaggcggcgctggaggccgccgccctgcgcctgcagcgcagcggccggttgccgctggccggcttcggcgagcgcctgcgcgagcaactgctgaagccgctgccggagcagatgcggcgttaccagagcctctgctccctgtggtcgacgcggctggaatcgcccaagccgctgtggttcgaacacgagggcgtcgaactggccggctggctcggcggcctgcgcgagaacgccggcggggcgctggcgcgcatcgagctgcagcccggcgagctcaagcgcggcaaggacgactggaaatggcaccgcctgctcaggccctgggtggcgcatgtcgccgccgcggcctgcggtgcgccgctgaccagcctgctggtcggccaggatgcgagcctcgagttcgcgcccatcgagcaagcacgggcgcaggcgatcctccgcctgtggctggaggcctggcgcgccgggttggaggcgccgttgccggtggcgctgaacaccgccatcgcttggttgaattccggagaagagggcgacgaggaggggggcacggcggaaaaggccgcccgcgaagcctacgaaggcggttacaaccgttccggcgaactggccggcagcgccagcctggcgcgccagtatccgaccttcgacgatctgatcgccgatcgcgatttctacgaatggagccgcgacctgtaccagtcgctgctggaccataagcccacggaactcatggaggaggaccgcgcatga

SEQ ID NO: 45530 - protein, 1168 aa, Azotobacter vinelandii
MQGDEGLGAGLMVVHGNRLEALRELAVEWMRRHPLAPLEDEVVLVQSNGIVQWLKLALAGRDGCGIAAAIRVELPARFLWQSYRAVLGSAGIPRESPLDKAPLTWRLMRLLPNLLEGEAFAPLRRFLEDDSDLRKRHQLAERLADLFDQYQVYRADWLADWAEGHDRLRTSRDGARPLDEAARWQPALWRALLADVGRDTVATSRAGVHLRFVERLRGLDAPPPGLPRRVMVFGISSLPAQALEALAALARFSQVLLCVHNPCRYHWGDIVPDQDLLRHQYRRQRRKDGMAPGLSAEDLHQHAHPLLAAWGKQGRDYINLLDRYDDPEHYRERFASLGGRIDLFDEEDGPRPGHLLGQLQDDILHLRTVEETRKEWPLVDPKADRSLRFHIAHSAQREVEILHDQLLARFAADPGLRPREVIVMVPDVNAYAPHIQAVFGQYARDDDRYIPFSLADQGQRGCDPLPIAVEQLLKLPEGRLTVSEVLDLLDVPALRARFAIEESDLPTLRRWIEGAGIRWGLDAERRAGLGLPAGLEQNTWRFGLRRMLLGYAVGSGAPCAGIEPFDEIGGLEAVLIGPLVRLLEALDDLHRRLARPVAPAEWGRILQAMLGDFFLARSERDETLLGQLGEALEEWLELCAGVDLDEPLPLGVVREAWLGLLDRGRLSQRFLAGAVNFCTLMPMRAIPFRVVCLLGMNDGDYPRSQTPLDFDLMAGDYRPGDRSRREDDRYLLLEALLAAREQLYVSWVGRSVRDNCERPASVLVGQLRDHLASGWRLPEEYHEASDSEADKAKRLLAALTTEHPLQPFSRRYFEGDDALFSYAREWAALHRRDAPAGAARALPPFEPDGALALETLQNFLRDPVKHFFTQRLKVHLDESMQAQLDEEPFGLDGLQLHQLRQSLLDAASLALEDDPARVEAALEAAALRLQRSGRLPLAGFGERLREQLLKPLPEQMRRYQSLCSLWSTRLESPKPLWFEHEGVELAGWLGGLRENAGGALARIELQPGELKRGKDDWKWHRLLRPWVAHVAAAACGAPLTSLLVGQDASLEFAPIEQARAQAILRLWLEAWRAGLEAPLPVALNTAIAWLNSGEEGDEEGGTAEKAAREAYEGGYNRSGELAGSASLARQYPTFDDLIADRDFYEWSRDLYQSLLDHKPTELMEEDRA

SEQ ID NO: 45531 - DNA, 3435 bp, Haemophilus somnus 2336
  CDS (1)..(3435)
atgtttactttgtattattccaatcaattggaaacgcaaaaagatattttgttacatttaatggatcaacagccattatcagatcctttccaaaaagaagttattttagtacaaagtggcggtatggcacagtggatacagtggcagattgcagagaaaaaaggtatatcggcaaatttgtcttttcctatgcctgcaagttttatttggcaattatatgttgataatttatcgcaagtcacagcttcttctcaatttagtaaagaaaatatgacttggcgattaatggaaattattccgcattatatagatcaaccggaattttacatattgcgtcaatatttacagcaaagttaccaatcaagtcagcagcgatactaccaattagccagcaaaatagcagagttatttgaccaatatttagtttatcgaccggaatggattataagttgggagcagaataaaggcgtagaaattattcagcaaattcagtattaccaaaaaaatttatctgtctcagaatcatgtttttctcaagttgagcaacatattgtttggcaaggtattttatggagagctttagtatgctctgtgcaaaaagaaacacaaaagaatgttttacatcgtgcacatttacatttacttttcttaaaacatattgccggcgaaaaacctaaaaatttgcctacgagaatttttgtatttggtatttcagctttaccgaaggtgcatttagatactttaagtgcattaagccagcattgcgatgtgcatttattttttaataatgcttgtcgtgaatattggggagatataattgatcagagccattggcaacgcttgaaagtacgagagcgtataagttggcaagatttccaacaaccacaaaatacacaggcttggttatccgatgcgcaaatacatacttttgaacaaaatggatttgaacaaatttatgatgaaaagttacaggttggcaatcctttgctttcctcatggggaaaattaggacgggattatttgtatttactcactgaactggaggctaatgaaatcaatgcttatgtcgaactttcggaaaaaacattgttgtcgcaagtacaggcacgcattttagatttggttccttcgaagcacaagtttttaaatttggcagaaaatgaccgctctttaacttttcattcttgttatagtccaatacgagaggttcaagctctacaagattatttgttacatctatttaaccaagctcaggatttgacacctaaagatgtggtagttatggttgcagacattgataaatatgcaccgtatattcaggcggtattcagtcaaggcgaacactatattccgtactctatcgcagacagcaaactttccgaaaatgaccctttagtatctgcttttttacagctgttaaatttaaaagaaagtttattcagtgcggaggaagtgctgacttttttggatcatcctgttattcgtcagagttttaatattactttagaggatttggcacaaattcgtcattgggttgagcattcgggtattcgattcggattagaaaaatatccgcaacaatccttgcaaaattataacgcttggcaggcaggtttagagagaatgttactgggatttgctatgcgggaagaaaatggtctatggttagatacgcttggctttgatgatacctatggattaaaagggcagcttgtcggttatttaaaggattttattactcgtttgtatcaatggcatcaatttttgcaagtagatcacgttattgaaaagtgggaagaacatttaattgaattaatgtcatctttttttgtggtagacggaatggatattccgcaacaatacaaaacaacttttaattatcttattgacactattcaacaattaacggagttgatcctagatagctcttttcaacaagaaataagtgcggaggttatttacgaagtttttgttgaacgcttaaaagatatacccaatagcctaaaatttttaatggggaaagtcactttttgtacgcttctccccatgcgatcaatcccttttaaagtggtgtgtttacttggtatgaatgatagtgattatccacgtcaacaaacaccgaacagctttgatttaatgcaatatcatcgtaaaaaaggcgatcgttttcgccgagatgatgatcgctatttatttttagaagcattgatctcggcacaacagtatttttatgtgagttatattggtcgctctattattgatgatagtgaacgagaaccttcagttcttgttacgcaattgttggattatatagctgaaaatatcaatgctcaaggtgatctaaaagggcaagatattctgaaaaaatcacttattcaacaacatgcgatgactgcatttagccgagaaaatttcaccaaaagagaccgctctttttctaagcaatggctagtgttggcaaataaaaaagatagtggcaatttggcgaattttttacagccgataaatgatacagagatagttaaagaactttcattaaatgacttaattgcgtttattcaggatcctgttcggtatttttttgagcaaaaattacgtgtttttttacgtaagacagaacaaaatattgcggatactgaaaattttactttagataatttagagttatatcaaataaaagaagaacttatttatctttctgagcaggaatgggaagacttttttgctcggatgaaaattaagggaattatgccacaaggggcgtttgcaaaaatttatcagcaaaaaacaaaaaatgagatcattacacttaaatctttagttacgccttatttggatcaaatatcggaacaaattcctgttgacttgagcgttgaaacagaatatggaaaagtatgcttaacggggagcattgacagtttatatcatcaaaaaatgcgaagagtaacgtggagagcctctgttgtcaaaacgaaagatattatccaaacatggatttattatttattacaaaccttggttggagagcctaattcgcaagttgagcattacgctttagacagcagactttcttttgaaaaaatagaaaaatctaccgcacttcaacagcttcaaacttatgttgaggcatatttacttggacaagtttcagtgttattaatgccaatgaaaaatttcgatcaatatcttcaattgctttttactccgaagagtaataaatggaaagaggaaaaggatattgatttatctgcttgttttgaattgttatcagaacttggctcaggtagaaaagagagaaatttttatgtgaaaacagatccttattggcaaagaatattagcacaaacaaaactagacgattcacatattttagaaattaatcaacgtgttatacaatggttcgatttaatgttaatgctaaaaagagttgaatag

SEQ ID NO: 45532 - protein, 1144 aa, Haemophilus somnus 2336
MFTLYYSNQLETQKDILLHLMDQQPLSDPFQKEVILVQSGGMAQWIQWQIAEKKGISANLSFPMPASFIWQLYVDNLSQVTASSQFSKENMTWRLMEIIPHYIDQPEFYILRQYLQQSYQSSQQRYYQLASKIAELFDQYLVYRPEWIISWEQNKGVEIIQQIQYYQKNLSVSESCFSQVEQHIVWQGILWRALVCSVQKETQKNVLHRAHLHLLFLKHIAGEKPKNLPTRIFVFGISALPKVHLDTLSALSQHCDVHLFFNNACREYWGDIIDQSHWQRLKVRERISWQDFQQPQNTQAWLSDAQIHTFEQNGFEQIYDEKLQVGNPLLSSWGKLGRDYLYLLTELEANEINAYVELSEKTLLSQVQARILDLVPSKHKFLNLAENDRSLTFHSCYSPIREVQALQDYLLHLFNQAQDLTPKDVVVMVADIDKYAPYIQAVFSQGEHYIPYSIADSKLSENDPLVSAFLQLLNLKESLFSAEEVLTFLDHPVIRQSFNITLEDLAQIRHWVEHSGIRFGLEKYPQQSLQNYNAWQAGLERMLLGFAMREENGLWLDTLGFDDTYGLKGQLVGYLKDFITRLYQWHQFLQVDHVIEKWEEHLIELMSSFFVVDGMDIPQQYKTTFNYLIDTIQQLTELILDSSFQQEISAEVIYEVFVERLKDIPNSLKFLMGKVTFCTLLPMRSIPFKVVCLLGMNDSDYPRQQTPNSFDLMQYHRKKGDRFRRDDDRYLFLEALISAQQYFYVSYIGRSIIDDSEREPSVLVTQLLDYIAENINAQGDLKGQDILKKSLIQQHAMTAFSRENFTKRDRSFSKQWLVLANKKDSGNLANFLQPINDTEIVKELSLNDLIAFIQDPVRYFFEQKLRVFLRKTEQNIADTENFTLDNLELYQIKEELIYLSEQEWEDFFARMKIKGIMPQGAFAKIYQQKTKNEIITLKSLVTPYLDQISEQIPVDLSVETEYGKVCLTGSIDSLYHQKMRRVTWRASVVKTKDIIQTWIYYLLQTLVGEPNSQVEHYALDSRLSFEKIEKSTALQQLQTYVEAYLLGQVSVLLMPMKNFDQYLQLLFTPKSNKWKEEKDIDLSACFELLSELGSGRKERNFYVKTDPYWQRILAQTKLDDSHILEINQRVIQWFDLMLMLKRVE

SEQ ID NO: 45533 - DNA, 3345 bp, Actinobacillus pleuropneumoniae serovar 1 str. 4074
  CDS (1)..(3345)
atgttcacggtctttttctctcaaaaactttcatctttagccgcattacttatccgtttacaacaaaacgacccgaatcccaatccgttcgagccggaaaccgtcttagtacaaagtgtcggaatggcgcaatggctgcaaatgcaaattgccgatcaaaccggtgtcgccgctcattatcaattcccgtttccgaccagttttttatggcaacaatatcgtgtactgtttccggaattgccgaaagagaatatttttgaaagagaaagcgtaacgtggcgcttaatgcgtttaattccgaagtatttagagaaagcggaatttgaatcgcttaatctctatttaaataaagatgctcgccagtacccgttaaagctatatcaattagccggcaaaattgccgatttattcgaccaatatttagtttaccgtccgcattggctggtccattgggaaagcaatcggattgaagcggtattaaacgagattttagccgcaattgcgtttagagaaaaaaatgaacgggatattttagcgaatttacgctggcaatcgatgttatggaacgcattaattgaagacattaaagctgatagcgacgaagaagtctttatgacttctcatcgtgcttatttgcaacaacaatattttgagaaattggataatttaaccgagtccgagaaatcgaaattgcctaagcgtatctttgtcttaggtatttcttcactgccggcgacgcagcttgcggtattgaaaaaattaagtgaacattgcgaagtttatttgttctttttagatccgagccaagaatattgggcggagagtgtggaagataaaacgttagagaaactggcgttaaaacggcagctttcgcaacaggatctcgatgcgttattggcggaacaaggcaatcaattgctgacgatgtggggtaagcaaggacgtgaatttcttgtgcaattagtcgaacaagaaccggataacacgatagaagtgtttgatgaatacgaaggcgattccaatctgattaaactaaaaaatgccattttaaattttaataacgaacagcgattcgaacttgccgaacaggatcggtcgatacaaattcacgcttgccatagtgtgatgcgagaggttgaggtactgcacaatcaattattacaaatgtttgagcgaaacccgacgctcgcgcctaaagatattattgtgatgtcggcggatattgataaatacgcgccttatattaatgcggtatttgcccgttatgaaaaaggcgataagcgttatattccgtttaccctttccgaccaaaaagtgaccgctgtcgatccgattattgccagctttttaatgcttttaaatctgaaagagagcgattttagtgcggaatcattgttggatttattagatgtaaaggcattgcgagaacgttttaatttacaagagcaggatctgcaaaccttgcgccattgggttaatcaagtcgggattcgtttcgggctacatattcaacaagatgactggcagaatcataatgcgtgggaaaacggtttaacccgtttattgcttggcaccagcttaaaagcggaatccggcatttggcaggatagtatcgcatttaacgagagttacggtttatcggcgacattagtcggctttttggcaaaatttatcgaaaatttgaccgcttggtacgagtttattcaacaagatcatacgcttgaggaatggaaggctcgtattcaaaaattaatcggcgaattttaccaagaatcgaacgaaagtttggatgcgctcctgttattgaatagcacgttggaggaagtggcgaataaggcggaacaggcggagtttagcgaaagtatcgggattgaaataatacgcttattgctggaagacaaactgaatcaacagcaaagcagcttgcagtttttagccggtaaggtgaatttctgtaccttattaccgatgcgtgccatcccgtttaaagtggtttgtttactgggtatgaatgaggcggattttcctcgccaacattcggtcaatagttttgacttaatgcaatacgccccgaaacgaggcgaccgagccagacgagatgacgaccgctatttatttttagaagcgttactttcggcgcaagagattttttatctaagttatatcggacaatcggccaccgataataagcagcgattgccgtctgtgctggtttcgcagttattggattatttggcggagcatttaaccgaacaagcccgtttacaagcgagtgagaaagacaatttttccgaagcattattttggcaaaaaatggtggtacaacaaccgcttaccgtatttagtccgaagaactttacgccgcaatacggttcttatgataaagaatggttattggaacagcaacacgaaccgttagcggattttctgaatgagtcgttcgatttaaaagcggagataccgaccgagattaatcttgaagatttaattgcctttgtaagtaatccgattaagtacttctttaatcaccaattaggcgtttatttccgcaatgatgaagaaagtatcgcagagagcgaaaaattctcgcttagtgatttggacgattatcaattacgtgatcagctagtgacattggaaccggcggaacgagaggcattttttaagcaagaacaattaaaaggaaacttaccgattgccaactttgctaaagtttcgctacaagatttagacgactcgattaatgaattacgggagttaatcctaccatatttaggcgaaagcgatattttgaaaattgagcgattattcgaggtcgagcaactgaaaattcgcttgttcggtaatattcgcaataaattcgccgacgaaattgtgttttggaaagtcagctcgttgaaagataaagattatattcgtttgtggatttattacctgttaattcaagctcaaggtttaaatctcgagttgaaagcaattgcccgtagtaaagagaaggcggagatattccgattcaatcaagttagtgcggaacaagccttttctcaattacaaacttatatttccgcttatgtaacgtcttttagacaattagcgtgggggatttggacggatttagacaactattttgagaagctgtccgatgaacaaaatgtggcggaatattgccagcaacaattatccgcattaatggataagcagtattttgagaaaagttacttacaacgagtgttacaacaaagttcacaattggattacgcccaaattcataccgtgaccttggaatggttcgaattaatgcaacaaagtaaaccgacaaaaaccaaaattaaggagaagaaatga

SEQ ID NO: 45534 - protein, 1114 aa, Actinobacillus pleuropneumoniae serovar 1 str. 4074
MFTVFFSQKLSSLAALLIRLQQNDPNPNPFEPETVLVQSVGMAQWLQMQIADQTGVAAHYQFPFPTSFLWQQYRVLFPELPKENIFERESVTWRLMRLIPKYLEKAEFESLNLYLNKDARQYPLKLYQLAGKIADLFDQYLVYRPHWLVHWESNRIEAVLNEILAAIAFREKNERDILANLRWQSMLWNALIEDIKADSDEEVFMTSHRAYLQQQYFEKLDNLTESEKSKLPKRIFVLGISSLPATQLAVLKKLSEHCEVYLFFLDPSQEYWAESVEDKTLEKLALKRQLSQQDLDALLAEQGNQLLTMWGKQGREFLVQLVEQEPDNTIEVFDEYEGDSNLIKLKNAILNFNNEQRFELAEQDRSIQIHACHSVMREVEVLHNQLLQMFERNPTLAPKDIIVMSADIDKYAPYINAVFARYEKGDKRYIPFTLSDQKVTAVDPIIASFLMLLNLKESDFSAESLLDLLDVKALRERFNLQEQDLQTLRHWVNQVGIRFGLHIQQDDWQNHNAWENGLTRLLLGTSLKAESGIWQDSIAFNESYGLSATLVGFLAKFIENLTAWYEFIQQDHTLEEWKARIQKLIGEFYQESNESLDALLLLNSTLEEVANKAEQAEFSESIGIEIIRLLLEDKLNQQQSSLQFLAGKVNFCTLLPMRAIPFKVVCLLGMNEADFPRQHSVNSFDLMQYAPKRGDRARRDDDRYLFLEALLSAQEIFYLSYIGQSATDNKQRLPSVLVSQLLDYLAEHLTEQARLQASEKDNFSEALFWQKMVVQQPLTVFSPKNFTPQYGSYDKEWLLEQQHEPLADFLNESFDLKAEIPTEINLEDLIAFVSNPIKYFFNHQLGVYFRNDEESIAESEKFSLSDLDDYQLRDQLVTLEPAEREAFFKQEQLKGNLPIANFAKVSLQDLDDSINELRELILPYLGESDILKIERLFEVEQLKIRLFGNIRNKFADEIVFWKVSSLKDKDYIRLWIYYLLIQAQGLNLELKAIARSKEKAEIFRFNQVSAEQAFSQLQTYISAYVTSFRQLAWGIWTDLDNYFEKLSDEQNVAEYCQQQLSALMDKQYFEKSYLQRVLQQSSQLDYAQIHTVTLEWFELMQQSKPTKTKIKEKK

SEQ ID NO: 45535 - DNA, 4539 bp, Psychrobacter sp. 273-4
  CDS (1)..(4539)
atgtttaccattattcaatcgcaccgcaccgaaaaccttgttgatcaattacttgtgcaatatcagtccaagaatcagcctgtttttgagccttttattgtcattgtaccctcaatggtattgggtgattggttggataaaaccattgccagtcgcgctgggattagtaccttggtgcgtactaaattttggggtcagtatcagtggacattaatgcaggatgtgttaacccgccataacgcatatttgttagagatagaccctgaagcggcaattttgaatgtgcctgaagttgcagtgctgtcaccaaccgtgatgcagtggcgcttatttgggtatttgacctactatcaagcgttgattgttaaagatgaaactcatccggttaacccactgctggcctctttgattgatgagccaaaagaaggaggggagcaagataaagcgcaacaagatgcgcgtatttggcagctggcaagcgatttggcgagggtgtttaaccgctatttgacccatcgtgaggattggctggcgctatggtcgcataacaagccgcttaatgtggatgaattgatagcagataaagatgcattgtcactgcgttttgacaagtatgcgcgcggtacgcctgattggttggtggagcattatgttgagttagaagtcgcgcaacgattcttatggtcgcacctatttgccgatgttcatcagcaccgtgtgacaattgaaaacactttttggtcagccttaaaagacaacaaggcaaatgagcgtgctcagttgcctaaaatactgcgtatttttaccattcagcagttgccacagactgagctcgactttttgcagcgcctatcgcaatacatggacatcacactgttgcattacaatccatcaaagctattttgggcggatatcgtggataagtcatggctacagcgccagcagattattaaccctgaaagtgtatttttgcgtgattatgggcatagcttgctgtcacgtttggggaagcagtcgcgcgatacttttgccatgctggctaacttgtcgggtaatgagcaataccaagatgagctagtggagtggcaagataactttgagaatagcgatgatggtttaaatgatgattttggttttagctttgatgatagcgcctatgatgttgatgacgctaataattctcaaattacgcaaaatagcccaagtttattgcgacgtttgcaaaacgatgtgctgatgcttgatgagcaatctactcagcaagtaaccgccgctacagtctctcaagcagtgagtaagcaaatagagccaagctttgataaagagaaaccagaaatggcttggtatgaagatgaggcgttagaaaacaaacgttttgagagagagcgtttttgggtaagctcttggcaagataatagcctaagcattcattcgtgtcacagtttgcagcgtcagcttgaagtgttgcgtattatgattggccgttggctaaatgaaccgatcaaacctggtgaaaagaaacgccatatatccgatattgttgttttgctacctgatgttgagcgtcatcatgctctgatcagctctatttttgtcagtggtaaaggtcaagatggtttgacactgcctgctaaggtaaccggtgttgtcgatgcagatattcgtcagctatgggaagccattattggtttttataagctgttaggcagtcatagtgcccgttttgaagcgcctgaggtcttagactggctgatgctacctcccttgtttgaaagctttgggctgacccacgaacaaatgagccgtggttgtgatttactggtagaggcgggttttatccgcggttttgatgagttacatcttaaacaaaccctagacagtaacgactttgattatcgatttagctttgctcaagcgctagatagattaacgttaggtctagtgatgccagaggccagtttgagcgactgcttatatcccttagctcaggatgattggccaagtactaccttgccagaaatgagtttgccgctgccacaggtgagcctaaacgatgcgatgattgttgaagccctttgccgcatttatgcgggtttggtcgcacgacgtgatgatcataggcaaaagatgaaagcggaagattggctggatcaaattgagacagaagtcattcatcgttactttggcgatgttgatcaaacacgcaccatgcgcgccatctataacgctatgaacggctttaaatccagtttgcgagccaaccgtcattataaacagtactctagtgctgatagtgccaataaagaagtagagcaaaagctggcaggcgttgagcagttgccgctaaagctgagctttatgctagacagtattgagtcagagcttgaaagtcagcaggtcagtgctgagcctactggtgtgattacctttggtcgatttggtgcattaagaaacgtgccttttgagttagtagtaatgcttaatatgaacctctctgagtttcctgggcgtgagcgtgacaaccgatatgatttgatgaaagccaccaacgcccgtcgcggcgacagagtcagtgaagatgatgataatggggcgtttttggatgcgctgttgtgcgcacgtagtgcttgttggatgttctacaacggtcaaagcctgacggacactcatgagcacctgccagccaacccaatcagtgagctattacagtttttgcaaggtgagatacagtggcaggtaaactcgttagaaacgttgcctaagaatattgaccccactaccgagagcctcaagcgctatttgcctaaattgattaagcagtggctggtaactgagcatccagcactgccttttcatgagagtctattcgaaacagaaattgaagacgctgatgtttctaagcaagagtctaaccacctcaatcccaatcctagtttaaatgagggagctgacgatattcaggacaatgctagagacaatagcactgttgatatgactgatgagctggatgttcttttaaataaagccatgcgcaagaccaagttggctcagaaaaagcaatttccgcctgcgccgctttggcaagccgtgtttgatactttgaagggacgagtagcaagcgagcatccacagctggtaggcttaccgacaaaagaacaatacgagtcaatcgctcagctacttggtcaaggtttgggtcagatgggacaagtaagcagtcaaaccttgtctgcattgattgacatgctggcgctagatagtactgctgatgtcagtgatatgaatgaggcgctcatcaaaaccgtgtttgatactatatttaacattggggagatagacgttgaaggggtgttggcttatcaagtgcgccatcctgccaaggcttttttgcgtactcaaaaggtgcatgtggtgcaaggcgaggaagcgatagcgcatcaagagccactgtttctagacagcttgactacctatcagattaaagagcatttgataaatgaactggccaccgatgccaccgataagaatggtgatggcaaggctaaacaagacagtcagatcttgatgtatcaaaaaattatgccggcaggtgtggctcgccaaaccacattgcccaatcaacaacaaaaactgcaacagcaatgcttggagttcaaagagcagttaattgctaatggttttgatgaggctgaagaagatagcactgctggtttgccgttactaacgccaacctctgagtaccccgttcagatagagcttgcagctgtgctgaatagcattaataacgagccaaatcacccatcagagcagcagacagagattcataaataccctcttaaaaataatgactcactactcaagctgctaccaaaagccattaagataaaaggctcagtaccaatatcagtgcctgtagatgctcacaacagccgctctcatctacaggctggcgtgtcctatgctgagcaatcacccaagcagtggttaaacatattgcccaattctgccagtcctaggcatttactcaagttttggttgtcacatttgtattggcaagttgccagacgcaccactgctgagcaagcggcatcaaatgatggagtgagcatttggcgctttaataagcccagctcacaaatcaaaaagtatgaaaaagtaactgcatttaagctaagtcctattgtgtatgaagatgcagtcgttgagctgataaagtgggcagtttttgccaagctatcgggtcaggtgcccattacgttactgccagaatatgcactcagttatcttgataagtgtctacaagctgaagaaagtggggacgaaatcggcagctattggccaaaacgagcagatttctcagattggttaaggcctagctattactcagacacaatatacgatacctgctcgcagcacgccatttggcaatacgtactgcgtgaccaagatgcgtttaaagcgctgtcagcagcgttatccaccttagcgcagccgctgtatgagccaatgtttgccgcactagacggtctagatgattaa

SEQ ID NO: 45536 - protein, 1512 aa, Psychrobacter sp. 273-4
MFTIIQSHRTENLVDQLLVQYQSKNQPVFEPFIVIVPSMVLGDWLDKTIASRAGISTLVRTKFWGQYQWTLMQDVLTRHNAYLLEIDPEAAILNVPEVAVLSPTVMQWRLFGYLTYYQALIVKDETHPVNPLLASLIDEPKEGGEQDKAQQDARIWQLASDLARVFNRYLTHREDWLALWSHNKPLNVDELIADKDALSLRFDKYARGTPDWLVEHYVELEVAQRFLWSHLFADVHQHRVTIENTFWSALKDNKANERAQLPKILRIFTIQQLPQTELDFLQRLSQYMDITLLHYNPSKLFWADIVDKSWLQRQQIINPESVFLRDYGHSLLSRLGKQSRDTFAMLANLSGNEQYQDELVEWQDNFENSDDGLNDDFGFSFDDSAYDVDDANNSQITQNSPSLLRRLQNDVLMLDEQSTQQVTAATVSQAVSKQIEPSFDKEKPEMAWYEDEALENKRFERERFWVSSWQDNSLSIHSCHSLQRQLEVLRIMIGRWLNEPIKPGEKKRHISDIVVLLPDVERHHALISSIFVSGKGQDGLTLPAKVTGVVDADIRQLWEAIIGFYKLLGSHSARFEAPEVLDWLMLPPLFESFGLTHEQMSRGCDLLVEAGFIRGFDELHLKQTLDSNDFDYRFSFAQALDRLTLGLVMPEASLSDCLYPLAQDDWPSTTLPEMSLPLPQVSLNDAMIVEALCRIYAGLVARRDDHRQKMKAEDWLDQIETEVIHRYFGDVDQTRTMRAIYNAMNGFKSSLRANRHYKQYSSADSANKEVEQKLAGVEQLPLKLSFMLDSIESELESQQVSAEPTGVITFGRFGALRNVPFELVVMLNMNLSEFPGRERDNRYDLMKATNARRGDRVSEDDDNGAFLDALLCARSACWMFYNGQSLTDTHEHLPANPISELLQFLQGEIQWQVNSLETLPKNIDPTTESLKRYLPKLIKQWLVTEHPALPFHESLFETEIEDADVSKQESNHLNPNPSLNEGADDIQDNARDNSTVDMTDELDVLLNKAMRKTKLAQKKQFPPAPLWQAVFDTLKGRVASEHPQLVGLPTKEQYESIAQLLGQGLGQMGQVSSQTLSALIDMLALDSTADVSDMNEALIKTVFDTIFNIGEIDVEGVLAYQVRHPAKAFLRTQKVHVVQGEEAIAHQEPLFLDSLTTYQIKEHLINELATDATDKNGDGKAKQDSQILMYQKIMPAGVARQTTLPNQQQKLQQQCLEFKEQLIANGFDEAEEDSTAGLPLLTPTSEYPVQIELAAVLNSINNEPNHPSEQQTEIHKYPLKNNDSLLKLLPKAIKIKGSVPISVPVDAHNSRSHLQAGVSYAEQSPKQWLNILPNSASPRHLLKFWLSHLYWQVARRTTAEQAASNDGVSIWRFNKPSSQIKKYEKVTAFKLSPIVYEDAVVELIKWAVFAKLSGQVPITLLPEYALSYLDKCLQAEESGDEIGSYWPKRADFSDWLRPSYYSDTIYDTCSQHAIWQYVLRDQDAFKALSAALSTLAQPLYEPMFAALDGLDD

SEQ ID NO: 45537 - DNA, 3381 bp, Haemophilus influenzae R2866
  CDS (1)..(3381)
atgttcattgtttattattccaatcagcttgaaaaacaaaaagaaattctttcttcattattcaaatctttaccgcctgaagatccttttcaacaagatattatcttggtacaaagccctaatatggcgcaatggctacaaattgaacttgccaaagaaacaggtatttcagcaaacctaaaatttcctatgccagccagttttatttggcaactttatgcacaaaatttacctgcaacggcattagagaacccttttgataaagattcaatgatgtggcgtttaatgcgcttaatcccaatttttcttgagaaagaaaatttttcgcctctacgcaattatttatcatcttcgccacattctgaacaatataaactttatcaactcagcagtaaaatagccgacttatttgaccaatatttagtttatcgacctgaatggatttttgcttgggaaaaaggcgaagatgaacaaatcactgctcaaatacaaaaacagcaacctaacctaaacgcaactttgtttgcgcaaattcaaggcaatacaaaatggcaaggtgagttatggcgtgcgttggtcgtcgatgttaaatcagatgtgggtgatgccacccatcgagcggctttgcataatcaattcttagccttgcttgccgataaaaaagcaccgaaaaaattaccttcacgcatatttatttttggtattcctgcgcttccaactgcttatcttaatattttgcaagcgatatcctctgaagtggatattcatttattttttaataatccttgccaagaatattggggagatattagcgatttacgccttgattatttgcgttctcgtcagcgttatcaattcaataaacaagatgaagatcaaccgctcttttccgaggatcaactttctcaattagaaaacgctcagtttgacgtcacttatcaaaaagaaaaccttcaactaggcaatccattactggcggcttggggaaaaatggggcgagattttctctatacattggtgagagatgaagaacatattccaacttatcccgtcaatgcctatcaagaaattgagtcgaacagtttgcttgggcaattacagtctcaaattctgcatttagaaaataaaccgttaaatatcgcaaaaaatgaccgcactttaaccctacattcttgccacagtgctatgcgagaagtggaagtattgcacgattatttactggatttattcaatcaagatcctagccctacgccaaaagatgtggttgttatggtggcagatattaaccaatacacaccctatattcaggcagttttcgggcaaaaaaatggagatgcgccacaaattccattttcactttcagataataaactttcagaaagcgatgtgttggtctcaagttacttaactttattaggcttaaaagaaagcaattttagtgcagaggatgttttagcgttgttggatatccctgctatgcgagaacgatttaatatttcccttgctgatttaccattagtgcgagaatgggtaacggattcagggattcgtttcggtttgcaaaaaaatcaagatggcatcaatttcaattcttggcaggctggattagaacgaatgattttaggctatgcgatgcgtgaagaacagggcatttggcaagatagtctgggcttaaacagcagttatggcttaaagggcgagcttgctggaaatttatctcattttttcaccgcactttccgcgctgcatgaaacgctgcaacaatcacattccatcgaaaaatggcaagaaattttaaccgcacttttatcggatttcttcgtgcgaaatgaagacacaagcgacatgattttctatattcaagagaaaattaatgaattagctgagcatctaaaaacgatccattttaatgaagaattacaagcagaagtgatcgccgatgtcatcacaatgaaattggaagatgcgccaaatagcctcaaattccttgcaggaaaagtaaatttctgcaccttattaccaatgcgttcagtgccattcaaagtggtttgtttacttggaatgaatgatgcggattacccaagaacacaaacaccaaacagttttgatttaatgcaatatcattatcaaaaaggcgatcgtgttcgtcgtgatgatgatcgctatttgttcttagaagccttattggccgcacgtgattattgctatatcagttatgttggccgttccattacagataatcaagcgaaagaaccttctgtattggtaagccaactgttggattatattaatcaagggcaaaaggaaaatgtccttactgtcattgaacatccaatgaccgcatttagcccagataatttcaaaaacaacgaaaaatttacccgctcttttgcgacaaaatggttgccaatagcacaatttgacacggcggctagcaattcagaatttgccgtcactatgacagaaaacccagaaaaaatcgaagaagttgaagtggattctttagtcagctttgtggaaaatccagtgaaatttttctttgaaaaacaacttggtgtttatttccgcgataaagatgaacgcattgctgacagtgaaaacttcactttaagtgggttagataattattctctcaataatgacttaatttaccttgatgaacaaaattttgctgattattttagacaagcagaagtaaaaggcgtgttaccgcgtgctgagtttggaaaggtttatgctgaaaatattcgcgacaatgttttagaatttaaagagaaaatagccgatcttggcgagcctaaacaggcttctatagattttaatattgccgtagattggcaaaacgaaaatcaaaaaatccgtttatttggttatatggacgctttatttggcgataattcacaagtcattcactggcattttgcgaaatacaaagatcgttattgtattcgtccttggatttattatttaattcaatgtgttacacaagaaaatgcggtaccagcaaaattaattacgcaagataaggttctcgaattaccgcctattgagcgtgaagttgcgcttgctcaattacaaatttacgtaaaagattatttacaaagccaaatagaaatacaattggtgccaaccataagaaatattaatgattttattgtagacgatgaaagtgcggtagattttgacaacgtttttgaaaaacttcaggcattaactgaaagtaatggtttcggttcaaaagccgatccatattggtcacgagtattagcgcagacctcaagatttaaacaacctgaaaatattgcaaaattattaaaacaaacaaaagcttggtttggcttattattcgcacaaaagaagacaagaaaggcacaaagctaa

SEQ ID NO: 45538 - protein, 1126 aa, Haemophilus influenzae R2866
MFIVYYSNQLEKQKEILSSLFKSLPPEDPFQQDIILVQSPNMAQWLQIELAKETGISANLKFPMPASFIWQLYAQNLPATALENPFDKDSMMWRLMRLIPIFLEKENFSPLRNYLSSSPHSEQYKLYQLSSKIADLFDQYLVYRPEWIFAWEKGEDEQITAQIQKQQPNLNATLFAQIQGNTKWQGELWRALVVDVKSDVGDATHRAALHNQFLALLADKKAPKKLPSRIFIFGIPALPTAYLNILQAISSEVDIHLFFNNPCQEYWGDISDLRLDYLRSRQRYQFNKQDEDQPLFSEDQLSQLENAQFDVTYQKENLQLGNPLLAAWGKMGRDFLYTLVRDEEHIPTYPVNAYQEIESNSLLGQLQSQILHLENKPLNIAKNDRTLTLHSCHSAMREVEVLHDYLLDLFNQDPSPTPKDVVVMVADINQYTPYIQAVFGQKNGDAPQIPFSLSDNKLSESDVLVSSYLTLLGLKESNFSAEDVLALLDIPAMRERFNISLADLPLVREWVTDSGIRFGLQKNQDGINFNSWQAGLERMILGYAMREEQGIWQDSLGLNSSYGLKGELAGNLSHFFTALSALHETLQQSHSIEKWQEILTALLSDFFVRNEDTSDMIFYIQEKINELAEHLKTIHFNEELQAEVIADVITMKLEDAPNSLKFLAGKVNFCTLLPMRSVPFKVVCLLGMNDADYPRTQTPNSFDLMQYHYQKGDRVRRDDDRYLFLEALLAARDYCYISYVGRSITDNQAKEPSVLVSQLLDYINQGQKENVLTVIEHPMTAFSPDNFKNNEKFTRSFATKWLPIAQFDTAASNSEFAVTMTENPEKIEEVEVDSLVSFVENPVKFFFEKQLGVYFRDKDERIADSENFTLSGLDNYSLNNDLIYLDEQNFADYFRQAEVKGVLPRAEFGKVYAENIRDNVLEFKEKIADLGEPKQASIDFNIAVDWQNENQKIRLFGYMDALFGDNSQVIHWHFAKYKDRYCIRPWIYYLIQCVTQENAVPAKLITQDKVLELPPIEREVALAQLQIYVKDYLQSQIEIQLVPTIRNINDFIVDDESAVDFDNVFEKLQALTESNGFGSKADPYWSRVLAQTSRFKQPENIAKLLKQTKAWFGLLFAQKKTRKAQS

SEQ ID NO: 45539 - DNA, 3339 bp, Burkholderia cepacia R18194
  CDS (1)..(3339)
atgctccatctcttctattcgaaccatcacgaaacgctagccgacgcgctgctcgaggatctggccgcgttcccggcccgcaacggcccgtgggcgcagcagcaggtcatcgtgccgagcgcggcgttgcgccgccgtctcgaactcgacatcgccgcgcgcaacggcgtgtgcgcgaacgtcgagttcacgtatctcgcgcaatggctgtgggcgcagatcggccgcgtgatggacgtacccaagcgttcgccgtttgcgcccgaccgcctcgtgtggcgctgctaccggctgtttgcgcaggcgcccgacgggacgccgtggctggcgtcgccgcggctggccgcgtatctgtccgcgtccgacgatgcgatgcgctacgagcttgcacaccgcgtcgcggccgtgctcgatcattacctgacctatcgccccgaatggctgtccgcatggcaggccggcgagtccgtgctcgcgggcgacggcgcgccgcgcgggatcagcgacgccgcacgcgacgacgagcgctggcaggccgcgctgtggcgcgcgctgctcgccgagctgagcgacagcggcacgccgccggcgcaccgttttctcgtcgaggcgcggcatctcgatgccgaaaccatcgcgcacgcggactggccggaatcggtcagcgtgttcgcactgccgacgatgccgccgctgcacgtcgcgttgctgcgcgagctgtcgcgctggatcgacgtgcgcgtctatgcgctgaacccgtgccgcgaattctggttcgacatcgtgaccgccgcgcatgccgatgcgctcgatgcggccgggcggctcgactaccaggaagtcggccatccgctgctcgccgaatggggcaggcagacgcaggcgcagctgcacatgctgcacgaactgactgaaagcgccgcgtcgggcgacgcgtcgcgtttcgtcgagaatcccgcgtcgacctggctcgcgcgcgtgcagaacgcgattctcgaactgcagccggaggctgacgtaggcgacacgccggccgagcgcgggatcgaggtgcacgtgtgccacagcctcgcgcgccagctcgaggtactgcacgaccggctgctcgcgtggttcgacgccgacgcgagcctgcagccgtccgacgtgctcgtcgcggtggccgatctcgcggcggccgggccgctgatcgacgccgtgttcggcacggccggcgccggcggctcgcgcgtgccttaccggatcaccggcctgccgccgtcgcaggcgaatccggtcgcgcgcgtgctgctcgactggctcgcgttgccggagcggcaggtcggcgcgcccgagctggtcgaatggctgcgcgtcgacgcggtggcggcgcgctacggcatcgatgcggcggcgctggagacggtgcagacctggctcgcggccgccggcgcgcggcgcgggctgtcgccgctcgcgagcgacgacgcggcggtgccgtcgccacgccatacgttctccgatgcgctcgcgcggctctttctcggttatgcgatgccggaaggcgcggcgccggtcggcgcgtggctgccgatcgaggcggccaccggcagcgaggccgaactgctcggccggctcgcgcgcttcaccgacgatctcgacggcttcgcgcggcggctggccgaatcgcatacgccgcaaggctggagcgagctgttcgccgatacgctcgcgcgtttcttcgattcgggcgccgcgtatgcggacgcgctcgcgggggtgcgcgacgcgctcgacgcgatgctggcggcgatgacggagggcgcgcccgacgaagcgttgccggcggccgtcgtccgggcggggctggccgctgcgctcgacgatccggcgcgcggcggtgtgccgtggggcggggtcacgttctcgtcgctgacgagcctgcgcggcctgccgtatcgcgtcgtctgcctgctcgggatggacgatggcgtgctgccgagcctcgcgcgtgccgatgaattcgacctgatggccgtgttgccgaaactcggcgaccggcagcgccgcgacgacgagcgcaacctgtttctcgacctgctgctcgccgcgcgcgaccggctgatgattgcgtacacgggccgcagcattcgcgacaacgcgccgttgccgcccgccgcactcgtcgacgaactgctcgaccacctcgcactcgtcacggccgggcccgacgcgccgccggacgcggtcgatgccgcgcggcgcgcattcgtcgtcgagcatccgctgcaaccgttcgcggccgcgtatttccagcccggcagcgaactcgtttcctacgacgccgagcgtgcgacgctcgcgacgctgctggcggccgaggcatcgcacgacgggccgcgcgagctaccgttcttcgcgcagccgctgccggccgaaccggtcgagccggtcgcattcagcgaattcgagcgcttctggcggcatcccgcgcgtgcgctgctgcgcgcgcggctcggcatcgtgctcgccgacgcgcaggccgaactgctcgacaccgagccgttcgcgctcgatttcgccggcagcgatgcgctcgccgagcgcgtgctgccgttgctgatcgaatcggacgagggcggcgtgcacgatcacgcgctgcgcattgcggacgcgagccccgaactgccgggcggcgcgacgggcgccgtgtggcgcgaccaggcgcttggctcgatgacgcagctcgcatcgaacgtgcgccgcgcgctggccgacgggatggagcggcggccgttctcgctcactgtcgtgcccgcctggcccgacacggaacaggcgctgttcggcgccgacgacgcgctgctgtcgggcgacgcggtgagcgcgccgctcgaactgcacggcacgctgaaccggctcacgccagccgggcagatcatctaccgctatgcgcggccgagtgcgcgcgactacctgtccgcgtggctcgagcatctcgtctactgtgcggtggatcctggcggcccgcgccgcacgctgtggttcggcagcggcggtgcattcgagctgacgcccgtcgcggcgccgctcgagcagctcgccccgctggccgcgctgtttcgcgcggggcggcgcatgccgctgcggtttttcccgcgcagcgcgtgggcgcgggtgtccgacggcgaagccaaggccgcaagcgtctggatcaacgagcgggtcgtgagcgaggctgacgatccggccatcgcgatcgcgtggcgcggggcgcatgcatcgctcgacgagccgttcggcacactcgcgcggctcgtgttcgatccgctcgtcgagcatctgaaggaggttgcatga

SEQ ID NO: 45540 - protein, 1112 aa, Burkholderia cepacia R18194
MLHLFYSNHHETLADALLEDLAAFPARNGPWAQQQVIVPSAALRRRLELDIAARNGVCANVEFTYLAQWLWAQIGRVMDVPKRSPFAPDRLVWRCYRLFAQAPDGTPWLASPRLAAYLSASDDAMRYELAHRVAAVLDHYLTYRPEWLSAWQAGESVLAGDGAPRGISDAARDDERWQAALWRALLAELSDSGTPPAHRFLVEARHLDAETIAHADWPESVSVFALPTMPPLHVALLRELSRWIDVRVYALNPCREFWFDIVTAAHADALDAAGRLDYQEVGHPLLAEWGRQTQAQLHMLHELTESAASGDASRFVENPASTWLARVQNAILELQPEADVGDTPAERGIEVHVCHSLARQLEVLHDRLLAWFDADASLQPSDVLVAVADLAAAGPLIDAVFGTAGAGGSRVPYRITGLPPSQANPVARVLLDWLALPERQVGAPELVEWLRVDAVAARYGIDAAALETVQTWLAAAGARRGLSPLASDDAAVPSPRHTFSDALARLFLGYAMPEGAAPVGAWLPIEAATGSEAELLGRLARFTDDLDGFARRLAESHTPQGWSELFADTLARFFDSGAAYADALAGVRDALDAMLAAMTEGAPDEALPAAVVRAGLAAALDDPARGGVPWGGVTFSSLTSLRGLPYRVVCLLGMDDGVLPSLARADEFDLMAVLPKLGDRQRRDDERNLFLDLLLAARDRLMIAYTGRSIRDNAPLPPAALVDELLDHLALVTAGPDAPPDAVDAARRAFVVEHPLQPFAAAYFQPGSELVSYDAERATLATLLAAEASHDGPRELPFFAQPLPAEPVEPVAFSEFERFWRHPARALLRARLGIVLADAQAELLDTEPFALDFAGSDALAERVLPLLIESDEGGVHDHALRIADASPELPGGATGAVWRDQALGSMTQLASNVRRALADGMERRPFSLTVVPAWPDTEQALFGADDALLSGDAVSAPLELHGTLNRLTPAGQIIYRYARPSARDYLSAWLEHLVYCAVDPGGPRRTLWFGSGGAFELTPVAAPLEQLAPLAALFRAGRRMPLRFFPRSAWARVSDGEAKAASVWINERVVSEADDPAIAIAWRGAHASLDEPFGTLARLVFDPLVEHLKEVA

SEQ ID NO: 45541 - DNA, 3603 bp, Burkholderia cepacia R1808
  CDS (1)..(3603)
atgctgatccacgggaatcgatccgagcagcttcgcgacctgctcgtcgaatggatcaagcactatccactcgccccgctcgagagtgagacgattctcgtccagagtaacggcatcgcgcaatggctgaagctcgcgctggccgccgaccgcgatccagcaactggcgagggcggctgcgggatcgccgccgcgctcgacgtttcgttgccgtcgcgcttcgtgtggcaggcgtatcgcgccgtgctcggtgcagaatcggttgcggaagtgtcgccgttcgacaagtcgcgactcgtctggcgcctgatgcgtatgttgcccgcgctggcagcccggccggcgttcgagccgctcaggcgcttcatcagcgacgacgacgatcggcgcaagcggttccagctcgccgagcgccttgccgacctgttcgaccagtaccagatgtatcgcgccgactggctggcgcgttgggcggacggcgacgcggtcgtgctcgatgcacgcggcggcgagcagccgttgcccgacgagcagcgctggcaggccgcgctgtggcacgaactggtggccgacgtggcgggcagcgacgcgtcccgggagatttcgtcgagaggcgggcgggctgcggtgcacgaagcgttcatgcgccggatcgccgcctgggacgacgaccgcgggccggtgggcattccgcggcgcatcgtgatcttcggcatttcgagcctgccgcaccagttgctggaagcgctggccgcactcgcgcgctggagccaagtgatgatgtgcgtggccaatccatgcgcccactactgggccgacatcgtgccagaccgcgacctgctgggccggcgtcagccgcgtcagcaacggcgaaccgggatgcccgccgaactcgacctcgacacgctccacttgcacgcccatccgcttctggcgtcgtggggcaagcaggggcgcgacttcatcggcctgctcgacgcgttcgacaacgccgatgcgcgcgagcattacggtccgaaattcgcgcgcatcggccagcgcatcgacctgttcgagtcgcgcggcgcatcgacgctgctgcagcagttgcaggacgatatccgcgatctgcgtccgctgcgcgagacgcaggagacgtggccggacgtcgatccggcgacggacggatcgattcgctttcacgtcgcgcacagcgcgcagcgcgaagtcgaaatcctgcacgaccagctgctcgcggcattcaacgcggacccgagcctgcggccgcaggacgtcgtcgtcgtggtgccagacatcgaagcctacgcgccgcacgtgcaggccgtcttcggcctggtcgaccggagcgacccgcgctacatcccgttcagcgtggccgaccgcgaacagcgcaaagccgatccgctcatcggtgcactcgagatgctgctcggcttgccgaacgcgcgccttgccgtcagcgatctgctcgatctgctcgacgtgccggcgctgcgcaagcgcttcggtatcgacgaaaccgacctgccaaagctgcgtgcgtggatccgcggcgcaaacatccgatggggtttgcacgcgcagcagcgcgcgagcctcggcttgccgctcgacgagcatgccgccgcgccccatacctgggcgttcggcctgcggcggatgctgctcggttatgccgtcggcagcgaggcgggcgcctggcacgacatcgaaccgttcgacgaggtgggcggactcgacgcggcgctgctcggcccgctggtccggctgatcgatgcgctcgaccacgcgtggcgctcgctcgccgagcctgcgacggcgccggactggtgcgagcggctgcggaatctgaagcagacgttcttcagcgcgcacgacagtgaagacgcgtatacgctcgcgcgcctcgacaacgtgttgcaggcctggctcgacgcatgcaccgaggctcgactgaccgacgtgctgccgctgtccgtcgtcagcgatcattggctgagccagctggatgagggcgggctctcgcagcgcttcttcgccggcgcggtgacgttcgcaaccttgatgcccatgcgcgcgattccgttccgtcgcgtgtgcctgctcggcatgaacgacggggactatccgcgtgcgcgcgtgccgatggatttcgacctgatgcgactgcattaccggccgggcgaccggtcgcgccgcgaggacgaccggtatctcctgctcgaggcgctgctgtcggcgcgagaccatcttcatgtgtcgtgggtcgggcgcagcattaccgataacggcgtgcgcccgccgtcggttctgatcggccagttgcgcgaccatctcgctgccgggtggcgcctcgcgggtgcgagcggtgcggggcctgacgcactcgtcaaggcgctgacggtcgagcatccgttgcaaccgttcagcgtcgcgtatttcccgcccgacacgaatgatgcggcggcggtcttcacgtatgccgccgaatggcgcgacgaaccgcgcgcgtgccgcgatcccgcgccgccggccgcgacgcacgtgccggcaatcgtccgcgacgatccattgtcgcttcgcgaactcgcggagttcctggcgaaaccggtcaagacgttttttagtcagcgactgcgcgtggcgctcgacgtcgacgagactgccgtcgacgacgaagagccgttcgagctcgattcgctcgacgcctggaaactgcaggacgagctgatcggcgtgcaggccgcgcacatgcacgacgacgacgcgctcgtggccgcacgcgacgcgcgcatggccgccatccgccggcggggcgacgtcgtgccgggcggcttcggcgatctcgcgagcgcagcattgctcgagccgatggacgaactgttcgccgcataccgcaagcaactcgcgcgatggcccgttgccatcgacggcgaatgcgaggtcgcatttcagatcgctggggaaagccgggtgcccggcctgagcgactggctcggtcaatggcgcgaggacagcgaaggccggcgtgcgcgactggtgctcgagacgagtgcgctcgtcgagaagggcgcgtaccgatatcacaagctggtcggccattgggtccggcatctggcggccaacctcgcggggcggcacgtaacgaccgtgatcgtcagcaagaagggcatcgtcgaattgcgaccgcttgccggcggcgacaccgaagcgcatctcacggcgttgctgcaggtgtgggacgcagggatgcgcgagccgctgccggtcgcggtggagtcggctttcgcatggctggtccggcgcttcggcaaggacggcaacggtgcggcgccggaggacacgcgcgcggccgccgaaaaggccgcacgttcgaaatacgcgggcgatgcgtacaacaagggcgaagttgccaagagcgcgagcctcggccgcgcatttccggatttcgatgcgctatgcgcggacggccggttcgaggcgcttgccgagtccttgctgttgccgctgttgcgcgccatcgtcagaagcgacacgaaagaaccaaagaaagacgcgaagcaggacaaggccgcacccgacgcggcgggagtcgacgaatga

SEQ ID NO: 45542 - protein, 1200 aa, Burkholderia cepacia R1808
MLIHGNRSEQLRDLLVEWIKHYPLAPLESETILVQSNGIAQWLKLALAADRDPATGEGGCGIAAALDVSLPSRFVWQAYRAVLGAESVAEVSPFDKSRLVWRLMRMLPALAARPAFEPLRRFISDDDDRRKRFQLAERLADLFDQYQMYRADWLARWADGDAVVLDARGGEQPLPDEQRWQAALWHELVADVAGSDASREISSRGGRAAVHEAFMRRIAAWDDDRGPVGIPRRIVIFGISSLPHQLLEALAALARWSQVMMCVANPCAHYWADIVPDRDLLGRRQPRQQRRTGMPAELDLDTLHLHAHPLLASWGKQGRDFIGLLDAFDNADAREHYGPKFARIGQRIDLFESRGASTLLQQLQDDIRDLRPLRETQETWPDVDPATDGSIRFHVAHSAQREVEILHDQLLAAFNADPSLRPQDVVVVVPDIEAYAPHVQAVFGLVDRSDPRYIPFSVADREQRKADPLIGALEMLLGLPNARLAVSDLLDLLDVPALRKRFGIDETDLPKLRAWIRGANIRWGLHAQQRASLGLPLDEHAAAPHTWAFGLRRMLLGYAVGSEAGAWHDIEPFDEVGGLDAALLGPLVRLIDALDHAWRSLAEPATAPDWCERLRNLKQTFFSAHDSEDAYTLARLDNVLQAWLDACTEARLTDVLPLSVVSDHWLSQLDEGGLSQRFFAGAVTFATLMPMRAIPFRRVCLLGMNDGDYPRARVPMDFDLMRLHYRPGDRSRREDDRYLLLEALLSARDHLHVSWVGRSITDNGVRPPSVLIGQLRDHLAAGWRLAGASGAGPDALVKALTVEHPLQPFSVAYFPPDTNDAAAVFTYAAEWRDEPRACRDPAPPAATHVPAIVRDDPLSLRELAEFLAKPVKTFFSQRLRVALDVDETAVDDEEPFELDSLDAWKLQDELIGVQAAHMHDDDALVAARDARMAAIRRRGDVVPGGFGDLASAALLEPMDELFAAYRKQLARWPVAIDGECEVAFQIAGESRVPGLSDWLGQWREDSEGRRARLVLETSALVEKGAYRYHKLVGHWVRHLAANLAGRHVTTVIVSKKGIVELRPLAGGDTEAHLTALLQVWDAGMREPLPVAVESAFAWLVRRFGKDGNGAAPEDTRAAAEKAARSKYAGDAYNKGEVAKSASLGRAFPDFDALCADGRFEALAESLLLPLLRAIVRSDTKEPKKDAKQDKAAPDAAGVDE

SEQ ID NO: 45543 - DNA, 3453 bp, Pseudomonas fluorescens PfO-1
  CDS (1)..(3453)
atgccggacacccagtccctcaacgctgcattcatggtcgttcagagcaacagcctggatgaactgcgcagccttgtgatcagcatcatgcggcgctatccactggcacccctggagaacgaaattgcgctcgtgcagagcaacggcatcgctcaatggctcaagctggcactggctgaagaccctgaagcggacgactctggcggctgtggtatcgccgccgctattgatgtgcaactgccgggcagtttcatgtggcagctttaccggatggttctggggcgagaggagattccggcaacgtcgctgctcgataaggcaccattgacctggcgcctgatgcgcctgttgccacaggtcatcacccgaccccatttcgaaccgctacaacgcttcctcatccatgacaccgatctgcgcaagcgttaccagttgtccgaacgtctggcagacctctttgaccaatatcaggtttaccgcgctgattggcttgaggattgggcagaggggcatcatcaactacgcaatgtgaggggtgaagcgaagccgcttcctccgaccagttgctggcaggcagagttgtggcgtgccctgctggacgatgtgggcgagcaaggcatggctcaaagtcgggcgggcgtgcaccagcggttcatggagcgcatcaacagtcttgaacgcgcaccgaccggacttccccagcgagtgatcgttttcggaatttcctcgttgccagcccaggtactggaggcattggccgggctttcccgtttcagccaggttttgttgtgcgtccataacccctgtcgttatcactgggccgatatcgttgccgacaaggatctcttgcgccatcagtacaagcggcaagcccgaaaaaacggtatgcccgtagtgctggattcggaaatgctccaccagcatgctcacccgctcctcgctgcgtggggcaagcaaggtcgcgattacatcaaccttctcgacagctatgacgaccccgatagctatcgcgcagcatttcgcaatggacgtatcgatctgttcagcgaaaaccagccgaagaacatgctcaatcagttacaggacgacattctggaactgcggccgctcaacgagactcgagcactctggccggcagtcgatctgactcaagacgattcgatccgctttcatattgcccatagcgcccagcgcgaagtggagattctccacgaccagttgctggcacgtttcagtgccaaccctcaattacgcccgcgcgacgtgatcgtgatggtgcctgacatcgatagttatgcgccgcatattcgcgccgtatttgggcagctggatcgtcatgatccacgcttcattcccttcacgatggccgatcaggggcagcgcggacgggatccattactgatcgctgtcgagcatctgctcaagctgccggatagtcgtttccccgtcagtgaaatcctcgacttgcttgatgttccggcgttacgcgccagatttggtgtgcaggaacgagacttgccgaccctgcatcgctggatcgaaggtgccggcgtgcgttgggggattgatgccgggcaacgggccgaactgggattgcccgacgaactggagcaaaacagttggcgcttcggcctgcgtcggatgctgctcggctatgccgtcggcagttccggagcctgtggggatatcgaaccctacgatgaaatcggcggtctcgatgccgcgttgattgggccattggtagcgttgctggatgcactggagctttcgcatcagcaactgatgaaacccgcccaaccacaggaatgggggcatcggcttcaggcgttgatgcaactgtttttcaagcccgaagatgagcatgacgactacctgctggctcaactcgaggagttgcgcgaaacctggatggaaacctgtgaggccgtcggtctgttggacgagctgccactgaccgtcgtccgtgaggcttggctggcggggctggatcaggggcgtctgtcgcagcgcttcctggccggagccgttaacttttgcacgctgatgccgatgcgcgcgatcccgttcaagctggtttgcctgttgggcatgaacgatggcgattatccgcgcgctcaaccgccgctggacttcgatctcatgggcagcgactaccggccgggagatcgctcccgtcgggaggatgatcgctatcttctgctcgaagcgctcttgtccgcccgtcatcagctctacatcagttgggtcggtcgcagcattcgcgacaacagcgagcggccagcctctgtgttgatcggccagttgcgcgatcatctcgccaatggatggcgatcgagcgacaacaaagaggatctcctgattgccatgactcaggagcatccgttgcagccattcagttcgcgctacttccatgaggaagacaaactgttcagctatgccagcgaatggcaggtgctgcatcaacctcacgaacagaacgacaccgcaacgatgcttgtaccccatatccaggaggagccgttgagtctggaactgctacaggacttcctgcgcaatccggtccgacactttttcactcagcgactcaaggtttacttcgaagcggcgcagatacctcaggctgacgaggaaccctttgtactggatgcgttgcagcgatatatgctcagtgacagcttgctcggagcagccttgagacacccggataatgttgatcaggcactcgagtctcaagcccgacgcctgcagaacagcggcctgttgcccattgccggattcggtgaatgccttcagcgagagctgatcgagcctttgccagacttgttgcagcgatatcaacagttgctggcgttatggccgacacccctgtccaacgccctaccgatcaattttgaatggcaggagctgcgccttgaagggtggctgggcggcttgcaccggcgcgccgatggcggcgtactgtcggtcacgacgatcccgaacagcataggctcgatcaagagccgcaaatggcatcgcctgaccaagccctgggtcagccaccttgtcgcgtgtgccagtgggctctccctgacgaccgcactggtggccagtgatgacacgctccttcttgaacctctggaacagactcgagcgggacgggttcttgaggatctgctgctcgcctggcagacgggtatgcgtcagccacttccggtcgcggtaaaaacggcttttgcatggctggggcagaccgatccagtcaaggctgaagcggctgcccgcaaaacctatgagggtgatggtcagaccagcgaaggcgaacgtcgggaaagcccggctctggcccgacagttccccgactacgatgcactgcaggcggatgaaaccttctccggttggtgtgatgcgctttatcgcccgttgctcgaggcaccttggcactcatggacccacgaggaggcaggcgcatga

SEQ ID NO: 45544 - protein, 1150 aa, Pseudomonas fluorescens PfO-1
MPDTQSLNAAFMVVQSNSLDELRSLVISIMRRYPLAPLENEIALVQSNGIAQWLKLALAEDPEADDSGGCGIAAAIDVQLPGSFMWQLYRMVLGREEIPATSLLDKAPLTWRLMRLLPQVITRPHFEPLQRFLIHDTDLRKRYQLSERLADLFDQYQVYRADWLEDWAEGHHQLRNVRGEAKPLPPTSCWQAELWRALLDDVGEQGMAQSRAGVHQRFMERINSLERAPTGLPQRVIVFGISSLPAQVLEALAGLSRFSQVLLCVHNPCRYHWADIVADKDLLRHQYKRQARKNGMPVVLDSEMLHQHAHPLLAAWGKQGRDYINLLDSYDDPDSYRAAFRNGRIDLFSENQPKNMLNQLQDDILELRPLNETRALWPAVDLTQDDSIRFHIAHSAQREVEILHDQLLARFSANPQLRPRDVIVMVPDIDSYAPHIRAVFGQLDRHDPRFIPFTMADQGQRGRDPLLIAVEHLLKLPDSRFPVSEILDLLDVPALRARFGVQERDLPTLHRWIEGAGVRWGIDAGQRAELGLPDELEQNSWRFGLRRMLLGYAVGSSGACGDIEPYDEIGGLDAALIGPLVALLDALELSHQQLMKPAQPQEWGHRLQALMQLFFKPEDEHDDYLLAQLEELRETWMETCEAVGLLDELPLTVVREAWLAGLDQGRLSQRFLAGAVNFCTLMPMRAIPFKLVCLLGMNDGDYPRAQPPLDFDLMGSDYRPGDRSRREDDRYLLLEALLSARHQLYISWVGRSIRDNSERPASVLIGQLRDHLANGWRSSDNKEDLLIAMTQEHPLQPFSSRYFHEEDKLFSYASEWQVLHQPHEQNDTATMLVPHIQEEPLSLELLQDFLRNPVRHFFTQRLKVYFEAAQIPQADEEPFVLDALQRYMLSDSLLGAALRHPDNVDQALESQARRLQNSGLLPIAGFGECLQRELIEPLPDLLQRYQQLLALWPTPLSNALPINFEWQELRLEGWLGGLHRRADGGVLSVTTIPNSIGSIKSRKWHRLTKPWVSHLVACASGLSLTTALVASDDTLLLEPLEQTRAGRVLEDLLLAWQTGMRQPLPVAVKTAFAWLGQTDPVKAEAAARKTYEGDGQTSEGERRESPALARQFPDYDALQADETFSGWCDALYRPLLEAPWHSWTHEEAGA

SEQ ID NO: 45545 - DNA, 3384 bp, Burkholderia fungorum LB400
  CDS (1)..(3384)
atgctccagctcttctactcgaaccgctacgaaacgcttgtcggcgcgctgctcgacgacctggcgcaagcgccgtccgacccctggaccgcgcagcccgtgatcgttccgagcgctgccgtgcggcgccgtctcgagctcgatatcgccacgcgccagggcatctgcgcgaatgtcaactttggttatctcgcgcaatggctgtgggcgcagatcggcggcgtgatcgaggtaccgaagcattcgccgttcgcgcccgaccggctcgtatggcgctgctaccggttgctgggcccggggaacgacggggacgaagcgctgccctggaatgcgtcgccgcgtctgcgcacgtatctcgatgcggcagacgcctcgatgcgctacgaactcgcgcggcgcgtggcgaccgtgctcgaccactatctgacgtatcggccggaatggctgctgcaatggcagaagggcggctcgatcttcgcgagcggtgcggcggacgactccggcccgcgtctcgtcggcgcgagcgaagcggcgcgcgaagacgagcgctggcaagccgcattgtggcgcgtggtgctcgcggaagtggcgggaaacgggcaaacggccgcagccgcgttgccgcccgcttaccgttttctggatgaaatcggcacgctcgatctcgaagccatctcgaacgcacagtggcccgaggcggtcagcgttttcgcgctgcccaccatgccgccgttgcacgtggcgctgctgcgcgcgctttcgcgctgggtcgacgtgcgtctgtacgtaatgaacccgtgccgcgagttctggttcgacgtggtcagcgaagggcgcgttcaggcgctcgacgccaccggccagctcgactatcaggaagtcggccatccgctgcttgccgagtggggccggcagacccaggcgcagttgcatatgctgcacgagctgaccgagagcgcggcctccggcgagaccggcgatttcacggaaaatccgcaaccgagctggcttgccgccgtgcagaacggcatcctcgatctgcgcaaggagaccgacaccgacgaactaccgagcgagcaaggcattgaggtccacgtctgccacagtctgtcgcggcagctcgaagtgctgcacgatcgcctgctgggctggttcgacgaattcgacgatctgcaaccgtccgacgtgctggtcgccgtatccgatctcgcggcggccggccccctgatcgacgccgtgttcggcaccacgccgcccggcgacacgcgccgcattccgtatcggatcaccggcttgccgccgtcgcaggccaatccggtcgcgcggttgctgctcgattggctggccttgcccgagcgcagcgtgggcgcgccggacctgatcgaatggttgcgcgtcgacgccattgccgtgcgttacgggatcgacgcgagttcgctcgaagccgcacaggaatggctggccgcggccggcgcgcgtcgcgggctcgcaccggtggagccgactggcgaacatgtgccgatcgcgcgtcatacgttggcggatgcgcttacgcgtctgtatctcggctacgccatgccggacggcggcgaaccggtcgacgcgtggctgccggtcgaaggcgccgacggcgcggatgccgaactgctcggccgcctgtcgcgtttcgtggacgacatcgacagcttcgcggcgaattgcgcggtcgaacgcacgcctgccgaatggacccaactgctgctcgacacgctcgcgcagtgtttcgacggtggcgtcgaattcgccgattcgctcgccgccgtgcgcgacgcgatcgacaaaatgggcgacgcaatgcaagccggcgcgcaagagatcgcgatgcccgccgcggtggtgcgcggtgcgctgaccgaagcgctcgacgacccggcgcgcggcggcgtgccctggggcagcgtgacgttttcgtcgttgaccagtttgcgcggcttgccgtatcgcgtggtgtgcctgctcggcatggacgacggtgtgctgccgagcctcgcgcgcgccgacgagttcgatctgatggccgcgttcggcaaagccggcgaccgccagcggcgcgacgacgaacgcaatctgttcctcgatctgctgctcgccgcgcgcgatcgcctcttcattgcttatacgggccgcagcattcgcgacaacgcgccgttgccgccggccgcgctggtcgatgaactgctcgaccatcttgcgcaggtgtcggcgggcgagggcgcgagtccggccgaagtcgagagcgcgcggcatgcgttcattgtcgatcatccgttgcaggcgttcgcatcggactatttctcgccgcaatccggtctcttcagctacgacgcggatcgcgccgaactggccacgctactggccgcgcccgcccatcccgctgccgcgcctttcttcgatcgacccttgccgcctgaagagccggcgccgatcgccttcgacgaattcgtgcgcttctggcgtcatcccgcgcgggcgttgttgcgcgaccggctgggcatcgtgttgtcggacgcacagggcgaattgctcgacaccgagccgttcgaactggattacgccgggcgcgatgcattggcggatcgtcttctgccagtcctgctcggcgccgatacggacgacaacgtcatcttcgaacgcgtacgccgcgtggcggcggccagcccggaattgccgggcggcgcgaccggcgcggtgtggcgcgcgcgtgagctcggcgcgttgcgccagctcgccgacagcgtgcgccgcgaagtggcttcgggtgtcgagcgtttgccgttcgtgctcgacatcgcaccgcgctggcccgagaacacggagattgccggcccgcttttcggcccgcatgacgcgctgctgcggcaagccgcacaaacgccgctgcaactgcacggcagtctgaatctgcttaccgaaacaggacaagtgattttccgctacgccaaacctaccgcacgcgactatctgtcggcgtggctcgcgcatctggtgtattgcgccgcacggccggacggtccgcgccgcaccgtatggcatggcagcggcgagagcttcgagctcacgccggtcgccgcgccgctcgacgaactggcgccgcttgccgcgttgttcaaggcagggcgcatgctgccgttgcgctttttcccgaagagcgcgtggacccgggtcagcgaaagcgaatccgcggcgctgggcgtctggatcaacgaccgcgtgcgcggcgagtccgacgaccccgcgttgcgcatcgccttgcgcggcacgccgctcacgctcgaagaaccgttcggcagtctcgccgcgatcgtgttcaagccgctcatccagcatctgcggagcgcgtcatga

SEQ ID NO: 45546 - protein, 1127 aa, Burkholderia fungorum LB400
MLQLFYSNRYETLVGALLDDLAQAPSDPWTAQPVIVPSAAVRRRLELDIATRQGICANVNFGYLAQWLWAQIGGVIEVPKHSPFAPDRLVWRCYRLLGPGNDGDEALPWNASPRLRTYLDAADASMRYELARRVATVLDHYLTYRPEWLLQWQKGGSIFASGAADDSGPRLVGASEAAREDERWQAALWRVVLAEVAGNGQTAAAALPPAYRFLDEIGTLDLEAISNAQWPEAVSVFALPTMPPLHVALLRALSRWVDVRLYVMNPCREFWFDVVSEGRVQALDATGQLDYQEVGHPLLAEWGRQTQAQLHMLHELTESAASGETGDFTENPQPSWLAAVQNGILDLRKETDTDELPSEQGIEVHVCHSLSRQLEVLHDRLLGWFDEFDDLQPSDVLVAVSDLAAAGPLIDAVFGTTPPGDTRRIPYRITGLPPSQANPVARLLLDWLALPERSVGAPDLIEWLRVDAIAVRYGIDASSLEAAQEWLAAAGARRGLAPVEPTGEHVPIARHTLADALTRLYLGYAMPDGGEPVDAWLPVEGADGADAELLGRLSRFVDDIDSFAANCAVERTPAEWTQLLLDTLAQCFDGGVEFADSLAAVRDAIDKMGDAMQAGAQEIAMPAAVVRGALTEALDDPARGGVPWGSVTFSSLTSLRGLPYRVVCLLGMDDGVLPSLARADEFDLMAAFGKAGDRQRRDDERNLFLDLLLAARDRLFIAYTGRSIRDNAPLPPAALVDELLDHLAQVSAGEGASPAEVESARHAFIVDHPLQAFASDYFSPQSGLFSYDADRAELATLLAAPAHPAAAPFFDRPLPPEEPAPIAFDEFVRFWRHPARALLRDRLGIVLSDAQGELLDTEPFELDYAGRDALADRLLPVLLGADTDDNVIFERVRRVAAASPELPGGATGAVWRARELGALRQLADSVRREVASGVERLPFVLDIAPRWPENTEIAGPLFGPHDALLRQAAQTPLQLHGSLNLLTETGQVIFRYAKPTARDYLSAWLAHLVYCAARPDGPRRTVWHGSGESFELTPVAAPLDELAPLAALFKAGRMLPLRFFPKSAWTRVSESESAALGVWINDRVRGESDDPALRIALRGTPLTLEEPFGSLAAIVFKPLIQHLRSAS

SEQ ID NO: 45547 - DNA, 3183 bp, Geobacter metallireducens GS-15
  CDS (1)..(3183)
atgccccttttcctctactccagcaaccggatggagcaccttgtcgaccggcttgtcgaggtgttgcggcgccccttggccgcccccctggcgccggaggtgatcgttgtccagagcaaggggatgcagcgctggctctccatggagctggcaacggcaaccggcgtctgggccaacggtgcctatccgttccccaatgcctttgtctgggacctgttccggaaggccctgccggatctccccgccgcatcccccttcgacccggcggtgctgtcgtggcggatcatggggctgctctccggtttcctggaccagccggcttttgcacccctggcgggatacctggcaggggaggagcgggagctgaagctctaccagcttgccgggaagatcgccgacaccttcgatcagtacacgatcttccgtcccgacatgatcgcccgctgggaacagggaaccgaggaccactggcaggccgtcctctggcgcgccctggcgggggaggggagagggctccaccgggaggcggtgcgtagcgaattcttccggcgcctggcccggggagaggtggacacggcgcttttcccggagcggatcaccgtcttcggcatctcgtacttaccccagttccacctggatgtcttccggcgcatcgccgatttcaccgaggtgaacctctttgtcatgggcccctgccgggagtactgggccgacatcctccccgagcggatcatcgcccggctctctccggaggagcgggaggtgcggatcgaggggaaccccctcctggcctccctggggctcctggggaaggagttttccgataccctcgtggagctgggcgccacggccggcggcgacaccgacctctacggcgatgcccccgacacgaccctcctcggcatggtgcagaacgacatcctccgcctggaggggagcagcggcgaccagcgccccgtggacgcggcggaccgctccatcctgatttcatcctgccacagccccatgcgtgaggtggaggtgctccacgacaccctcctgaacctctttgcctccgcggacgatctcaccccccgcgatatcctcgtcatgacgccggacatcgagacctacgccccctatatctccgccgtgttcgacgggtgccgggacccgcggctgaagattccctactccatcgccgaccggagcatccggagggaaggggggcttgcggagacgttcctggcaatcctcgacctttccggcaagcggttcccggtgaccgcggtcacggagatcctggcctcctccccggttcacggccggttcggcctcgatgccggccatctggaactgatccgcacctggctggaggagacccgcatccggtggggaatggacggtgaggagcggcgccgtgccgggtttcccccctaccgggaacacagctggcgggccgggctggaccggctcatcctgggatatgccatgccagaggaggatggccggatggtggaggggattctccccttcgacgccatggaaggggagggaccggcggtcctgggacggtttgcgggcttcgtggaagggctccacgccttggtggacgaactggaccgcccccgcaccctgacggagtgggtgcggctctgccggcggattctcgacgactttttcgcccctggggaggagggggcttttgacctggccaccctgaacggcattctcaccgagttggagacggtgcgggacgaggcgggattcggcggcgcggtggcgctgccggtgatccgcgcctggctccggggacggctcgaccgggaggtgcgggggctcggcttcatgaccggcggggtcaccttctgcgccatgcttcccatgcggagcatccccttcaaggtcatcgcgctccttggcatgagcgacggtgctttcccccgccggaacaccccccccggcttcgacctcatagcccgggaccggcggcggggagaccgctccctgcgggacgaggaccgttacctcttcctggaggcccttctgtcggcccggcggcattttatcatcagctacacggggcagagcatccgggacaacagcacgcttcctccatcggtcctcgtggacgagtttctcgactacctggggcgccgcttctcggacggcactccggacttcccgaaaaaactcgtgagcaagcaccggcttcaacccttcagcccgacctacttcaccggcgacggcacgcttttcagctactcggaggagaactgccgggccgtggcccaacgcctgaagggtgccgtggcggtacctaccttcatcaccgagcccctgccggagcctccggatgaactgctgacggtctccctttcagctctcctttacttcttcgataacccggcccgctacttcgtgcggacccggctcggcatccggctcgacgagcttccgcctcccctggaagaccgggagccctttgccattgattccctcgacgcctaccggctcagggaagagatgctggacctggccctggcgggacgggaaccgcgggaaacctttgccgtggcccgggcccgggggatactgccgccggcccgccagggggagctcctgttccgggggcttggcgacggagttgaggatctggctgcacagatcagggcgctgaccggtggaaggtcgccgctggatcctctccccgttgaccttgccctggggccttaccggatcaccgggatgttgggggatatctggcccgtggcgcttctgcgccataagggggcgaaatgttcggggcgcgatcaggtacggctctggatcgagcatctgctgctgaatcttctcgcccaggaggggtatccggccgcaagcatccttgttgcaaccgatgtttccctgcggtttgagccggtgccgaatcccatggtgcacctggagacccttctcggcctctacgggcaggggctccgggagccgctccggttcttcccccgcacggcggcggcctatgcggtaaagggagagctttccgctgcccgcaacgcttggggaggggagttcttccccgagggggacgacccctactaccgcctctgcttcggcggcatcgaccccctcgacggggaattcgagcggatcgcccgggcggtattcggccccctgaacgagcatcggcagggcaagggggagtaa

SEQ ID NO: 45548 - protein, 1060 aa, Geobacter metallireducens GS-15
MPLFLYSSNRMEHLVDRLVEVLRRPLAAPLAPEVIVVQSKGMQRWLSMELATATGVWANGAYPFPNAFVWDLFRKALPDLPAASPFDPAVLSWRIMGLLSGFLDQPAFAPLAGYLAGEERELKLYQLAGKIADTFDQYTIFRPDMIARWEQGTEDHWQAVLWRALAGEGRGLHREAVRSEFFRRLARGEVDTALFPERITVFGISYLPQFHLDVFRRIADFTEVNLFVMGPCREYWADILPERIIARLSPEEREVRIEGNPLLASLGLLGKEFSDTLVELGATAGGDTDLYGDAPDTTLLGMVQNDILRLEGSSGDQRPVDAADRSILISSCHSPMREVEVLHDTLLNLFASADDLTPRDILVMTPDIETYAPYISAVFDGCRDPRLKIPYSIADRSIRREGGLAETFLAILDLSGKRFPVTAVTEILASSPVHGRFGLDAGHLELIRTWLEETRIRWGMDGEERRRAGFPPYREHSWRAGLDRLILGYAMPEEDGRMVEGILPFDAMEGEGPAVLGRFAGFVEGLHALVDELDRPRTLTEWVRLCRRILDDFFAPGEEGAFDLATLNGILTELETVRDEAGFGGAVALPVIRAWLRGRLDREVRGLGFMTGGVTFCAMLPMRSIPFKVIALLGMSDGAFPRRNTPPGFDLIARDRRRGDRSLRDEDRYLFLEALLSARRHFIISYTGQSIRDNSTLPPSVLVDEFLDYLGRRFSDGTPDFPKKLVSKHRLQPFSPTYFTGDGTLFSYSEENCRAVAQRLKGAVAVPTFITEPLPEPPDELLTVSLSALLYFFDNPARYFVRTRLGIRLDELPPPLEDREPFAIDSLDAYRLREEMLDLALAGREPRETFAVARARGILPPARQGELLFRGLGDGVEDLAAQIRALTGGRSPLDPLPVDLALGPYRITGMLGDIWPVALLRHKGAKCSGRDQVRLWIEHLLLNLLAQEGYPAASILVATDVSLRFEPVPNPMVHLETLLGLYGQGLREPLRFFPRTAAAYAVKGELSAARNAWGGEFFPEGDDPYYRLCFGGIDPLDGEFERIARAVFGPLNEHRQGKGE

SEQ ID NO: 45549 - DNA, 3195 bp, Geobacter sulfurreducens
  CDS (1)..(3195)
ttgcccctgaccatctacacgagcaaccggatggaggccctggtcgagcagctttgcgccgtggtcgagccccccctgtcgtcaccctttgttcccgagaccatcgtggtgcagagccggggcatggaacggtggctcgccatggagctggcaaagcgcctggggatctgggcgaacggctcctatccctttcccaatgcctttgtctggtcgctcttccgggcggcgctgccccatctgccggaccagtccccctttgaccccgccatcctgacttggcggatcatggacctgctgccgcgcctgctcccggaaccggccttcggccagttgcgggggtatctggccggggaggaccgggaactgcggctctaccagcttgcggccaggatcgccgacacctttgaccagtacaccgtgttccggggcgacctgctggcgacctgggaaacggggcgggaccagcagtggcaggcccggctctggcgcgcattgaccgcggacagccccggtacccaccggggggccgtgcgcgacgcatttctgaaacagctggccggggggcgtctccctgccggcgtctgccccgaacgggtgtcggtcttcggcatctcgtaccttccgccgttccacctggagatcttcacctccctggcccggctctgcccggtgaacctgttcgtcctgagcccctgccgggaatactggggggatatcgtctcgcccggcgcccgggcgcggatgaccccggagcgccggcagcaggccgtggaggggcatccgctgcttgcctccctgggcaagccggggcgcgatttctcgtccctcatcctggcctgcgacgacttgtcgggcggcgagcgcgacctctatgccgacgcccccggcgaaacgctcctggcagcggtgcagaacggcatccttaccctggacgaggccgacggcactccgcgcctggtccgggtggaccccggcgaccgctcgatcgggattcattcctgtcacggccccatgcgcgaggcggaggtgctccacgacgtcctgctggccatgttcgaggacctgcccggcctcacgccccgggatatcctcgtgatgacgccggacatcgagacctatgccccctatgttgccgcggtgttcggcggcggtcaggaccagcggcggcgcatcccgttttccattgccgaccggagcatcaggagtgcggggggagcggccgacgccttcctggccatcctcgatctccccctgggccgcttcccggcgaccggtgtgctggacatcctggagaccggcgcggtccaccgccgtttcggcatcgacgaggccggtctcgaacagatccgctcctgggttgaggccacccgcatccgttggggcatggacgagaacgagcgccgggctgccgggctgcctgcctaccgggagaacagctggcaggcggggctcgaccggctgctgctgggggtggccatgcccgacgaggaaggggccatgttcggcggcatcctcccccacgatgccatggaaggggacgggccggtgctcctggggcgcttcatccgcttcgtggaggccctggagcgggtgcggcaggatctggcgcgcccccgctcccttgaggggtggacagcgaccctgcgcggcatcctggccgacttcttcaatcccgatgacgccaccgccttcgaacgtgccgccttgggcaggatcgtggacggcctcggcgaactcggcgcgggctccggcttcacggacgaggtggggcggtccgtgatcagggcctggctcggcgaacggctcgacaggcccgaccaggggctcggcttcatgaccggcggggtcaccttctgcgccatgctccccatgcggagcatccctttccgggtgatctgcctgctgggggtgaacgacgactccttcccccgccgggaccgcgccgccggcttcgacctgatggccgcagaccgccgtcccggcgaccggtccctgcgggaggaggaccgctacctctttctggaagccctcctctcggcccgggagcgcctggtgatcagctacaccggtcagagcgtccgggataacgccgagcttcccccgtcggtgctggtgagcgagttcctcgactacctgggatcgcgcttcacggacggcaccgaccggttcccggcctccctggtgacacggcaccggctccagcccttcagccccgcctacttcaccggtgacggcgggctgttcagttacgcggccgaagagtgtcgcgccctgtcccgtcgcggcagggacgacgcaccgcgccccttcctggagcaccccctggccgagtccggtccggcgtcggccgacgaaacggagatcctgcccctggcgcagctcatctcctttttcgagcacccggtgcgctacctcatgcgtcaccggctcggcatccgcctggaggagagccgctcccccctggaggaccgggagccctttgccctggactctctggatgccttcctgctggaacaggagatcctggaccacattctggcgggcggcgacccggccgacctcctccccgtggcccgggcccggggcggcctgcccccggcgcgccagggagagctggcctttgcggggctcaccgcccgggtgcgggacctggccgaccgggtccggccggcaaccaacggccagccccccctcgaacccctgaccgtggacctgcgggtgggtgagcggcggctcgtgggcgagctgggttccctctggcccgccggccttatccgctggcgctgtgccaggctgtccggccgcgaccacatccggctctggattgagcacctggttttcaatgccctggcattgcccgccaccggggcggcaagcaggctcctggccgctgacggcgacctggcgctccgtcccgtggccgatccccttgcgcacctggaggctctggtgtcgtactacgggcaggggagccgggagccgctgcggttcttcccgcgcagctccctggcctttgcccgcacgggcgagatggcggcggcccgcaccacctgggggggagacttctacccagagggggacgatccctactatgcgctctgcttcggcactgccgatcccctggacgacgccttccgcgagacgtccgtcgcaatcctgacccccctgctggcccaccgggaggacgagcggtga

SEQ ID NO: 45550 - protein, 1064 aa, Geobacter sulfurreducens
MPLTIYTSNRMEALVEQLCAVVEPPLSSPFVPETIVVQSRGMERWLAMELAKRLGIWANGSYPFPNAFVWSLFRAALPHLPDQSPFDPAILTWRIMDLLPRLLPEPAFGQLRGYLAGEDRELRLYQLAARIADTFDQYTVFRGDLLATWETGRDQQWQARLWRALTADSPGTHRGAVRDAFLKQLAGGRLPAGVCPERVSVFGISYLPPFHLEIFTSLARLCPVNLFVLSPCREYWGDIVSPGARARMTPERRQQAVEGHPLLASLGKPGRDFSSLILACDDLSGGERDLYADAPGETLLAAVQNGILTLDEADGTPRLVRVDPGDRSIGIHSCHGPMREAEVLHDVLLAMFEDLPGLTPRDILVMTPDIETYAPYVAAVFGGGQDQRRRIPFSIADRSIRSAGGAADAFLAILDLPLGRFPATGVLDILETGAVHRRFGIDEAGLEQIRSWVEATRIRWGMDENERRAAGLPAYRENSWQAGLDRLLLGVAMPDEEGAMFGGILPHDAMEGDGPVLLGRFIRFVEALERVRQDLARPRSLEGWTATLRGILADFFNPDDATAFERAALGRIVDGLGELGAGSGFTDEVGRSVIRAWLGERLDRPDQGLGFMTGGVTFCAMLPMRSIPFRVICLLGVNDDSFPRRDRAAGFDLMAADRRPGDRSLREEDRYLFLEALLSARERLVISYTGQSVRDNAELPPSVLVSEFLDYLGSRFTDGTDRFPASLVTRHRLQPFSPAYFTGDGGLFSYAAEECRALSRRGRDDAPRPFLEHPLAESGPASADETEILPLAQLISFFEHPVRYLMRHRLGIRLEESRSPLEDREPFALDSLDAFLLEQEILDHILAGGDPADLLPVARARGGLPPARQGELAFAGLTARVRDLADRVRPATNGQPPLEPLTVDLRVGERRLVGELGSLWPAGLIRWRCARLSGRDHIRLWIEHLVFNALALPATGAASRLLAADGDLALRPVADPLAHLEALVSYYGQGSREPLRFFPRSSLAFARTGEMAAARTTWGGDFYPEGDDPYYALCFGTADPLDDAFRETSVAILTPLLAHREDER

SEQ ID NO: 45551 - DNA, 3450 bp, Pseudomonas syringae
  CDS (1)..(3450)
atgccggttgctacgtccctcaatgcgggttttatggtggttcacggtaaccgccttgatgagttgcgcagcctggttgtgagctggatgcgccgctaccctctggctcctttggagaacgaaattgctttggtgcagagcaacggtatcgcccaatggctgaagctggctctggcggaagatgcccgggacgatgaccttggcggctgtggtattgccgccgcggtagacgtgcagttgcccggcagtttcatgtggcaactttatagagtcgtcctgggcagtgaacaaatccctgcaacgtccctgctcgataaagccccgctgacctggcgcctgatgcgcttgctcccggcgcttatcgatcagccgcacttcgaacccttgcagcgcttccttacccatgacagcgatctgcgcaaacgctatcagctgtcagagcggctggctgacctgttcgaccaatatcaggtttaccgggccgactggctggaagattgggccgcaggccgccatcaattgcgcaacgcccggggtgaaagtccggccctgagcccggctaactgctggcaggccgaactctggcgtgcgttattgctcgatgtgggtgaggagggcatgtcccagagtcgggccggtgttcaccagcgcttcatggataagatcaacagccttgagcaagcgccgcccggtctaccggccagggtgattgtattcgggatttcttcactgcccgcccaggcgctcgaagccctggccggactttcccgtttcagccaggtgctgctgtgcgtacacaacccttgtcgccatcactggtcagacatcgttgcggataaagacctgctgcgtcaccagtacaaacgtcaggcgcgcaaagcgggaatgcctgcagccctggacctggatatcctgcatcaacacgcccacccgttgcttgcagcctggggcaaacaagggcgtgactacatcaatctgctcgacagctacgatgaccccaatagttatcgcgctgcttttcgtgatggccgtatcgacctgttcagtgaggtgcaaccgctgaaccagctgaaccagttgcaggatgacatcctcgaactgcgccccctaagcgaaacccgcgagttatggcccgccgtcgatttggatcaggatcaatcaatccgcttccaggttgcccacagtgcgcagcgcgaagtcgagatccttcacgaccaattgctcgcccgtttcgcaaaatatcctcagttgcagccgcgggatgtgatcgtgatggtgccggatatcgacagctacgcgccccatatccgtgcggtatttggccagatcgagcgagacgaccgccggctcatcccctacaccctggcagaccagggccagcgtggccgtgatccgctgctgatcgccatcgagcatctgctcaagctgccggacagccgttttcccgtcagtgaaattctcgacttgctggatgttcctgccctgcgcgcacgcttcaacgtacaagagcgcgacttgccgaccctgcatcgctggattgagggtgcggggattcgttggggactgaatgctgagcaacgggccggcctcggtttgccggctcatctggaacaaaacagttggcgctttggcctgcgccgcatgttgctcggttatgccgtcggcagcgccgaagcctgcgatggcattgagccttatgatgaaattggcggtctcgatgcggtactgatcggccccctcgtggcattgctggacgcactggaaattgcccaccaggagctgtcccgaccggctttgccggggcaatggggcgagcgcctgcaggcattggtgcaactgtttttccaggcagaaaccgaacatgacgattacctgctggcccagctcgaagagcttcgcgaaacctggctcgagacctgtgagctggtcggtctgcaagacgagttaccgctaaccgtagtacgtgaagcctggttggccgggcttgatcaaggcaagctgtcgcagcgctttttggccggggcggtgaatttttgcaccctgatgccgatgcgggccattccgttcaagctggtatgcctgttgggcatgaacgatggcgactacccgcgtgcgcaaccaccgcttgatttcgacctgatgggcagtgactaccgcccgggtgacagatcccgccgggaagatgaccgctacctgctgctcgaagcgctgctttctgcacgggatcagctctatatcagctgggtcgggcgcagtattcgcgacaacagcgagcgtcctgcctgcgtattgatcgggcaactgcgcgaccacctggccagcggctggcaactggcgggcgggggtgacttgctgcaagccatgacccaggaacatccgcttcaacccttcagtacccgctatttccatgaaggtaattccaacctgttcagctatgcccgggaatggcagcgtttgcacgagccccaaccggcacctgttgcgccgggcatcctgaccgcgcacgaacaagaagaacctttgaacctgacccaactgcaggacttcttgcgtaatcctgtacggcacttctttagccaacgtttgaaagtgttctttgaggcggccgaagtgcctctggcagatgaggaacccttcgtactcgacgcgttacagcgctacaccctgagcgacagcttgctcgaagccgcattggcgcagccagaccagcctgaacaggccttgcatacccgggccctgcgtttacagggcagcggtctgctgcccatggccggttttggcgagagtctgcagcaagaactgatagagccacttccagatgtactacagcgctatcagcaattacttgccctttggcctacgccgctcaatagcgcgcttcccgtcagctttgagtcaaacggcctgactctggaaggctggctgagcaatctgcatcaacgcagtgacaagggcctactgtccgtcacgactattcctaacagtattggcgcgatcaaaacccgtaaatggcatcgcttgacccggccctgggtcaaccatctggtcgcttgcgccagtggcctggacatgtccactgcgttggtagccagcgatgacaccttgctgctcgcgcctctggaggccaagcacgccagtgaaattcttggcaacttgctgatggcctggaaagtcggcatgggccgcccgttacccattgcggtcaaaacagccttcgcctggctggcccagaccgatccggccaaagccgatgccgcggcgcaaaaagcctacgaaggtgacggccagaccagcgatggcgagcgtcgcgaaagtgccgcactcgcacgccagttccctgattacccggccctgatggccagtgaagaatttgcagagtggtgcgatgccctctatcgaccactctttgatgcgccatggcgttcattgaacagcgaggcgtcccgctaa

SEQ ID NO: 45552 - protein, 1149 aa, Pseudomonas syringae
MPVATSLNAGFMVVHGNRLDELRSLVVSWMRRYPLAPLENEIALVQSNGIAQWLKLALAEDARDDDLGGCGIAAAVDVQLPGSFMWQLYRVVLGSEQIPATSLLDKAPLTWRLMRLLPALIDQPHFEPLQRFLTHDSDLRKRYQLSERLADLFDQYQVYRADWLEDWAAGRHQLRNARGESPALSPANCWQAELWRALLLDVGEEGMSQSRAGVHQRFMDKINSLEQAPPGLPARVIVFGISSLPAQALEALAGLSRFSQVLLCVHNPCRHHWSDIVADKDLLRHQYKRQARKAGMPAALDLDILHQHAHPLLAAWGKQGRDYINLLDSYDDPNSYRAAFRDGRIDLFSEVQPLNQLNQLQDDILELRPLSETRELWPAVDLDQDQSIRFQVAHSAQREVEILHDQLLARFAKYPQLQPRDVIVMVPDIDSYAPHIRAVFGQIERDDRRLIPYTLADQGQRGRDPLLIAIEHLLKLPDSRFPVSEILDLLDVPALRARFNVQERDLPTLHRWIEGAGIRWGLNAEQRAGLGLPAHLEQNSWRFGLRRMLLGYAVGSAEACDGIEPYDEIGGLDAVLIGPLVALLDALEIAHQELSRPALPGQWGERLQALVQLFFQAETEHDDYLLAQLEELRETWLETCELVGLQDELPLTVVREAWLAGLDQGKLSQRFLAGAVNFCTLMPMRAIPFKLVCLLGMNDGDYPRAQPPLDFDLMGSDYRPGDRSRREDDRYLLLEALLSARDQLYISWVGRSIRDNSERPACVLIGQLRDHLASGWQLAGGGDLLQAMTQEHPLQPFSTRYFHEGNSNLFSYAREWQRLHEPQPAPVAPGILTAHEQEEPLNLTQLQDFLRNPVRHFFSQRLKVFFEAAEVPLADEEPFVLDALQRYTLSDSLLEAALAQPDQPEQALHTRALRLQGSGLLPMAGFGESLQQELIEPLPDVLQRYQQLLALWPTPLNSALPVSFESNGLTLEGWLSNLHQRSDKGLLSVTTIPNSIGAIKTRKWHRLTRPWVNHLVACASGLDMSTALVASDDTLLLAPLEAKHASEILGNLLMAWKVGMGRPLPIAVKTAFAWLAQTDPAKADAAAQKAYEGDGQTSDGERRESAALARQFPDYPALMASEEFAEWCDALYRPLFDAPWRSLNSEASR

SEQ ID NO: 45553 - DNA, 3258 bp, Mycobacterium smegmatis
  CDS (1)..(3258)
atggcactgcacctgcatcgggccgaacgcaccgatctgctcgctgatggactcgcggcgctgctgtcggatcccctgcccgatccgttcgcgaccgaactggtgctggtccctgccaagggcgtcgaacgctggctgagccagcggttgtccaaccgtctcggggtgtgcgcggcggtcgagttccgcaacccgcgctcgctcatcgccgagctcaccggaaccgccgacgacgatccgtggtcacccgacgcgatggtgtggccgctgctcggcgtgatcgacgagagcctcgacgagccgtggtgcgcgacgctcgcgacgcacctcggccacttcgagatgggcgaggagtacgagctgcgccagggccgccgctacgcggtcgcgcgacggctggcggggttgttcgcgtcctacgcgcggcagcgcccgcaactactggtcgactgggacggcctccccgacgacctggcctggcagaaagcgctgtggcaggcactgtgtgagcgcatcgacgccgacccgccccacatccgccacgccaaaacccttgtccagctacatgagtcgcccacggatctgccgcagcgcctgtcgctgttcgggcatacacgcctgcctgccaccgaggtcgaattgctgaccgcgctggccacgcatcacgatctgcacctgtggctgccccaccccagcgacactctctggcaggcactgtccacgcgcaagggtccgctgccccgacgtgaggacaccagccaccgtgacgtcgggcatccactgctggccaccctgggccgcgacctgcgcgagatgcaacgtctgctgcccgagcccgacaccgacgaattccgcggcaggtccgagtatcccgacacgctgctgggctggctgcagtccgacatcgcggccgacgcggtacgcccgcagggccgtcaccaccgtcgcgaggaccgctcgatccaggtgcacagctgccacggcccgtcacggcagatcgatgtgctgcgcgaggtgctgctcggcctgctcgccgacgatcccacgctggaaccccgcgacatcctcgtcatgtgtcccgacatcgagacctacgcgccgttgatcacggccgggttcgggctcggcgacgtcgtgccgcgcacgcgaggagcacatataaatctcagcgcgcatcccgcgcacaagctgcgggtgcggctggccgaccgcgcgctggtgcagaccaatcccctgctggcggtggccgcgcaactgctggcgctggccggcggccgcgcgaccgcgagcgaggtgctcaacctggccgaatccgcgccggtgcgggcccggttcggattcaccgacgacgacctcgacgcgatcacggcgtggacgcgcgaggccaacatccgctggggtttcgaccaggagcaccgccgcccgtacggcgtcgaattcctgcacaacacctggcgtttcggcatcgaccgcgtgctggccggggtcgccatgtccgacgactcgcatgcctggctgggcacgacgctgccgctcgacgacgtcagcagcaaccgcgtggagttggcgggccggttcgccgatttcgtcgagaagctccgccgcacggtcgatcagctcagcggcacccgcccgctgcacgagtggctcgacgcgctgaccgcgggcatcgacgcgctggcactggccgacgaggactggcccgccgcccagatgcagcgtgagttcgccgagatcaccgcacgtgcgggcgacaccgcaacctcgttgcggctggcggatgttcgcgcactgctggaccgccatctggccgggcgccccacgcgggccaacttccgcaccggaacgctcacggtgtgcaccatggtgccgatgcgttcggtgccgcaccgcgtggtgtgcctcgtgggtctcgacgacggcgtgttcccgcgtctgggggcggtcgacggcgacgacgccctcgcgcgcgacccgatgaccggtgagcgtgacattcgttcggaggatcgccaactgctgctcgacgcgatcctcgcggccacgcagacgctcgtcatcacctacaccggcgccaacgaatactcggggcaggcccgcccgcccgcggtcccgctggccgagctgatcgacacgctcaagatcaccaccgaagattccgcactcgacgtcctcacgcggcatccgttgcagcccttcgacaaacgcaacgtgatccctggcgcgctggtgccggacgagccgttcacgttcgaccagaccgcgctcgtcgcggcacgggccagcagtggtgaacgcgccatgcggccggcgttcttcagcgatccgttgccgccgccgctgcccgacgacgtcgccctcgaagacctgctgaacttcttcaaggatcccgtcaaggggttcttccgcgcgctcgactacacgctgccatgggacgtcgagggcgtgtccgacgtgatgcccgtcgacatcgacgcactcgaggaatggacggtcggcgaccgcatgctgtcggacatcctgcgcggcatgaccccggccgccgcgcaacaggccgagtggcgccgtggcacgctgccgcccggacagttgggatggcgccgcgcgatcgcactgcgcgaccagtgcgcgctgctggccgccgaggcgctggggttccgcgacaccgacggtcaggcctacgacgtcgacatcgacctgggcggtggccggcgtctcaccggcacggtgtcaccggtgttcggtgaccgactggtgtcggtgacgtactccaagctgggcggcaagcacttgctgcagtcgtggattccgttgctggcgttggccgccggatatcccgaccgcgactggctcgcggtgtgcatcgggcggcccgcgcggggcaccacaccgcgggtcgaggggctgggcgggcccgacaacccggtcgatctgctggcggatctggtggcgatctacgacgcggggcggcgcgaaccactgccgcttccggtcaagacgtcgtatgcgtgggccgaggcacggcactgcggcgacgatccggagcagaaggccggcttccgctggcgcagcggccgatacccgggcgaggacgccgaacctgcccacgtgcgcgcgtggggccgtgacgcgtggctgcgcgacctcatgcaaccgctgcgccccggtgaggagttcgaaggcgaaacccaccggttaggtgcgtactcgtcacggctgtggctgccgctgctgcgcgccgaaaggccggtgcggtga

SEQ ID NO: 45554 - protein, 1085 aa, Mycobacterium smegmatis
MALHLHRAERTDLLADGLAALLSDPLPDPFATELVLVPAKGVERWLSQRLSNRLGVCAAVEFRNPRSLIAELTGTADDDPWSPDAMVWPLLGVIDESLDEPWCATLATHLGHFEMGEEYELRQGRRYAVARRLAGLFASYARQRPQLLVDWDGLPDDLAWQKALWQALCERIDADPPHIRHAKTLVQLHESPTDLPQRLSLFGHTRLPATEVELLTALATHHDLHLWLPHPSDTLWQALSTRKGPLPRREDTSHRDVGHPLLATLGRDLREMQRLLPEPDTDEFRGRSEYPDTLLGWLQSDIAADAVRPQGRHHRREDRSIQVHSCHGPSRQIDVLREVLLGLLADDPTLEPRDILVMCPDIETYAPLITAGFGLGDVVPRTRGAHINLSAHPAHKLRVRLADRALVQTNPLLAVAAQLLALAGGRATASEVLNLAESAPVRARFGFTDDDLDAITAWTREANIRWGFDQEHRRPYGVEFLHNTWRFGIDRVLAGVAMSDDSHAWLGTTLPLDDVSSNRVELAGRFADFVEKLRRTVDQLSGTRPLHEWLDALTAGIDALALADEDWPAAQMQREFAEITARAGDTATSLRLADVRALLDRHLAGRPTRANFRTGTLTVCTMVPMRSVPHRVVCLVGLDDGVFPRLGAVDGDDALARDPMTGERDIRSEDRQLLLDAILAATQTLVITYTGANEYSGQARPPAVPLAELIDTLKITTEDSALDVLTRHPLQPFDKRNVIPGALVPDEPFTFDQTALVAARASSGERAMRPAFFSDPLPPPLPDDVALEDLLNFFKDPVKGFFRALDYTLPWDVEGVSDVMPVDIDALEEWTVGDRMLSDILRGMTPAAAQQAEWRRGTLPPGQLGWRRAIALRDQCALLAAEALGFRDTDGQAYDVDIDLGGGRRLTGTVSPVFGDRLVSVTYSKLGGKHLLQSWIPLLALAAGYPDRDWLAVCIGRPARGTTPRVEGLGGPDNPVDLLADLVAIYDAGRREPLPLPVKTSYAWAEARHCGDDPEQKAGFRWRSGRYPGEDAEPAHVRAWGRDAWLRDLMQPLRPGEEFEGETHRLGAYSSRLWLPLLRAERPVR

SEQ ID NO: 45555 - DNA, 3213 bp, Buchnera aphidicola
  CDS (1)..(3213)
atgtttaccatttacaagtcaaattctcttaatacgctactattaaaagcatatcatattattgaagaaaaacctttttctaatatttttgaaaaagagatatttatttatgataacaaagtgctatttcaatacttaaatatatttattgctgaaaaaaaaggtatttctgctaattttaaattttatcatcccaatgattttatatggaaattatttaaaataattttatctaaaaaagagttaaaaaatatatttactcattctatgattatttgggaaattataaaaattttagataataaaaaattttttgaaaattgcagtaaaaaaaaagatatgataaaaaaatttaaattttcatttttaatggccagtatatttaaaaaatatattttatatcgtcctgaatggatcaatcaatgggaaatagaaaaaaatatatcaatttttgacaaaaacgaacaatggcaaataaaattatggatggaaataatacataatacaaaaaaaataaatcaatctagtgatcattttgctaatttattttataatattcagaaaataattaaagaaaaaaaaataaaaaaaaaatatttacctaaacgtttctttattatttcctctttttcaatgaatccttcttatataaaaatttttcaaaatattagtatatatactgatatttatttcttatatattaccccatttaagaaaaatatatttaattttattcaagataataaaatttttacagatataaaaatagaaaaaaaaaatatattaaatgattcattaataacattatggggacaatatgaagaaatttattatttttatattcttaagtctaaaaaaaataaagtaatcaattgctttaaaaaaaataaaaataaaagtttattaagtcagattaaaaataatttttttaacgatagtgaattcacacgcaaaaaaagatttttagaaataagtgaccattcaatttctataaatatttgttttaataaaaaaaatgaaattgaagtgttatatgaaaaattattgatatttcttaatgaaaactcatctataaaaccaggtgatatagtagttacttctttttcactagatacatatatttcatcaattaatttaatatttcaatcaatagataataaaaaaaccattcctttttttatcgctaaaaaatcttctaaaacaacagaaataatgctttggtcttttaaaaaaatattaaatttatcaaatagtcggttcgaaaacgaagaaatattagaattactcgatgttcctgaaatagcagaaaaatttaatttttcagaagaagaaataaaaattttataccattggatagaagaaacaaatattcgatggggtattaatgaaaaacataaaaattatttgttgtttcctaaaaataaacaaaatacatggttttacggtatagaaaaattacttcttagttatgcaatgaatgatacagaaaaaatttggaatggtgttttgtcatgcagttttattaacggttccagatcggaattgataggaaaactgatttcatttataaaaatactagaaaaatggcaaaaaaaactatcaaaattacaataccttacatattggcgttcattatatagcgatttagttagtgatttttttcaaaataacacaaaaatagaaaaatctattcaaataattcaaaaaaaatggatagaaataattgatgatagtttatcatcaaattatttaaaaaaaatttcaattaatatacttaaaaaaatttttttctataaatattatgataataatcatgaaatatttttacctggagtagtaaatttttgctatcctgattctgtatgttatattccatttaaagtaatatgtatgattggaactgatcatacaagtattccgaaaacaaattatttagataactttaatttattaaaaaagtatccgttaattggagatattaatctgtatcaaaaatattcttacttgtttgttcaaagcttatcttgtgccgaaaaatatttttatattagttatatcggatattctgttaaagacgaaagcaaagtacatccttcaattttagttgatcagttattaaattatataacattaaatttttgttttataggcgatcaaaatttaagttacaaagaaaattctaaaaaaatcactaaatatctgtgcaaaaaacataaaaaacaatttttctatgaaacaaaaaatatagaatcttttatacaagatgatataaaaaatgattttaaacatacagaaaaaaatatatctcataaaaatttactaaaaaaaaatactgataatgaaattaatttgaaagatttgataaatttttggaaacatccaatacgatatttttataattctcatttaaaaattaaaattcgtcaaaaaaaacaaaaaatcaatacaacagaaacttttttagtaaatccattaaattcttttaaaataaaaaataaactactagattacatcatacataataaaaatataacaaaattataccaacactaccttctttctggaaaactaccttatcattttttcggggaaatattttggataaaaaatattaaagaaatgaaattgatagcaaataaagtaatgcaatatagaattgaaaaagaagaaaaaaagattaatttaaatatagaaaaataccaaatatatggcgttttatctgaaatacaaagtacagggttgctgcgttggaaaacaagctcaatcagatatagcgatcgtattgctttatggttagaacatttaatttactctatattaggaggttgtgggaaaagcaaaataataggttataaaagtcaaatttggtctttttcttctttaaattctcatagagcacatagttatctactagagtatattaaaggatatataaagggcatgaaagaacctctttttttaacaaaatcaggggcatcttggcttgaccaggtttatgatgaaagaaataattgtattaaaaatgattattatacaaaaataaaagcatataaaaaattattatatacctggaaaggagataattacaccgaaggggaacaagaagattattatttaaaaaaaacaattaccatatcaaataaaaagaacatcaaaaaaatttgtgagagtgctgaaaagtggcttattcccattttaaaaaataaaggttga

SEQ ID NO: 45556 - protein, 1070 aa, Buchnera aphidicola
MFTIYKSNSLNTLLLKAYHIIEEKPFSNIFEKEIFIYDNKVLFQYLNIFIAEKKGISANFKFYHPNDFIWKLFKIILSKKELKNIFTHSMIIWEIIKILDNKKFFENCSKKKDMIKKFKFSFLMASIFKKYILYRPEWINQWEIEKNISIFDKNEQWQIKLWMEIIHNTKKINQSSDHFANLFYNIQKIIKEKKIKKKYLPKRFFIISSFSMNPSYIKIFQNISIYTDIYFLYITPFKKNIFNFIQDNKIFTDIKIEKKNILNDSLITLWGQYEEIYYFYILKSKKNKVINCFKKNKNKSLLSQIKNNFFNDSEFTRKKRFLEISDHSISINICFNKKNEIEVLYEKLLIFLNENSSIKPGDIVVTSFSLDTYISSINLIFQSIDNKKTIPFFIAKKSSKTTEIMLWSFKKILNLSNSRFENEEILELLDVPEIAEKFNFSEEEIKILYHWIEETNIRWGINEKHKNYLLFPKNKQNTWFYGIEKLLLSYAMNDTEKIWNGVLSCSFINGSRSELIGKLISFIKILEKWQKKLSKLQYLTYWRSLYSDLVSDFFQNNTKIEKSIQIIQKKWIEIIDDSLSSNYLKKISINILKKIFFYKYYDNNHEIFLPGVVNFCYPDSVCYIPFKVICMIGTDHTSIPKTNYLDNFNLLKKYPLIGDINLYQKYSYLFVQSLSCAEKYFYISYIGYSVKDESKVHPSILVDQLLNYITLNFCFIGDQNLSYKENSKKITKYLCKKHKKQFFYETKNIESFIQDDIKNDFKHTEKNISHKNLLKKNTDNEINLKDLINFWKHPIRYFYNSHLKIKIRQKKQKINTTETFLVNPLNSFKIKNKLLDYIIHNKNITKLYQHYLLSGKLPYHFFGEIFWIKNIKEMKLIANKVMQYRIEKEEKKINLNIEKYQIYGVLSEIQSTGLLRWKTSSIRYSDRIALWLEHLIYSILGGCGKSKIIGYKSQIWSFSSLNSHRAHSYLLEYIKGYIKGMKEPLFLTKSGASWLDQVYDERNNCIKNDYYTKIKAYKKLLYTWKGDNYTEGEQEDYYLKKTITISNKKNIKKICESAEKWLIPILKNKG

SEQ ID NO: 45557 - DNA, 3186 bp, Buchnera aphidicola
  CDS (1)..(3186)
atgttttttgtttacagatcaaatcaaattgatattttatttactaaaatatgtaaaataataaaaaaaaaaccacttcttaatatttttgaaagagaaattattattcatgacaatgaaatattatttcaaaatttaaatacatttattgctaatcatacaggaattgctgcagattttaaattaatttaccctaacgtttttatatggaaattatttaaacaagttttttctgatattcaattaaataatattttttcaagatctactataacttggaaaattatgaaaattatagaagaaaatgatttttgtaaatttgttcaaaaaaaagataaaataatgaaaaaatttgaattttcatttttaatgtctcatttatatcaacaatatattctataccgaccaaattggattaatatgtgggaaaagaataaaaaaaatacattaaaaattgaaaaaaaagatgaatggcaagcaaaactatggattaaaattatactttataccgaaaaacttcaacaatcaaaatggcatttttcaaatttatttaaaaaatttaaaacattaaaaaaaatagaacatataaaatttccaaaacgtatttttattatttattctataagtttaaatccaaaatatatggaaatttttaaaaaaataagcacatatacagatatatattttttatctattaacgcttgtgaaaaaaaaatttttcatattagttttgctaaaaactatgttgttcaaaaaaataatttattaatgaatttatccgaaaaatatgaaaaattttattttttattttttaaaaagtttaaaaaaataaaatataataatttttttcaaaaaaacaatagtaacaatttacttaacattgttaaaaatgactttttaaattttaaagaaaaagaaaatttattaaaaaaaaactcttttttactcaaagataattcaatatcaataaacatttgctgtgataaaaaacatgaaattgaagttttatataataaattattgagtttttttaacgaagactcgaaactcaaacctagtgatattgttattacttcattttcattaaatacttatataatttacattaattcaatatttaaatctaaaaataaaaaagaaaaaatacctttttatatatctaaaaaacattctgataaaatagaaaaaatactatttatttttaataaaatactaaatttaccaaatatccgttgtaataatgaagaaatattagatttaattgaaattcaagatataagagataaatttgatatttcagaagaagaaataaatattttatacgaatggattgaaaaagcaaatataagatggggtcttcacgaaaatgaaaaacaaaaaaataatttaatttttataaaaaaaaatcaaaatacctggttttacggtattaaaaaattactaataagtcatgcaataaatgaagaagaagaagtttggaataatgttttatcatgtacctctattaacacttcaagaacagaattaataggaaaactaataaattttattaaagttcttgatcaatggagagataaattatttttttcaaaaaaaattaaatcttggcgtccactttttctttgttttataaaagatttcttttataaaaatgaaaaaataagagatagcatcgatatcattaataaaacttggacaaaaatgatcgatgatgcaactttatctaattatgagaaaaaaattcctataagtattttaaagaaaaaattttcacatattatgaataatttcagtgaaaaaaaatttttaccaggtgtaataaatttttgtcatccatctttagtatgttatataccatttaaaataaaatgtattattggagcagaatatcaagaaattcctaaaaaaaaattaagttcttttaacttaatcgataaatatccattaactagcgatttgcacatttgtaaagaaaattatatatttcttcaaaattttatttctacccaagaaactttatatattagttatgttggacattctttaaaaaataataataaagttcgttcatcaatattaattgatcaactattgaatcatatcacatcaaatttttatgtttcagaacatcatgattataaaaataataaaaaagagatatttgaacatatttgtaaaaaacataaaaaagaaaatctttatgaaaaaaaacaagtcaataaaattaatttgaatacacttcaaaaaacaaaaaaaataaatcaagaaatatataataaaattttttctataaaaaatagaataatttctacttctactcaaataagcttaaaaagcttgatatctttttggaaaaatccaatacgttatttttttaattatacattaaatataaagttaaaaatagcaaaaagaaatattataacagaacctttttcaattaatctatttgatgattttaagatcagtaatataatctttaaaaaaatattaaacaatgaaagtataaaagatgaattcaaaaaaattattttatctggtattttaccatatggacattttggatcaattttactaaaagaaaaaaagaaagaaatagaaaatatagtaaaagcaatttataaatatcgaatatcatctcctaaaaaagaaaattttgatataaaaatagaaaaatataatattaatggatgtttagatgaaatacaaaatacaggtttacttagatggaaattaggtacaattaattatagagatagaatatccctttggttagaacacttaatttattgtattttaggaggtactggagaaagtaaaattataggttataaaaaaaattttttttctttttatcctttatcatctcacttagcatataattatcttttcacctatattgaaggatatatgaaaggaatgaaaaatcctttgttactaataaaatcaggatctaattggtttgataaagtctatgataaaaaaaatgattgtatcaaaaaaaacgatgatataaaaagaaaagcatataaaatactatatcatacatggatgggaaacgagtatataacaggagaaaaagaagacttatatatacaacaaattatttctgaactaaacgtaaaaaaaatttgtaaaatttctcaaaaatggtttactccgatactaaaacatcaaaaaaaataa

SEQ ID NO: 45558 - protein, 1061 aa, Buchnera aphidicola
MFFVYRSNQIDILFTKICKIIKKKPLLNIFEREIIIHDNEILFQNLNTFIANHTGIAADFKLIYPNVFIWKLFKQVFSDIQLNNIFSRSTITWKIMKIIEENDFCKFVQKKDKIMKKFEFSFLMSHLYQQYILYRPNWINMWEKNKKNTLKIEKKDEWQAKLWIKIILYTEKLQQSKWHFSNLFKKFKTLKKIEHIKFPKRIFIIYSISLNPKYMEIFKKISTYTDIYFLSINACEKKIFHISFAKNYVVQKNNLLMNLSEKYEKFYFLFFKKFKKIKYNNFFQKNNSNNLLNIVKNDFLNFKEKENLLKKNSFLLKDNSISINICCDKKHEIEVLYNKLLSFFNEDSKLKPSDIVITSFSLNTYIIYINSIFKSKNKKEKIPFYISKKHSDKIEKILFIFNKILNLPNIRCNNEEILDLIEIQDIRDKFDISEEEINILYEWIEKANIRWGLHENEKQKNNLIFIKKNQNTWFYGIKKLLISHAINEEEEVWNNVLSCTSINTSRTELIGKLINFIKVLDQWRDKLFFSKKIKSWRPLFLCFIKDFFYKNEKIRDSIDIINKTWTKMIDDATLSNYEKKIPISILKKKFSHIMNNFSEKKFLPGVINFCHPSLVCYIPFKIKCIIGAEYQEIPKKKLSSFNLIDKYPLTSDLHICKENYIFLQNFISTQETLYISYVGHSLKNNNKVRSSILIDQLLNHITSNFYVSEHHDYKNNKKEIFEHICKKHKKENLYEKKQVNKINLNTLQKTKKINQEIYNKIFSIKNRIISTSTQISLKSLISFWKNPIRYFFNYTLNIKLKIAKRNIITEPFSINLFDDFKISNIIFKKILNNESIKDEFKKIILSGILPYGHFGSILLKEKKKEIENIVKAIYKYRISSPKKENFDIKIEKYNINGCLDEIQNTGLLRWKLGTINYRDRISLWLEHLIYCILGGTGESKIIGYKKNFFSFYPLSSHLAYNYLFTYIEGYMKGMKNPLLLIKSGSNWFDKVYDKKNDCIKKNDDIKRKAYKILYHTWMGNEYITGEKEDLYIQQIISELNVKKICKISQKWFTPILKHQKK

SEQ ID NO: 45559 - DNA, 3336 bp, Buchnera aphidicola
  CDS (1)..(3336)
atgtttacattatataaatctcttaaatttaatctatttgttaaatcagctttcaaagtgatattaaatgaaccattactaaatccattaactaaagaaatattcattgtaaacaacaaagaaacagaacaatggatcaaaatatttatagccaaaaaatataaagtttgcactaacattaaattttttaaactcaaacattttattttaaatattttaaaacaaaatactcctaaattatattctaaatcagaatttagtaaatattcaataatgtggaaaataataaatataccagacatccaacatttacttactaaaattgtttctaaaaataatacctatagcacattatttaaaatagcatcttctatatcaaatttatttcaattatatttaaagtatcgaccagattatataaaaaaatgggaacaaaagtctaatatccctaaaactcgtttaaaacaaaaatggcagcaaataatctggatgcgcattattaaatatacaaaagatgcaaacaaacctattttacatttttcaaatttactatatgacagtataaaaaaaatgcaacgaaataactttattaatacaaaattacctgtcagaatctttatttttaatataacacctattaccccgcaatatgcaatttttttaaaatctataagtaaatattgttctgtgcattttttttatgcaacagcatcatataatgataaacaaatgttttccactagttttattaaattcaaacaaacacaagaaatttcaaataatcaattattatctttactacattctaaaaataaaaacattatttatcatgaaattgaaaattttcaaaaaaatactaaatttcaatcatactggataacatatgaatatgagcaaatgttatttttgtcattaataaaagacaaaacaattaatttaaactttaaaataaaacaaaattctctattacaatatcttcaaaataaaatattaaatttacatagcattcaaaaaaaaaataatgaacaagaaaataataaaatacttatactgaagacagataaatctctttcaatacattcttgccatactttaataagagaaattgaagttttgcataataatttacttaatattttaaatgataacaacgacattttattccaagatgtactagttattagcaaaaatctagatacatatattccttatataaatcaaatttttaattctgcttcatccaaaaattttattcccttttcaattaattacaagaatataaaaaacattgaattttataaaactatattagaattgatagatttacctaatattgaactaaatattaataaaattactaatttattgaatattccaactttattaaaaaaagtacaaataaacgaacaagaaatacctattttattacaaattataaatcaaactgaaatacaatgggaaaacgacaatatcttatcgaacgattggttgtctaacgacataacaaaatgttgggaacatggattacaaagaatttttttgggacaaattataaataatattgattataaattttgggaaaatattgtaccctataacgaatttagcacgctatattataacatttttaataaattaatatctttaatatcactactcaataaatggaaaaaaatattatctaaacctaaattcttatcacattgggatattacgtttaaaaaactattaaatgacttttttacagatcatgaacaaaaacaacccgaagctaaattaattataaaaaaatggacagaaataatacattccggaatgcaagaaaaatatactaaaaaaatttctataacattactaaagaacgaactatgcaattctgtttcatacatttctcaatcaaattatttattttctggaaaaataacattttgtaataactttactttaacaaatattccatttaagataatttatttaataggattaaacgataacataagttctaatacacatgaatcattcgacatatataatttacttaaattacacccaagagcatatgatccatgtgatgaaataaatcataaaaatctacttttaaaaacattattatcagcaaaaaaatttttctatataagtcatcaaattgtctctaacaattataaaaagttaaataacattcctattgcaatagacaaaattattaaatatattactcaatacttttatataaaaaataaaaacaaagacaatttcaatgataacttaaaagatataaaatctcacatatatcataattatactttttatgcccatgaaaaaagaaattttttagaaaaactaaattatcctaattttaatacaacaatatggaaaatggctactttaattaataattctcataaagaatttataaaaaaattaccatccattaaaaatcaaacgataaactataacacattaatcttattttggaaaaaccctattcaaacattttttcatgtacgtcttaatattcaattaaatacaacaaaaaataaacatatgcaccaaaacaaacattttataaacaaattagatcaatataaaatgaataaaacacttttaaaattttttttatataaacaaaatactaaccaattatttcaatattataaaaacataggaattattcctaataacaatattggaaacattatttgggaatatacaaaaaaattaataacaccattatacgaccaaattatgaaaataaaaaaaatattaaataattctaaattttgcataaatgttaaaaataaatgtatgttacacggacaattaaaaaatattaatagttcaggaggattattacgctggaaagcaacaaaacttagttttcaagatatcatatcgtgctggctagaacatttattatattgttcactatataaaaaacataacagtatattaataggaactaatcatcaaataattactttttataaattagaaaataaaacagctaaatactatttgaaaaaatacatatcgggctattttgatggaatggaacaaccaatattgctaactaaatctggaattaattggattaatgcaatttatgacaaaaaaaataacaagttttatactaatacaaataaaaacctaaatgcttataaaatatttctaaatacatggaacggaaataattggataactggtgaaaaagatgatccgtatatacaaaaaatgatagtttatttaactaaaaaaaatattcaaaaaatatataaaacaactaaaaaatggttaacaccaatactaaaaaatatttcttattcgaaataccattaa

SEQ ID NO: 45560 - protein, 1111 aa, Buchnera aphidicola
MFTLYKSLKFNLFVKSAFKVILNEPLLNPLTKEIFIVNNKETEQWIKIFIAKKYKVCTNIKFFKLKHFILNILKQNTPKLYSKSEFSKYSIMWKIINIPDIQHLLTKIVSKNNTYSTLFKIASSISNLFQLYLKYRPDYIKKWEQKSNIPKTRLKQKWQQIIWMRIIKYTKDANKPILHFSNLLYDSIKKMQRNNFINTKLPVRIFIFNITPITPQYAIFLKSISKYCSVHFFYATASYNDKQMFSTSFIKFKQTQEISNNQLLSLLHSKNKNIIYHEIENFQKNTKFQSYWITYEYEQMLFLSLIKDKTINLNFKIKQNSLLQYLQNKILNLHSIQKKNNEQENNKILILKTDKSLSIHSCHTLIREIEVLHNNLLNILNDNNDILFQDVLVISKNLDTYIPYINQIFNSASSKNFIPFSINYKNIKNIEFYKTILELIDLPNIELNINKITNLLNIPTLLKKVQINEQEIPILLQIINQTEIQWENDNILSNDWLSNDITKCWEHGLQRIFLGQIINNIDYKFWENIVPYNEFSTLYYNIFNKLISLISLLNKWKKILSKPKFLSHWDITFKKLLNDFFTDHEQKQPEAKLIIKKWTEIIHSGMQEKYTKKISITLLKNELCNSVSYISQSNYLFSGKITFCNNFTLTNIPFKIIYLIGLNDNISSNTHESFDIYNLLKLHPRAYDPCDEINHKNLLLKTLLSAKKFFYISHQIVSNNYKKLNNIPIAIDKIIKYITQYFYIKNKNKDNFNDNLKDIKSHIYHNYTFYAHEKRNFLEKLNYPNFNTTIWKMATLINNSHKEFIKKLPSIKNQTINYNTLILFWKNPIQTFFHVRLNIQLNTTKNKHMHQNKHFINKLDQYKMNKTLLKFFLYKQNTNQLFQYYKNIGIIPNNNIGNIIWEYTKKLITPLYDQIMKIKKILNNSKFCINVKNKCMLHGQLKNINSSGGLLRWKATKLSFQDIISCWLEHLLYCSLYKKHNSILIGTNHQIITFYKLENKTAKYYLKKYISGYFDGMEQPILLTKSGINWINAIYDKKNNKFYTNTNKNLNAYKIFLNTWNGNNWITGEKDDPYIQKMIVYLTKKNIQKIYKTTKKWLTPILKNISYSKYH

SEQ ID NO: 45561 - DNA, 25 bp, Primer
atgttaagggtctaccattccaatc

SEQ ID NO: 45562 - DNA, 26 bp, Primer
ttatgactgattaaagcgaaacagcg

SEQ ID NO: 45563 - protein, 1491 aa, consensus
  MISC_FEATURE (1)..(1491): consensus for the disclosure of xaa see table XV
PXXXXXXXVXXXXXXXWLXXXXAXXXXXXXXXXXXGXXAXXXXXXXXXXXXXXXXXXXXXXXXXXXXXXXXXXXXXXXXXXXXXXXXXXWXXXXXXXXXXXXXXXXXXXXXXXXXXXXXXXXXXXXXXXXXXXXXXXXXXXXXXXXXXXXXLXXXXAXXFXXYXXXRXXXXXXWXXXXXXXXXXXXXXXXXXXXXXXXXXXXXXXXXXWQXXLWXXLXXXXXXXXXXXXXXXXXXXXXXXXXXXXXXXXXXXXXXXXXXXXXXXXPXXXXXXXXXXXXXXXXXXXXXXXXXXXXXXXXXXPXXXXWXXXXXXXXXXXXXXXXXXXXXXXXXXXXXXXXXXXXXXXXXXXXXXXXXXXXXXXXXXXXXXXXXLLXXXGXXXXXXXXXXXXXXXXXXXXXXXXXXXXXXXXXXXXXXXXXXXXXXXXXXXXXXXXXXXXXXXXXXXLXXXQXXXXXXXXXXXXXXXXXXXXXXXXXXXXXXXXXXXXXXXXXXXXXXXXXXXXXXXXXXXXXXDXSXXXXXXHXXXRXXEXLXXXLLXXXXXXXXXXXXXXXXXXXXDXXVXXXXXXXYXPXIXXXFXXXXXXXXXXXXXXXXXXXXXXXXPXXXXXXXXXXXXXXXXXXXXXLXLXXXXXXXXXXXXXXXXLXXXXXXXXFXXXXXXXXXXXXWXXXXXXRXGXXXXXXXXXXXXXXXXXXXXXXXXXXXXXXXXXRXXLGXXXXXXXXXXXXXXXXXXXXXXXXXXXXXXXXXXXXXXXXXXXXXXXXXXXXLXXXXXXXXXXXXXXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXRXXPXXXXXXXGXXXXXXPXXXXXXXXXLXXXXXXXXXXXXXXXXGDRXXXXXXXXLXLXXXXXAXXXXXXXXXGXXXXXXXXXXXXXXXXXXLXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXPXXXXXXXXLXXXXXXXXXXXXXXXXXXXXXEXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXL

SEQ ID NO: 45564 - protein, 64 aa, consensus
  MISC_FEATURE (1)..(64): consensus for the disclosure of xaa see table XV
XXXXXXXXXXXXXXXXXXXXXXXXXXXXXXXXXXXXXXXXXXXXXXXXXXXXXXXXXXXXXXXX

SEQ ID NO: 45565 - protein, 105 aa, consensus
  MISC_FEATURE (1)..(105): consensus for the disclosure of xaa see table XV
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 45566 - DNA, 1014 bp, Escherichia coli
  CDS (1)..(1014)
atgcgtgtactgggtattgaaacttcctgcgatgaaaccggcatcgccatttacgacgatgaaaaaggtttgttagccaaccaattgtatagtcaggtgaaattgcacgctgactacggcggcgtcgtgcctgaactggcctcccgcgatcatgtgcgtaaaaccgtaccgttgatccaggcggcgctaaaggagtctggtttaacggcaaaagacattgatgctgtggcctataccgcaggccctggattagtcggcgcgctactggttggcgcgaccgtggggcgttctctggcgtttgcctgggacgttccggcgatccctgtacaccatatggaagggcatctgttagcgccgatgctggaagataacccgccggaatttccgtttgttgcgctgcttgtttccggcggtcatacgcagttaatcagcgtgactggcattggtcagtacgagctgctcggcgagtctatcgatgatgccgccggggaagcgtttgataaaaccgcgaagctgctggggctggattatcctggcgggccgttactgtcgaaaatggcggctcagggtactgccgggcgctttgtcttcccgcgtccgatgaccgaccgtccggggctggatttcagcttctccggcctgaaaaccttcgcggcaaataccattcgtgacaacggcaccgacgaccagacgcgtgctgatatcgcccgcgcctttgaagatgcggtggtcgatacgctgatgattaagtgcaagcgggcgctggatcagacgggctttaagcgactggtcatggcgggcggcgtgagtgctaaccgtacgttacgggcgaagctggctgaaatgatgaaaaaacgccgcggcgaagtgttctacgcgcgtccggaattttgtactgataacggcgcgatgatcgcctatgccggaatggtgcggtttaaagcaggcgcgacggcggatctcggcgttagcgtgcgtccgcgctggccgctggcggagttaccggctgcgtaa

SEQ ID NO: 45567 - protein, 337 aa, Escherichia coli
MRVLGIETSCDETGIAIYDDEKGLLANQLYSQVKLHADYGGVVPELASRDHVRKTVPLIQAALKESGLTAKDIDAVAYTAGPGLVGALLVGATVGRSLAFAWDVPAIPVHHMEGHLLAPMLEDNPPEFPFVALLVSGGHTQLISVTGIGQYELLGESIDDAAGEAFDKTAKLLGLDYPGGPLLSKMAAQGTAGRFVFPRPMTDRPGLDFSFSGLKTFAANTIRDNGTDDQTRADIARAFEDAVVDTLMIKCKRALDQTGFKRLVMAGGVSANRTLRAKLAEMMKKRRGEVFYARPEFCTDNGAMIAYAGMVRFKAGATADLGVSVRPRWPLAELPAA

SEQ ID NO: 45568 - DNA, 978 bp, Thermococcus kodakaraensis
  CDS (1)..(978)
atgatagcgctcggcatagagggaaccgcccacactcttggcataggcatagtgaccgaaaagagtgtcctcgccaacgtatttgacactctcacaacggaaaagggtggcatccacccaaaggaggccgccgagcaccacgcaaggctactgaagccgctcctcagaaaggcccttgaaaccgctggagtaacgatggaagacgttgacctaatagcattttcccaggggcctgggctggggcctgcactcagggtcgttgccacagcagcgagggcgctcgcgataaagtacaacaagcccatagtcggcgtgaaccactgcatagcccacgtcgagataacgaagatgttcggcgttaaagatccggtcggcctctacgtgagcggtgggaacacgcaggttttggcattagagggcggccgctaccgcgtctttggagagacgctggacatcggcatagggaacgcgatagataccttcgcgagggagctcggtataggctttcctgggggacctaagatagagaagctcgccctaaaaggggagaagtacattgaactgccctacgctgtcaagggcatggacctgagtttctcgggcgttcttactgaagccgtcaggaagtaccgtactggcaagtacaggattgaagacctcgcttactccttccaggaaacggccttcgcggccctcgtagaggtcacagagagggcagttgcccacactggcaaagaagaggttgtcctggtcgggggagttgcggcaaacaacaggctccgcgagatgctcaaaatcatggctgaggacagggggattaagttcttcgtaccgccctacgacctctgcagggacaacggggcgatgatagcctacacaggcctgagaatgtaccgcggaggggtaaggttcaagattgaagacaccgtagttaaacagaagttccgcaccgatgaggtggaagttgtatgggactga

SEQ ID NO: 45569 - protein, 325 aa, Thermococcus kodakaraensis
MIALGIEGTAHTLGIGIVTEKSVLANVFDTLTTEKGGIHPKEAAEHHARLLKPLLRKALETAGVTMEDVDLIAFSQGPGLGPALRVVATAARALAIKYNKPIVGVNHCIAHVEITKMFGVKDPVGLYVSGGNTQVLALEGGRYRVFGETLDIGIGNAIDTFARELGIGFPGGPKIEKLALKGEKYIELPYAVKGMDLSFSGVLTEAVRKYRTGKYRIEDLAYSFQETAFAALVEVTERAVAHTGKEEVVLVGGVAANNRLREMLKIMAEDRGIKFFVPPYDLCRDNGAMIAYTGLRMYRGGVRFKIEDTVVKQKFRTDEVEVVWD

SEQ ID NO: 45570 - DNA, 1026 bp, Staphylococcus aureus subsp. aureus COL
  CDS (1)..(1026)
atgactaaagatatattaatactagctgttgaaacaagttgtgatgaaacaagcgttagtgttataaaaaatggcagagatattttatcaaatacagttttaagtcagattgaaagtcataaacgatttggcggtgtcgttcccgaagtggcaagtagacatcacgttgaaggtataacagcaacaataaacgaggctctaggggatgccgatgtatcaatagaagatattgatgccatagcggttacagaaggccctggactaattggtgcgttactaataggtgttaatgcagccaaagcattggcatttgcttacgataagccacttattcctgttcatcatattgcaggacatatatatgctaatcacatagaagagccattaacattcccgctaattgcacttattgtttcaggtggacatactgaattagtttatatgaaggatcatttatcatttgaagtcattggtgaaacacgagatgacgcagtaggtgaggcttatgataaagtggcacgaacaattggtttaaattatccaggtggtccacaagttgatcggttggctgctgaaggtgaagatacttattcattccctcgtgtttggttggataaagatagttatgattttagttttagtgggttgaaaagtgccgtaatcaatcaacttcacaatcaacgacaaaaaaatattccaatcattgaagctaacgtagcaacgagctttcaaaacagtgttgtagaggtgctcacgtttaaagctattcaagcttgtaaagaatatggtgttcagcgattaattgttgctggtggcgtggcgagtaataaaggattacgtcaatctttagcggatcaatgcaaagtcaatgacattcaattaactatcccaagtcctaaattatgcacagataatgctgcaatgataggcgttgccggccactatttgtatcagcaaggtcgatttgctgatttagcattaaatgggcacagcaatatagatttagaagagtattctgcagaataa

SEQ ID NO: 45571 - protein, 341 aa, Staphylococcus aureus subsp. aureus COL
MTKDILILAVETSCDETSVSVIKNGRDILSNTVLSQIESHKRFGGVVPEVASRHHVEGITATINEALGDADVSIEDIDAIAVTEGPGLIGALLIGVNAAKALAFAYDKPLIPVHHIAGHIYANHIEEPLTFPLIALIVSGGHTELVYMKDHLSFEVIGETRDDAVGEAYDKVARTIGLNYPGGPQVDRLAAEGEDTYSFPRVWLDKDSYDFSFSGLKSAVINQLHNQRQKNIPIIEANVATSFQNSVVEVLTFKAIQACKEYGVQRLIVAGGVASNKGLRQSLADQCKVNDIQLTIPSPKLCTDNAAMIGVAGHYLYQQGRFADLALNGHSNIDLEEYSAE

SEQ ID NO: 45572 - DNA, 1167 bp, Gluconobacter oxydans 621H
  CDS (1)..(1167)
atgaacggcagctttagcccattcacacgggactgtcatgatatgacagactcggccataataagccccatgtcagcccccgccacttctccatccgcacccacgcgcccccttctggccatcgaaacctcctgcgacgacacggcctgcgccatcctcgcctgggacggcacgatcctggccgaaggcgtcctgtcccagaccgaccacgccattctcggcggcgtcgtcccggaaatcgcggcccgcgcccatctggacgccctgcccgcactggtggcggaagtcctgaaaaaagcctccctgacgctggccgacatcgacacttttgccggcacaaccggccccggcctgatcggcggcctgatcgtcggcagttcctacgccaagggactggccatggcgctgcaccgtcccttcgtggccgtaaaccacatcgaagcccacattctcaccccgcgccttcccagcctgggtgctgacctgcacttcccctacctgacgatgctggtctcgggcggccactgccagtgcgtctcggtcgaggaaaccggccgttatgtccgcctcggcggcacgatcgacgacgctgctggcgaggccttcgacaaggtcgccaaaatgctcggcctcagctggcccggcggccccgctctggaaaaactcgccaccgaaggccgcgacgacgcctatccgctgccccgccccctcaagggccgcgaaggctgcgatttctcattctctggcctcaaaactgccgtcagccgcctgatcgacacacaggacccgaccggcagccgcgacgccctgccgcgccagttcgccgcagacgtcgcagcctccttccagcgcgccgttgcggatgtgatggccgaccgcgccgaacacgccctggccctcagcccgaacgccacggccctggtcgtcgcaggcggggtggccgccaacaaaaccctgcgccacgccctcgaacaggtcgccgccaaccacggcatccccttcttcgccccgcccctgcgcctgtgcacggacaacgcggtcatggtcgcctgggccgcgctcgaacgcctccacgcgggcgaaacccccaacgaaatcgacaccgctgcccgcccccgctggcccctgtctgaacgcactcccgccaccccggaacacgtctcttga

SEQ ID NO: 45573 - protein, 388 aa, Gluconobacter oxydans 621H
MNGSFSPFTRDCHDMTDSAIISPMSAPATSPSAPTRPLLAIETSCDDTACAILAWDGTILAEGVLSQTDHAILGGVVPEIAARAHLDALPALVAEVLKKASLTLADIDTFAGTTGPGLIGGLIVGSSYAKGLAMALHRPFVAVNHIEAHILTPRLPSLGADLHFPYLTMLVSGGHCQCVSVEETGRYVRLGGTIDDAAGEAFDKVAKMLGLSWPGGPALEKLATEGRDDAYPLPRPLKGREGCDFSFSGLKTAVSRLIDTQDPTGSRDALPRQFAADVAASFQRAVADVMADRAEHALALSPNATALVVAGGVAANKTLRHALEQVAANHGIPFFAPPLRLCTDNAVMVAWAALERLHAGETPNEIDTAARPRWPLSERTPATPEHVS

SEQ ID NO: 45574 - DNA, 1215 bp, Danio rerio
  CDS (1)..(1215)
atgtttcagagttgtctgcctggagctctgcggtcctggagcagaagagtcttcagcacttcaacgagacccaggttagttttggggatcgagacgagctgcgatgagaccggggcggcggtgctggacgagaccgggaggattttgggtgaatctctgcattctcagaaagagacacacctgaaaacgggtggaattatcccattagtggcccaacgcctacacagagaaaacatctccagagtggtccaggaggctcttaacagaagtgctattgaacccagtgaactcacagctgtggcaacaacagtaaagcctggccttgccctcagtcttgggattggtttagattacagcctgaagtttgtgagacaacaccaaaagcccttcatccctatccatcatatggaggctcatgccctcaccgtgagaatgctgcatccattagacttccctttccttgtgctccttgtctcaggaggtcattcccttctagcgttggccaaaggaatcgatgagtttcttcttctgggacaaactctagatgaagcagccggggacacgttagataagattgccagaagactttctctcaggaatcaccctgaatgtgggactctgagtggtggacaagccatcgagcgactggcaaaagaaggagatcaacttgcctttcacttcatttcaccaatggggcagaactacgactgcaatttctcatttgctggtttgcgaacacagatcacaggggcaataaacaaaaaagagaaagaagaaggtgttgaagcaggacagtttttatcttgtgtaaaagacattgctgctgcctcacaacacacggtagcatctcacttggccaaacgaacacatcgagccattttgttctgcaaatccaaaggtcttctgccagagcagaatccgacactgattgtttcaggaggagtagccagtaatgaatacatcagacagattctgaaaatcatcacagatgccactgggctgcatttattgtgccctccgtcaaagttttgcactgataatggagtcatgattgcatggaatggcatagagagactaaagcagggaaagggaatcttgtcctattctgaagaagtcagctatgaacccaaggcaccacttggactagacatcacctcagaagttaaagaagctgccatcaaagttcctaaattaaaacttaggacaaactcttga

SEQ ID NO: 45575 - protein, 404 aa, Danio rerio
MFQSCLPGALRSWSRRVFSTSTRPRLVLGIETSCDETGAAVLDETGRILGESLHSQKETHLKTGGIIPLVAQRLHRENISRVVQEALNRSAIEPSELTAVATTVKPGLALSLGIGLDYSLKFVRQHQKPFIPIHHMEAHALTVRMLHPLDFPFLVLLVSGGHSLLALAKGIDEFLLLGQTLDEAAGDTLDKIARRLSLRNHPECGTLSGGQAIERLAKEGDQLAFHFISPMGQNYDCNFSFAGLRTQITGAINKKEKEEGVEAGQFLSCVKDIAAASQHTVASHLAKRTHRAILFCKSKGLLPEQNPTLIVSGGVASNEYIRQILKIITDATGLHLLCPPSKFCTDNGVMIAWNGIERLKQGKGILSYSEEVSYEPKAPLGLDITSEVKEAAIKVPKLKLRTNS

SEQ ID NO: 45576 - DNA, 1161 bp, Saccharomyces cerevisiae
  CDS (1)..(1161)
atggtcaacttgaacactatcccacccaaaaatggcagggactactacattgcgcttggacttgaaggttctgcaaataaactgggcgttggtatagttaagcatccgcttctgcctaaacatgccaacagcgatctatcttatgattgcgaagctgagatgctttctaatattagagacacatatgtcacacctcctggggagggatttttgcctcgagacacggcaaggcatcacagaaattggtgcataagactcataaaacaagcactggccgaagctgacatcaaaagcccgacactagacattgatgtaatttgctttaccaaaggtcccggcatgggggcccctctgcattcagttgtcatcgccgccagaacgtgctccttactgtgggacgtgccactggtgggagtaaaccactgcattggtcacatcgaaatggggagagaaatcactaaagctcaaaatcctgtggtactgtatgtaagtggtggaaatacacaagttattgcatactcggaaaaaaggtaccgtatctttggtgaaacgcttgatattgctatcggtaattgtcttgatagatttgcaagaactctgaagatacctaatgagccctcgcctggctacaacatcgagcagttagctaaaaaagcccctcacaaagaaaacttggtagaacttccctatacagtaaaggggatggatctttcgatgagtggtatattggcttccatcgatttacttgccaaggatctatttaagggcaataagaaaaataagatcctattcgacaagacaacgggcgagcaaaaagtcactgtagaggatctttgctactctctgcaagagaacctattcgccatgctagttgaaataacagaaagagctatggctcacgttaactccaatcaagttttgatcgtaggcggtgttggttgtaacgtgcgattacaagaaatgatggcgcaaatgtgtaaagacagggccaatgggcaagtacatgctacagataataggttttgtatcgataacggagttatgattgcccaagcaggactactagagtatagaatgggtgggatcgtgaaggacttttctgaaactgttgttacgcagaaattcagaaccgatgaagtatacgcagcctggcgtgattaa

SEQ ID NO: 45577 - protein, 386 aa, Saccharomyces cerevisiae
MVNLNTIPPKNGRDYYIALGLEGSANKLGVGIVKHPLLPKHANSDLSYDCEAEMLSNIRDTYVTPPGEGFLPRDTARHHRNWCIRLIKQALAEADIKSPTLDIDVICFTKGPGMGAPLHSVVIAARTCSLLWDVPLVGVNHCIGHIEMGREITKAQNPVVLYVSGGNTQVIAYSEKRYRIFGETLDIAIGNCLDRFARTLKIPNEPSPGYNIEQLAKKAPHKENLVELPYTVKGMDLSMSGILASIDLLAKDLFKGNKKNKILFDKTTGEQKVTVEDLCYSLQENLFAMLVEITERAMAHVNSNQVLIVGGVGCNVRLQEMMAQMCKDRANGQVHATDNRFCIDNGVMIAQAGLLEYRMGGIVKDFSETVVTQKFRTDEVYAAWRD

SEQ ID NO: 45578 - DNA, 972 bp, Archaeoglobus fulgidus DSM 4304
  CDS (1)..(972)
atgattgctctcggaatagagggcacggcctggagtttgagcataggtgttgttgatgaggagggcgttatagccctcgaaaatgacccctacatcccgaaagagggagggatacacccgagagaggcttcacagcatcacagcgaaaggctcccctccctgctttcaagagtttttgagaaagtcgataagaattccatcgacgtcgttgccttttctcagggccccggaatggggccttgtctcagagttgtggcgaccgcagccagacttctggccattaagctcgaaaaaccccttgtcggtgtaaaccactgcctcgcccacgttgaggtagggaggtggcaaactggtgcaagaaagccggtttctctctacgtgagcggcggaaacagtcaggtcattgcaaggagggggaacaggtacagagttttcggcgagacgctcgacataggtataggcaacgccttggacaaattggcgaggcacatgggactcaaacatcccggtgggcctaagatagaggagcttgcaaagaaggggcaaaaataccactttctgccatacgtggtaaaggggatggacttctccttcagcggtatggttactgcagcacagcgcctttttgattcaggagttagaatggaggacgttgcattcagcttccaggagactgccttcgcaatgctgacggaggtgacggaaagagccctcgcctatcttgatctgaacgaggtgctgcttgttggtggtgtagctgcaaacaaaaggctgcaggagatgctcagaattatgtgcgaggacaggggagcaaaattttatgtgccgccaaaagagctcgccggagacaacggggcgatgattgcctataccggcctgctgatgtacaagcacggtcaccagactcccgtagagaaatcctacgtcaggcccgatttcagaatagaggatgttgaggtaaattgggattaa

SEQ ID NO: 45579 - protein, 323 aa, Archaeoglobus fulgidus DSM 4304
MIALGIEGTAWSLSIGVVDEEGVIALENDPYIPKEGGIHPREASQHHSERLPSLLSRVFEKVDKNSIDVVAFSQGPGMGPCLRVVATAARLLAIKLEKPLVGVNHCLAHVEVGRWQTGARKPVSLYVSGGNSQVIARRGNRYRVFGETLDIGIGNALDKLARHMGLKHPGGPKIEELAKKGQKYHFLPYVVKGMDFSFSGMVTAAQRLFDSGVRMEDVAFSFQETAFAMLTEVTERALAYLDLNEVLLVGGVAANKRLQEMLRIMCEDRGAKFYVPPKELAGDNGAMIAYTGLLMYKHGHQTPVEKSYVRPDFRIEDVEVNWD

SEQ ID NO: 45580 - DNA, 963 bp, Ureaplasma parvum serovar 3 str. ATCC 700970
  CDS (1)..(963)
atgaatgataattatttaattttaagcattgaatcaagttgtgatgaaacaagtttagcgttatttgaaaataataaattaattgctcataaaattagtagttcagcatctatacaatcacttcatggcggtgttgttcctgaattagcaagtcgttatcatgaacaaaatattaatcacctatttaatgaaattttaaatgaaacaaaaatcaaccctttaactatcactcacgttgcttacactgcaatgcctggtttgccaggttgtttacatgtaggaaaagtttttgcgaaacaattagctgttttaattaatgctgaattagtgccaatcaatcatttacatgcgcatgtttttagtgcaagtattaatcaaaatttgacttttccatttttgggattagtggtttcaggaggggaaagttgtatatatttagtaaatgattatgatgaaatcaaagttttaaatcaaacacacgatgatgcaattggtgaatgttatgataaaattgctcgtgttcttggttgaaaatatccagggggtccaattattgataaaaattatcaagaaaatttagcaacattagaatttattaaatcacagcccgctgctaaagattttagttttagtgggttaaaaactgctgtaattaattacattcataatgctaaacaaaaaaagataagttttgaccctgttgttgttgcttcaagttttcaaaaatttgcaattaatgaaattataaagaaaattaaatattacttaaatttatacaaattaaatcatttagcaattgggggaggcgtatcagctaatagtttactccgtaaaaaaattcaatctttagatgttatatcatatattccagaaatgatttatacaggtgataatgctgctatgattggggcttatgcttatgctttaattaaaaatcataagaaatcaatattaataaaataa

SEQ ID NO: 45581 - protein, 320 aa, Ureaplasma parvum serovar 3 str. ATCC 700970
MNDNYLILSIESSCDETSLALFENNKLIAHKISSSASIQSLHGGVVPELASRYHEQNINHLFNEILNETKINPLTITHVAYTAMPGLPGCLHVGKVFAKQLAVLINAELVPINHLHAHVFSASINQNLTFPFLGLVVSGGESCIYLVNDYDEIKVLNQTHDDAIGECYDKIARVLGWKYPGGPIIDKNYQENLATLEFIKSQPAAKDFSFSGLKTAVINYIHNAKQKKISFDPVVVASSFQKFAINEIIKKIKYYLNLYKLNHLAIGGGVSANSLLRKKIQSLDVISYIPEMIYTGDNAAMIGAYAYALIKNHKKSILIK

SEQ ID NO: 45582 - DNA, 1245 bp, Mus musculus
  CDS (1)..(1245)
atgctaatgttaagaaggacagcaggagctattcccaagcccccaaagagtaaagtttatggatttttaagaagatttagtgttcatcccagaactctctcttgtcataaactggtcctgggaattgaaaccagctgtgatgacacaggagcggctgtggtggatgaaactgggaatgtgctgggggaagcactgcactcccaaactcaggttcatctgaaaacaggtgggattgttcctccagtagctcaacaacttcacagagaaaatattcaacgaatagtagaagaaactctttctgcctgtagaatcaccccaagcgatctctcagcaattgcaactaccatcaaaccgggactggccctaagcttgggagttggcttatcctttagcttacagctagtaaatcagtttaaaaagccattcatcccgattcatcacatggaggctcacgcactgactattaggctcaccaataaagtagaatttccttttttagttcttttgatttctggcggtcactgcctgttggcattagtccaaggtgtttccgatttcctgctccttgggaagtctttggacatagcaccaggcgacatgcttgacaaggtggcaagaagactttctttaatcaaacatccagaatgttctacaatgagtggtggaaaagctatagaacagttggccaaagacggaaatagattccattttactatcaatccacctatgcagaatgctaagaattgcgatttttctttcacgggacttcaacatattactgataagctaataacacacaaggaaaaagaagaaggcattgagaaggggcaaatcctgtcatcagctgcagacattgctgctgcggtacagcatgcaacagcgtgccaccttgcgaaaagaacacatcgcgctattctgttttgcaagcagaaaaatttgctctctccagctaacgcagtattagttgtatctggaggtgttgcaagtaacttgtacatccgaaaagcattggaaattgtcgcaaatgcaacgcagtgcacgttgttgtgtccacctccaagactgtgcactgacaatggcatcatgattgcatggaatggaattgaaagattacgtgctggcttgggcgttttacatgatgtagaagacatccgatatgaaccaaaatgtcctcttggagtagacatatccagagaagttgcagaagctgccataaaagtaccgcgattaaaaatggcactttga

SEQ ID NO: 45583 - protein, 414 aa, Mus musculus
MLMLRRTAGAIPKPPKSKVYGFLRRFSVHPRTLSCHKLVLGIETSCDDTGAAVVDETGNVLGEALHSQTQVHLKTGGIVPPVAQQLHRENIQRIVEETLSACRITPSDLSAIATTIKPGLALSLGVGLSFSLQLVNQFKKPFIPIHHMEAHALTIRLTNKVEFPFLVLLISGGHCLLALVQGVSDFLLLGKSLDIAPGDMLDKVARRLSLIKHPECSTMSGGKAIEQLAKDGNRFHFTINPPMQNAKNCDFSFTGLQHITDKLITHKEKEEGIEKGQILSSAADIAAAVQHATACHLAKRTHRAILFCKQKNLLSPANAVLVVSGGVASNLYIRKALEIVANATQCTLLCPPPRLCTDNGIMIAWNGIERLRAGLGVLHDVEDIRYEPKCPLGVDISREVAEAAIKVPRLKMAL

SEQ ID NO: 45584 - DNA, 1089 bp, Mesorhizobium loti MAFF303099
  CDS (1)..(1089)
ttgatccgcgttctgggcattgagacgagttgcgacgagaccgccgccagcgtcgtggcgctggagggcgatgccgcgccgaaaatcctgtccaacatcgtgctttctcagatcgaggaacatgccgccttcggcggtgtcgtgcccgagatcgccgcccgcgcccatgtcgaggcgctggacggcatcgtcgaggcggcgctggcggattcgggcacaacccttgccgatatcgatgcgatcgccgccaccgctggccccggcctggtcggcgggctgatcgtcgggctgatgacggccaaggcgatcgccgccgcggcaggcaagccgctgatcgccgtcaaccaccttgaaggccatgccttgacggcgcggctgaccgacgggctcgaatttccctatttgctgctgctggtctccggcggccacacgcagatcctggcggtgcgcggcgtcggcgactatcagcgctgggccaccaccatcgacgacgcgctcggcgaagccttcgacaagaccgccaagatgctcggcctgccctatcccggcggaccgaatgtcgagaaggcagcacagacgggcaatgcctcacgctttaccttccctcgcccgatgaaaggctcggcgcagcccgacttctccttctccggtttgaagaccgccgtgcgccaggcggcgaccgcgatcgagccgctgggcgaccaggacgtcgccgacatctgcgcctcgttccaggcggcggtcgccgatgcgctggccgaccgcgtttcgcgcgcgctggcgcgattcagccagacatttcccggcacgaaaaacccggctttggtcgttgccggcggcgtcgccgccaaccataccatcaaggcaacgctggaacggctctgcgccgaggccggtttcatcttcgtcgcgccgccgctcaaactgtgcaccgacaatgccgcgatgatcgcctgggccggcatcgaacggctgcgggaaggcatggcgcaggagaacggcttcgatttcgtgccgcgctcgcgctggccgctggacagcatctcggcgccgatggtcggttccggccggcgcggagccaaggcatga

SEQ ID NO: 45585 - protein, 362 aa, Mesorhizobium loti MAFF303099
MIRVLGIETSCDETAASVVALEGDAAPKILSNIVLSQIEEHAAFGGVVPEIAARAHVEALDGIVEAALADSGTTLADIDAIAATAGPGLVGGLIVGLMTAKAIAAAAGKPLIAVNHLEGHALTARLTDGLEFPYLLLLVSGGHTQILAVRGVGDYQRWATTIDDALGEAFDKTAKMLGLPYPGGPNVEKAAQTGNASRFTFPRPMKGSAQPDFSFSGLKTAVRQAATAIEPLGDQDVADICASFQAAVADALADRVSRALARFSQTFPGTKNPALVVAGGVAANHTIKATLERLCAEAGFIFVAPPLKLCTDNAAMIAWAGIERLREGMAQENGFDFVPRSRWPLDSISAPMVGSGRRGAKA

SEQ ID NO: 45586 - DNA, 1584 bp, Thermoplasma volcanium GSS1
  CDS (1)..(1584)
gtgatagttcttggacttgaaggtacagcacacacgataagctgtgggatactggatgaaaatagcataatggctaacgtctcatccatgtacaagccaaaaactggcggcatccatccaactcaggctgcagctcaccatgtagataaggtctctgaagtaatagctaaggctatcgagattgcaggaataaaaccctcagatatcgatcttgtggcgttctctatgggaccagggcttggcccatcgctgagggtaacgagcactgcagcaaggactctcgcggtcaccctaaaaagacccataattggtgtgaaccatccgcttggccacatagagatcgggaagaggttaagcggtgcacaagatccagttatgctatacgtatctggcggaaatacgcaagtgattgcacatcttaacggaagataccgtgtacttggcgagactctcgatatcggaataggaaatatgatcgacaaatttgccaggtatgcgggcattccctttccaggaggccctgaaattgagaagcttgcaaaggacggtcgcaagcttcttactctaccctactccgtcaaaggcatggatacttcgttttccggcatcctaacctcagcgctcgaatatcttaaaaagggagaaccagtggaagatataagcttcagcattcaggaaacagctttttcaatgttagttgaggtgcttgaaagggcactttatgtttcaggcaaagacgaggtacttatggctggcggtgttgccctcaataacaggttaagggagatggtttctgaaatggggcgcgaggtggatgccactacgtacatgactgataagaactactgcatggacaacggagctatgatagctcaggccggactcttgatgtataaatctggtataaggatgaatatagaggatacaagcataaacccaaggtatagaatcgacgaagttgatgcaccttgggtaattgaaaaaaatgtaaaatacagggatgccggtgctgaatcaaggatcgttaatacagatttctatgggcgtagcgctgttaagaagatccgcatagcaaagggatacaggcttaaggaattagacgagaggatcaggggcgaacgtatgaaaaacgagtttacggtgatcagaaggatgagggatgctggaatatgcgtgccaattgtatatgattatgatccatttgaaaaaacacttaccttgagccaaattcaaggggaattacttagggatgtcatacgtgcgaggccgaacgttatgggcaacgtaggacatgatgttgcagttatgcacaaaaataaaatttcacacggagaccttacagtgaacaatataatcgtatctgacaggatatgctttatcgatgcgagtatgggaaaggtaaacgcagaactagaagaccttgcagtcgatgtgtatactcttgaggattcaataaatagcctgagtgaaaatggaaaaacactcatgaaggaatttaaaatgtcgtatagagcaaattttccacaagcaaatgatgtactgaacatagttgaagacataagaaggaggcataggtatgtttaa

SEQ ID NO: 45587 - protein, 527 aa, Thermoplasma volcanium GSS1
MIVLGLEGTAHTISCGILDENSIMANVSSMYKPKTGGIHPTQAAAHHVDKVSEVIAKAIEIAGIKPSDIDLVAFSMGPGLGPSLRVTSTAARTLAVTLKRPIIGVNHPLGHIEIGKRLSGAQDPVMLYVSGGNTQVIAHLNGRYRVLGETLDIGIGNMIDKFARYAGIPFPGGPEIEKLAKDGRKLLTLPYSVKGMDTSFSGILTSALEYLKKGEPVEDISFSIQETAFSMLVEVLERALYVSGKDEVLMAGGVALNNRLREMVSEMGREVDATTYMTDKNYCMDNGAMIAQAGLLMYKSGIRMNIEDTSINPRYRIDEVDAPWVIEKNVKYRDAGAESRIVNTDFYGRSAVKKIRIAKGYRLKELDERIRGERMKNEFTVIRRMRDAGICVPIVYDYDPFEKTLTLSQIQGELLRDVIRARPNVMGNVGHDVAVMHKNKISHGDLTVNNIIVSDRICFIDASMGKVNAELEDLAVDVYTLEDSINSLSENGKTLMKEFKMSYRANFPQANDVLNIVEDIRRRHRYV

SEQ ID NO: 45588 - DNA, 1050 bp, Aeropyrum pernix K1
  CDS (1)..(1050)
atgccgcctaagagggatggggaggtcctcgtcctgggtatagagtctacagcccacaccttcggcgtggggatagtctcgaccaggccccctatcgtcagggcggatgtgaggaggaggtggactcctagggaggggggcatactcccccgggaggtggctgagttcttcagcctccacgccggcgaggcggtggcggaggctctgggtgaggccggggtctccattgctgacgtggatgctgtggccgttgctctggggcctggtatggggcctgccctcagggtgggggctaccgtggcgagggcgctgtcggccaagtacgggaagcccctggtccccgtgaaccatgctgtggcccacgttgaggcggcgaggttcacaacggggctccgggaccctgtggccctctatgttgcggggggtaacacgaccgtggtctcctttgtcgccgggaggtacaggacgttcggcgagaccctggacatagcgctgggcaacctcctggacacgttcgccagggaggcggggatagcgcccccctacgtcgccgggggcctccacgctgtggacaggtgcgccgaggggggcgggttcgtggagggcataccctacgtggttaaggggcaggacgtatccttcagcggaatactcacggcggcactaaggctcctgaagaggggggcgaggctgagtgacgtgtgctacaccctgagggaggtggcgttctcgagcgtggtggaggttacagagaggtgcctcgcccacacgggcaagaggcaggccaccctgacggggggagttgcggctaacagggtgctcaacgagaagatgagcctgatggcggggctccacggcgccgtctacagaccggtggacgtgaggctcagcggcgacaacggagtcatgatagccctcaccggcctcgccgcctacctccacggcgtcatcatagacccgggggaggcgtatataaggcagaggtggaggatagacgaggtggacataccatggtatccctggctccctggggacccgccgcccggctag

SEQ ID NO: 45589 - protein, 349 aa, Aeropyrum pernix K1
MPPKRDGEVLVLGIESTAHTFGVGIVSTRPPIVRADVRRRWTPREGGILPREVAEFFSLHAGEAVAEALGEAGVSIADVDAVAVALGPGMGPALRVGATVARALSAKYGKPLVPVNHAVAHVEAARFTTGLRDPVALYVAGGNTTVVSFVAGRYRTFGETLDIALGNLLDTFAREAGIAPPYVAGGLHAVDRCAEGGGFVEGIPYVVKGQDVSFSGILTAALRLLKRGARLSDVCYTLREVAFSSVVEVTERCLAHTGKRQATLTGGVAANRVLNEKMSLMAGLHGAVYRPVDVRLSGDNGVMIALTGLAAYLHGVIIDPGEAYIRQRWRIDEVDIPWYPWLPGDPPPG

SEQ ID NO: 45590 - DNA, 1062 bp, Arabidopsis thaliana
  CDS (1)..(1062)
atgaagaagaagatgatagccattggtttcgaaggatcagctaacaagattggagttggaattgtgactttagacggtactatcttagcaaatcctcggcatacgtatataacaccacctggtcatggttttcttcctagagagactgcacatcaccatcttgaccatgttcttcctttagtcaaatcagctttagagacttctcaagttactcctgaagaaatcgactgtatttgttatacgaaaggtcccgggatgggagcgccgttgcaggtttcagccattgttgttagagtattgtcacagctttggaaaaagccaattgttgctgtgaatcattgtgtggctcacattgagatggggagagtagttactggagctgatgatcctgttgtgttgtatgtgagtggtggtaacactcaggtgattgcttatagtgaaggtaggtaccggatttttggtgagactattgatattgctgttggtaattgtttggatcggtttgctagagtcttgaagctttctaatgatccaagccctggttataacattgaacagcttgctaagaaaggagaaaactttattgatcttccgtatgctgttaaaggtatggatgtatcgttcagcggaatcttgagttatatcgaaactactgcagaggagaagctcaagaataacgagtgtacaccagcagacttgtgttattcccttcaagagacggtgtttgcgatgttggttgagatcacagaaagagcgatggcgcattgtgacaagaaagacgttttgatagttggcggtgttgggtgtaacgagcgtttgcaggaaatgatgaggactatgtgctcagaacgtgatggtaagctgtttgcaacagatgaccgttactgcatcgataatggagctatgatcgcttacacaggtctactcgcgtttgttaatggtattgaaacaccgatcgaagactctacctttacacaacgatttcgcacagacgaggttcatgcggtgtggcgagagaaagaagctgtactacttggggataagaaagttgcagcgaattga

SEQ ID NO: 45591 - protein, 353 aa, Arabidopsis thaliana
MKKKMIAIGFEGSANKIGVGIVTLDGTILANPRHTYITPPGHGFLPRETAHHHLDHVLPLVKSALETSQVTPEEIDCICYTKGPGMGAPLQVSAIVVRVLSQLWKKPIVAVNHCVAHIEMGRVVTGADDPVVLYVSGGNTQVIAYSEGRYRIFGETIDIAVGNCLDRFARVLKLSNDPSPGYNIEQLAKKGENFIDLPYAVKGMDVSFSGILSYIETTAEEKLKNNECTPADLCYSLQETVFAMLVEITERAMAHCDKKDVLIVGGVGCNERLQEMMRTMCSERDGKLFATDDRYCIDNGAMIAYTGLLAFVNGIETPIEDSTFTQRFRTDEVHAVWREKEAVLLGDKKVAAN

SEQ ID NO: 45592 - DNA, 984 bp, Thermotoga maritima MSB8
  CDS (1)..(984)
atgagagttcttggaatagaaacgtcctgcgatgaaacggcggtcgctgttctggacgatggtaaaaacgttgttgtgaatttcacagtttctcagatagaggtccaccagaagtttggaggggtggtgcctgaagtggcggccaggcaccacctcaaaaatttacccattcttttgaagaaagcttttgaaaaagtcccaccggagacagtggatgtcgttgcggccacctatggacctggcctaatcggtgccctcctcgttggtctgtccgcagcaaaaggactcgccatttcgcttgaaaaacccttcgttggagtgaatcacgtagaggctcatgtgcaggcggtttttttggcaaaccctgatctgaaaccacccctcgttgttttgatggtttcaggtgggcacacacagctgatgaaagtggatgaggactattccatggaagtgctgggtgaaacgctcgatgattcggcgggggaggcattcgataaggtggctcgcctcctcggactcggatatcctggaggtcctgtgatcgacagagtggcaaagaaaggagatcctgaaaagtacagcttccctcgtccgatgctggatgatgacagttacaacttcagctttgcgggtttgaagacttctgtcctctatttcctccagagggaaaaaggctacaaggtagaagacgttgcggcttctttccagaaggcggtcgttgatattctcgttgaaaaaaccttccgactggcgagaaatcttggaatcagaaaaatagcgttcgtcggaggtgttgccgcgaattctatgttgagagaagaggtacggaaaagggcggaaagatggaattacgaggttttctttccaccgttggaactctgcacggacaacgctctgatggtcgcaaaggcgggctacgaaaaagcgaaaagggggatgttctcccccttgagtttgaacgccgatcccaacttgaatgtttag

SEQ ID NO: 45593 - protein, 327 aa, Thermotoga maritima MSB8
MRVLGIETSCDETAVAVLDDGKNVVVNFTVSQIEVHQKFGGVVPEVAARHHLKNLPILLKKAFEKVPPETVDVVAATYGPGLIGALLVGLSAAKGLAISLEKPFVGVNHVEAHVQAVFLANPDLKPPLVVLMVSGGHTQLMKVDEDYSMEVLGETLDDSAGEAFDKVARLLGLGYPGGPVIDRVAKKGDPEKYSFPRPMLDDDSYNFSFAGLKTSVLYFLQREKGYKVEDVAASFQKAVVDILVEKTFRLARNLGIRKIAFVGGVAANSMLREEVRKRAERWNYEVFFPPLELCTDNALMVAKAGYEKAKRGMFSPLSLNADPNLNV

SEQ ID NO: 45594 - DNA, 1032 bp, Bacillus halodurans C-125
  CDS (1)..(1032)
gtgggtgatgttgtcatgaatgaacgagaattaattttagcgattgaaacgagttgtgatgaaacatcggcagctgtgattgaaaatggaaccaccattttaagtaatgttgtttcgtcgcaaattgatagccataaaaggtttggcggtgttgtccctgagatcgcctcccgccatcatgtggaacaaattacagtcattgtggaggaggcgatgcatgaggcgggagtggactttgctgacctagcagcggttgctgttaccgaagggcctggacttgttggagctttgctcattggtgtcaatgcggccaaagcgatcgcctttgcccatcaactccctcttatcggagtccatcacattgctgggcatatttatgctaatcgcctgctaaaggagctagagttccctctactagcccttgtcgtttctggcggccataccgaattgatctatatggagaatcacggggagtttgaagtgattggtgaaactcgtgacgatgcagtaggggaagcgtatgataaagtggcccgaacattaggtcttccgtatccaggtggcccgcatatcgaccgactagcggtaaacggggaggatacgctccaatttcctcgggcgtggctggagcctgactcgttcgactttagcttcagtggcttaaagtcagccgtgattaatacgctccacaatgcaaagcagcgaggagaaaacgttcaggcagaggatgtagcggccagctttcaagccagtgtgattgatgtactagtgacaaaaacgaaaaaagcagcagaagagtataaggtcagacaggtgctccttgcgggtggagttgctgccaacaaaggattacgtactgctctagaggaagcattttttaaagagccaatcgatttagtgattcctcctctttcactttgtacagacaacgccgccatgattggtgcagcagcaagtataaaattcaagcaacagacgtttgctggtatggatttaaacggccagccaagtttagagctagagaacgattaa

SEQ ID NO: 45595 - protein, 343 aa, Bacillus halodurans C-125
MGDVVMNERELILAIETSCDETSAAVIENGTTILSNVVSSQIDSHKRFGGVVPEIASRHHVEQITVIVEEAMHEAGVDFADLAAVAVTEGPGLVGALLIGVNAAKAIAFAHQLPLIGVHHIAGHIYANRLLKELEFPLLALVVSGGHTELIYMENHGEFEVIGETRDDAVGEAYDKVARTLGLPYPGGPHIDRLAVNGEDTLQFPRAWLEPDSFDFSFSGLKSAVINTLHNAKQRGENVQAEDVAASFQASVIDVLVTKTKKAAEEYKVRQVLLAGGVAANKGLRTALEEAFFKEPIDLVIPPLSLCTDNAAMIGAAASIKFKQQTFAGMDLNGQPSLELEND

SEQ ID NO: 45596 - DNA, 1032 bp, Pasteurella multocida subsp. multocida str. Pm70
  CDS (1)..(1032)
atgcgcgtgttaggcattgaaacctcctgtgatgaaacaggggtcgcgatttatgatgaagaaaaaggtttagtggcaaaccagttatacacacaaattgctttacatgctgattacggcggggtcgtgcccgaattagcatcgcgcgatcatattcgaaaaaccgctcctttgatccaagcggcgttagcacaagctaatttaacgcccgacgagatcgatgggatcgcgtatacctctggtccaggcttagtcggtgcattattagtgggatccactattgcacgctctttagcttatgcttggaatgtgccagctattggtgtacaccatatggaagggcatttgctagcaccaatgttggaagataatccaccgacattcccttttgttgcgttattagtctcagggggacacacgcaattagtccgtgtcgatggcgtaggacgttatcagttactgggtgaatcaattgatgatgcggcaggcgaagcctttgataaaacagcgaaattattaggcttagattatccgggtggtgccgcgttggcgcgtttggcggaaaaaggtgatcctaaacgttttaagtttccacgtccgatgacggatcgtccaggtttggattttagtttctccggtttaaaaacctttgctgccaatacactgcagcaagcgataaaagaagaaggggaattaaccgaacaaaccaaagcagatattgcctatgctttccaacaagctgtggttgaaactttagtgattaaatgccgccgtgcgttaaaagaaacgggatttaaccgcctcgtgattgcggggggcgtaagtgcaaataagcaacttcgtcaggatttagcacaattaatgcagcagttaaaaggggaagtattttatccacaaccacaattttgtaccgataatggagccatgattgcctatactggttttttacgtttaaaacaaggggagtcacaaccgcttgcgattcaggtaaagccgcgttgggcgatgactgagctttctgcgattgattaa

SEQ ID NO: 45597 - protein, 343 aa, Pasteurella multocida subsp. multocida str. Pm70
MRVLGIETSCDETGVAIYDEEKGLVANQLYTQIALHADYGGVVPELASRDHIRKTAPLIQAALAQANLTPDEIDGIAYTSGPGLVGALLVGSTIARSLAYAWNVPAIGVHHMEGHLLAPMLEDNPPTFPFVALLVSGGHTQLVRVDGVGRYQLLGESIDDAAGEAFDKTAKLLGLDYPGGAALARLAEKGDPKRFKFPRPMTDRPGLDFSFSGLKTFAANTLQQAIKEEGELTEQTKADIAYAFQQAVVETLVIKCRRALKETGFNRLVIAGGVSANKQLRQDLAQLMQQLKGEVFYPQPQFCTDNGAMIAYTGFLRLKQGESQPLAIQVKPRWAMTELSAID

SEQ ID NO: 45598 - DNA, 1452 bp, Halobacterium salinarum NRC-1
  CDS (1)..(1452)
atgcgggaggcgatccccgcagtcatcgagacggtgctcggggcggccgacggcgacatcgacgcggtcgcgttctcccgcgggccgggcctggggccgtgtctgcgcatcgtcggatcggcggcgcgcgcgctcgcccaggctctcgacgtacccctcgtgggcgtcaaccacatggttgcgcacctcgaaatcggccgccaccagtctgggttccagcagcccgtctgcctgaacgcaagcggcgcgaacgcccacgtgttggcgtaccgcaacggccggtatcgcgtgctcggggagacgatggacaccggcgtcgggaacgccatcgacaagttcacgcgccacgtcggctggcagcaccccggcgggccgaaagtcgaaacgcacgcccgggacggcgagtacaccgcgttgccctacgtggtgaagggcatggacttctcgttttccgggatcatgagcgccgccaaagacgccgtcgacgacggcgtgccggtggccgacgtctgccgggggttggaggagaccatgttcgcgatgctgaccgaggtcgcggagcgcgcgctcgcgctcaccggccgggacgaactcgtgttgggcggcggcgtcggccagaacgaccggctgcgggggatgctcgaagcgatgtgtgcggcccgcggggcgtcgtttcacgcgcccgagccgcggttcctgcgggacaacgcgggcatgatcgcggtgctcggcgcgaagatggcggccgccggggcgacgatccccgtggccgactccgcgatcaactcccagttccgccccgacgaggtgtcggtgacgtggcgcgaccccgagtcgccggcacgcgacccgggggccgacgccgtgcgccagggcgccgaagccaccgtcacgttcgccgacgacgccgtgatcaaggagcgcgcgccgaaggcctaccgtcacgaccgcctcgacgaccgcctgcgccgagaccgcaccgtcctggaggccagactgaccagcgacgcccgccggcagggcgttccgacgccgctcgtccgcgacgtcgacgtgccggcggcgacgatcacgctccagcacgtcggggacgccgacctccgggacgcgctctcgcccgcccgcgttcgcgccgtcggccggcatctcgcgaccatccacgacggcgggttcgtgcacggcgacccgaccacgcgcaacgtgcgcgtcggcgccgagcgcacgttcctcatcgacttcgggctggggtattacaccgacgccgtcgaggactacgccatggactgccacgtcttcgagcagagcctcgtcggcaccgccgccgacgccgacgctctcgttgcggccttcgaggacgcctacgaggaggccgccgccagcgggcgcgtgctcgaccagctgcgcgccgtcgagggccgggggcgttaccaggacgaccccgagacggcgtag

SEQ ID NO: 45599 - protein, 483 aa, Halobacterium salinarum NRC-1
MREAIPAVIETVLGAADGDIDAVAFSRGPGLGPCLRIVGSAARALAQALDVPLVGVNHMVAHLEIGRHQSGFQQPVCLNASGANAHVLAYRNGRYRVLGETMDTGVGNAIDKFTRHVGWQHPGGPKVETHARDGEYTALPYVVKGMDFSFSGIMSAAKDAVDDGVPVADVCRGLEETMFAMLTEVAERALALTGRDELVLGGGVGQNDRLRGMLEAMCAARGASFHAPEPRFLRDNAGMIAVLGAKMAAAGATIPVADSAINSQFRPDEVSVTWRDPESPARDPGADAVRQGAEATVTFADDAVIKERAPKAYRHDRLDDRLRRDRTVLEARLTSDARRQGVPTPLVRDVDVPAATITLQHVGDADLRDALSPARVRAVGRHLATIHDGGFVHGDPTTRNVRVGAERTFLIDFGLGYYTDAVEDYAMDCHVFEQSLVGTAADADALVAAFEDAYEEAAASGRVLDQLRAVEGRGRYQDDPETA

SEQ ID NO: 45600 - DNA, 1008 bp, Campylobacter jejuni subsp. jejuni NCTC 11168
  CDS (1)..(1008)
atgaaaaatcttatcctagctatagaaagttcttgtgatgatagttctatagctatcattgataaaaacaccttagaatgtaaatttcataaaaaaatttcccaagaattagatcatagtatctatgggggagtggtacctgaacttgctgcaagacttcatagcgaggctttaccaaagatgcttaagcaatgcaaagagcattttaaaaatctttgtgccatagctgtgacaaatgaacctggacttagtgtttctttgctcagtggaatttctatggcaaaaaccttagcaagtgcgctaaatttacccttaatccctataaatcatcttaaaggtcatatttatagtctttttttggaagaaaaaatttctttagatatgggaattttgcttgttagtggtgggcataccatggtgctttatcttaaagatgatgcaagcttagagcttttagcaagtacaaatgatgatagctttggagaaagttttgataaagtggctaaaatgatgaatttaggttaccctggtggggtcatcatagaaaatttagcaaaaaatgccaaacttaaaaatatctcttttaacacacctttaaagcattctaaagaactcgctttcagtttttcagggcttaaaaatgcagtgcgtttggaaattttaaaacatgaaaatttaaatgaagacacaaaagcagaaatagcctatgcctttgaaaatacagcttgtgatcatatcatggataaattagaaaaaatttttaatctttataaatttaaaaattttggcgttgtaggtggagctagtgcaaatcttaacttgcgttcgcgtttgcaaaatttatgtcaaaaatataatgcaaatttaaaactagctcctttaaaattctgctctgataatgctttgatgatagcaagagccgcagttgatgcttatgaaaaaaaggaatttgtaagtgtagaagaagatattttaagccctaaaaataaaaatttttcaaggatatag

SEQ ID NO: 45601 - protein, 335 aa, Campylobacter jejuni subsp. jejuni NCTC 11168
MKNLILAIESSCDDSSIAIIDKNTLECKFHKKISQELDHSIYGGVVPELAARLHSEALPKMLKQCKEHFKNLCAIAVTNEPGLSVSLLSGISMAKTLASALNLPLIPINHLKGHIYSLFLEEKISLDMGILLVSGGHTMVLYLKDDASLELLASTNDDSFGESFDKVAKMMNLGYPGGVIIENLAKNAKLKNISFNTPLKHSKELAFSFSGLKNAVRLEILKHENLNEDTKAEIAYAFENTACDHIMDKLEKIFNLYKFKNFGVVGGASANLNLRSRLQNLCQKYNANLKLAPLKFCSDNALMIARAAVDAYEKKEFVSVEEDILSPKNKNFSRI

SEQ ID NO: 45602 - DNA, 1065 bp, Neisseria meningitidis Z2491
  CDS (1)..(1065)
atgttggtattaggaatcgagtcttcttgcgacgaaaccggtgttgcgctttacgatacggaacgtggattgcgggcgcactgcctgcacactcaaatggcaatgcacgccgaatacggcggggttgtgccggaattggcaagccgcgaccatatccgccgccttgttccgttgactgaaggctgtttggcgcaggcgggcgcatcgtatggcgacattgacgcggttgcctttacgcaggggcccggtttgggcggtgcgctgctggcgggttcgagctacgccaacgcgctggctttagcgttggacaagcctgttattcccgtccatcatttggaaggacatctgctgtcgccgctgttggcggaggaaaaacccgactttccttttgtcgcgctgctggtttcgggcgggcatacgcagattatggcggtcaggggcataggcgactacgcgcttttgggcgagagcgtcgatgatgcggcgggcgaggcattcgacaaaacggcgaaactgctgggcttgccgtatccgggcggtgcgaaactgtcggaacttgcggaatcgggcaggcccgaagcgtttgtttttccgcgcccgatgattcattccgacgatttgcagatgagtttttcaggtttgaaaaccgccgtattgaccgccgttgagaaagtgcgcgcggaaaacggggcggatgacattcctgagcagacacgcaacgacatctgccgtgcgtttcaagatgcggtggtcgatgtgttggcggcgaaagtgaaaaaagccctgttgcagacagggttcagaaccgtagtggttgccggcggggtcggtgcaaaccgcaaactccgcgaaactttcggcaacatgacggtgcaaatcccgacccccaaaggcaagccgaaacatccgtccgaaaaagtcagcgtgtttttcccgccgacggcatattgcacggacaacggtgccatgattgcctttgccggtgcgatgcacctgggcaagggcagggaggtcggtgcgttcaatgtccgtccgcgctggccgctgtcggaaatcgtcagatga

SEQ ID NO: 45603 - protein, 354 aa, Neisseria meningitidis Z2491
MLVLGIESSCDETGVALYDTERGLRAHCLHTQMAMHAEYGGVVPELASRDHIRRLVPLTEGCLAQAGASYGDIDAVAFTQGPGLGGALLAGSSYANALALALDKPVIPVHHLEGHLLSPLLAEEKPDFPFVALLVSGGHTQIMAVRGIGDYALLGESVDDAAGEAFDKTAKLLGLPYPGGAKLSELAESGRPEAFVFPRPMIHSDDLQMSFSGLKTAVLTAVEKVRAENGADDIPEQTRNDICRAFQDAVVDVLAAKVKKALLQTGFRTVVVAGGVGANRKLRETFGNMTVQIPTPKGKPKHPSEKVSVFFPPTAYCTDNGAMIAFAGAMHLGKGREVGAFNVRPRWPLSEIVR

SEQ ID NO: 45604 - DNA, 1038 bp, Deinococcus radiodurans R1
  CDS (1)..(1038)
atgacgcgttttatcctcggcatcgacacctcctgcgacgacaccggcgtcggcatcgtggaattgttgcccggcgctgggccaatgggcggcggggtgaaggtgcgggccaaccgcgtcctggtcgcagacgttcacgcgcagtacggcggcgtgatgcccgagctggcgagccgcgagcatgtggagcgcatcgacagcatcctcggcgacgcgctggccgaggcggggctggccctctccgacattgacgcggtggcggccaccgctggtcccggtctggtcggcgccctgctcgtcgggctgatgtacggcaaggggctcgcgcaggcgctcggggtgccgttttacgcggcgcatcaccttgagggccacatcttcgctgccgcctcggaggagcagttgcaagcaccttacctcgcgctggtcgtctcgggcgggcacacccacctcttcgatgtgccccacgagggcgactaccgactcgtcggcgccaccatggacgacgcagcgggcgaagcgttcgacaaggtggcgcgactgtgcggcctgggctaccccggcggcccggccatcagcgaggcggccaagaagggcgaccccaacgccgtgcccttcaaggaaccgctcaagggtcagaaagccttcgatttcagcttcagcggcctcaagacggcggcgctgctggcgcataaggccggcgcgaagcccgaagacctcgccgcgagtttcgagcgggccgccgtgcagtttctggtgaaaacgacggtgcgggccaccgagcatctgggccgccgcacggtggtcgtctcgggcggcgtagcagccaaccgcgccctgcgggacgctttcgcgcagacgggactacacgttgtctttcccggcaagggtctgaacaccgacaacggcgccatgattgcgctcgccggagccgccgccgtccgcgctgggcgggcaccgtcaccgctaagcgtaggtgccgaggcctacgcgccgctgacccagcaaagggcggatggagaaggcgagcgggcgtaa

SEQ ID NO: 45605 - protein, 345 aa, Deinococcus radiodurans R1
MTRFILGIDTSCDDTGVGIVELLPGAGPMGGGVKVRANRVLVADVHAQYGGVMPELASREHVERIDSILGDALAEAGLALSDIDAVAATAGPGLVGALLVGLMYGKGLAQALGVPFYAAHHLEGHIFAAASEEQLQAPYLALVVSGGHTHLFDVPHEGDYRLVGATMDDAAGEAFDKVARLCGLGYPGGPAISEAAKKGDPNAVPFKEPLKGQKAFDFSFSGLKTAALLAHKAGAKPEDLAASFERAAVQFLVKTTVRATEHLGRRTVVVSGGVAANRALRDAFAQTGLHVVFPGKGLNTDNGAMIALAGAAAVRAGRAPSPLSVGAEAYAPLTQQRADGEGERA

SEQ ID NO: 45606 - DNA, 1047 bp, Xylella fastidiosa 9a5c
  CDS (1)..(1047)
gtgaaaatcatcggtattgagtcttcatgtgatgaaactggcgttgcggtgtatgacactgcgctctctggttttgctgcgttacgtgcgcattctgtctatagtcaggttgcgttgcatgccgaatacggtggtgtggtgccggagttggcaagtcgtgatcatgtacgtaagttgctgccattgctacgtcagacgctggctgaggccaagctttcggttgaggagttggatggagtggcctacacggccggaccgggtcttgttggtgcgctgttggtcggtgccggggtggcacgtgcattggcttgggcacttgaggtgccagcgattggggtgcatcacatggaaggtcatttgttgtcaccgttgctggaggatgatccacctgaggtgccgtttgtggcgttgctggtctcgggcgggcatacccagttggttgcagtcgatgcgattggtgattaccggttgcttggtgaaacgttggacgatgcggctggcgaggcgtttgacaaggttgccaagttgatgggcctgccgtatccgggagggcctcagttggctgcgttggctgaacagggtattccaggtcgattctgtttcactcgtccgatggttgatcgtcctgggttggatttcagcttttccggattaaaaactcaggtattgttagcgtggcgtaacagtgatcagtctgatgcgattcgcgtcgatgttgcacgcggttttgaggatgcggtggttgatactctggcgatcaaatgtgaacgtgccttggatacggtggcttgtcagacgctggtagtggctggcggtgtcggtgccaacaagtgcttgcgtgcacgattacaggcaatgtgcaggcaacgtggtgggcgtgcttgttttccgcgtccagcattgtgtacggataacggtgcgatgatcgcttttgccggggcgttgcgtttgcaggcgggtcagcagagtgatattgcggtgcgtgtaacgccgcgttgggatatggctgcgttgccaccgttggtctcgcggtcgtgccgccgatga

SEQ ID NO: 45607 - protein, 348 aa, Xylella fastidiosa 9a5c
MKIIGIESSCDETGVAVYDTALSGFAALRAHSVYSQVALHAEYGGVVPELASRDHVRKLLPLLRQTLAEAKLSVEELDGVAYTAGPGLVGALLVGAGVARALAWALEVPAIGVHHMEGHLLSPLLEDDPPEVPFVALLVSGGHTQLVAVDAIGDYRLLGETLDDAAGEAFDKVAKLMGLPYPGGPQLAALAEQGIPGRFCFTRPMVDRPGLDFSFSGLKTQVLLAWRNSDQSDAIRVDVARGFEDAVVDTLAIKCERALDTVACQTLVVAGGVGANKCLRARLQAMCRQRGGRACFPRPALCTDNGAMIAFAGALRLQAGQQSDIAVRVTPRWDMAALPPLVSRSCRR

SEQ ID NO: 45608 - DNA, 1023 bp, Clostridium acetobutylicum ATCC 824
  CDS (1)..(1023)
atgtgtaaagacattaagatacttgcaatagaaagtagttgtgatgaaactgccgcggctgttgttgtcaatggcagaaaggtattatctaatataatatcatcgcaaatagatatacataaaaagttcggaggagtcgttccagagatagcatcaagaaagcatatcgaaaatatatcattggtggttcaggatgctataaaagaagctggtgtagagcttaaagatattgatgctgttggagttacatatggaccgggacttgtaggagcgcttcttgtaggacttcaatatgccaaaggacttgcgtactcaataaacaaacctcttataggagttaatcatatagaaggacatataagtgcaaattttatacaatacccagatttaaagcctccatttgcatgtcttgtagtatctggaggacatacttttatagtatatatgaaagattacggtgagtttgaagttttaggtcagacgagagatgatgctgcaggagaagcttttgataagattgcaagagctataggtcttggttatccaggtggacctaagattcaggaaatggctaaaagaggagatgaaagtgcacttcaatttccaagagctaagtttcatgataattctttggatttctcttttagcggagttaaatctgcagtactcaactatttaaatactatgaagatgcaagaaaaagaaataaatagagcagatgttgcagcatcatttcaaaaaaatgttgttgatttcctggttgataatactattaaggcttgtaaaataaagaagatagatagaatagcagttgcaggtggtgtggcctcaaacagcttcttaagggagacaatggtaagtcgaggaagagagaatgggatagatgtattgtttccagcaccaatactatgcactgataatgcagcaatgattggaagtgcagcgtattttgagtttaaaaaaggaaatattgcacctcttgatttaaatgctatacctaatttgaaactaggggaaagataa

SEQ ID NO: 45609 - protein, 340 aa, Clostridium acetobutylicum ATCC 824
MCKDIKILAIESSCDETAAAVVVNGRKVLSNIISSQIDIHKKFGGVVPEIASRKHIENISLVVQDAIKEAGVELKDIDAVGVTYGPGLVGALLVGLQYAKGLAYSINKPLIGVNHIEGHISANFIQYPDLKPPFACLVVSGGHTFIVYMKDYGEFEVLGQTRDDAAGEAFDKIARAIGLGYPGGPKIQEMAKRGDESALQFPRAKFHDNSLDFSFSGVKSAVLNYLNTMKMQEKEINRADVAASFQKNVVDFLVDNTIKACKIKKIDRIAVAGGVASNSFLRETMVSRGRENGIDVLFPAPILCTDNAAMIGSAAYFEFKKGNIAPLDLNAIPNLKLGER

SEQ ID NO: 45610 - DNA, 1101 bp, Agrobacterium tumefaciens str. C58
  CDS (1)..(1101)
ttgatgcccccctttcttcgtattctcggcatagagacaagctgtgacgaaaccgctgcatccattgtggttcggcatgcggacgggcgtggcgagatcgtctccgatgtcgttttgtcgcagcttgaggaacacagtgcctatggcggtgtggtgccggaaattgctgcgcgcgcccatgtcgaggcgctggacacgctggtggaagaagcgctggatcaggcgggcgtcaagcttgccgatgtcgacgccattgcagccacctccggccctgggctcatcggtgggctactggtggggctgatgaccggcaaggccatcgccaaggcggccggcaaaccgctctacgccatcaatcatctggaaggccacgcgctgacggcgcgactgaccgatggtctgtcttttccctatctgatgttgctcgtctccggcggtcacacccaactggtgctggtgcgcggggtgggggaatacgagcgctggggcaccaccatcgacgacgcgctcggcgaggccttcgacaagaccgccaaacttctcgggctgccctatcccggtgggcctgccgtcgagaacgcggcggcgaagggtgacccggaccgttttccgctcccgcgcccgatggttggggaagcacggctcgatttttccttctcgggcttgaagacagcggtgcggcaggctgcgaccgccatcgcgccgctttcggagcaggatattgccgatatctgcgcctccttccagaaggcggtgtcgcgcaccctgaaagaccgtatcggccgtggccttgcgcgtttcaaagtagaatttccgcatatcaatggagaaccggctcttgtggtggccggcggcgtagccgccaaccaggaaatccgccagaccctgcaggcactttgcgatacacacggcttccgcttcgtcgcgccgccgcaccggctttgcaccgataatgctgcgatgatcgcctgggcgggtctggagcgcatggcggaaggcaggcaagccgatgcgcttgaggtcgcgccgcgctctcgctggccgcttgacggtagcgcggagacattgattggtttcggtaaaaggggagccaaggcctga

SEQ ID NO: 45611 - protein, 366 aa, Agrobacterium tumefaciens str. C58
MMPPFLRILGIETSCDETAASIVVRHADGRGEIVSDVVLSQLEEHSAYGGVVPEIAARAHVEALDTLVEEALDQAGVKLADVDAIAATSGPGLIGGLLVGLMTGKAIAKAAGKPLYAINHLEGHALTARLTDGLSFPYLMLLVSGGHTQLVLVRGVGEYERWGTTIDDALGEAFDKTAKLLGLPYPGGPAVENAAAKGDPDRFPLPRPMVGEARLDFSFSGLKTAVRQAATAIAPLSEQDIADICASFQKAVSRTLKDRIGRGLARFKVEFPHINGEPALVVAGGVAANQEIRQTLQALCDTHGFRFVAPPHRLCTDNAAMIAWAGLERMAEGRQADALEVAPRSRWPLDGSAETLIGFGKRGAKA

SEQ ID NO: 45612 - DNA, 1011 bp, Streptococcus pneumoniae R6
  CDS (1)..(1011)
atgaaggatagatatattttagcatttgagacatcctgtgatgagaccagtgtcgccgtcttgaaaaacgacgatgagctcttgtccaatgtcattgctagtcaaattgagagtcacaaacgttttggtggcgtagtgcccgaagtagccagtcgtcaccatgtcgaggtcattacagcctgtatcgaggaggcattggcagaagcagggattaccgaagaggacgtgacagctgttgcggttacctacggaccaggcttggtcggagccttgctagttggtttgtcagctgccaaggcctttgcttgggctcacggacttccactgattcctgttaatcacatggctgggcacctcatggcagctcagagtgtggagcctttggagtttcccttgctagcccttttagtcagtggtgggcacacagagttggtctatgtttctgaggctggcgattacaagattgttggggagacacgagacgatgcagttggggaggcttatgacaaggtcggtcgtgtcatgggcttgacctatcctgcaggtcgtgagattgacgagctggctcatcaggggcaggatatttatgatttcccccgtgccatgattaaggaagataatctggagttctccttctcaggtttgaaatctgcctttatcaatcttcatcacaatgccgagcaaaagggagaaagcctgtctacagaagatttgtgtgcttccttccaagcagcagttatggacattctcatggcaaaaaccaagaaggctttggagaaatatcctgttaaaaccctagttgtggcaggtggtgtggcagccaataaaggtctcagagaacgcctagcaactgaaatcacagatgtcaatgttatcattccacctctgcgtctctgcggagacaatgcaggtatgattgcttatgccagtgtcagcgagtggaacaaagaaaactttgcaaacttggacctcaatgccaaaccaagtcttgcctttgataccatggaataa

SEQ ID NO: 45613 - protein, 336 aa, Streptococcus pneumoniae R6
MKDRYILAFETSCDETSVAVLKNDDELLSNVIASQIESHKRFGGVVPEVASRHHVEVITACIEEALAEAGITEEDVTAVAVTYGPGLVGALLVGLSAAKAFAWAHGLPLIPVNHMAGHLMAAQSVEPLEFPLLALLVSGGHTELVYVSEAGDYKIVGETRDDAVGEAYDKVGRVMGLTYPAGREIDELAHQGQDIYDFPRAMIKEDNLEFSFSGLKSAFINLHHNAEQKGESLSTEDLCASFQAAVMDILMAKTKKALEKYPVKTLVVAGGVAANKGLRERLATEITDVNVIIPPLRLCGDNAGMIAYASVSEWNKENFANLDLNAKPSLAFDTME

SEQ ID NO: 45614 - DNA, 1011 bp, Sulfolobus tokodaii str. 7
  CDS (1)..(1011)
atgaatgttttagggatcgaatctactgctcatacttttggagtaggtatagtttctgatgatgatagtgaaataagaatattatcaaatgaaagggatacttttgtccctaaacaaggtggaatgaaacctagtgatttgggtagacatcattctgaagttgcaccagaagtattacaaaaggccttaataaaggctaatttgagcataagagatattaattatatagcagtttctttaggccctggtatagggccagcattaagagtaggagctacaatagctagagcattatctttaaaatatgacattaaacttgtacccgtaaatcatggaattgcccatattgaaataggaagatttacaactagatctaaagatcctttaatcttgtatctttctggagggaatactataataacaacttatttagatggcaagtatagaatttttggtgaaacgttagatatagcattaggaaatatgttagacacatttgttagagaagtagggctagctcctccttatattgtaaacggtgttcatcaaatagatttatgtgcaaataaaggtgggaattttattgagctaccatatatagtaaagggtcaggatatgtcttatagtggtttgctaactgctgctttaagagcgacaaaaaataatagacttgaagacgtatgttatagtgttagggaagtggcttttgatatgttattagaggctactgaaagagcattagcattgactggaaagaaagaaattcttgttgttgggggtgttgcagctagtgtaagtttaaagactaagttatataatcttgcgaaagattggaatgttgaagtaaaaatagttccaccagaatattctggagataacggggcaatgatagcttttactggtttacttgaggcaaggcacggagttacaattccagtagaaaaaagtattattagacctagatggagagtagatcaagtagatgtgacatggagattatcagagaattaa

SEQ ID NO: 45615 - protein, 336 aa, Sulfolobus tokodaii str. 7
MNVLGIESTAHTFGVGIVSDDDSEIRILSNERDTFVPKQGGMKPSDLGRHHSEVAPEVLQKALIKANLSIRDINYIAVSLGPGIGPALRVGATIARALSLKYDIKLVPVNHGIAHIEIGRFTTRSKDPLILYLSGGNTIITTYLDGKYRIFGETLDIALGNMLDTFVREVGLAPPYIVNGVHQIDLCANKGGNFIELPYIVKGQDMSYSGLLTAALRATKNNRLEDVCYSVREVAFDMLLEATERALALTGKKEILVVGGVAASVSLKTKLYNLAKDWNVEVKIVPPEYSGDNGAMIAFTGLLEARHGVTIPVEKSIIRPRWRVDQVDVTWRLSEN

SEQ ID NO: 45616 - DNA, 1083 bp, Sinorhizobium meliloti 1021
  CDS (1)..(1083)
ttgcgcatcctcggcattgagacaagctgcgacgaaaccgccgcttcggtcgtgctgcgtgacgaagagggccgcggccggattctcggcgacgtggtgctgagccagctggaagagcatagtgcctatggcggcgtcgttcccgagatcgcggcgcgcgcccatgtcgaggcgctcgacgcgctgatcgaggaagcgctcctgcgcgccggcgtgacactccgggacatcgacgcggtcgctgcgacaagtggtcccggcctgatcggcgggctcatcgtcgggctgatgaccggcaaggcgatcgcgcgggcgaccggcaagccgctctatgcggtcaatcatctcgaaggccacgcgctgacggcgcggctgaccgacggcctttcatttccctatctgatgctgctcgtctcgggcggccatacacagctgatcctcgtcaagggcgtcggcgaatacgaacgctggggcacgacgatcgacgatgcgctcggcgaggccttcgacaagaccgcaaagctgctcggtcttccctatccgggcgggccggccgtcgagcgggcggcgcaagccggtaatgcggagcgcttcgattttccccggccgctcgtcggcgacgccaggctcgacttttcgttttcgggcctcaagaccgccgtccgccaggccgcacagtcgctggggccggtgacggatcaggatatcgccgacgtctgtgcctcttttcagcgcgccatttcccgcacgctcagggatcgggtcgggcgcggcttgaagcggttcagggcggacttcgcctccgtcgaccaaccggctctcgtcgtggccggcggggttgccgcgaaccagacattgcgccggacactgcaatcgctttgcgacgagcacggcttccgcttcatcgcgccgccgctccagctttgcaccgacaacgcggcgatgattgcgtgggccggtgcggagcgcctcgcggcgggcctgccggcggacgggctcgatgcagctccgcgttcgcgctggccgctcgattccgaagccaaggcattgatcggctccggcagacgcggcgccaaggcatga

SEQ ID NO: 45617 - protein, 360 aa, Sinorhizobium meliloti 1021
MRILGIETSCDETAASVVLRDEEGRGRILGDVVLSQLEEHSAYGGVVPEIAARAHVEALDALIEEALLRAGVTLRDIDAVAATSGPGLIGGLIVGLMTGKAIARATGKPLYAVNHLEGHALTARLTDGLSFPYLMLLVSGGHTQLILVKGVGEYERWGTTIDDALGEAFDKTAKLLGLPYPGGPAVERAAQAGNAERFDFPRPLVGDARLDFSFSGLKTAVRQAAQSLGPVTDQDIADVCASFQRAISRTLRDRVGRGLKRFRADFASVDQPALVVAGGVAANQTLRRTLQSLCDEHGFRFIAPPLQLCTDNAAMIAWAGAERLAAGLPADGLDAAPRSRWPLDSEAKALIGSGRRGAKA

SEQ ID NO: 45618 - DNA, 1590 bp, Thermoplasma acidophilum DSM 1728
  CDS (1)..(1590)
gtgatagttcttgggctagagggtactgcgcatacaatcagctgtggcataatagacgaatcccgcatactggccatggaatcgtccatgtacaggccaaagaccggagggataaggccactggacgcagctgtacatcattctgaggtaatagatactgtgatatctagggctctcgagaaagcgaagatatcgatccatgacatcgacctcatagggttttccatggggccaggccttgctccatctttgagggtgaccgcaaccgccgcaagaacgatatcggttctgaccggcaaaccaatcataggtgtaaaccatccgcttggccacatagagataggcaggcgggtaactggtgcgatcgatccggtaatgctatacgtttcaggcggcaatacacaggtcatagcccacgtcaatggaaggtatagggttctcggggagacgctggacatcgggatagggaatatgattgacaaattcgccagagaagccgggataccgtttcctggtggtccggagatagagaagctcgcaatgaagggaacgaagcttctggatcttccctattcagtgaaggggatggatacggccttttctggcatcctaaccgctgctttgcagtatctcaaaaccggccaggccatagaggatataagctacagcatacaggaaacggcattcgccatgctggtagaggtgctggaaagagcgctatacgtttcaggcaaggatgagatactcatggctggtggggttgcgctgaacagaaggctccgggatatggtgactaatatggctcgggaggcgggcatcagatcctatctaactgacagggaatactgcatggacaacggcataatgatagcacaggcagcgctgttgatgtataaatccggtgtacgcatgtccgttgaggagacggcggtgaaccctcgtttcagaatagatgaggtggacgcaccgtggataacagacgcttccagaaaagactatggaaaggccggtgcagaatccaggatagaggaggtcagctttcatggaaggccggcaataagaaaggtgcgcatttccaagtcctaccgaaattcggatcttgataagaagatccgatatgaacgaatgcgcaatgaattcacgattctcagaaagctcaaggaggccggtgttaactcaccagtagtctacgacttcgatcctttctcaatgtccatcaccatgcagaaaataccaggaaggatgatgtccgcagagcttaacgaaggcagaaccgatttcctgaacgagctgggcatcatgatagcaaagatgcacagggcaggaatcgctcatggggatctgactgtcaataacataattgttaacgatagcgttttcatcatcgatcccagcatgggaaaggttaatgcagagatagaggacatggccgtggatatatacgccctagaggattctattaaggggctgggtttggattcgggcagcgtgatcggccagatgcttaagtcctacaggaacaatttcaatctggcggacgatgtactcgaaaccgtatccgcaataagaaggaggcacaggtatgtatag

SEQ ID NO: 45619 - protein, 529 aa, Thermoplasma acidophilum DSM 1728
MIVLGLEGTAHTISCGIIDESRILAMESSMYRPKTGGIRPLDAAVHHSEVIDTVISRALEKAKISIHDIDLIGFSMGPGLAPSLRVTATAARTISVLTGKPIIGVNHPLGHIEIGRRVTGAIDPVMLYVSGGNTQVIAHVNGRYRVLGETLDIGIGNMIDKFAREAGIPFPGGPEIEKLAMKGTKLLDLPYSVKGMDTAFSGILTAALQYLKTGQAIEDISYSIQETAFAMLVEVLERALYVSGKDEILMAGGVALNRRLRDMVTNMAREAGIRSYLTDREYCMDNGIMIAQAALLMYKSGVRMSVEETAVNPRFRIDEVDAPWITDASRKDYGKAGAESRIEEVSFHGRPAIRKVRISKSYRNSDLDKKIRYERMRNEFTILRKLKEAGVNSPVVYDFDPFSMSITMQKIPGRMMSAELNEGRTDFLNELGIMIAKMHRAGIAHGDLTVNNIIVNDSVFIIDPSMGKVNAEIEDMAVDIYALEDSIKGLGLDSGSVIGQMLKSYRNNFNLADDVLETVSAIRRRHRYV

SEQ ID NO: 45620 - DNA, 1014 bp, Yersinia pestis CO92
  CDS (1)..(1014)
atgcgagtattgggtatagaaacgtcctgcgatgaaaccggaattgcagtctatgacgataaagccggtctgttagctaaccaattgtacagtcaggtaaaattacacgctgactacggtggtgtcgtacctgaactggcctcccgtgatcacgtgcgtaagaccgtacccctgattcaggcggcgttgaaagaagccaatttgagcgccaaagatatcgatgcggtggcttatacagcaggccctggtttggtgggggcgttgttagtgggggcgaccattggtcgggcattagctttcgcatggggagtccctgcggtaccggttcatcatatggaaggccatttgttggcaccaatgctggaagaaaatgcaccagagttcccgtttgttgcgctgctggtatccggcggccatacccaattgattagtgtgaccggtattggtgaatatttgctgttgggcgaatctgttgatgatgcggcaggcgaggcctttgataagacagcaaaactactagggctggattaccccggtgggccaatgttgtcgcgtatggctcaacaaggtactgtggggcgttttacctttccgcgcccaatgactgatcgccctgggctggattttagtttttccggcctgaaaacgttcgcggcgaatactattcgtgctaatggtgatgatgaccaaacccgtgccgatatcgcccgagcattcgaagatgcggtggttgatacgttggcgatcaagtctaaacgtgcattagatcagacgggttttaaacgcttagtcattgccgggggcgtgagcgctaaccagacactgcgattaaaactggccgatatgatgcaaaaacgaggcggtgaagtattctatgcccgacccgaattttgcactgacaatggcgcgatgattgcctatgccgggatggtcaggttgcgaagtaacctgaacagtgagttgagtgtgtcggtgcggccgcggtggccgttatctgagttaccaaaagtctga

SEQ ID NO: 45621 - protein, 337 aa, Yersinia pestis CO92
MRVLGIETSCDETGIAVYDDKAGLLANQLYSQVKLHADYGGVVPELASRDHVRKTVPLIQAALKEANLSAKDIDAVAYTAGPGLVGALLVGATIGRALAFAWGVPAVPVHHMEGHLLAPMLEENAPEFPFVALLVSGGHTQLISVTGIGEYLLLGESVDDAAGEAFDKTAKLLGLDYPGGPMLSRMAQQGTVGRFTFPRPMTDRPGLDFSFSGLKTFAANTIRANGDDDQTRADIARAFEDAVVDTLAIKSKRALDQTGFKRLVIAGGVSANQTLRLKLADMMQKRGGEVFYARPEFCTDNGAMIAYAGMVRLRSNLNSELSVSVRPRWPLSELPKV

SEQ ID NO: 45622 - DNA, 1104 bp, Caulobacter crescentus CB15
  CDS (1)..(1104)
atgacatcccctaagcaatccgaccttctcatcctcggccttgagactagctgcgatgaaaccgcggcctcggtcgtgcgccgcgctgcggacgggacggtgacggtgctgtcgtcggtgatcggcacccagttcgagaagcacgccccgtttggcggcgtcgtgcccgagatcgccgcccgggcccacgtcgagtcgatcgacgccatcgccgccgaggctgttcgcgcggcgggcgtcgggttcggggacctggacggggtcgccgccacggcggggccgggccttgtgggcggggtcatggtggggctggcgttcggcaaggccgtagccttggcgcggggcgcgccgctggtggccgtcaaccacctggagggtcacgccgtctcggcccgcctgggggccgacatcgcctatccgttcctgctgctgctggtgtccggcgggcattgtcagctgctggaggtgtcgggcgtcggggcctgcaagcgcctgggcaccacgatcgacgacgccgccggcgaggccttcgacaagatcgccaagagtctgggcctgccctatcccggcggcccggcgctggagaagctggccgtgggcggcgatccgacccgctacgccctgccccgcgccctgctgggccgcaaggattgcgacttctcgttctcgggcctgaagaccgccgcggcgcggatcgccgagaccctgaccaccgacgacgcgcgccgcgacctggccgccggcgtccaggccgccatcgcccgccagctgtcggagcgggtcgatcgggcgatgaagctttacaaggacagccatgacccggaggacctgcgcttcgtggtcgccggcggcgtagcggccaatggcgcggtgcgggcggccctgctggccgactgcgagaagaacggcttttcgttcgccgcgccgcccctggcctattgcaccgacaacgccgccatgatcgccctcgccggagccgagcggctagcgctcgggatcttcgatgacctcgacgccatcgcccgtccgcgctggccgctggacgaggccgcggcgctggccaatcccgccaacgcctacggacgcaagggagccaaggcatga

SEQ ID NO: 45623 - protein, 367 aa, Caulobacter crescentus CB15
MTSPKQSDLLILGLETSCDETAASVVRRAADGTVTVLSSVIGTQFEKHAPFGGVVPEIAARAHVESIDAIAAEAVRAAGVGFGDLDGVAATAGPGLVGGVMVGLAFGKAVALARGAPLVAVNHLEGHAVSARLGADIAYPFLLLLVSGGHCQLLEVSGVGACKRLGTTIDDAAGEAFDKIAKSLGLPYPGGPALEKLAVGGDPTRYALPRALLGRKDCDFSFSGLKTAAARIAETLTTDDARRDLAAGVQAAIARQLSERVDRAMKLYKDSHDPEDLRFVVAGGVAANGAVRAALLADCEKNGFSFAAPPLAYCTDNAAMIALAGAERLALGIFDDLDAIARPRWPLDEAAALANPANAYGRKGAKA

SEQ ID NO: 45624 - DNA, 1035 bp, Chlamydophila pneumoniae AR39
  CDS (1)..(1035)
atgctcaccctaggcttggaaagttcttgcgatgagactgcctgcgctatagttaatgaggataagcagatattagcaaatattattgcctctcaagatatccatgcatcctatggcggagtcgttcctgaacttgcttcaagagcacatctccatatcttcccacaagtgataaataaagctctacaacaggccaacttattgatcgaagatatggatctgattgcagtaacgcaaactccagggttgataggttctctatcagtaggagtgcattttggtaaaggcattgccataggagcaaaaaaatccttgattggagtcaatcacgtcgaagctcatctctatgctgcctatatggcagcgcaaaacgtgcaattccctgctttaggtcttgtggtctctggagctcataccgcagcgttttttatagaaaatcctacatcctataaactcataggaaaaactcgagatgatgctataggagaaacttttgataaagtaggacgctttctaggattaccataccctgcaggcccattaattgaaaaactcgctttagaaggctctgaggacagttatccttttagtccagctaaagtcccaaactatgacttttcattcagcggtcttaaaacagctgttctctacgcaatcaaaggaaataatagtagcccccgctctcctgctccagagatatctttagaaaaacaaagagatatcgctgcttcatttcaaaaagcggcctgcactactattgcacaaaaacttcccactattataaaagaattttcgtgccgatctatacttattggaggtggcgtagccattaatgaatactttagatccgcaatacaaactgcgtgtaatctacctgtatacttcccccctgctaaactatgctcagataatgctgctatgattgcaggtctagggggagaaaattttcaaaaaaactctagtattccggaaattcgtatatgcgcaagatatcagtgggaatctgtatcaccattctccttagcctctccgtag

SEQ ID NO: 45625 - protein, 344 aa, Chlamydophila pneumoniae AR39
MLTLGLESSCDETACAIVNEDKQILANIIASQDIHASYGGVVPELASRAHLHIFPQVINKALQQANLLIEDMDLIAVTQTPGLIGSLSVGVHFGKGIAIGAKKSLIGVNHVEAHLYAAYMAAQNVQFPALGLVVSGAHTAAFFIENPTSYKLIGKTRDDAIGETFDKVGRFLGLPYPAGPLIEKLALEGSEDSYPFSPAKVPNYDFSFSGLKTAVLYAIKGNNSSPRSPAPEISLEKQRDIAASFQKAACTTIAQKLPTIIKEFSCRSILIGGGVAINEYFRSAIQTACNLPVYFPPAKLCSDNAAMIAGLGGENFQKNSSIPEIRICARYQWESVSPFSLASP

SEQ ID NO: 45626 - DNA, 1035 bp, Listeria innocua Clip11262
  CDS (1)..(1035)
gtgggtggacttatgaaaaaaaatacattaattcttgggatagaatcgagctgtgatgaaacagctgcttctgttgtgaaaaatggttgtgaaatagtatctagcgttgtggcttcgcaaattgaaagtcataagcgattcggtggtgtggttccagaaattgcatctcgtcatcatgtggaacaaattacgcttgtgattgaagaagctttaaaacaagcgaatgtaacgatggacgatttagacggggtggcggtaactgaaggacctggtttagtcggtgcacttctaattggcgtcaatgctgcaaaaacacttgcttttatgcataatttgcctttagttggtgtgcatcatattgctggacatatttatgcgaatcgctttgaaacagaatttcaatttccgcttttatcgttagttgtcagtggtgggcatacggaacttgttttaatgaaagcagataatgaatttgaaattatcggggaaacaagagatgatgcggccggcgaagcatacgataaagtggcgcgtacacttggtttagcttatccaggtggtgttcaaattgataaacttgcaaaagatggtgaagacacgttccattttccgcgggcgatgatggatgatggttcgtttgactttagttttagcggattgaagtcttcttttattaatacgttgcataatttaagacagcgcggggaagaaccaaatcctaatgatatggcagctagttttcaagctagtgtagtcgatgttttagtaagtaagacgattcgcgcagctaaacaacatggcgtgaaacaattgcttcttgctggtggagtggcggcaaatcaaggtttaagagagcgacttattcaagaagtaaaactagaacttccggataccgagctgattattccgccgttatcgttatgtggtgataatgcggctatgattgccgctgcagggacagtgagtttcttacaaggaaaacgaagcaattatgatatgaatgcaaatccaggtttattgctggaagacatttaa

SEQ ID NO: 45627 - protein, 344 aa, Listeria innocua Clip11262
MGGLMKKNTLILGIESSCDETAASVVKNGCEIVSSVVASQIESHKRFGGVVPEIASRHHVEQITLVIEEALKQANVTMDDLDGVAVTEGPGLVGALLIGVNAAKTLAFMHNLPLVGVHHIAGHIYANRFETEFQFPLLSLVVSGGHTELVLMKADNEFEIIGETRDDAAGEAYDKVARTLGLAYPGGVQIDKLAKDGEDTFHFPRAMMDDGSFDFSFSGLKSSFINTLHNLRQRGEEPNPNDMAASFQASVVDVLVSKTIRAAKQHGVKQLLLAGGVAANQGLRERLIQEVKLELPDTELIIPPLSLCGDNAAMIAAAGTVSFLQGKRSNYDMNANPGLLLEDI

SEQ ID NO: 45628 - DNA, 1041 bp, Nostoc sp. PCC 7120
  CDS (1)..(1041)
atgacaactgttttagcaatcgaaaccagctgtgatgaaactgccgtggcaattgtaaacaatcgtcaagttttgagtagtatcatagcctcgcaaatttccgtccatcagcagtatggtggggtagtacctgaagtagcctcacgagcgcacttggaaacgataaatggcgcgatcgcccaagcgatggatcaagctcaactaggttgggataaaatcgatgcgatcgccgccacttgtgcgcctggacttgtaggcgcgctgttagtggggctgactgctgccaaaactttagcaatcttacacaacaaaccatttttgggagttcaccacctcgaaggtcacatctacgcgacttatttgagtgagccaactttagatcccccttttcttagcttactggtttctgggggacatacaagcttaatttacgttaaggaatgtggtaggtatgaaagtctgggtgaaacgcgtgatgatgcggctggggaagcttttgacaaggtagctaggctgttaaagctaggttatcctggtggcccagtcattgataaactagcgcaaacagggaatcctcaagcctttgcgttgcctgaaggaaaagtgtccttgcctggtgggggatatcatccctatgatggcagttttagcggcttaaagacggctgtacttcgtctagtgcagcaattagagaaagatggcgattcactgcctttagaggacattgccgctagctttcaggcgaccgtagccaaggcattaaccaagagagcgatcgcctgtgctttagattatggtctagataccattgccgttggtggcggggtagccgctaacagtggcttgagacaacacttacaagcagccaccgccgcaaataacctccgtgtcctcttccctccgctaaaattctgtaccgataacgccgccatgatagcctgtgcagccgtagaccacttatcacgcggacatacttcccccatcaccttaggcgtggaatcaaggctaagtcttagccaagtgatgaagttatatcagtag

SEQ ID NO: 45629 - protein, 346 aa, Nostoc sp. PCC 7120
MTTVLAIETSCDETAVAIVNNRQVLSSIIASQISVHQQYGGVVPEVASRAHLETINGAIAQAMDQAQLGWDKIDAIAATCAPGLVGALLVGLTAAKTLAILHNKPFLGVHHLEGHIYATYLSEPTLDPPFLSLLVSGGHTSLIYVKECGRYESLGETRDDAAGEAFDKVARLLKLGYPGGPVIDKLAQTGNPQAFALPEGKVSLPGGGYHPYDGSFSGLKTAVLRLVQQLEKDGDSLPLEDIAASFQATVAKALTKRAIACALDYGLDTIAVGGGVAANSGLRQHLQAATAANNLRVLFPPLKFCTDNAAMIACAAVDHLSRGHTSPITLGVESRLSLSQVMKLYQ

SEQ ID NO: 45630 - DNA, 1176 bp, Caenorhabditis elegans
  CDS (1)..(1176)
atggtctgcgtaatcggaatcgaaggatcggccaataaaattggggtgggaataatccgtgacggagtagtgctctcaaatccgcgagcaacatttcatgctccaccgggtgaaggatttcgtccaacagaaaccgcccaacatcaccgtcaacaaattgttcgattagttggagaagctattaaactggcaaatattcagaatccagagcttgaaattgatggaattgcatatacaaagggtcctggaatgggggctccacttcaggttggagcaattgtcgcacgaactctatccctcacatggaaaaagccaattattccagttaatcactgtgttggacacattgaaatgggcagacttatcacgggagctgataatcctgttgttttgtatgttagcggtggaaatactcaggtaatctcatatacgaagaaaagataccgaatctttggtgaaacaatcgatattgccgtcggaaactgtttggatcgatttgcccgtgttctcaagctcccgaatgcaccatctccgggatataacattgagcagcttgcgaaaaacggaaaaaagcttatggaactaccgtattctgtgaaaggaatggatgtttcactctcaggaattctgtcacttatcgagaaaaaagcgccaaaactcatcgaatctggggattttacaccggaagacttgtgtttctcacttcaagagaccgtttttgcaatgcttattgagattaccgaaagagcaatggctcatacgtcgagcaaggagttgctcattgttggcggggttggatgtaatctgagattgcagttatcccccgtccaattttcaatcatttctttattattttctcctgttcttcacacgttttttgcacaaaaaggaacgggaaacaaaatggtcgacggatgtgctgagaaattcgagcaaatgagttcatggattgtgctgatttcaattgttccaataacattcagctttataactgtcattcttttgtgctcatctcttctaaaagtgaagaaaatgcgtggaatttgtgatggaatccattcgaatgctcattggttgtctagaactgctgttcgtgttggaattggagcaactgcccgtgttacaatcaatgaatatgcatcgacgaagcctgagctcaagagattgcttaaatag

SEQ ID NO: 45631 - protein, 391 aa, Caenorhabditis elegans
MVCVIGIEGSANKIGVGIIRDGVVLSNPRATFHAPPGEGFRPTETAQHHRQQIVRLVGEAIKLANIQNPELEIDGIAYTKGPGMGAPLQVGAIVARTLSLTWKKPIIPVNHCVGHIEMGRLITGADNPVVLYVSGGNTQVISYTKKRYRIFGETIDIAVGNCLDRFARVLKLPNAPSPGYNIEQLAKNGKKLMELPYSVKGMDVSLSGILSLIEKKAPKLIESGDFTPEDLCFSLQETVFAMLIEITERAMAHTSSKELLIVGGVGCNLRLQLSPVQFSIISLLFSPVLHTFFAQKGTGNKMVDGCAEKFEQMSSWIVLISIVPITFSFITVILLCSSLLKVKKMRGICDGIHSNAHWLSRTAVRVGIGATARVTINEYASTKPELKRLLK

SEQ ID NO: 45632 - DNA, 1266 bp, Caenorhabditis elegans
  CDS (1)..(1266)
atgaatattccgaaaattctgaacaacaatttagttttaaagcgaattttttgtcgaaattactccgttaaagtgctaggaattgaaacaagttgtgacgatactgcagtagcaattgtcaacgagaaacgagagattttatcttcagagcggtacacagaacgggcgattcagagacaacaaggcgggattaatccttcagtctgcgcacttcaacaccgtgagaaccttccaaggcttatagaaaagtgtctgaacgacgctggaacatcaccgaaagatctggatgcagtagcggttacagtaacgcctggattagttattgcacttaaagagggaatttcagcggcgattggatttgcaaaaaaacatcgtcttccactgattccagttcatcatatgagagcccatgctctgtcaattcttctcgtcgatgattcagtgcgatttccattttcagcagttcttctttcgggtggtcatgcattgatttctgttgcagaagatgtcgagaaattcaaattgtacggccaaagtgtcagtggaagcccgggcgagtgcattgacaaagttgcgcggcagcttggagatcttggatcagaattcgatgggattcatgtgggcgctgcggtggaaattctagcctctagagcctctgctgatggccatttgagatatcccatatttcttccaaacgttccaaaagctaatatgaacttcgatcaaatcaaaggatcctatctgaatttgctggaaagattgagaaaaaactctgaaacatcaattgatattccagatttttgtgctagccttcagaacaccgtagcccgacatatctcgagcaaacttcacatcttcttcgaaagtctctccgagcaggaaaaacttccaaaacagctggtgatcggcggcggagtggcggcgaatcagtacatttttggagcaatctcaaaactatcagctgctcacaatgtcacaaccatcaaagtcctcttgtccctttgcacagacaatgccgaaatgatcgcctacagtggccttctgatgctcgtcaatcgatcggaggcaatttggtggcgaccgaatgacattcctgacacaatttatgcacacgctagaagcgatattgggacggatgcttcttcggaaatcattgatacaccgcgtcggaaactggtgacatccacgatccatggcaccgagcggatacgattccggaatctggatgattttaagaagcctaaaagccctaaaacaactgaatga

SEQ ID NO: 45633 - protein, 421 aa, Caenorhabditis elegans
MNIPKILNNNLVLKRIFCRNYSVKVLGIETSCDDTAVAIVNEKREILSSERYTERAIQRQQGGINPSVCALQHRENLPRLIEKCLNDAGTSPKDLDAVAVTVTPGLVIALKEGISAAIGFAKKHRLPLIPVHHMRAHALSILLVDDSVRFPFSAVLLSGGHALISVAEDVEKFKLYGQSVSGSPGECIDKVARQLGDLGSEFDGIHVGAAVEILASRASADGHLRYPIFLPNVPKANMNFDQIKGSYLNLLERLRKNSETSIDIPDFCASLQNTVARHISSKLHIFFESLSEQEKLPKQLVIGGGVAANQYIFGAISKLSAAHNVTTIKVLLSLCTDNAEMIAYSGLLMLVNRSEAIWWRPNDIPDTIYAHARSDIGTDASSEIIDTPRRKLVTSTIHGTERIRFRNLDDFKKPKSPKTTE

SEQ ID NO: 45634 - DNA, 1032 bp, Pyrobaculum aerophilum str. IM2
  CDS (1)..(1032)
gtgttagtcctaggcgtagagtccactgcccacacctttagcctcggacttgtattagacgggaaaatcttgggacagttggggaagacatacctccccccaagcggcgagggcattcacccccgggaagccgccgatcaccactccaaggtcgctccggttatcttccggcagttgctaaacgcgcatggcatcacggcatcagatatcgacgtaattgcatatgcggcagggcccgggctgggaccggcgttgagaataggcgcggtgttcgccagggctttggctataaaactgggggttcccctcgtccctgtccaccacggcatagcgcatatagaagtggcgagatacacaacggcgtcgtgcgatcccctagtcctcctaatctccggcggccacacgcttattgcgggtttttcagaaggtcggtatagaattttcggcgagactttagatgtggccattggaaacgctatagatatgtttgcaagagaggtgggccttggatttccgggggtacccgccgtggagaagtgcgcggaatctgcggataggctagtcccgttccccatgactataattggccaggacttatcctatgcgggcttgaccacatacgccttgaaactgtggaaaagcggcacgccgctacctgtagtgtgtaagtctctcgtagaggccgcctattatatgttagctgaagtgaccgagagggcgctcgcctttactaaaaaacgggagctcgtagtggcaggcggcgtggctaggagtaagaggctgagggggatattggaacatgtggggagggagtacggcgttgctgttaaaattgtgcctgatgaatacgccggtgacaacggcgcaatgatcgcgttgacgggctactacgcatacaggcgtgggatacgcacaacgcctgaagaaagctttgttaaacagaggtggcggctggactctgtggacatcccctggttctacgacttgtgcgaggaggtagtgttaaatacctcaacaaagcgtaggccatga

SEQ ID NO: 45635 - protein, 343 aa, Pyrobaculum aerophilum str. IM2
MLVLGVESTAHTFSLGLVLDGKILGQLGKTYLPPSGEGIHPREAADHHSKVAPVIFRQLLNAHGITASDIDVIAYAAGPGLGPALRIGAVFARALAIKLGVPLVPVHHGIAHIEVARYTTASCDPLVLLISGGHTLIAGFSEGRYRIFGETLDVAIGNAIDMFAREVGLGFPGVPAVEKCAESADRLVPFPMTIIGQDLSYAGLTTYALKLWKSGTPLPVVCKSLVEAAYYMLAEVTERALAFTKKRELVVAGGVARSKRLRGILEHVGREYGVAVKIVPDEYAGDNGAMIALTGYYAYRRGIRTTPEESFVKQRWRLDSVDIPWFYDLCEEVVLNTSTKRRP

SEQ ID NO: 45636 - DNA, 1020 bp, Clostridium perfringens str. 13
  CDS (1)..(1020)
atggataaaaaaattatattagcaatagaaagtagttgtgacgaaacagcggcagctgtagtagtcaatggtagagaagttttatcaaatataatatcttctcagatagatatacatacaaaatttgggggagtagtcccagaggttgcatcaagaaaacacatagaagctataaatgcagtggtagaggaagccttagaagttgcaggagtaacatttgatgacatagatgcaatagcagttacatatggtccagggttagttggagcacttttagtgggacttcaatatgctaaaggattagcatactctttagataaaccattaataggagttaaccatatagaagggcatataagtgctaactttatagatcataaagacttagaaccaccttttgtttgtttagttgtttcaggaggacacacttttgtagtacatgttgaagactatggaaagtttgaaataataggtgaaacaagagatgatgcagcaggagaagcttttgacaaggtggcaagagccgtaggattaggatatccaggaggacctaaaatagataaattagctaaggaaggaaatagtgatgctataaaattcccaaaagctaatttccatgatgataccttagatttttcatttagtggagttaaatcagctgtcttaaattatttaaataagatggaaatgaaaaatgaagaaataaataaagctgatgttgtagctagtttccaaaaggccgtagttgaagtattaactgataatgcaataaaaacttgtaagatgagaaaggcagataaaatagccattgcaggtggagttgcttctaatagtgctttaagagaaaatcttcttagagaaggagaaaagagaggaataaaggttttattcccatcaccaatactttgtacagataatgctgccatgataggaagtgctgcatattttgaattattaaagggaaatgtatctgaaatgagtcttaacgcaaaacctaatttaagattaggagaaagatag

SEQ ID NO: 45637 - protein, 339 aa, Clostridium perfringens str. 13
MDKKIILAIESSCDETAAAVVVNGREVLSNIISSQIDIHTKFGGVVPEVASRKHIEAINAVVEEALEVAGVTFDDIDAIAVTYGPGLVGALLVGLQYAKGLAYSLDKPLIGVNHIEGHISANFIDHKDLEPPFVCLVVSGGHTFVVHVEDYGKFEIIGETRDDAAGEAFDKVARAVGLGYPGGPKIDKLAKEGNSDAIKFPKANFHDDTLDFSFSGVKSAVLNYLNKMEMKNEEINKADVVASFQKAVVEVLTDNAIKTCKMRKADKIAIAGGVASNSALRENLLREGEKRGIKVLFPSPILCTDNAAMIGSAAYFELLKGNVSEMSLNAKPNLRLGER

SEQ ID NO: 45638 - DNA, 1443 bp, Arabidopsis thaliana
  CDS (1)..(1443)
atggttcgtctgtttcttacactttctccggcgatttcccgattcaatctttatccaggaatctctattctagcgagaaataataattctctcagattacaaaaacaccataagcttaaaaccaaaaccccgactttctcgttaatctctccttcatcttcacccaattttcaaaggacacgtttttattctaccgaaacaagaatttcctccttaccctatagcgaaaacccgaattttgatgataatttggttgttctgggtattgaaacgagctgcgacgacactgccgcagctgttgtgagaggtaatggtgaaattctcagtcaagtcatttcttctcaggcagaattgcttgtccaatatggaggcgtcgctcctaaacaggctgaagaagcacactcccgagttatcgataaggttgtgcaagacgcgcttgataaagccaatttgaccgagaaggatctctctgctgttgctgttaccattggacctggtttgagcctctgtctacgtgttggtgtgcgcaaggctagaagagttgctggtaacttcagtctcccaatcgttggggtgcatcacatggaggctcatgctctcgttgctagattagtggaacaagaattaagcttccctttcatggcattgcttatatcaggagggcacaatcttctagttcttgcgcataagcttggtcagtacacacaacttgggactacagtagatgatgctataggtgaggcatttgacaagacagctaaatggctcggcctcgatatgcacaggagtggtggaccagctgttgaagaacttgctctggagggtgatgcaaagtctgttaagtttaatgttccaatgaaatatcataaagattgcaacttttcttatgctggtttgaagacacaagtgaggctagccattgaagccaaagaaattgatgctaaatgtcccgtctcttctgcaacaaacgaagacagaagaaaccgtgctgatattgccgcttctttccagcgagtagctgtcttgcatctggaagaaaaatgtgagcgagcaatagactgggcattagaactagagccttctattaaacatatggtaatctctggtggtgttgcttcaaacaagtatgtacgactccgacttaataacattgtcgaaaacaaaaacctgaaacttgtttgccctcctcctagcctctgcacagacaatggagtaatggtggcttggactggtctcgagcattttcgtgtaggaagatatgatccacctccacctgcaactgaacctgaggattatgtgtatgatcttcgaccgaggtggcctcttggcgaggagtatgcgaaaggaagaagcgaagctcgttctatgagaactgcacggatccatccgtcacttacttcaatcattagagcagattctcttcaacaacaaacacaaacgtag

SEQ ID NO: 45639 - protein, 480 aa, Arabidopsis thaliana
MVRLFLTLSPAISRFNLYPGISILARNNNSLRLQKHHKLKTKTPTFSLISPSSSPNFQRTRFYSTETRISSLPYSENPNFDDNLVVLGIETSCDDTAAAVVRGNGEILSQVISSQAELLVQYGGVAPKQAEEAHSRVIDKVVQDALDKANLTEKDLSAVAVTIGPGLSLCLRVGVRKARRVAGNFSLPIVGVHHMEAHALVARLVEQELSFPFMALLISGGHNLLVLAHKLGQYTQLGTTVDDAIGEAFDKTAKWLGLDMHRSGGPAVEELALEGDAKSVKFNVPMKYHKDCNFSYAGLKTQVRLAIEAKEIDAKCPVSSATNEDRRNRADIAASFQRVAVLHLEEKCERAIDWALELEPSIKHMVISGGVASNKYVRLRLNNIVENKNLKLVCPPPSLCTDNGVMVAWTGLEHFRVGRYDPPPPATEPEDYVYDLRPRWPLGEEYAKGRSEARSMRTARIHPSLTSIIRADSLQQQTQT

SEQ ID NO: 45640 - DNA, 975 bp, Pyrococcus furiosus DSM 3638
  CDS (1)..(975)
atgatagctctagggatcgaggggacagctcatacgcttgggatagggatagttacggaaaacaaagtacttgcaaatgtatttgacactctaaaaacagaaaaaggtggaatacacccaaaagaagctgctgagcatcacgccaagttgctcaaacccctattgagaaaagcattggaagaagcaggagttagtatggaagacatagatgtaatagcgttttcccaggggccaggattggggcctgcattaagggttgtcgcaacggctgcaagagcattggcaataaagtataacaaacccatagtgggagttaaccattgtattgcacatgtcgaaataaccaaaatgttcggggtcaaagatccagtggggttatatgttagcggtgggaacactcaagttttggcattagaaggggggagatacagggtttttggcgaaacacttgatataggaataggaaacgcacttgacgtatttgccagagaactgggattaggattcccaggaggaccaaagatagaaaaacttgcccttaaaggagagaagtacatagagctcccctacgctgttaagggaatggacttaagcttttctggccttctgactgaggctatcaggaagtataaaagcggaaagtatagggtggaagatttagcatactctttccaagaaacagcatttgcagctttggttgaagtcacagaaagagcattggcacacacagaaaaagaggaggttgtattagtagggggagttgcagcaaacaataggttaagagaaatgttgagaattatggcagaagacaggggagttaagttcttcgttcctccctatgatctctgcagggacaatggagcaatgatagcttatacaggacttaggatgtacaaggctggaattaagtttaagttggaggagaccatagttaaacaaaagtttagaacggacgaggtcgaggtagtatggtag

SEQ ID NO: 45641 - protein, 324 aa, Pyrococcus furiosus DSM 3638
MIALGIEGTAHTLGIGIVTENKVLANVFDTLKTEKGGIHPKEAAEHHAKLLKPLLRKALEEAGVSMEDIDVIAFSQGPGLGPALRVVATAARALAIKYNKPIVGVNHCIAHVEITKMFGVKDPVGLYVSGGNTQVLALEGGRYRVFGETLDIGIGNALDVFARELGLGFPGGPKIEKLALKGEKYIELPYAVKGMDLSFSGLLTEAIRKYKSGKYRVEDLAYSFQETAFAALVEVTERALAHTEKEEVVLVGGVAANNRLREMLRIMAEDRGVKFFVPPYDLCRDNGAMIAYTGLRMYKAGIKFKLEETIVKQKFRTDEVEVVW

SEQ ID NO: 45642 - DNA, 1239 bp, Schizosaccharomyces pombe
  CDS (1)..(1239)
atgctttgtctggtatataattctattttgtgcaagcaacgtcgaatttctttaaaagttttacaacagtttcgctgttggaacatctctaaaacttttctatcctatcgaacacttacagccttagctatcgagacgtcttgtgatgatacatcggtttctgtcgttcgaacctcagattcatcatcacattgccaaaacgagatcatttgcttaaatacacaccggacaatttcaaaatacgaggcttatggtggtatccatcctaccatagttattcatgagcatcaaaagaatttagcgaaagtaatccaaaggactatctcagatgccgcgcgtagtggtattactgattttgaccttattgctgtcacaagaggcccaggaatgattggtccccttgctgtgggtttaaatacagccaaaggcctcgcggttggccttcaaaaacctttacttgcggttcatcacatgcaagcacatgcccttgcagtgcaactagaaaagtctattgatttcccatatcttaatattcttgtctcaggtggacacactatgctagtgtattccaattctctgttaaatcacgagattattgtcacaaccagtgatattgctgtaggcgattatctggacaaatgtgcaaagtatttgggtattccttgggacaatgaaatgcctgctgctgctcttgaacagtttgcttctcctgaaataaatagtactagttattcattaaaaccgccaatcccactgaatactagagaaaaggtgcatagcgcgagcttctctttttcaggcttggagtcgtacgcctgtcgaataataaggaagacgcctttaaatctaagtgaaaaaaagttttttgcctatcaacttcaatatgctgcttttcaacatatatgtcaaaaaacgttgctagcgttgaaacgactggatttatcgaaagttaagtaccttgtatgcagtggtggtgtcgctagaaacgaattgttgaaaaagatgctgaatgatactttaatggtattgcagtttgaacatcaacctacagacatcaaattggtgtacccaagtccagatatatgcagtgataatgctgccatgataggctatactgctattcaaatgttcaaagcaggttatacatcttcatttgatgttgagcccataagaaaatggcccatcaatcagattttaaccgttgaaggttggcttacaaaaaaaaataaaaaagtataa

SEQ ID NO: 45643 - protein, 412 aa, Schizosaccharomyces pombe
MLCLVYNSILCKQRRISLKVLQQFRCWNISKTFLSYRTLTALAIETSCDDTSVSVVRTSDSSSHCQNEIICLNTHRTISKYEAYGGIHPTIVIHEHQKNLAKVIQRTISDAARSGITDFDLIAVTRGPGMIGPLAVGLNTAKGLAVGLQKPLLAVHHMQAHALAVQLEKSIDFPYLNILVSGGHTMLVYSNSLLNHEIIVTTSDIAVGDYLDKCAKYLGIPWDNEMPAAALEQFASPEINSTSYSLKPPIPLNTREKVHSASFSFSGLESYACRIIRKTPLNLSEKKFFAYQLQYAAFQHICQKTLLALKRLDLSKVKYLVCSGGVARNELLKKMLNDTLMVLQFEHQPTDIKLVYPSPDICSDNAAMIGYTAIQMFKAGYTSSFDVEPIRKWPINQILTVEGWLTKKNKKV

SEQ ID NO: 45644 - DNA, 1041 bp, Schizosaccharomyces pombe
  CDS (1)..(1041)
atgggaaaacctttaattgcacttggattagagggttcagcaaacaaattaggcgttggtattattttgcatgataccaatggatcggctaaaatattagcaaatgtcagacacacttatatcactcctcccggacagggattcttgcccagcgatactgctaagcatcatcgtgcgtggataatccctttaattaagcaagcgtttgctgaggcaaaaatttcttttaaagatattgattgcatttgtttcacaaaggggccaggaatcggtgctcctctgaatagtgtagctctttgtgctaggatgttatcactaattcacaagaaacctttagtagcagttaatcattgtattggtcacattgaaatgggtcgtgaaattacgggtgcacaaaatcctgtcgtgctttatgtttctgggggaaacactcaagtaattgcatactcagagaagaagtataggatttttggtgaaacgcttgatattgctataggcaattgtttggatcgatttgccagaatcattggtttgtccaatgcaccttcacctggttacaatattatgcaagaagcaaaaaaaggcaaaagatttatagagttaccctatactgttaaaggtatggattgttcattttccggattgttgtcaggggttgaagcggcagctacagagctattagacccaaaaaatccgagttctgttacaaagcaagatctttgttactctttacaggaaactggctttgcaatgctagttgaaattacagaacgcgcgatggcacatatcagagctgattctgttttaattgttggaggtgttggatgcaatgaacgtctccaacaaatgatggctgaaatgagttcggatagaggcgctgatgttttttctacagatgaacgtttctgtattgataatggtataatgatagcccaagcagggttgttggcttataaaaccggggaccgatgtgccgtcgcagaatcgacgattactcaaagatatcgtactgacgatgtttatatatcatggagggattaa

SEQ ID NO: 45645 - protein, 346 aa, Schizosaccharomyces pombe
MGKPLIALGLEGSANKLGVGIILHDTNGSAKILANVRHTYITPPGQGFLPSDTAKHHRAWIIPLIKQAFAEAKISFKDIDCICFTKGPGIGAPLNSVALCARMLSLIHKKPLVAVNHCIGHIEMGREITGAQNPVVLYVSGGNTQVIAYSEKKYRIFGETLDIAIGNCLDRFARIIGLSNAPSPGYNIMQEAKKGKRFIELPYTVKGMDCSFSGLLSGVEAAATELLDPKNPSSVTKQDLCYSLQETGFAMLVEITERAMAHIRADSVLIVGGVGCNERLQQMMAEMSSDRGADVFSTDERFCIDNGIMIAQAGLLAYKTGDRCAVAESTITQRYRTDDVYISWRD

SEQ ID NO: 45646 - DNA, 996 bp, Encephalitozoon cuniculi
  CDS (1)..(996)
atgatagcaatgggactggaaggaagtgccaacaaactaggtgtggggataatgcgcgatgatgagatactggcaaacgaaagactcacatatgcacctccacctggtgagggattcattccggtgaaaactgcagagcaccaccgctccagaattctgggcctcgttgccgtgtccctagagaaggctggagtagatcttgacgatgttgacatattctgctacacaaaaggtcccggaatggggctgcctttgtctgtggttgccaccgttgctcgcacactaagcctttactgtaacaagccccttgttcccgtaaaccattgtatagctcacatagaaatgggaaggttcataactaaagcaagcaatcccgtcatcctgtatgctagtggtggaaacacccaaatcatagcataccacaacagaagatacaaaattttcggggagaccctggacatagctgttggaaactgcatagacagatttgctagagcccttaagctgccgaactttcctgcacccgggcttagtgtagagagatatgcaaaactgggtaagaactacatagagctcccctatgttgtaaaggggatggatgtctcgttctccgggattttatcgaacataaagagaaaaatagcggaagatgagcaggtaaagcgcgacttgtgctactccctccaggaaacggttttttctgcactagttgaagttacagaaagagcgatggcatttagcagctctaaggaggttctgattgttggtggtgttggatgtaacctgagacttcaggagatgatgggtataatggctagagagcgtggtggggtctgctatgcaacagacgagaggttttgcatagacaatggggtgatgattgcgtatgtaggaatgctgatggctaagagcggtgctgccttcaaactgggcgagtgttttgttacacaaagatacaggacagattctgtagaggtgacttggagagattattaa

SEQ ID NO: 45647 - protein, 331 aa, Encephalitozoon cuniculi
MIAMGLEGSANKLGVGIMRDDEILANERLTYAPPPGEGFIPVKTAEHHRSRILGLVAVSLEKAGVDLDDVDIFCYTKGPGMGLPLSVVATVARTLSLYCNKPLVPVNHCIAHIEMGRFITKASNPVILYASGGNTQIIAYHNRRYKIFGETLDIAVGNCIDRFARALKLPNFPAPGLSVERYAKLGKNYIELPYVVKGMDVSFSGILSNIKRKIAEDEQVKRDLCYSLQETVFSALVEVTERAMAFSSSKEVLIVGGVGCNLRLQEMMGIMARERGGVCYATDERFCIDNGVMIAYVGMLMAKSGAAFKLGECFVTQRYRTDSVEVTWRDY

SEQ ID NO: 45648 - DNA, 1035 bp, Corynebacterium glutamicum ATCC 13032
  CDS (1)..(1035)
atgatcgttttgggaattgaaagctcctgcgatgaaacaggcgtaggcgtagtcaaacttgacggcgaaggaaacctagagatcctcgccgactcagtggcctcctccatgcaagaacatgcccgctttggtggcgtcgtgccagaaatcgcctcccgggcgcacctggaatctatggtccccgtgatgcgtgaagcgttgaggcaggcgggcgtcgacaggccagatgctgtggctgcaaccgtgggccctggtttggcgggcgcgctgctcgttggagccagcgctgcgaaggcgtatgccgctgcgtggggagttccgttttacgcggtcaaccacctgggcggacacgtcgccgtggccaatctggaaggtgaaactcttccacacgcggtggctttgctggtttccggcggacacactcaattgttggaagtcgacgcggtgggattacccatgaaggaattgggatccaccctcgacgatgccgctggcgaagcctatgacaaagtctcaaggctgttgggattgggctacccaggcggccccatcattgataaattggcgcgccggggtaatccagaggccattgctttcccccgcggattgatgaaaaagtcggattctcggcatgatttcagcttttccggtttgaaaacctccgttgcccgctacgtggaagctgcggaaagaaacggtgaagttatttccgtggaggacgtctgcgcatcattccaagaagcggtgtgtgatgtgttgacgtttaaggccgtgcgtgcgtgccgcgatgtcggtgcgaaggtgctgctgttgggtggaggagtggctgccaactctcgtctgcgggagcttgctcaagaacgttgcgataaagccgacatcgaactccgggttcctcgtttcaatttgtgcaccgataatggtgtcatgattgcagcgttggcggctcaaagaatccacgaaggtgcccaagaatcaccaatttcggtcggaactgatccttctttgtccgttgagaccccacaggtgttttaa

SEQ ID NO: 45649 - protein, 344 aa, Corynebacterium glutamicum ATCC 13032
MIVLGIESSCDETGVGVVKLDGEGNLEILADSVASSMQEHARFGGVVPEIASRAHLESMVPVMREALRQAGVDRPDAVAATVGPGLAGALLVGASAAKAYAAAWGVPFYAVNHLGGHVAVANLEGETLPHAVALLVSGGHTQLLEVDAVGLPMKELGSTLDDAAGEAYDKVSRLLGLGYPGGPIIDKLARRGNPEAIAFPRGLMKKSDSRHDFSFSGLKTSVARYVEAAERNGEVISVEDVCASFQEAVCDVLTFKAVRACRDVGAKVLLLGGGVAANSRLRELAQERCDKADIELRVPRFNLCTDNGVMIAALAAQRIHEGAQESPISVGTDPSLSVETPQVF

SEQ ID NO: 45650 - DNA, 1026 bp, Fusobacterium nucleatum subsp. nucleatum ATCC 25586
  CDS (1)..(1026)
atgattattttaggtatagaaagttcatgtgatgaaacttctattgcagttgtaaaagatggaaaagaaattttatcaaataatatttcttctcaaattgaaattcataaagaatatggtggagttgttccagaaattgcttcaagacaacatattaaaaatattgctactgtacttgaagaaagtttagaagaagcaaaaattaccttggatgatgtagactatattgcagtaacttatgccccaggattaattggggctttacttgtgggagtttcatttgcaaaaggtttatcttatgcaaaaaatattcctattatcccagttcatcatattaagggacatatgtatgcaaatttcttagaacatgatgtagagttaccttgtatttctcttgttgtgtctggtgggcataccaatattatatatattgatgaaaatcataattttattaatataggagaaaccttagatgatgcagtgggagaaagttgtgataaggttgcaagagttctaggacttggatatcctggtggacctgtgatagataagatgtattataaaggagatagagatttcttaaaaattactaaaccaaaagtttcaagatttgattttagtttctcaggaattaaaacagctattataaattttgataataatatgaaaatgaaaaatcaagaatataaaaaagaagatttagcagcttcttttttaggaactgttgtggatattctatgtgataaaactttaaatgcagcagttgaaaaaaatgtaaaaacaattatgcttgcaggtggtgttgcagctaactcacttttaagaagccaacttacagaaaaagcagctgaaaaaggaattaaagttatatacccaagtatgaaattgtgtacagataatgcagccatgatagcagaggcagcatattataagttaaaaaatgctaaaaatgaaaaagattgctttgcaggtttagacttaaatggtgttgcaagtttaatggttagtgatgaaaaagctatataa

SEQ ID NO: 45651 - protein, 341 aa, Fusobacterium nucleatum subsp. nucleatum ATCC 25586
MIILGIESSCDETSIAVVKDGKEILSNNISSQIEIHKEYGGVVPEIASRQHIKNIATVLEESLEEAKITLDDVDYIAVTYAPGLIGALLVGVSFAKGLSYAKNIPIIPVHHIKGHMYANFLEHDVELPCISLVVSGGHTNIIYIDENHNFINIGETLDDAVGESCDKVARVLGLGYPGGPVIDKMYYKGDRDFLKITKPKVSRFDFSFSGIKTAIINFDNNMKMKNQEYKKEDLAASFLGTVVDILCDKTLNAAVEKNVKTIMLAGGVAANSLLRSQLTEKAAEKGIKVIYPSMKLCTDNAAMIAEAAYYKLKNAKNEKDCFAGLDLNGVASLMVSDEKAI

SEQ ID NO: 45652 - DNA, 1230 bp, Drosophila melanogaster
  CDS (1)..(1230)
atgcatgcacttcgtaattttgccggcaatggaatagcaaatgtatttggctgtgggatcaggcgccggctcagctatgtcctgggcatcgagacctcctgcgacgacacgggcatcgccatcgtggacaccacgggccgagtgattgccaatgtgctggagtcgcaacaggagttccacacccgctatggaggcattattccgcccagggcccaggaccttcaccgcgcccgcatcgagtccgcctaccagcgctgcatggaggcggcgcaattgaagccggaccaactgacggccatcgcggtgaccacgcgtcccggactgccgctgagtttgctggtgggcgtgcgctttgcacggcacctggcccgtcgcctgcagaagcccctgctgcccgttcaccacatggaggcgcacgcgctgcaggcccgcatggaacatccggagcagatcggctaccccttcctctgcttgctggccagcggcggccactgtcagttggtggtggctaacggccccggtcgccttacgcttcttggccaaacactggatgatgcgcccggcgaggcctttgacaagatcggtcggcgactacgcctgcacattctgccggagtaccgcttgtggaacggaggacgggccattgagcatgccgcccagctggccagcgatccgctggcctacgagtttccgctgccacttgcccagcagcggaactgcaacttcagcttcgccggcatcaagaacaactccttccgggccatccgagcgcgcgagcgggcagagcggacacctccggacggagtcatcagcaactacggcgacttctgcgccggcctgctgcgctctgtcagccggcacctgatgcaccgcacgcagcgggcaattgagtactgcctcctgccgcacaggcagctcttcggtgacaccccgcccacactggtcatgtccggcggtgtggccaacaacgatgccatatacgccaacatcgaacatctggccgcgcagtatggctgcaggagcttccgtccatcgaagcggtactgctccgacaacggcgtcatgatcgcctggcacggcgttgagcaactgctgcaggataaagaggccagcacgcgctacgactacgacagcattgatatccagggcagcgcgggattcgccgagtcgcacgaggaagctgtcgctgcggcggccataaaatgcaagtggatacagccactggtttga

SEQ ID NO: 45653 - protein, 409 aa, Drosophila melanogaster
MHALRNFAGNGIANVFGCGIRRRLSYVLGIETSCDDTGIAIVDTTGRVIANVLESQQEFHTRYGGIIPPRAQDLHRARIESAYQRCMEAAQLKPDQLTAIAVTTRPGLPLSLLVGVRFARHLARRLQKPLLPVHHMEAHALQARMEHPEQIGYPFLCLLASGGHCQLVVANGPGRLTLLGQTLDDAPGEAFDKIGRRLRLHILPEYRLWNGGRAIEHAAQLASDPLAYEFPLPLAQQRNCNFSFAGIKNNSFRAIRARERAERTPPDGVISNYGDFCAGLLRSVSRHLMHRTQRAIEYCLLPHRQLFGDTPPTLVMSGGVANNDAIYANIEHLAAQYGCRSFRPSKRYCSDNGVMIAWHGVEQLLQDKEASTRYDYDSIDIQGSAGFAESHEEAVAAAAIKCKWIQPLV

SEQ ID NO: 45654 - DNA, 1041 bp, Methanopyrus kandleri AV19
  CDS (1)..(1041)
atgatctgtgtgggtatagagtctacggccgagaaactcggcgtgggtgtcgtgacggacgacggggagatactggtcaacgtgaaggctcagtacatcccccctccgggctcggggatactacccagagaggcggctgaacatcactccagagaactgccggagctcctcgaacgcgcgttgaagaacgcgggagtggagcccgaagacatcgacttagtggcttactcgcaagggcctggactgggaccctgcctacgtgtcggcgccaccgcggcccgaaccctggcactgacgctcgaggtccccctggcaccggtcaaccactgcgtggcccacgtggagatagggaagttagcggcacgccaggacgggttcgatttcgacgagccggtaacactctacgtgtccggagggaacacccaggtgctggccctcaaagccggacgataccgggtgttcggggaaaccctggatctccccgtgggtaacatgctggacactttcgcccgtaaggtcggactcccacatcccggtgggcccgagatagaacgcctcgccgaggaaggtgagcccgtggaactcccttacactgtacgtggcaccgacgtgtcgttctcaggccttctgacggcggcactgcggagatacgagcagggagacaggctcgaggacgtgtgtgcaggacttcaggagacagccttcgcaatgctggtggagataacggagcgtgccgcggcccagctgggccgggatgagatcctgctcacgggaggggtggccgcgaaccgtcgtctctccgagatgatgcacgaaatggcggaggaccgcggtgcggaggcgtacacggtgcccccggaactggccggagacaacggggccatgatcgcttggacggggatcctcgtccacgaacacggcctctcgataccgcccgatgagatcccggagaaggctatcgtcaagcaacgataccgtgtagacgaggcgcccgtcccgtgggccgctcgtccttccagatcggccgattctcaaggatag

SEQ ID NO: 45655 - protein, 346 aa, Methanopyrus kandleri AV19
MICVGIESTAEKLGVGVVTDDGEILVNVKAQYIPPPGSGILPREAAEHHSRELPELLERALKNAGVEPEDIDLVAYSQGPGLGPCLRVGATAARTLALTLEVPLAPVNHCVAHVEIGKLAARQDGFDFDEPVTLYVSGGNTQVLALKAGRYRVFGETLDLPVGNMLDTFARKVGLPHPGGPEIERLAEEGEPVELPYTVRGTDVSFSGLLTAALRRYEQGDRLEDVCAGLQETAFAMLVEITERAAAQLGRDEILLTGGVAANRRLSEMMHEMAEDRGAEAYTVPPELAGDNGAMIAWTGILVHEHGLSIPPDEIPEKAIVKQRYRVDEAPVPWAARPSRSADSQG

SEQ ID NO: 45656 - DNA, 1644 bp, Methanosarcina acetivorans C2A
  CDS (1)..(1644)
ttgaaaaacacattcatccttggaatcgaaggcactgcctggaacctgagtgccgcaatcgtgaccgagaccgagatcattgcagaggtcacggagacctataaacccgaagtaggcggaatccaccccagagaagccgcccagcaccatgcaaagtatgcagcaagtgttatcaaaagactccttgcagaagcaaaagaaaaaggagtggaaccttcagatcttgacggcatagctttttcacagggacccgggctcgggccctgcctgaggaccattgcaaccgcagccaggatgctttccctgtccctggacattcctcttataggggtcaaccactgcatcgcccatatagaaatagggatctggcgaaccccggcaagagatcctgtagttctctatgtaagcggggcaaattcccaggtcatctcatttatggaagggcgctacagggtctttggcgaaacccttgatatcgggcttgggaacgcccttgacaagtttgcgcggagagcaggtctgcctcaccccggggggcctaaaatcgaagcctgcgcaaaagacgcaaaacgatatatccctcttccttatgtgattaaggggatggacctctctttttccgggctttccacggcttcaagcgaagccctgaaaaaagcctcccttgaagatgtctgctactcctatcaggaaaccgcttttgcaatggttgtggaggttgcggaacgcgcccttgcccacaccggaaaaaatgaagtgctgctggcaggcggggttggagcaaacacaaggcttcgcgagatgttaaatgagatgtgtgaagccagaggggcaaagttctatgtgcccgaaaaacgcttcatgggcgacaacgggacgatgatcgcatacaccgggctcctgatgtataagtcaggaaataccctgacccttgaggattcgcgggtgaacccgaatttcaggaccgatgacgtgaacgttacctggataaaagaagaagagatgaaaaaagtcccggaaatctctcccgaggctttcctcagggcgcccccaggagaaaggctggacaacggagctgaagctgttatttaccttgacgaggggccggaagggaaaaaagtgcttgttaaggaaagggtcccgaagctttacagacacaaagagatagatgaaaggatcaggagggaaaggaaccggacagaagcccgtttgatatctgaagccaggcgggcaggagtgcccacgccgatcatctatgacattgaggaattcaagctcaaaatgcagttcatcgaaggagtccccataaagtacctcataacccccgagctttcggaaaaagtcggagagcttgtaggcaggctgcacagttcggggatagtccacggcgaccttaccacctcaaacctcctgcttgcaggggaacgactttacctcatcgacttcgggcttgcctactttgacaaaagcctggaagccagaggagtggacgtccatgtacttttccagacctttgaaagtacgcaccgcggccacgaaacccttgtcaaagcctttgaaaaagggtatggaagtacttttatagattcaaaggatgtactcaagcgagttgaagagataaaaaagagggctcgctatgcataa

SEQ ID NO: 45657 - protein, 547 aa, Methanosarcina acetivorans C2A
MKNTFILGIEGTAWNLSAAIVTETEIIAEVTETYKPEVGGIHPREAAQHHAKYAASVIKRLLAEAKEKGVEPSDLDGIAFSQGPGLGPCLRTIATAARMLSLSLDIPLIGVNHCIAHIEIGIWRTPARDPVVLYVSGANSQVISFMEGRYRVFGETLDIGLGNALDKFARRAGLPHPGGPKIEACAKDAKRYIPLPYVIKGMDLSFSGLSTASSEALKKASLEDVCYSYQETAFAMVVEVAERALAHTGKNEVLLAGGVGANTRLREMLNEMCEARGAKFYVPEKRFMGDNGTMIAYTGLLMYKSGNTLTLEDSRVNPNFRTDDVNVTWIKEEEMKKVPEISPEAFLRAPPGERLDNGAEAVIYLDEGPEGKKVLVKERVPKLYRHKEIDERIRRERNRTEARLISEARRAGVPTPIIYDIEEFKLKMQFIEGVPIKYLITPELSEKVGELVGRLHSSGIVHGDLTTSNLLLAGERLYLIDFGLAYFDKSLEARGVDVHVLFQTFESTHRGHETLVKAFEKGYGSTFIDSKDVLKRVEEIKKRARYA

SEQ ID NO: 45658 - DNA, 1689 bp, Methanosarcina mazei Go1
  CDS (1)..(1689)
gtgacagtaagcagaggaaaaggaacggaaaggagacctgaagccttgaaaaaaacattcatccttggaatcgaaggcactgcctggaacctgagtgccgcaatcgtgaccgagaccgagatcattgccgaggttacagagacatataaacctgaaaaaggcggaatccaccccagggaagccgcccagcaccatgcaaaatatgcggcaggcgttatcaaaaaactccttgcagaagcaaagcaaaacgggatagagccgtcagacctcgacggcatagctttttcacaggggcctggacttgggccgtgcttaaggaccgttgcaacggcagccaggatgctcggcctttcccttggcatcccgcttataggagtcaaccactgtattgcacatattgagatagggatctggaaaactcctgcaaaggaccctgttgtgctctatgtgagcggggcaaattcccaggtaatctcttatatggaagggaggtacagggtttttggagaaacccttgatataggacttggaaatgcccttgataaattcgctcgcggagcaggcttgcctcacccgggtgggcccaaaatcgaggcatatgcaaaagaagcaaagagatatatccctctcccgtacgtgattaaaggtatggacctctcattttccgggctttcaacagctgcaagtgaagccctgagaaaagcctcccttgaagatgtctgttattcttatcaggagactgcctttgcaatggttgtggaggttgcagaacgcgcccttgcccatacaggaaaaaaagaagtgctgcttgcaggcggggtgggagcaaacaccaggcttcgtgagatgttaaatgaaatgtgtgaagccagaggtgcaaagttctatgttcccgaaaaacgctttatgggcgacaacgggacaatgatcgcatacacagggctcctgatgtataagtccggaaataccatttcccttgaagattcgcgcgtaaaccccagtttcaggacagatgatgtcaaagtgacatggataaaggaagaagagatgaaaaaggtccctgaaatctcccctgaaactttcttcaggatgcctcccggggaaattctcgacaacggggctgaagctgttgtctaccttcaagagggacctgaaggtaagagggcgctggtcaaggaaagggtcccaaaggcttacaggcataaagagatagacgagaggataagaagagagaggaacaggacagaagcccgccttatgtctgaagccaggcgcgcaggcgtgcccactccaatcatctatgacgttgaggaattcaagcttaaaatgcagttcatcgaaggggtccccataaagtaccttataacccccccactttcggaaaaggttggagagctcgtgggcaaactgcacagttcaggcatcgtacatggagaccttacaacctcaaacctcctgcttgcaggtgagaggctttatcttatcgacttcgggcttgcgtattttgacaaaagccttgaagccagaggtgtggacgtccatgtgcttttccagacttttgagagcactcaccgcaactatgaagcccttgtcaaagctttcgagaaagggtatgcaagtacttttatagattcagaggatgtactcaggcgagttgaagagataaaaaagagggctcgctatgcataa

SEQ ID NO: 45659 - protein, 562 aa, Methanosarcina mazei Go1
MTVSRGKGTERRPEALKKTFILGIEGTAWNLSAAIVTETEIIAEVTETYKPEKGGIHPREAAQHHAKYAAGVIKKLLAEAKQNGIEPSDLDGIAFSQGPGLGPCLRTVATAARMLGLSLGIPLIGVNHCIAHIEIGIWKTPAKDPVVLYVSGANSQVISYMEGRYRVFGETLDIGLGNALDKFARGAGLPHPGGPKIEAYAKEAKRYIPLPYVIKGMDLSFSGLSTAASEALRKASLEDVCYSYQETAFAMVVEVAERALAHTGKKEVLLAGGVGANTRLREMLNEMCEARGAKFYVPEKRFMGDNGTMIAYTGLLMYKSGNTISLEDSRVNPSFRTDDVKVTWIKEEEMKKVPEISPETFFRMPPGEILDNGAEAVVYLQEGPEGKRALVKERVPKAYRHKEIDERIRRERNRTEARLMSEARRAGVPTPIIYDVEEFKLKMQFIEGVPIKYLITPPLSEKVGELVGKLHSSGIVHGDLTTSNLLLAGERLYLIDFGLAYFDKSLEARGVDVHVLFQTFESTHRNYEALVKAFEKGYASTFIDSEDVLRRVEEIKKRARYA

SEQ ID NO: 45660 - DNA, 1065 bp, Xanthomonas campestris pv. campestris str. ATCC 33913
  CDS (1)..(1065)
atgaaagtgcttgggatcgaatcatcctgcgatgagaccggggtggcggtgtacgacaccgcgctgtccggcgtgccggcgctgcgcgcccatgcggtctatagccagatcgcgctgcatgccgaatacggcggcgtggtgccggagctggccagccgcgaccatgtgcgcaagctgctgccgctgatccgtcagaccctggacgaggccgggttgcgcatcgatgagctggacggggtggcctataccgccggtccgggcctggtcggtgccttgctagtaggtgcgggggtagcgcgcgcgctggcctgggcactggaggtgccggcgatcggcgtgcaccacatggaaggccacctgctggccccgttgatggaagacgacccgccgcagccgccgttcgtggcactgctggtgtctggcggccacacccagctggtctcggtgaaggcgctgggcgcgtatgaagtgttgggcgaaacgctggacgacgccgccggcgaagccttcgacaagactgccaagatgatggggctgccgtatccgggcggcccgcagctggcggcgttggccgaaaccggcacgccggggcgctacaagttcgcgcggccgatgaccgaccgccccgggctggacttcagtttcagcgggctcaagacccaggtgctgctggcctggcgcggcagcgaccaatccgacaccacccgcgccgacatcgcgcgcgggttcgaggacgcagtggtggagacgctggcgatcaagtgcttgcgcgcgctggacaccgccgactgcaacaccctggtggtggccggcggcgtgggcgccaacaagcgcctgcgggcccgcctgcaggaggccgcgcaacgccgcggcggccgggtctgcttcccgcgcccggccctgtgcaccgacaacggcgccatgattgccttcgccggcgcgctgcgcctggaagccggcgagcacgccgatgccgcggtgcaggtgacgccgcgttgggatatggcgagcttgccgccgctggcggcggcgcgggagtcgggaatcgggaatcgggaatcgtaa

SEQ ID NO: 45661 - protein, 354 aa, Xanthomonas campestris pv. campestris str. ATCC 33913
MKVLGIESSCDETGVAVYDTALSGVPALRAHAVYSQIALHAEYGGVVPELASRDHVRKLLPLIRQTLDEAGLRIDELDGVAYTAGPGLVGALLVGAGVARALAWALEVPAIGVHHMEGHLLAPLMEDDPPQPPFVALLVSGGHTQLVSVKALGAYEVLGETLDDAAGEAFDKTAKMMGLPYPGGPQLAALAETGTPGRYKFARPMTDRPGLDFSFSGLKTQVLLAWRGSDQSDTTRADIARGFEDAVVETLAIKCLRALDTADCNTLVVAGGVGANKRLRARLQEAAQRRGGRVCFPRPALCTDNGAMIAFAGALRLEAGEHADAAVQVTPRWDMASLPPLAAARESGIGNRES

SEQ ID NO: 45662 - DNA, 1059 bp, Xanthomonas axonopodis pv. citri str. 306
  CDS (1)..(1059)
gtgaaagttcttgggatcgaatcatcgtgcgatgagaccggcgtagcggtctacgacaccgaattatccggcgtgccggcgctgcgcgcgcatgcggtctacagccagatcgcgctgcatgccgaatacggcggcgtggtaccggagcttgccagccgcgaccatgtgcgcaagctgctgccgctgatccgccagaccctgggcgaggccgggctgcgcatcgacgaactggatggtgtggcctacaccgcggggccggggctggtcggcgcattgctggtcggtgccggcgtggcgcgctcgctggcctgggcattggatgtgccggcgatcggcgtgcaccatatggaaggccacttgctggcgccgttgatggaagacgacccgccgcaggcgccgttcgtggccttgctggtatccggcgggcatacccaactggtgtcggtgaaggcgctgggcagctaccaagtgctgggcgagacgctggacgatgcggccggcgaagccttcgacaagaccgccaagatgatgggcctgccgtacccgggcggcccgcagctggccgccttggccgaaaccggcacgccggggcgctataagttcgcgcggccgatgaccgaccggcccggcctggatttcagtttcagtgggctcaagacccaggtgctgctggcctggcggtccagcgaccagtccgacaccacccgggcggacatcgcgcgcggcttcgaagacgcggtggtggacaccctggccatcaagtgcctgcgcgcgctggacgcggccggctgcgacaccctggtggtggccggcggcgtgggcgcaaacaagcgcctgcgcgcgcgcctgcaagaggctgcccagcgccgcggcggccgggtctgcttcccgcgcccggccttgtgcaccgacaacggcgcgatgatcgccttcgccggcgcgctgcggctgcaggccggtgagcatgcggatgcggcggtgcatgtgacgccgcggtgggatatggcggcgctgccgccactggcggcgcaggaatcgggagtggggaatcgggaatag

SEQ ID NO: 45663 - protein, 352 aa, Xanthomonas axonopodis pv. citri str. 306
MKVLGIESSCDETGVAVYDTELSGVPALRAHAVYSQIALHAEYGGVVPELASRDHVRKLLPLIRQTLGEAGLRIDELDGVAYTAGPGLVGALLVGAGVARSLAWALDVPAIGVHHMEGHLLAPLMEDDPPQAPFVALLVSGGHTQLVSVKALGSYQVLGETLDDAAGEAFDKTAKMMGLPYPGGPQLAALAETGTPGRYKFARPMTDRPGLDFSFSGLKTQVLLAWRSSDQSDTTRADIARGFEDAVVDTLAIKCLRALDAAGCDTLVVAGGVGANKRLRARLQEAAQRRGGRVCFPRPALCTDNGAMIAFAGALRLQAGEHADAAVHVTPRWDMAALPPLAAQESGVGNRE

SEQ ID NO: 45664 - DNA, 1044 bp, Drosophila melanogaster
  CDS (1)..(1044)
atggtttgcgctttgggtattgaaggcagtgccaataaaattggcattggcataattcgagatggtaaagtactggcgaacgtacgtagaacgtacattaccccaccaggagaaggtttcctgcccaaggaaacggccaaacatcacagggaagccatcctgggcttggtggaatccagtctaaaggaagcccaattgaaatcctctgatctagatgttatttgttacacaaaaggcccaggaatggctcctcctttgctggttggcgccattgtggctcgcactttgtcgctcttgtggaatatcccgctgctgggcgtaaatcactgcattggacacatcgagatgggtcgcctgatcaccggtgcccagaatcctacagttctctatgtgagcggtggaaacacacaggttattgcctactccaataagcgatatcgcatctttggcgaaactatagacattgcagtgggcaattgcctggatcgattcgcccgcatcattaagctgtccaacgatcctagtccgggctacaacatcgagcagctggccaagtcgagcaatcgttatattaaactgccctatgtggttaagggcatggatgtcagcttctcggggattttatcctacatcgaggacctggcagagccgggcaagaggcaaaataagagaaaaaagccacaggaagaagaggtcaataattacagccaagccgatctttgctattcgctgcaggagaccatcttcgccatgttggtggagatcacagagcgcgccatggcacactgcggctcaaatgaggtccttatagttggaggtgtgggttgcaatgagcgactccaggagatgatgcgtattatgtgcgaggaacgcggaggcaaactctttgccactgatgaacgttactgcatagacaacggactaatgattgcccatgctggtgcagaaatgttccgctctggcactaggatgccctttgaggaatcttatgtgactcagcgatttcgaacggacgaagtgctggtcagctggcgggatgactaa

SEQ ID NO: 45665 - protein, 347 aa, Drosophila melanogaster
MVCALGIEGSANKIGIGIIRDGKVLANVRRTYITPPGEGFLPKETAKHHREAILGLVESSLKEAQLKSSDLDVICYTKGPGMAPPLLVGAIVARTLSLLWNIPLLGVNHCIGHIEMGRLITGAQNPTVLYVSGGNTQVIAYSNKRYRIFGETIDIAVGNCLDRFARIIKLSNDPSPGYNIEQLAKSSNRYIKLPYVVKGMDVSFSGILSYIEDLAEPGKRQNKRKKPQEEEVNNYSQADLCYSLQETIFAMLVEITERAMAHCGSNEVLIVGGVGCNERLQEMMRIMCEERGGKLFATDERYCIDNGLMIAHAGAEMFRSGTRMPFEESYVTQRFRTDEVLVSWRDD

SEQ ID NO: 45666 - DNA, 1062 bp, Chlorobium tepidum TLS
  CDS (1)..(1062)
atgaatattttagggatagaaaccagttgcgacgaaacctcggcggctgtcctcagcgatggatcggtccggtcgaacattgtcagttctcagcgatgccataccgatttcggcggtgtggtgccggagctggcttcacgggagcatgagcgactgatcgtctcgatcgtggatgccgccataaccgaagcaaatatagcaaaaaatgacctcgatgtcatagccgctaccgccgggccggggctgatcggcgcggtgatggtggggctttgctttgccgagggcctggcctgggcgcttggcaagcccttcgtgccggtcaaccatgtcgaggcgcacatcttttcacccttcatcagcgacgaacctggccaccgcgagccgaagggcgacttcgtttcgctgaccgtctccggaggccacacattgctgtcggtcgtgcggcaggatctgggctacgaggtaatcggacgcaccatcgacgacgcggcgggcgaggcgttcgacaagaccggcaagatgcttggcctcggttatccggcggggccggtgatcgaccggcttgcccgcgagggcgattcggatttccaccgttttccccgagccctgaccgcaagttcgcagacaagcaagagttaccggggcaacttcgacttcagcttctctggcctcaaaacctccgtgcgcacctggctcgaagctcacgactcggagtatgtccaaaagcatcaggctgaccttgcagcctcaatccagtcagcgattgttgaggtgctggtcgaaaagagcgtcgccgccgcgctcttgcataaagtcaatgccatttcggtggcgggcggcgtgagcgccaactccggcctccgctcggcgatgcaggcggcctgcgaccggcacggcatcgaactcttcattcccgcgctcgcctactcgaccgacaatgcagcaatgatcgccaccatggcgcagttgatgattgcgcgaggcaagtaccggatcgaggataattcctatggcgtagcgccttttgcccgcttcgaggcagccagaaaaggggcgcgttga

SEQ ID NO: 45667 - protein, 353 aa, Chlorobium tepidum TLS
MNILGIETSCDETSAAVLSDGSVRSNIVSSQRCHTDFGGVVPELASREHERLIVSIVDAAITEANIAKNDLDVIAATAGPGLIGAVMVGLCFAEGLAWALGKPFVPVNHVEAHIFSPFISDEPGHREPKGDFVSLTVSGGHTLLSVVRQDLGYEVIGRTIDDAAGEAFDKTGKMLGLGYPAGPVIDRLAREGDSDFHRFPRALTASSQTSKSYRGNFDFSFSGLKTSVRTWLEAHDSEYVQKHQADLAASIQSAIVEVLVEKSVAAALLHKVNAISVAGGVSANSGLRSAMQAACDRHGIELFIPALAYSTDNAAMIATMAQLMIARGKYRIEDNSYGVAPFARFEAARKGAR

SEQ ID NO: 45668 - DNA, 1062 bp, Thermosynechococcus elongatus BP-1
  CDS (1)..(1062)
atggtaagaattctggccattgaaaccagttgcgatgaaacggcggctgccgtagtgcgcgatcgcgccattgaaagtaatgtgattgcctcgcaagtgtgcgcccatcaaccctttggcggtgtggtgccggaggttgcctcccgtgcccacttagaaaacattaatggggtcatcaccgcagccatcagtgaggccggttgcgattggtctgccattgatgccattgccgtcacctgtgcccccggcttggtagggtcgctgctcattggggttacggccgcaaaaacccttgcccttgtgcaccaaaagcccctcttgggcattcaccaccttgaaggccacctctatgcctcctacttagcggagccaacccttgaaccaccgtttctctgccttttggtctctggtgggcataccagtctcattggcgtttatggctgtggcgagtaccagctttttgggcaaacgcgggatgatgcagcaggtgaagcctacgataaggtcgcacggctaatgggcttggggtatccagggggaccactgctcgatcgctgggcgcagcaggggaatccagaggcttttgatctaccagagggaaatatccgcctcccagatggcaaggtgcatccctacgatgccagttttagtggactgaaaaccgcagtggcacggctggtggcggagctacgtcaaacccatcctgagttgccggtggctgacctcgcggccagttttcagaaggctgtggcacaggccctgaccaagcgggcgatcgcggcagcggtggatcatggcttcaaaaccctagccattgggggaggagtagcggcaaattctggcctgcgacaacacctcactgcggctgctgaacccttgggactacggttaatttttccgcccctgcggctgtgtaccgataatgcggccatgattggctgtgccgcggccgatcacttccagcggggcgatcgctcccccttggacttaactgcgcgttcacgcctcagcttgttggagatttctgccctctatggacccacgcccctggcagtaagttaa

SEQ ID NO: 45669 - protein, 353 aa, Thermosynechococcus elongatus BP-1
MVRILAIETSCDETAAAVVRDRAIESNVIASQVCAHQPFGGVVPEVASRAHLENINGVITAAISEAGCDWSAIDAIAVTCAPGLVGSLLIGVTAAKTLALVHQKPLLGIHHLEGHLYASYLAEPTLEPPFLCLLVSGGHTSLIGVYGCGEYQLFGQTRDDAAGEAYDKVARLMGLGYPGGPLLDRWAQQGNPEAFDLPEGNIRLPDGKVHPYDASFSGLKTAVARLVAELRQTHPELPVADLAASFQKAVAQALTKRAIAAAVDHGFKTLAIGGGVAANSGLRQHLTAAAEPLGLRLIFPPLRLCTDNAAMIGCAAADHFQRGDRSPLDLTARSRLSLLEISALYGPTPLAVS

SEQ ID NO: 45670 - DNA, 1026 bp, Oceanobacillus iheyensis HTE831
  CDS (1)..(1026)
gtgggtgaatctgaaatgaaaaaagatacgattatattaggtatagaaacaagttgtgatgaaaccgcagcctctgtagtaaaaaacggtagagagattatgtccaatgtagttgcatctcaaattgaaagtcataaacgcttcggaggagtagttcctgaaattgcatcaaggcatcacgttgaacaaattacacttgtgcttgaacaagcaattactgaggctgatgttacttgggaagatatagatgcaatcgcagttacagaaggaccaggattagtaggagctttattagtaggtgtaaatgcagcgaaagcattagcgtttgctaagaagaaaccattagttggggttcaccatattgctggtcatatttatgcaaatagactagagcatgaatttgtgtttccgatgttagcccttattgtttctggtggacacacagaattagtcctaatgaaggaacatggagactatgaattaataggggagacaagagatgatgctgcaggagaagcatatgataaggtcgcccgtatgttgaaattgccttatccaggtggtccacaaattgatcgcttagctgctaaaggtgaggaaacgattgaatttcctcgtgcttggttagaagcagatagttatgattttagttttagtggattgaagtctgccgttataaataaaattcataacgcaaagcaacgtgatttgacgttaagtgcagaagatattgctgcaagttttcaagcgagtgttgtggaagtactgacagaaaaaacatatcgtgcagcgaaagaatataacgtaaatcaagttattgtagcgggtggagtagctgctaatacaggtttaagaaaaagcctagagaaacgtttctcaggcgaagattttccattatatattccaccaattcaattatgtacagataatgctgcaatgattgccgcagcaggtacgatatcgtttgaaaaggggcatcgttcattactcgatttaaatgcaaatccttcacttatactgagttag

SEQ ID NO: 45671 - protein, 341 aa, Oceanobacillus iheyensis HTE831
MGESEMKKDTIILGIETSCDETAASVVKNGREIMSNVVASQIESHKRFGGVVPEIASRHHVEQITLVLEQAITEADVTWEDIDAIAVTEGPGLVGALLVGVNAAKALAFAKKKPLVGVHHIAGHIYANRLEHEFVFPMLALIVSGGHTELVLMKEHGDYELIGETRDDAAGEAYDKVARMLKLPYPGGPQIDRLAAKGEETIEFPRAWLEADSYDFSFSGLKSAVINKIHNAKQRDLTLSAEDIAASFQASVVEVLTEKTYRAAKEYNVNQVIVAGGVAANTGLRKSLEKRFSGEDFPLYIPPIQLCTDNAAMIAAAGTISFEKGHRSLLDLNANPSLILS

SEQ ID NO: 45672 - DNA, 1080 bp, Brucella suis 1330
  CDS (1)..(1080)
atgcgcgttcttggaatagaaacaagttgcgacgaaacagccgccgcaatcgtcgagcgtgacgatatgggcgaagggcggattttgtccaatgtggttctgagccagattgccgagcacgagccctatggcggcgtggtgccggagatcgccgcccgcgcccatgtcgaggcattggacaggctggtggaccgtgccctgaacgacgcgggcctgaaactgtacgaggtggatgcagtggccgctacggctggccccggcctcatcggcgggctgatcgtcgggctgatgacggcaaaggcgctcgccatggctgcacaaaagcccttctatgccgtcaaccatctggaaggccacgcgctgacggcgcggctgaccgacggcctgccatttccctatctgctgcttctcgtttccggtggccacacgcagatggtgcttgtgcgcggcatcggcgattatgagcgcctcggcaccaccatcgacgatgcgctgggcgaagccttcgacaagaccgcaaagcttctcggcctgccttatcccggtggcccggctgtcgagcgcatggcgctacagggcgaccagaagcgttttgccctgccgcgcccgctgaaaggcgaagcacggctggatttttccttctccggccttaaaaccgccgtccgccagaccgcaaccgaattggtgcctctcaccgatcaggacgtcaccgatatatgcgcctcgtttcaggctgctgtcgccgatacgctttccgaccgtgtgggccgctcgctggagcgtttcaagacggaattcccggattgcgccacgccctccctggtggttgcaggcggggttgcagccaacaagaccctgcgtgccgcactggaaaacctctgcacccggcatggctttgcctttatcgctccgccgcttaatctttgcaccgacaatgcagcgatgatcgcatgggcgggggctgagcgcgccgcgacccaagcgcctgattcgcttgacatcgccccgcgctcgcgctggccgctcgacgaaaaatccgcgccggtcttcggcacgggacggcggggagcaaaggcatga

SEQ ID NO: 45673 - protein, 359 aa, Brucella suis 1330
MRVLGIETSCDETAAAIVERDDMGEGRILSNVVLSQIAEHEPYGGVVPEIAARAHVEALDRLVDRALNDAGLKLYEVDAVAATAGPGLIGGLIVGLMTAKALAMAAQKPFYAVNHLEGHALTARLTDGLPFPYLLLLVSGGHTQMVLVRGIGDYERLGTTIDDALGEAFDKTAKLLGLPYPGGPAVERMALQGDQKRFALPRPLKGEARLDFSFSGLKTAVRQTATELVPLTDQDVTDICASFQAAVADTLSDRVGRSLERFKTEFPDCATPSLVVAGGVAANKTLRAALENLCTRHGFAFIAPPLNLCTDNAAMIAWAGAERAATQAPDSLDIAPRSRWPLDEKSAPVFGTGRRGAKA

SEQ ID NO: 45674 - DNA, 1017 bp, Leptospira interrogans serovar Lai str. 56601
  CDS (1)..(1017)
atgatcggaatgggaatcgaaaccagttgtgatgaaacatcgattgggatcgtgcgcgatggtaaggacttacttagccttaaaattttcagtcagatcgatttacataaaccctacggagggattgttccagaaatcgcctctagggctcatttagaaaaaatcaatcttttactcgaagaagcgatggaagaatctgagattcaatttaaagatctttcttacgtcgctgtgacttcttctcctggtttgactggttctttgatggtaggagcccagatggcccgttgtattcacatggtatacgaaactccgattttacctgtatgccatcttcagtctcattttgctgtgttacatttggagggagttcccacagaatttcctgttttaggacttttactttccggagggaattcggccatttacatcttacatgaatttggtaaaatggaactgttaggagatacgatggatgacgctttaggggaggcctttgataaagtggcaggccttttagaacttccttatcctggcggacctcatatagaagtgagggcgaaagaatacaaaccatctccaaatgaaaaaccgatccttccagcacttttacgaaatcttccacaagaagaggtatctttttcttttagcggactgaaaaccgctgtgatggtattattggaaaagcaaaaagaactttcaaaagaaaggatttgttggaattttcagaattctgcgtttgatctagttgaaagaaatcttaaacgagcagtttcgaaaaccgggatcaaacgtatttttgccgcgggaggggtgcttgcaaacttcactcttcagaatcggttgtatacctgggccgaaaaaaattccgtggaactttttgctcccaagaaaaaaatttattgtactgataacggtgcaatggtagcgtcgctgggatactatttgtttcaaaaaggttatcaaagagatattgattttacggtcagtccatccagacaggagattttttcatga

SEQ ID NO: 45675 - protein, 338 aa, Leptospira interrogans serovar Lai str. 56601
MIGMGIETSCDETSIGIVRDGKDLLSLKIFSQIDLHKPYGGIVPEIASRAHLEKINLLLEEAMEESEIQFKDLSYVAVTSSPGLTGSLMVGAQMARCIHMVYETPILPVCHLQSHFAVLHLEGVPTEFPVLGLLLSGGNSAIYILHEFGKMELLGDTMDDALGEAFDKVAGLLELPYPGGPHIEVRAKEYKPSPNEKPILPALLRNLPQEEVSFSFSGLKTAVMVLLEKQKELSKERICWNFQNSAFDLVERNLKRAVSKTGIKRIFAAGGVLANFTLQNRLYTWAEKNSVELFAPKKKIYCTDNGAMVASLGYYLFQKGYQRDIDFTVSPSRQEIFS

SEQ ID NO: 45676 - DNA, 1017 bp, Shewanella oneidensis MR-1
  CDS (1)..(1017)
atgcgggttctaggtattgagacatcctgtgacgagacaggtattgccgtttatgacgataagctggggttactttcccatgctttatatagtcaggttaagttacatgcagattatggtggtgtggtgcctgaactcgcctcccgcgaccatgtgcgcaaaattgtccccttgatccgccaagcgttgaaaaacgccaatactgatattgctgacatcgatggtatcgcttacaccaaaggcccaggattaattggggctttattagtgggcgcttgtgttggtcgctcgcttgcctttgcatggaacaaacctgccatcggcgtgcaccatatggaagggcatttgcttgcgcctatgctggaagaggatgcaccagagtttccttttgttgcactgttagtgtcaggcggtcattccatgttggtcaaggttgatggcattggcctttatgcagtcttaggtgaatcagttgatgatgctgccggtgaagcctttgataaaacggccaagttaatggggcttgattatccaggtggaccacgtttagccaaacttgcggcaaaaggtgaacctgcaggttatcaatttccgcgcccaatgaccgacagaccagggcttgatttcagcttctcaggccttaaaactttcaccgctaataccattgcggctgaacctgatgatgaacaaacccgtgccaatatcgccagagcttttgaagaagcggtagttgatactttagcgataaaatgtcgccgcgcgttaaaacaaacgggctataaccgtttagtgattgctgggggggtgagtgctaatacccgcttacgggaaaccttggctgagatgatgacctccattggtggccgggtttattatcctcgcggcgagttttgtactgacaatggcgccatgattgcctttgccggattgcaacgcttaaaagcagggcagcaggaagacttagcagtaaaaggtcaaccaagatggccgcttgataccttaccgcccttggcttga

SEQ ID NO: 45677 - protein, 338 aa, Shewanella oneidensis MR-1
MRVLGIETSCDETGIAVYDDKLGLLSHALYSQVKLHADYGGVVPELASRDHVRKIVPLIRQALKNANTDIADIDGIAYTKGPGLIGALLVGACVGRSLAFAWNKPAIGVHHMEGHLLAPMLEEDAPEFPFVALLVSGGHSMLVKVDGIGLYAVLGESVDDAAGEAFDKTAKLMGLDYPGGPRLAKLAAKGEPAGYQFPRPMTDRPGLDFSFSGLKTFTANTIAAEPDDEQTRANIARAFEEAVVDTLAIKCRRALKQTGYNRLVIAGGVSANTRLRETLAEMMTSIGGRVYYPRGEFCTDNGAMIAFAGLQRLKAGQQEDLAVKGQPRWPLDTLPPLA

SEQ ID NO: 45678 - DNA, 1011 bp, Streptococcus mutans UA159
  CDS (1)..(1011)
atgatagatagatacattttagccatcgaatcatcctgtgatgaaaccagtgtggccattttaaaaaatgaagatcaacttttaagcaatattattgccagtcaggtagaaagtcataagcgttttggtggtgtggtaccagaagttgccagtcgtcaccatgttgaagtcattacgctttgtattcaggatgctttgcaggaagctggaattactgcaggtgatttatctgctgttgcggtaacttatggtccgggtcttgttggagcccttttggtaggaatggcagcagctaaagcttttgcttgggctaatcatttgcccttaattccagttaatcatatggcaggtcatttaatggcagcacaaagcattgccgatttgcagtatccgcttttagcgctcttggtgtcagggggacatacagaacttgtctatgtagcggctcccggtgattatcgtattgttggggagactcgagacgatgctgttggtgaggcttatgacaaagtcgggcgcgtcatgggccttacttatcctgcaggcaaagaaattgatcaactagctcatcaagggcaagatatctatgattttccgcgcgctatgattaaagaagacaatttggaattttccttttcaggtcttaaatcagcttttattaatcttcatcataatgcccgacaaaaaggagagcaactccgcttagaagatttatgcgcttctttccaagcagctgttttggatatcttgatggtgaaaacaaaaaaggctttggcagcttatcctgtaaaaactttggttattgctggaggtgtggcagctaaccaaggtcttcgtgaacgcctaaaagaagacataaaagatattaatgttgtcattccaccactacgtctttgtggtgataatgctggaatgattgcttatgctgcggccgttgaatatgaaaagggccattttgcagaactcgatctaaatgctaaacccagtttggcttttgaaggattagaataa

SEQ ID NO: 45679 - protein, 336 aa, Streptococcus mutans UA159
MIDRYILAIESSCDETSVAILKNEDQLLSNIIASQVESHKRFGGVVPEVASRHHVEVITLCIQDALQEAGITAGDLSAVAVTYGPGLVGALLVGMAAAKAFAWANHLPLIPVNHMAGHLMAAQSIADLQYPLLALLVSGGHTELVYVAAPGDYRIVGETRDDAVGEAYDKVGRVMGLTYPAGKEIDQLAHQGQDIYDFPRAMIKEDNLEFSFSGLKSAFINLHHNARQKGEQLRLEDLCASFQAAVLDILMVKTKKALAAYPVKTLVIAGGVAANQGLRERLKEDIKDINVVIPPLRLCGDNAGMIAYAAAVEYEKGHFAELDLNAKPSLAFEGLE

SEQ ID NO: 45680 - DNA, 1035 bp, Corynebacterium efficiens YS-314
  CDS (1)..(1035)
atgattgtcctgggtattgagagctcctgtgatgaaaccggtgtgggcgtggtcgacctggatgagcagggcaacctgaccatcctcgccgacgcggtggcatcctccatgcaggatcacgcacgtttcggtggtgtcgtgccggagatcgcctcccgcgcacatctggaatccatggtgccggtcatgcgagaggcgctgcaccgggcgggcatcgataaacccgatgcggtggccgccaccgtcggccccggtctggccggcgccctgctggtcggtgccagcgccgccaaggcctacgccgccgcctgggatgtgccgttctacgccgtcaaccacctcggcggacatgtcgccgtggccaacctcgacggcgaacccctgccgcattcggtggcgctgctggtctccggcgggcacacccagctgctcgaggtcgaggctgtcggcctgcccatgaaggagctcggctccaccctcgatgacgccgccggtgaggcctatgacaaggtctcgcgcctgctggggctgggatacccgggtgggccggtcatcgacaagctggcgcgccggggtgacccgcaggccatcgccttcccccgtggtctgatgaagaagtccgattcccgccatgatttctccttctccggcctcaagaccgccgtggcacgctatgtcgaggccgccgagcgcgccggcgaggtcatctcggtggaggatgtgtgcgccagtttccaggaggccgtctgcgatgtcctcaccttcaaggctgtgcgcgcctgccaggacgtcggggcgaaggtgctgctgctcggcggtggtgtggccgcgaactcccgtctgcgggaactcgcccaggagcgttgtgatgccgccggcatcgaactgcgtgtgcccagcttcaagctgtgcaccgacaatggcgtgatgatcgccgccctggctgcccaacgcatccacgaaggcgctggtggatccgccctgactgtgggaacggacccatctttggcggttgagacacctcaggtgttctga

SEQ ID NO: 45681 - protein, 344 aa, Corynebacterium efficiens YS-314
MIVLGIESSCDETGVGVVDLDEQGNLTILADAVASSMQDHARFGGVVPEIASRAHLESMVPVMREALHRAGIDKPDAVAATVGPGLAGALLVGASAAKAYAAAWDVPFYAVNHLGGHVAVANLDGEPLPHSVALLVSGGHTQLLEVEAVGLPMKELGSTLDDAAGEAYDKVSRLLGLGYPGGPVIDKLARRGDPQAIAFPRGLMKKSDSRHDFSFSGLKTAVARYVEAAERAGEVISVEDVCASFQEAVCDVLTFKAVRACQDVGAKVLLLGGGVAANSRLRELAQERCDAAGIELRVPSFKLCTDNGVMIAALAAQRIHEGAGGSALTVGTDPSLAVETPQVF

SEQ ID NO: 45682 - DNA, 1026 bp, Pseudomonas putida KT2440
  CDS (1)..(1026)
atgctagtactgggattggaaacatcctgcgacgaaaccggcgtcgcattatacgacagtgaacgcggtttgttggccgacgcactgttcagccagatcgacctgcaccgcgtcttcggcggcgtggtgcccgagcttgcctcgcgtgatcacgtcaagcgcatgctgccgctcatccgccaggtgctggacgaggcaggttgcgttgccaccgaaatcgacgccatcgcctacaccgcaggccccggcctggtcggcgccttgctggtgggcgcttcctgcgcccaggcgctggcctttgcctgggacatcccggcgatcggtgtgcaccacatggagggtcacctgctggcacccatgctggaagaaaacccgccagagtttccgttcgtcgctttgttggtttccggtggacatacccagctggttcgggtcgatggcatcggtcagtacgaactgttgggcgaaagcctggacgatgctgccggtgaagcgttcgacaagaccgccaagctgatcggcctcaattatcctggtggtccggaaatcgcgcgtctggccgagcaaggtgtgcctgggcgcttcgtgttcccgcggccaatgaccgatcggccaggcctggaattcagcttcagtggcctcaagaccttcgccctgaacacctggcagcaatgcaagaatgctggcgacgacagtgagcaaacccgttgcgacctgtccctggcattccagcaggcggtggtggagactttgaccatcaagtgcaagcgggcgctcaagcagaccggcctcaagcggctggtcatcgcgggtggcgtgagtgccaacaaggccctgcgcgcgtccctggaggacatgctcggtagcatcaagggcaacgtgtactacgcgcgtccgcaattctgtaccgacaatggtgcgatgatcgcctacgccggttgccagcgcctgctggccgggcagcagcaagacctggcgatcagcgtgcaggcacgctggccgatggaacagttgccgccgctgtaa

SEQ ID NO: 45683 - protein, 341 aa, Pseudomonas putida KT2440
MLVLGLETSCDETGVALYDSERGLLADALFSQIDLHRVFGGVVPELASRDHVKRMLPLIRQVLDEAGCVATEIDAIAYTAGPGLVGALLVGASCAQALAFAWDIPAIGVHHMEGHLLAPMLEENPPEFPFVALLVSGGHTQLVRVDGIGQYELLGESLDDAAGEAFDKTAKLIGLNYPGGPEIARLAEQGVPGRFVFPRPMTDRPGLEFSFSGLKTFALNTWQQCKNAGDDSEQTRCDLSLAFQQAVVETLTIKCKRALKQTGLKRLVIAGGVSANKALRASLEDMLGSIKGNVYYARPQFCTDNGAMIAYAGCQRLLAGQQQDLAISVQARWPMEQLPPL

SEQ ID NO: 45684 - DNA, 1023 bp, Staphylococcus epidermidis ATCC 12228
  CDS (1)..(1023)
atgacaaataataaattaatcttagcaattgaaacaagttgtgatgaaacgagtgtaagtgtaataaagaatggcactgaacttttatctaatactgttttaagtcaaatagatagtcacaaacgttttggtggtgttgtacctgaagttgctagtagacatcatgttgaaggaataacagcaactatagatgaatcgttagtgagtgcaaaagtgaaaatggaagacattgacgctattgcagtaacacaaggcccaggattaataggagctttattgattggtattaatgcggctaaagctttggcatttgcttatgataagcctattattccagtacatcatattgctggtcatatttatgccaatcacttagaacaaccattaacgtttccactaatgtcattgattgtatctggtggtcatactgaactagtatatatgaaaaatcatttagatttcgaagtgattggtgaaacgagagatgatgcagtaggagaagcttatgataaagttgctcgaacaatcaatcttccttatcctggtggaccgcatattgatcgattagcagctaaaggtaaagatgtatatgattttccaagagtttggctcgaaaaagatagttatgattttagttttagtggtcttaaaagtgctgtaataaataaactgcataatttaagacagaaaaatattgaaattgtagctgaagatgttgcaacgagtttccaaaatagtgttgtagaagttttaacctataaagctattcatgcttgtaaaacttataatgttaatcgcttaattgttgcaggtggtgttgctagtaataaaggattaagaaatgcactaagtgaagcatgtaaaaaagagggtatacaccttactattccaagtcctgttctttgcactgataatgcagcgatgattggtgctgctggatattatttatatcaagctggtttgcgtggcgatttagctttaaatggacaaaataatattgatattgaaactttttctgtttaa

SEQ ID NO: 45685 - protein, 340 aa, Staphylococcus epidermidis ATCC 12228
MTNNKLILAIETSCDETSVSVIKNGTELLSNTVLSQIDSHKRFGGVVPEVASRHHVEGITATIDESLVSAKVKMEDIDAIAVTQGPGLIGALLIGINAAKALAFAYDKPIIPVHHIAGHIYANHLEQPLTFPLMSLIVSGGHTELVYMKNHLDFEVIGETRDDAVGEAYDKVARTINLPYPGGPHIDRLAAKGKDVYDFPRVWLEKDSYDFSFSGLKSAVINKLHNLRQKNIEIVAEDVATSFQNSVVEVLTYKAIHACKTYNVNRLIVAGGVASNKGLRNALSEACKKEGIHLTIPSPVLCTDNAAMIGAAGYYLYQAGLRGDLALNGQNNIDIETFSV

SEQ ID NO: 45686 - DNA, 1074 bp, Bradyrhizobium japonicum USDA 110
  CDS (1)..(1074)
atgctggtattgggcatcgaaaccacctgcgacgagaccgccgcggccgtgatcgagcgcgcgcccgacggcatcggcaagatcctgtccaacatcgtgcggtcgcaggtcgatgagcatgccccgttcggcggcgtggtgccggagattgccgcccgcgcgcatgtcgacctgctcgacggcatcatcgaccgcgccatgcgcgaggccggcatcggcttcgcccagctcaatggcgtcgcggcggccgcgggaccgggcctgatcggcggtgtcatcgtcgggctcaccaccgcgaaggcgatcgctttggtgcacgacacgccgctggtcgcggtgaaccatctggaggcgcatgcgctgacgccacggctgaccgacggaatcgaattcccgtactgcctgttcctcgcctccggcggccacacccagatcgtcgcggtcaccggcgtcggccaatatgtgcggctcggcaccaccgtcgacgacgccatcggcgaagccttcgacaaggtcgcgaagatgctgggcctgccctatcccggtggcccgcaggtcgagcgcgcggcggccggcggcgatgccgcgcgcttcgcctttccgcggccgatgcagggcaggccggacgccaacttctccctgtcgggattgaagaccgcggtgcgcaacgaagcgagccggatcgccgagatcacgccgcaggacatcagcgatctctgcgcaagcttccaggccgccgtgctggaggcgacggccgaccggctgaatgtcggcttgagacttttccgcgaacagttcggcgcgccgcgcgcgctcgtggccgccggcggcgtcgccgccaatcaggcgatccgcggcgcgctgcatgacgtcgctcggcaggccaagacgcaactgatcatgccgccgcctgcgctctgcaccgacaacggcgcgatgatcgcctgggccggcgccgagcgcctcgcgctgggaatgaccgacacgatggaagcccagccccgcgcccgctggctgctcgacgcgaatgcgacagcgcccgcgggctacggcaagacgcgagcgggattctaa

SEQ ID NO: 45687 - protein, 357 aa, Bradyrhizobium japonicum USDA 110
MLVLGIETTCDETAAAVIERAPDGIGKILSNIVRSQVDEHAPFGGVVPEIAARAHVDLLDGIIDRAMREAGIGFAQLNGVAAAAGPGLIGGVIVGLTTAKAIALVHDTPLVAVNHLEAHALTPRLTDGIEFPYCLFLASGGHTQIVAVTGVGQYVRLGTTVDDAIGEAFDKVAKMLGLPYPGGPQVERAAAGGDAARFAFPRPMQGRPDANFSLSGLKTAVRNEASRIAEITPQDISDLCASFQAAVLEATADRLNVGLRLFREQFGAPRALVAAGGVAANQAIRGALHDVARQAKTQLIMPPPALCTDNGAMIAWAGAERLALGMTDTMEAQPRARWLLDANATAPAGYGKTRAGF

SEQ ID NO: 45688 - DNA, 1023 bp, Clostridium tetani E88
  CDS (1)..(1023)
atggagaaagatataaaaatattagctattgaaagtagttgtgatgaaacatcagcggctgtagtaatcaatggcagagaagttttatctaatgtaatttcatctcaaatagatatacacgaaaaatttggaggggtagttccagaggtagcatctagaaaacatatagaagccatttctttagtagttcaagaagcaataaaagaggctaatatggattacgaagaattagatgctatagctgtaacctatggaccaggattagtaggagcactattggtaggattgcagtatgctaaaggactatcctatgcattaaataagcctttgattggagttaaccatatagaaggtcatataagtgcgaattatattcaacataaggacttagagccaccttttttatgtcttgtggtctctggaggaaatacttttatagtatatgttgaaaactatggagaatatgaaataataggagaaactagagatgatgccgcaggagaggcctatgataaagtagcaagagccataggattgggatatccaggagggcctaaaatagataaattagctaaagaaggtaatgaaaatgctataaaatttccaagggctaagtttcatgaagaaaatactttagacttttcctttagtggacttaaatcttcagtattaaattatttaaacactatggaaatgaaaaaagaagaaataaatagagcagatgtagcagcatcttttcaaaaggcagtggtagattttttagtagacaatactatgaaagctgctaagataaaaaaagtagatgaaatagcggtagcaggcggagtggcagcaaattcttgtcttagagatactatagttaaagaaggagaaaaaaataatataaaaatattgtttccaagtattaaactatgcacagataatgcggcaatgataggtagtgcagcttattttcaatttttgaaaagtgatttttcagatttaaatttaaatgcagtaccaaatttaaaattaaataaataa

SEQ ID NO: 45689 - protein, 340 aa, Clostridium tetani E88
MEKDIKILAIESSCDETSAAVVINGREVLSNVISSQIDIHEKFGGVVPEVASRKHIEAISLVVQEAIKEANMDYEELDAIAVTYGPGLVGALLVGLQYAKGLSYALNKPLIGVNHIEGHISANYIQHKDLEPPFLCLVVSGGNTFIVYVENYGEYEIIGETRDDAAGEAYDKVARAIGLGYPGGPKIDKLAKEGNENAIKFPRAKFHEENTLDFSFSGLKSSVLNYLNTMEMKKEEINRADVAASFQKAVVDFLVDNTMKAAKIKKVDEIAVAGGVAANSCLRDTIVKEGEKNNIKILFPSIKLCTDNAAMIGSAAYFQFLKSDFSDLNLNAVPNLKLNK

SEQ ID NO: 45690 - DNA, 1047 bp, Lactobacillus plantarum WCFS1
  CDS (1)..(1047)
atgggaaccgtggaaaaacaaaacttgattttagcgtttgagtccagttgtgacgagactagtgtggcagtgatcaaagatggccatgagattttatccaacgtgattgcaacgcagattaatagtcacaaacggtttggtggcgtggttcctgaagttgccagccgtcatcatattgaacaaattacaatttgtattgaagccgcacttcaagaggcacacgtgacgtatgctgaccttgatgctgttgccgtgacgtatggccccggtctagtgggggcactgttagtcggtgttaatgcagctaagacagtggcatacgcgcaccaattaccgctgattccagttaaccatatggctgggcacatttatgctgctcggttcgttaagccgttcgaatttccgctaatggcactattagtttctggcggtcatactgaattggtctacatgcaagcagatgggcaatttgagattataggtgaaacacgtgacgatgcggctggtgaagcctatgataaaatcggtcgggtattgggtgttccatatccggcaggtaaagtcattgacgagatggcacatgcaggccacgacactttcaaatttccgcgagcaatgattgatgaagataattacgattttagttttagtgggctgaagagtgcgttcatcaatacggtccatcacgcagatcaaattggcgcgactctggataagaacgatttagcggctagctttcaggctagcgtggttgatgtcctgatgagtaaaacgttacgagtccttaaacaatatccagttaagcaattggtcttagccggtggcgttgcagctaaccaggggctacgtgaacggttacaacaagatttaccagccgctttccctgacaccgaactaatcttagcgcctctaaagttatgcggtgataatggtgccatgattggtgctgcgggctatgttcaatatcagcatcaccaattcggcgacgcgacgctgaatgccgatccaagcttagaatttgattggatgccaggtatgttgaagtaa

SEQ ID NO: 45691 - protein, 348 aa, Lactobacillus plantarum WCFS1
MGTVEKQNLILAFESSCDETSVAVIKDGHEILSNVIATQINSHKRFGGVVPEVASRHHIEQITICIEAALQEAHVTYADLDAVAVTYGPGLVGALLVGVNAAKTVAYAHQLPLIPVNHMAGHIYAARFVKPFEFPLMALLVSGGHTELVYMQADGQFEIIGETRDDAAGEAYDKIGRVLGVPYPAGKVIDEMAHAGHDTFKFPRAMIDEDNYDFSFSGLKSAFINTVHHADQIGATLDKNDLAASFQASVVDVLMSKTLRVLKQYPVKQLVLAGGVAANQGLRERLQQDLPAAFPDTELILAPLKLCGDNGAMIGAAGYVQYQHHQFGDATLNADPSLEFDWMPGMLK

SEQ ID NO: 45692 - DNA, 1206 bp, Tropheryma whipplei str. Twist
  CDS (1)..(1206)
gtgtctattatcctcggaatcgaaacatcttgcgatgaaacaggtgttggcatagtgtctggttcaactgttcttgcaaatgaggttgcctcatcaagcttacgccataaaccttttggcggtgttatccccgaaatagctgctcgggcgcatcttgagtatttgccaaatttgcttgaattggcgcttgagacggcacagctctgtattaaagatattgatggtatagctgttaccgcaggccctggacttgttaccagtctttctgttggcgtttctgcggccaaggctttgggattatctacggggacgcctgtttatggtgtaaatcatcttgttggacatgccgtatcggcttttctggatgattacactaatgatggccttggtgttattcaccgcagggacagtatcggatctaatggaattgagaatgacgccagttcgacacactcacatacgcatacaacgcaggtaaacagacattcaaacctgtgtgtctatacacctccccggcgtgttttacgagatgtttgtaagtatatgcatgtcagagattcagttgttttgcttgcatcaggtgggcattcctgtctgttgaaaatacataacaataagatatcgcttttaggtgagacactggatgatgcagccggtgaggcgtttgacaaaatcgcaagacttatgggccttcagtatcccggaggtcctgcgattgagatgcttgccagttcgggtaaccccaatgccgtggagtttccaagggcgctgttgacgcattttgaagaacacaacaggtatagtttttctttttcagggttgaaaaccgcggttggtagggttgttgaaagaataaagagtaatccagcccattcgatacccaagatagaagatattgctgcaagttttcaggaagccgttgcagatgttttgacagcaaaaactgtagcggctgccttggccagtgatgtggatctaatagttatgggtggtggggtagctgcaaataatcgcattagagagatgctttgcgaaagagcgaaaatccacggcttggacgtaaagatcccacctattgcgctgtgcaccgataatggtgcaatgattgccgccgctggctcgtggcttatgcagctgggatacaatccgagtcattcaaggttttcgcccgtatcgattatgccgctaacccagatggttgtgtga

SEQ ID NO: 45693 - protein, 401 aa, Tropheryma whipplei str. Twist
MSIILGIETSCDETGVGIVSGSTVLANEVASSSLRHKPFGGVIPEIAARAHLEYLPNLLELALETAQLCIKDIDGIAVTAGPGLVTSLSVGVSAAKALGLSTGTPVYGVNHLVGHAVSAFLDDYTNDGLGVIHRRDSIGSNGIENDASSTHSHTHTTQVNRHSNLCVYTPPRRVLRDVCKYMHVRDSVVLLASGGHSCLLKIHNNKISLLGETLDDAAGEAFDKIARLMGLQYPGGPAIEMLASSGNPNAVEFPRALLTHFEEHNRYSFSFSGLKTAVGRVVERIKSNPAHSIPKIEDIAASFQEAVADVLTAKTVAAALASDVDLIVMGGGVAANNRIREMLCERAKIHGLDVKIPPIALCTDNGAMIAAAGSWLMQLGYNPSHSRFSPVSIMPLTQMVV

SEQ ID NO: 45694 - DNA, 1020 bp, Bacteroides thetaiotaomicron VPI-5482
  CDS (1)..(1020)
atgagtgcaataatattaggaattgaatcctcctgtgatgatacgtcggcagccgtaatcaaggatggttatctgctgtcaaatgtggtatcaagtcaagccgtacatgaagcatacggcggagtagtacccgaattagcttcacgggcacatcaacaaaatatcgttcctgtggtacacgaagcactgaaacgggcaggggttaccaaagaagaactgagcgcggtagctttcacacgtggaccgggattgatgggatctttacttgtaggcgtctctttcgccaaaggattcgcacgttcactcggtattcctttgatagatgttaatcatctgacagggcatgtcttagctcattttattaaagcagaaggagaagaaaatatccaaccgaaattcccgttcctttgcctgttggtatccggaggaaactcacagattatattggtaaaagcctataatgatatggaaattctcggtcagacgattgatgacgctgccggagaagcaatcgataaatgttctaaagtgatgggtctcggatatccgggcggaccgatcattgacaaactggcacgtcaaggcaatccgaaagcgtatactttcagcaaaccgcatattccggggctggactacagtttcagcggactgaaaacttctttcctatactccttgcgtgactggatgaaagacgatcccgatttcatcgagcatcataaagtggatttggccgcctctctggaagcaactgttgtagacattctgatggacaaactgcggaaagctgccaaagaatataaaataaaagaagtagccgtagccggaggagtctctgccaataacggattgcgtaactctttccgagaacacgctgaaaagtatggctggaatatttttattcctaaattcagctatacgaccgacaatgcagccatgattgccattaccggatacttcaagtatctggataaagacttctgctccattgatcttccggcttattcccgtgtcacattataa

SEQ ID NO: 45695 - protein, 339 aa, Bacteroides thetaiotaomicron VPI-5482
MSAIILGIESSCDDTSAAVIKDGYLLSNVVSSQAVHEAYGGVVPELASRAHQQNIVPVVHEALKRAGVTKEELSAVAFTRGPGLMGSLLVGVSFAKGFARSLGIPLIDVNHLTGHVLAHFIKAEGEENIQPKFPFLCLLVSGGNSQIILVKAYNDMEILGQTIDDAAGEAIDKCSKVMGLGYPGGPIIDKLARQGNPKAYTFSKPHIPGLDYSFSGLKTSFLYSLRDWMKDDPDFIEHHKVDLAASLEATVVDILMDKLRKAAKEYKIKEVAVAGGVSANNGLRNSFREHAEKYGWNIFIPKFSYTTDNAAMIAITGYFKYLDKDFCSIDLPAYSRVTL

SEQ ID NO: 45696 - DNA, 1047 bp, Enterococcus faecalis V583
  CDS (1)..(1047)
atgacaatttttacaaaagaacgtaaattattattagctgtggaaagtagctgtgatgaaacaagtgtggctgtcattgaagatggcgacaaaattctttccaatatcgtagcttcgcaaattaagagccatcaacgttttggcggagtcgttccggaagttgcgagtcgtcatcatgttgaacaagtgacgatctgtattgaagaagcattaacagaagcaaaagtcacaccagaagaactcagtggcgttgctgtgacctatgggcctgggttagtcggtgctttattaataggactttctgcagcaaaagcatttgcttgggcgcaccaattaccacttattccagtcaatcatatggctgggcacatttatgctgcccgttttgtggcaccgctcgaatttccattgatggccttactcgttagtggaggacatacggaattggtctacatgaaagaagatggctctttcgaaattgttggtgaaacacgtgatgatgcagctggtgaagcgtatgataaagtcggacgtgtgttagggttgccttatcctagtggcaaagagattgatgctttggcccatgaaggcacagatacctatcaatttccacgggcgatgctaaaagaggataactatgactttagctttagtggtttgaaaagtgcgtttattaacacggttcataatgcagagcaacgtggtgaagcactgtctacaaaggatttagccgcaagttttcaggcgagtgtggtagaagtattagtgactaaaaccattcgtgcttgtcaagaatatcctgttaagcaattgctaatcgctgggggcgttgctgcgaatcaaggattacgagaagcaatgagacatgcaatcagtgaacaattaccagcagtgacattacttattccgccattaaaactttgtggggataacgcggcgatgattggcgctgccgcctttatcgaagctgaaaagaatcactttgcttcgtataacttaaatgcagaacctggcgttagttttatgacaattagtgaagaaggctag

SEQ ID NO: 45697 - protein, 348 aa, Enterococcus faecalis V583
MTIFTKERKLLLAVESSCDETSVAVIEDGDKILSNIVASQIKSHQRFGGVVPEVASRHHVEQVTICIEEALTEAKVTPEELSGVAVTYGPGLVGALLIGLSAAKAFAWAHQLPLIPVNHMAGHIYAARFVAPLEFPLMALLVSGGHTELVYMKEDGSFEIVGETRDDAAGEAYDKVGRVLGLPYPSGKEIDALAHEGTDTYQFPRAMLKEDNYDFSFSGLKSAFINTVHNAEQRGEALSTKDLAASFQASVVEVLVTKTIRACQEYPVKQLLIAGGVAANQGLREAMRHAISEQLPAVTLLIPPLKLCGDNAAMIGAAAFIEAEKNHFASYNLNAEPGVSFMTISEEG

SEQ ID NO: 45698 - DNA, 1020 bp, Coxiella burnetii RSA 493
  CDS (1)..(1020)
atgaaatgtgtccttggtgttgaaacttcctgtgatgaaactgctgttgcgctgtatgatggtgagcgaggattattagcgcaccgtgtttatagtcaaatagccatccacgctgagtatggcggtgtggttcctgagcttgcttcgcgcgatcacattagaaaaattttgcctctaattaaagccgctttggatgacgctgccttgtccaaagaaaacattgacggaattgcttacacaaaaggccctggtttaatcggggcgttgatggtaggggcgtcggtggcaaaaagcttagcgtatgcctggcgggtgccggtcgtgggtgtgcaccatatggaagcgcatttaatggcgctgcaattagaagaaagccgacctgcgtatccgtttattgccttattggtttcggggggccacacgatgttggttcacgtcgagcagccaggccgctataaaatcttgggagaaagcgttgatgatgctgcgggagaagcgtttgataaaacagctaaattattagggctgccctatcccggtggtcccgcgctggctcgcttagcagagcaaggcgaacctaaacgttttatttttccacggccaatggtgaatcaaccacatcttaattttagttttagcggcttaaagacacacgcggttaattgttttaaacaatacggtggtgaggaacaaacccgagcggatattgcttgcgcgtttgagaacgcggtcgtcgatactttaattattaaatgtttacgagccttggaaaaaacaggaattaatactttggttttagtcggtggcgtcgcggcaaacaagaaattgcgtgaacgattgggacaagttgccgtaaagcgagccgcacaaatttattacccccgtcaagaattttgtacggataacggcgcgatggtcgcttatacaggctggctgcggttaaacgctggcgaaaaagaagataaaataattcgcgttaaaccaagatggtcgatggctgaattaaatataataaactag

SEQ ID NO: 45699 - protein, 339 aa, Coxiella burnetii RSA 493
MKCVLGVETSCDETAVALYDGERGLLAHRVYSQIAIHAEYGGVVPELASRDHIRKILPLIKAALDDAALSKENIDGIAYTKGPGLIGALMVGASVAKSLAYAWRVPVVGVHHMEAHLMALQLEESRPAYPFIALLVSGGHTMLVHVEQPGRYKILGESVDDAAGEAFDKTAKLLGLPYPGGPALARLAEQGEPKRFIFPRPMVNQPHLNFSFSGLKTHAVNCFKQYGGEEQTRADIACAFENAVVDTLIIKCLRALEKTGINTLVLVGGVAANKKLRERLGQVAVKRAAQIYYPRQEFCTDNGAMVAYTGWLRLNAGEKEDKIIRVKPRWSMAELNIIN

SEQ ID NO: 45700 - DNA, 1125 bp, Streptomyces avermitilis MA-4680
  CDS (1)..(1125)
atggctgactcacgcgacgagccgctcgtcctgggcatcgagacgtcctgcgacgagaccggcgtcggcattgtccgcggcaccaccctgctcgcggacgccatcgcgtccagcgtcgacgagcacgcccgcttcggcggtgtggtgcccgaggtcgcctcccgtgcgcacctcgaggcgatggtgccgaccatccagcgcgccctgaaggaggcgggcgtctcggcgaaggacctggacggcatcgccgtgaccgccggtcccggcctggccggcgcgctgctcgtcggggtctcggcggcgaaggcgtacgcctacgcgctcggcaagcccctctacggcgtcaaccacctcgcctcccacatctgcgtcgaccagctggagcacgggccgctgccggagccgaccatggcgctgctggtgtccggcgggcattcctcgctgctgctctccacggacatcacctccgatgtgcggccgatgggcgcgaccatcgacgacgcggcgggcgaggccttcgacaagatcgcgcgcgtgctgaacctgggcttcccgggcggtccggtcatcgaccggtacgcgcgcgagggcgacccgaaggcgatcgcgttcccgcgcggtctcaccgggccgcgcgaccccgcgtacgacttctccttctccggtctgaagaccgccgtggcccgctggatcgaggccaagcgggccgccggtgaggaggtgccggtgcgtgacgtctccgcgtccttccaggaggcggtggtggacgtgctgacccgcaaggccgtacgcgcctgcaaggacgagggcgtcgaccacctcatgatcggcggcggcgtcgcggccaactcgcggctgcgcgcgctcgcccaggagcggtgcgaggccgccgggatccggctgcgggtgccccgcccgaagctgtgcacggacaacggggcgatggtcgcggcgctgggcgcggagatggtggcgcgggggcgtgccgcctccgactgggacctgtccgcggactcgtcgctgccggtgacggacccgcacgtgcccgggcgcgcgcacacgcatgcgcacacgcacggccacgatcacgtgcacgaggtcagcaaggagaacctgtactcgtga

SEQ ID NO: 45701 - protein, 374 aa, Streptomyces avermitilis MA-4680
MADSRDEPLVLGIETSCDETGVGIVRGTTLLADAIASSVDEHARFGGVVPEVASRAHLEAMVPTIQRALKEAGVSAKDLDGIAVTAGPGLAGALLVGVSAAKAYAYALGKPLYGVNHLASHICVDQLEHGPLPEPTMALLVSGGHSSLLLSTDITSDVRPMGATIDDAAGEAFDKIARVLNLGFPGGPVIDRYAREGDPKAIAFPRGLTGPRDPAYDFSFSGLKTAVARWIEAKRAAGEEVPVRDVSASFQEAVVDVLTRKAVRACKDEGVDHLMIGGGVAANSRLRALAQERCEAAGIRLRVPRPKLCTDNGAMVAALGAEMVARGRAASDWDLSADSSLPVTDPHVPGRAHTHAHTHGHDHVHEVSKENLYS

SEQ ID NO: 45702 - DNA, 1035 bp, Chlamydophila caviae GPIC
  CDS (1)..(1035)
atgcttacccttgggttggaaagctcttgtgacgagacggcatgtgctttggtagatgctaaggggcacattatggctaatgtcgtcttctctcaacaagatcatgttgcctacgggggcattgttcctgaactggcctccagagctcatctaagggttttcccctctgttgtggattctgctttaaaagagtcgggagtttccctagaggacattgatcttattgcagtaacacataccccagggctaataggttcgttagctataggcgtgaattttgccaaaggtttggcgataggatgtcaaaagcccatcattggtgtaaatcatgtcgaagctcatctttatgcagcttatatggaagcagaaaatgtggagtttcctgctttaggcttagcggtttccggagcgcatacggcgatgtttttgatggaagatcctttaacatataagttaataggaaaaagccgagatgatgctataggagagacttttgataaggtggcaagattcctggggcttccttatcccggaggctctttaatagaaaagcttgcctcctgtggatgcgaggaatcctattctttttcaccctctaaagttcccggttgtgatttatcctttagtggattgaaaaccgctgttctttacgcaattaagggaaataacagcaatagtcgtaccccccttccagagctttctgaagcggaaaaaagtgatatcgcagcatcttttcaaagagctgctttcacgagcattgcacaaaaacttcctaatattgtaaaaaaaatttcgtgcagatcgatcctggtcggagggggagtagcaagtaataagtatttccaaaatttattaaaaaatactctaaatttgcctttatactttccctcttctaagttatgtaccgataatgctgcgatgatcgcaggattaggacgagagctgtttctttcagataaatctactataggaattcatccatgcgcaagatatcattgggaatctatctcagcttccttgtctcctcttccttag

SEQ ID NO: 45703 - protein, 344 aa, Chlamydophila caviae GPIC
MLTLGLESSCDETACALVDAKGHIMANVVFSQQDHVAYGGIVPELASRAHLRVFPSVVDSALKESGVSLEDIDLIAVTHTPGLIGSLAIGVNFAKGLAIGCQKPIIGVNHVEAHLYAAYMEAENVEFPALGLAVSGAHTAMFLMEDPLTYKLIGKSRDDAIGETFDKVARFLGLPYPGGSLIEKLASCGCEESYSFSPSKVPGCDLSFSGLKTAVLYAIKGNNSNSRTPLPELSEAEKSDIAASFQRAAFTSIAQKLPNIVKKISCRSILVGGGVASNKYFQNLLKNTLNLPLYFPSSKLCTDNAAMIAGLGRELFLSDKSTIGIHPCARYHWESISASLSPLP

SEQ ID NO: 45704 - DNA, 1014 bp, Nitrosomonas europaea ATCC 19718
  CDS (1)..(1014)
atgcttgtattaggtattgaaacttcatgtgacgagacaggtgtagcactttatgatacctgccagggattactcggccataccctatattctcaggtcgacatgcatcgcgaatatggcggtgtcgtgccggaacttgcttcacgcgaccatatccgccgcatcctgcctctcatcagacaattattcagacaatcggatacttcgctggaatctgttgatgccatcgcctgtacccagggtccggggcttgcaggagcgttgctgaccggggcaagtttcagcagtgctctggcttttgcgcgcaatatacccgtcttgaacatccaccatcttgaaggtcatctgctctccccacttttatccgatccggcacctgattttccgttcgtggcactattggtatccggagggcacacacaactgatgcgggtagacggaatcgggcagtatcggttattgggagaaaccgtggatgatgcagccggagaagcgtttgacaaaactgcaaaattacttgacctcgactaccccggtggaaagttgcttgcagaactggccacacaaggccgggcagaacaattcaggctcccgcgccccatgctgaacagcaatgatctgaatttcagtttcagcggattaaaaacagctgcggctctgctgatcggcaagcatgagatgaacagtcagacacgcgccgatatcgcatttgcctttgaagacgcagttaccgatgtgctggtaaaaaaatcagtaactgctctgaatatcactggattgcagcaactggtcgtagcaggcggtgtaggcgcaaacagccgattgcgtcagaagctattacaccatctgtccggaaccgatatcaccgttttcttcccagcgctggagttttgtaccgataacggcgcaatgattgcgctggccggtgcattacgtttacagcagctcgatgagcgcctcagagcgggcggcagctttaccgtcaaagcccgctggaatctggaagatttataa

SEQ ID NO: 45705 - protein, 337 aa, Nitrosomonas europaea ATCC 19718
MLVLGIETSCDETGVALYDTCQGLLGHTLYSQVDMHREYGGVVPELASRDHIRRILPLIRQLFRQSDTSLESVDAIACTQGPGLAGALLTGASFSSALAFARNIPVLNIHHLEGHLLSPLLSDPAPDFPFVALLVSGGHTQLMRVDGIGQYRLLGETVDDAAGEAFDKTAKLLDLDYPGGKLLAELATQGRAEQFRLPRPMLNSNDLNFSFSGLKTAAALLIGKHEMNSQTRADIAFAFEDAVTDVLVKKSVTALNITGLQQLVVAGGVGANSRLRQKLLHHLSGTDITVFFPALEFCTDNGAMIALAGALRLQQLDERLRAGGSFTVKARWNLEDL

SEQ ID NO: 45706 - DNA, 1077 bp, Helicobacter hepaticus ATCC 51449
  CDS (1)..(1077)
atgatcttaagcatagaatcaagctgcgatgatagctcacttgccctaatgagcattaatgatgcttcgcttctttatcatatcaaactttctcaagatgaagaacatagcacttatggtgggattgtgccagaaattgcttcaagacttcacgctcaaagacttccagagattctaaaaaagctcaaagcatttctcaataacgatttatctcctattaaagcagtcgcggtaaccacgcgtccgggactaagtgtaacactcattgaaggtttgatgatggcaaaggcactttgtcttggtttgcaagtgccgcttatttgtgttaatcaccttaagggacatatttattcgcttttgattcataaagccacttcagatatgcaagccattctccctaaaaacacctctctaccccaacctcttggcattttgcttgtatctggcgggcatacacagattctccatatgcgcgattttaatgccataagccttatcgctcaaagccttgatgatagctttggggaaagctttgataaagtagctaaatatttgggattaggttatccgggtggtcctgttatagaatcttatgctacaacttttatgcgcgactttccacatattgcgcctcatagttttcctgtgccacttttgcataatcaaaaactacaatttagcttttcgggtttaaaaaatgccgtaagacttgccattcaagctctaccccaacctcttagcctcaaagatagaggaagtatctgtgcaggattccaacaaagcgcgtgtgaacatatcgtgcgcaaagtaagattatattttcaaagcgcgcaggcacaagatttagaacattttgctattgtaggaggagcaagcgcaaatacatacctacgcaccaccctaaatgagctttgtgaggagtataataaacagcttcatctcgctgaccttgctttttgtgctgataatgcagcaatgattggcgtgtgtgccatagagcattataaaaggggagattttacacccatagatgaagcgcaaatctcgcctaaaagtttgctaaatgattttttataa

SEQ ID NO: 45707 - protein, 358 aa, Helicobacter hepaticus ATCC 51449
MILSIESSCDDSSLALMSINDASLLYHIKLSQDEEHSTYGGIVPEIASRLHAQRLPEILKKLKAFLNNDLSPIKAVAVTTRPGLSVTLIEGLMMAKALCLGLQVPLICVNHLKGHIYSLLIHKATSDMQAILPKNTSLPQPLGILLVSGGHTQILHMRDFNAISLIAQSLDDSFGESFDKVAKYLGLGYPGGPVIESYATTFMRDFPHIAPHSFPVPLLHNQKLQFSFSGLKNAVRLAIQALPQPLSLKDRGSICAGFQQSACEHIVRKVRLYFQSAQAQDLEHFAIVGGASANTYLRTTLNELCEEYNKQLHLADLAFCADNAAMIGVCAIEHYKRGDFTPIDEAQISPKSLLNDFL

SEQ ID NO: 45708 - DNA, 1077 bp, Rhodopirellula baltica SH 1
  CDS (1)..(1077)
atgacgccgacggccgcttctgaattgctgctgtcgattgaatccacttgtgatgaaactgccgcggcggtcattcgccgcgacggcacggtccttggccaatgcatcgccacccaagaaacacttcacgagcagttcggcggtgtggtccccgagatcgccgcgcgagcccacctggaacgcatccttccggtgatcgacacggcactgacgcaagcgaaagttcgtggcgaagacctcaccgcgatcgccgtagccgatcgtccgggcttggctggttcattgctggtcggtgtcgttgccgccaaaacgctcgccttggcatggaacaaaccactgatctcgctcaatcatttgcacgctcacttgtatgcgtgtcaattgattgaaggggccccggcgaacatctatccggcgattggcctgatcgtatccggcggtcacaccagcctgtatgtttgtcgcaccgcgatcgacctggagtatctcggcggaacaatcgacgatgccgctggcgaagcattcgacaaagtggcagcgatgttgtccctaccctttcccggcggaatcgaagtcgcaaagctcgcctcgcaaggaaacgacaaggcatactctttccctcgctcgatgattcacgatccaggcgatgatttttccttcagcggtttgaagacggcggttcggtacgccatcgtcggcccgggccgccaagactttgcgtcgctggacatttccgaccaagtcaaacgggacgtctgcgcctcgtttgaggccgctgttgtcgatgtcttggtatccaaatgccgtcgagcgatcaagcggcacagaaatcgcaacaacgatcctcagaactcaatcaatcggctgatcgtcggaggcggcgtggcagccaaccagcgtttgcgacgtgacctgcaagccgccgccgacaaagacggcttcgagctttggatcgctccaccgcacctatgcactgacaatgctgtcatgggtgcgatcgcctggaagaagttcgaagccgaacaattcgcatcgcttgatctggacatcacccccggactgcaacgaggcttctga

SEQ ID NO: 45709 - protein, 358 aa, Rhodopirellula baltica SH 1
MTPTAASELLLSIESTCDETAAAVIRRDGTVLGQCIATQETLHEQFGGVVPEIAARAHLERILPVIDTALTQAKVRGEDLTAIAVADRPGLAGSLLVGVVAAKTLALAWNKPLISLNHLHAHLYACQLIEGAPANIYPAIGLIVSGGHTSLYVCRTAIDLEYLGGTIDDAAGEAFDKVAAMLSLPFPGGIEVAKLASQGNDKAYSFPRSMIHDPGDDFSFSGLKTAVRYAIVGPGRQDFASLDISDQVKRDVCASFEAAVVDVLVSKCRRAIKRHRNRNNDPQNSINRLIVGGGVAANQRLRRDLQAAADKDGFELWIAPPHLCTDNAVMGAIAWKKFEAEQFASLDLDITPGLQRGF

SEQ ID NO: 45710 - DNA, 1023 bp, Wigglesworthia glossinidia endosymbiont of Glossina brevipalpis
  CDS (1)..(1023)
atgttaatcctaggaatagaaacatcttgtgatgatactggagctgcaatttatgatttagaaaaaggactaattatacataaagtaattagccaaaataatatacattcaaaatatggaggagtagtaccagaaaaatcatctaaatatcatttaaaaaacatacaacctttagttgaaaatattttcaagaattctaatatatctttgtctaaaatagatggaatagcatacactgccggtccaggtttggttggatctttaataataggtgcaacatttgcttgttctttagcttatacattgcaaataccatcaatagcaataaatcatttagaaggtcatttattaactccaatgataaaatataaacgtccaaaatttccttttttggggttaattatttcaggagcacatactcaatttgtattagccgaagatattgggaaatataaaataattggagattgcttagatgacgctttaggagaagcttttgacaaagtagcaaaattattaggaattaaatatccaggtggaaaaaagttatcaattatagcaaaacaggggaattctaaaaggtttttttttcctagacctatgacaaaaaaaccaggaataaattttagtttttctggattaaaaacttatgctaaaaatcttgtatcttctttttcaaaaatagataatcaaacaaaatgcgatatagctcgtgcatttgaagattctataattgatactgttattattaaatgcaaaagagctttggatataactaattctaaaatattgttaatatctggaggagttagcgcaaatgaaccattaagaaaaaatttaagaaatttaatgaaatcaagaaatggaaaattatttttttcaaaaaaatctttatgcactgacaatgcagcaatgatagcttatgttggttctataagatttaaaaaaaataaaacaaaagatctatcagtattaattaatcctaaatggtcattagaagatatttcacgacttgaaaattaa

SEQ ID NO: 45711 - protein, 340 aa, Wigglesworthia glossinidia endosymbiont of Glossina brevipalpis
MLILGIETSCDDTGAAIYDLEKGLIIHKVISQNNIHSKYGGVVPEKSSKYHLKNIQPLVENIFKNSNISLSKIDGIAYTAGPGLVGSLIIGATFACSLAYTLQIPSIAINHLEGHLLTPMIKYKRPKFPFLGLIISGAHTQFVLAEDIGKYKIIGDCLDDALGEAFDKVAKLLGIKYPGGKKLSIIAKQGNSKRFFFPRPMTKKPGINFSFSGLKTYAKNLVSSFSKIDNQTKCDIARAFEDSIIDTVIIKCKRALDITNSKILLISGGVSANEPLRKNLRNLMKSRNGKLFFSKKSLCTDNAAMIAYVGSIRFKKNKTKDLSVLINPKWSLEDISRLEN

SEQ ID NO: 45712 - DNA, 1047 bp, Haemophilus ducreyi 35000HP
  CDS (1)..(1047)
atgcgaattttaggaattgaaacttcatgtgatgaaactggtgttgctatttatgatgagcaacgaggtctaattgcaaatcaactttatagccaaattgagatgcacgctgattatggtggtgtggttcccgagttagcttcacgagatcatatccgtaaaacattacctttgattcaagcggcattaaaagaagcaaatttaaccgcttctgagattgatggcattgcttatacggctggaccagggctagttggagccttgcttgttggtgccactattgcacgtgcattagcttatgcttggaatgttcccgcattagctgtacatcatatggaagggcatttaatggcacctatgctagaagaaaatcctcctgaatttccctttattgcgctgttgatttcaggtgggcatacacaattaattaaagtagcgggtgtaggtgaatatgaaattttaggcgaatcaatagatgatgctgcgggagaagcttttgataaaacgggtaaattgcttggtttggattaccctgctggtgttgctttatcgcaattagcggaaaaaggtacgccgaatcgttttgtttttcctcggccaatgacggatagaccaggtttagactttagtttctctggtttgaaaacctttgcagcaaatacgattaatgctcagttagatgaaaatggtcagttaaatgaacaaacgcgttgtgatattgcacacgcatttcagcaagctgttgtggatacgattattattaaatgtaagcgagcattacagcaaacaggctatagccgtttagttatggcgggcggtgtaagtgctaataaacagttacgtgcagaattagctactatgatgcaagcattaaaaggtcaagtctattatcctcgtcctcaattttgtacagataatggggcaatgattgcctataccggttttattcgcttgaaaaagggggaaaaaacggatttaagtgtaagtgtaaagcctcgttggccaatgacaactttattaaaattatcagcgcaccataaagtttaa

SEQ ID NO: 45713 - protein, 348 aa, Haemophilus ducreyi 35000HP
MRILGIETSCDETGVAIYDEQRGLIANQLYSQIEMHADYGGVVPELASRDHIRKTLPLIQAALKEANLTASEIDGIAYTAGPGLVGALLVGATIARALAYAWNVPALAVHHMEGHLMAPMLEENPPEFPFIALLISGGHTQLIKVAGVGEYEILGESIDDAAGEAFDKTGKLLGLDYPAGVALSQLAEKGTPNRFVFPRPMTDRPGLDFSFSGLKTFAANTINAQLDENGQLNEQTRCDIAHAFQQAVVDTIIIKCKRALQQTGYSRLVMAGGVSANKQLRAELATMMQALKGQVYYPRPQFCTDNGAMIAYTGFIRLKKGEKTDLSVSVKPRWPMTTLLKLSAHHKV

SEQ ID NO: 45714 - DNA, 1062 bp, Candidatus Blochmannia floridanus
  CDS (1)..(1062)
atgcgtgtcttaggaattgaaacttcttgtgatgaaactggcatagcggtgtatgatgaatatagaggtttattagtacataaagtgtatagtcaaggtgtattacattcgcgttatggaggagtagtaccagagttagcagcgagagatcacattcgtaaggttattccattaattgtaggatcactgaagcaagcgcgtttaatatcgagtgatatagatgcggtagcatatactgctggtcctggattaataggtgcattgttggtgggagcttctgttgcgtgttcattagcttatgcttggaatgtgcctgttattggtgtacatcatatggaagctcatttgttgactccgatgctgaataaaaaacttattatttctaatagtactagtttttctgattttattgatgtaattgattttccttttattgctttgttagtatctggaggtcatactcaacttgttatggtaaaaaatataggtgagtataagatattaggagaatctgttgatgatgctgtaggagaggtatttgataaaattgctgtgtttttaggtttaggatatccaggaggagcattattatctgaaatggcgcaagtcggtataaaaggacgttatatttttccaaaacctatgattaacaaaccaggttttaattttagtttttctggattaaagactgctgttattcgtgctattatgtcaagctctaatgatcagcaaactcgagcagatattgcatgtggatttgaacgagccgttgttgaaacgttgtctgtgaaatgttacaaagcgttaaaacagatgaaagtaaaatatttagtgatatcaggtggagttagtgctaatacaatgttaagatcaaagttgttaaagatgatgtattcaatttcaggtaagttattatgtccagaattagagttttgtacagataatggagcaatggtagcatatactggtttaattagattgaaagcaggtttgtcaaatcgagatttatcgattacggtaaaaccacgttggtcattagaatctttacctagtattttttga

SEQ ID NO: 45715 - protein, 353 aa, Candidatus Blochmannia floridanus
MRVLGIETSCDETGIAVYDEYRGLLVHKVYSQGVLHSRYGGVVPELAARDHIRKVIPLIVGSLKQARLISSDIDAVAYTAGPGLIGALLVGASVACSLAYAWNVPVIGVHHMEAHLLTPMLNKKLIISNSTSFSDFIDVIDFPFIALLVSGGHTQLVMVKNIGEYKILGESVDDAVGEVFDKIAVFLGLGYPGGALLSEMAQVGIKGRYIFPKPMINKPGFNFSFSGLKTAVIRAIMSSSNDQQTRADIACGFERAVVETLSVKCYKALKQMKVKYLVISGGVSANTMLRSKLLKMMYSISGKLLCPELEFCTDNGAMVAYTGLIRLKAGLSNRDLSITVKPRWSLESLPSIF

SEQ ID NO: 45716 - DNA, 1041 bp, Bordetella pertussis Tohama I
  CDS (1)..(1041)
atgatcattctcggctttgaaagctcgtgcgacgaaaccggcgtggccgccgtctgcaccgagcgcggcctgcttgcgcacgccctgcatacccagatcgccatgcaccaggaatatggtggcgtggtgcccgaactcgcctcgcgcgaccatatccggcgcgtggtgccgctgacccgccaggtgctggccgaggccggcctgacgctggctgacgtgggcgcggtggcctacaccgccgggccgggcctggccggcgccttgctggtgggcgccagcgtggcccaggcgctggcctggtcgcgcgcgctgccggccatcggcatccatcacctggaaggacatctgctgtcgccgctgctggccgagccgcgtcccgagtttccgttcgtggccttgctggtctcgggcgggcatacccagctgatgctggtcgacggcgtgggccgctacgaactgctgggcgagacgctggacgacgccgccggcgaggccttcgacaaatcggccaaactgatgggcctgggctatccgggcggccccgcgctggcgcgcctggccgagcagggcgacgccagccgctacgacctgccgcgccccatgctgcacagcggcgacctggatttcagcttcagcggattgaagaccgcggtcctgacccgtgtgaaagcggccacgcgcgatggcggcgaactgggcgaacaggaccgcgccgacctggcggcggcaacgcaggccgccatcgtcgaggtgctggcggccaaggccatccgcgccttgaagcagacgggcctgcgccgcctggtggtggccggcggggtaggcgccaacgcgctgctgcgcgcgcatctggcgcgcgcgctcaagcccttgcgggccgaagcctattttccgccgctgtcgctgtgcaccgacaatggcgccatgatcgcgttcgcggcggccgagcgggtcaaggccggactggccgacctgcgcgagggcgaccacgccttcacggtgcggccgcgctgggatctggcggacatccaggccgggtag

SEQ ID NO: 45717 - protein, 346 aa, Bordetella pertussis Tohama I
MIILGFESSCDETGVAAVCTERGLLAHALHTQIAMHQEYGGVVPELASRDHIRRVVPLTRQVLAEAGLTLADVGAVAYTAGPGLAGALLVGASVAQALAWSRALPAIGIHHLEGHLLSPLLAEPRPEFPFVALLVSGGHTQLMLVDGVGRYELLGETLDDAAGEAFDKSAKLMGLGYPGGPALARLAEQGDASRYDLPRPMLHSGDLDFSFSGLKTAVLTRVKAATRDGGELGEQDRADLAAATQAAIVEVLAAKAIRALKQTGLRRLVVAGGVGANALLRAHLARALKPLRAEAYFPPLSLCTDNGAMIAFAAAERVKAGLADLREGDHAFTVRPRWDLADIQAG

SEQ ID NO: 45718 - DNA, 1041 bp, Bordetella parapertussis 12822
  CDS (1)..(1041)
atgatcattctcggctttgaaagctcgtgcgacgaaaccggcgtggccgccgtctgcaccgagcgcggcctgcttgcgcacgccctgcatacccagatcgccatgcaccaggaatatggtggcgtggtgcccgaactcgcctcgcgcgaccatatccggcgcgtggtgccgctgacccgccaggtgctggccgaggccggcctgacgctggccgacgtgggcgcggtggcctacaccgccgggccgggcctggccggcgccttgctggtgggcgccagcgtggcccaggcgctggcctggtcgcgcgcgctgccggccatcggcatccatcacctggaaggacatctgctgtcgccgctgctggccgagccgcgtcccgagtttccgttcgtggccttgctggtctcgggcgggcatacccagctgatgcgggtcgacggcgtgggccgctacgaactgctgggcgagacgctggacgacgccgccggcgaggccttcgacaaatcggccaaactgatgggcctgggctatccgggcggctccgcgctggcgcgcctggccgagcagggcgacgccagccgctacgacctgccgcgtcccatgctgcacagcggcgacctggatttcagcttcagcggattgaagaccgcggtcctgacccgtgtgaaagcggccacgcgcgatggcggcgaactgggcgaacaggaccgcgccgacctggcggcggcaacgcaggccgccatcgtcgaggtgctggcggccaaggcgatccgcgccttgaagcagacgggcctgcgccgcctggtggtggccggcggggtgggcgccaacgcgctgctgcgcgcgcatctggcgcgcgcgctcaagcccttgcgggccgaagcctattttccgccgctgtcgctgtgcaccgacaatggcgccatgatcgcgttcgcggcggccgagcgggtcaaggccggactggccgacctgcgcgagggcgaccacgccttcacggtgcggccgcgctgggacctggcggatatccaggccgggtag

SEQ ID NO: 45719 - protein, 346 aa, Bordetella parapertussis 12822
MIILGFESSCDETGVAAVCTERGLLAHALHTQIAMHQEYGGVVPELASRDHIRRVVPLTRQVLAEAGLTLADVGAVAYTAGPGLAGALLVGASVAQALAWSRALPAIGIHHLEGHLLSPLLAEPRPEFPFVALLVSGGHTQLMRVDGVGRYELLGETLDDAAGEAFDKSAKLMGLGYPGGSALARLAEQGDASRYDLPRPMLHSGDLDFSFSGLKTAVLTRVKAATRDGGELGEQDRADLAAATQAAIVEVLAAKAIRALKQTGLRRLVVAGGVGANALLRAHLARALKPLRAEAYFPPLSLCTDNGAMIAFAAAERVKAGLADLREGDHAFTVRPRWDLADIQAG

SEQ ID NO: 45720 - DNA, 1071 bp, Prochlorococcus marinus subsp. pastoris str. CCMP1986
  CDS (1)..(1071)
atgcacaaagttctagctattgaaacaagttgtgatgagacgtctgtctcaattgtttctaatagtggtgatatttataaaatacattcaaatattgttgcatcacaaattgaagatcattctaaatggggaggtgtggtcccagaactcgcagcgagaaaacatttagagttacttccttttgtcctagaacaagctttagaagaatcaaaaattcgaattgaaaaaattgatgttatagcttcaacagttacaccaggattagttggctgtttaagggttggttctataactgcaagatcactatgtactttatactcaaaaccttttttggggatacatcacttagaaggacatctttcgtcaatattattttcaaaaaattatcccaagcctcctttcttaaccttacttgttagtggtggacatactgaattaataaaagttggtgagagaagaaagatgcaaagacttggaagaagttatgatgacgctgctggtgaagcgttcgataaagtaggaagattattaggactcagttatcctggaggtcctgcaattgcgaaaatcgccaaaaagggtaatgcctccaaatttaatttacctaaatgcaagatctctgataaggaagggggttttttgaaatatgatttctcttttagtggtttaaaaacggctgtattaagattggttgagaaaataaatttaaatggggatgaaataccaattccagatattgctgcaagttttgagagggttgtagcagaggtgttagtagagaggacaataaaatgtgcaaatgattatggtttagataatatcgtcgttgtaggaggagtcgcggctaacgatacgttaagaaaaatgatgattagtgaagcttgtaaaaaatctattaaagttcatttagctccaataaatctttgcacagataatgcggcgatgattggagccgctgccttatatagactcaaatttaaggcatatgaaagttctcttaaattgggtatttcaggaagactccctattgaccaagcaaatactctttatgaaaataaacctcctttctag

SEQ ID NO: 45721 - protein, 356 aa, Prochlorococcus marinus subsp. pastoris str. CCMP1986
MHKVLAIETSCDETSVSIVSNSGDIYKIHSNIVASQIEDHSKWGGVVPELAARKHLELLPFVLEQALEESKIRIEKIDVIASTVTPGLVGCLRVGSITARSLCTLYSKPFLGIHHLEGHLSSILFSKNYPKPPFLTLLVSGGHTELIKVGERRKMQRLGRSYDDAAGEAFDKVGRLLGLSYPGGPAIAKIAKKGNASKFNLPKCKISDKEGGFLKYDFSFSGLKTAVLRLVEKINLNGDEIPIPDIAASFERVVAEVLVERTIKCANDYGLDNIVVVGGVAANDTLRKMMISEACKKSIKVHLAPINLCTDNAAMIGAAALYRLKFKAYESSLKLGISGRLPIDQANTLYENKPPF

SEQ ID NO: 45722 - DNA, 1071 bp, Prochlorococcus marinus str. MIT 9313
  CDS (1)..(1071)
atgccgacggtgcttgccctcgaaacaagttgtgacgagtcggctgccgcagttctacgtctaaataacgggtgtttgcaggttatcgctagccgaattgcttctcaggttgagaaacatgcccagtggggaggcgtggtaccggaagtggcctctcgcttgcatgtggaggctctgcctcatcttgtagaggaggttttgcaggaggcgggacagtcgatggctcgctttgatgctgtagcggcaacggtgacccctgggctggccggagcactgatggtgggatcggtgacaggccgatctttggctgctctccatgcgctgcctttttttggcattcatcacctggaggggcatttggcttcagtgcgcttggcggaacatcctccacgccctccttatctggtgctacttgtgagcgggggacacactgagttgattcgggtcggggcagagagtgagatggtgcgtcttggacgtagccatgatgatgctgctggagaggcttttgacaaagttggtcgtttgctcggtttggcctatccaggtggccccgctattcaggcgttggccgcgactggagactctggcagattttctttgcccaaaggacgggtctctaagcctggtggtggatttcatccctacgatttctctttcagcggattgaagaccgccatgctgcgcctggttcaggctctttcagaggctgatgaagacctgccccgcgcagatcttgctgccagttttgagcaagtggttgcagatgttttggtcgagcgcagcttgctctgcgctaatgaccagggcctaaaaactgtggtgatggttggaggagtcgctgctaaccgccgcctaagagaactgatgagcaaacgtggacaagaacagggaattgaagtgcacacggcaccgcttcgatactgcacggataatgccgccatgattggagcagcggccctgcagcgcttggtgtctggggttaatggcagctctcttgagctgggagtggcagcccgatggccattggacaaaaccgaggttttgtaccattcacctcccccattttga

SEQ ID NO: 45723 - protein, 356 aa, Prochlorococcus marinus str. MIT 9313
MPTVLALETSCDESAAAVLRLNNGCLQVIASRIASQVEKHAQWGGVVPEVASRLHVEALPHLVEEVLQEAGQSMARFDAVAATVTPGLAGALMVGSVTGRSLAALHALPFFGIHHLEGHLASVRLAEHPPRPPYLVLLVSGGHTELIRVGAESEMVRLGRSHDDAAGEAFDKVGRLLGLAYPGGPAIQALAATGDSGRFSLPKGRVSKPGGGFHPYDFSFSGLKTAMLRLVQALSEADEDLPRADLAASFEQVVADVLVERSLLCANDQGLKTVVMVGGVAANRRLRELMSKRGQEQGIEVHTAPLRYCTDNAAMIGAAALQRLVSGVNGSSLELGVAARWPLDKTEVLYHSPPPF

SEQ ID NO: 45724 - DNA, 1065 bp, Synechococcus sp. WH 8102
  CDS (1)..(1065)
atgacatcagtcctagccctcgaaacaagttgtgacgagtcggcagcggccttggtctggcgagatgccgatggaagattcgaggtttcctcggcacgcattgcctctcaggttgaagagcacgcccgctggggtggtgttgtgccggagatcgcgtcgcgtcgtcacgtggaagcattgccggggttgatccagcaggtgctggacgagtcggattccaccctcgccgaggtggatgcgattgccgccacggtgacgccagggttggctggcgcactgatggtggcctctgtgaccggacgcacactgtcagcgctgcgtgatcgccccttcctggcggtgcaccatctcgaaggacatctggcatcggtgcacctggcggagcatcgcccccaactgccctacttggtgctgctggtgagcggtgggcacaccgaactgatccgcgtcgaagcggatggggcgatggagcggcttggccgcagccacgacgatgctgcgggggaggccttcgacaaagtggcccgcttgcttggccttggctacccgggtggaccggccattcaggccgcggcggaggggggtgatggccgtcggttcaagttgccaaagggccgtatctccctgccagagggaggtttccatccctatgacttctcgttcagcgggctgaaaacggccatgctgcgcaccgtggaggctcagtcaggtccgctgccgacggctgatctggcggccagttttgagcaggtggtggtggacgttctggtggagcgcagtttgcgctgtgccatggaccatggccttgaagagctggtgatggtgggtggtgtggcggccaatcgccggttgcgacaaaccctggaacagcgctccaacgccgtgggggtgcgggtctcggtggcaccgctggcgtattgcaccgataacgccgccatgatcggtgccgctgccctgttgcgctgggacgctggcgcccggggctgttccttgaggactggggtgtcagcgcgctggcctctcgcgcaggtcgaccagctttacaccgagcagccagccttttga

SEQ ID NO: 45725 - protein, 354 aa, Synechococcus sp. WH 8102
MTSVLALETSCDESAAALVWRDADGRFEVSSARIASQVEEHARWGGVVPEIASRRHVEALPGLIQQVLDESDSTLAEVDAIAATVTPGLAGALMVASVTGRTLSALRDRPFLAVHHLEGHLASVHLAEHRPQLPYLVLLVSGGHTELIRVEADGAMERLGRSHDDAAGEAFDKVARLLGLGYPGGPAIQAAAEGGDGRRFKLPKGRISLPEGGFHPYDFSFSGLKTAMLRTVEAQSGPLPTADLAASFEQVVVDVLVERSLRCAMDHGLEELVMVGGVAANRRLRQTLEQRSNAVGVRVSVAPLAYCTDNAAMIGAAALLRWDAGARGCSLRTGVSARWPLAQVDQLYTEQPAF

SEQ ID NO: 45726 - DNA, 1026 bp, Chromobacterium violaceum ATCC 12472
  CDS (1)..(1026)
atgctggtacttggcattgaatcctcctgcgacgaaaccggcgtcgcgctgtacgacaccgaacgcggcctgctggcccatcagctgcatactcaaatggcgatgcacgccgagtacggcggcgtggtgcccgagctggccagccgcgaccacatccgccgcgccatcccgctgaccgaagcctgcctctccgaggcgggcaagaaactcgccgatctggacgccatcgcctacacccagggccctggcctgggcggcgcgctgatggtgggcgccagcatggccaatgcgctggccttcggcctgaatattcccgtcatcccggtacaccacctggaaggccatctgctgtcgccgctgctggccgatcccaagccggaattccccttcctggcgctgctggtttccggcggacacacccagttgatggcggtgcgcggcgtcggcgactacgaaatcctcggcgagaccgtggacgacgccgccggcgaggccttcgacaaaaccgccaagctgctgggcctgccctaccctggcggcccgctgctgtccaggctggcggaatccggcagcccggaccgcttcacgctgccgcggcccatgctgcactcaggcaatctggacatgagcttctccggcctgaagacggcggtgctgacgctggtgcgccagcaggagtccgcgcagggcgagctggacgaacagacgcggatggatatctgccgcgccttccaggaagccatcgtagaggtgctggtgaaaaagtccctcgccgcgatgaggcaggccggcatgaagcggctggtggtggccggcggcgtcggcgccaacaagcagctgcgcgccgcgctcaacgacgccgccgcgcgcaagcgtttcgacgtgttctacccgcccttggcgctgtgcaccgacaacggcgcgatgatcgccttcgccggcgccatgcgcctgaaattcgcggagccggccggcggcttcaccatcaagccgcgctgggatttgtccagcctgccggcagtataa

SEQ ID NO: 45727 - protein, 341 aa, Chromobacterium violaceum ATCC 12472
MLVLGIESSCDETGVALYDTERGLLAHQLHTQMAMHAEYGGVVPELASRDHIRRAIPLTEACLSEAGKKLADLDAIAYTQGPGLGGALMVGASMANALAFGLNIPVIPVHHLEGHLLSPLLADPKPEFPFLALLVSGGHTQLMAVRGVGDYEILGETVDDAAGEAFDKTAKLLGLPYPGGPLLSRLAESGSPDRFTLPRPMLHSGNLDMSFSGLKTAVLTLVRQQESAQGELDEQTRMDICRAFQEAIVEVLVKKSLAAMRQAGMKRLVVAGGVGANKQLRAALNDAAARKRFDVFYPPLALCTDNGAMIAFAGAMRLKFAEPAGGFTIKPRWDLSSLPAV

SEQ ID NO: 45728 - DNA, 1026 bp, Porphyromonas gingivalis W83
  CDS (1)..(1026)
atgaagaaagacattatcatattggggatcgaaagctcctgtgacgacacctctgcagccgtggtcaggaacgaaactatgcttagcaacgtgatcgcgggacaggccgtacacaaagcctacgggggagtggttcccgaactggcatcgcgtgcgcatcagcagaacattgtcccggtagtcagcgaagctatcaaacgtgccggcattcgcaaagaagaaattgatgccatcgctttcactcgtggaccgggtttgctgggatcgctccttgtaggcaccagctttgccaagggattgtctctttcattgggcattccgatgctggaagtcaatcatcttcatgcccatgtcctggccaacttccttcgtgagccgggtgaggagtcacagcatccctctttcccattcctgtgcttgttggtttcagggggcaactctcagattattctggttcgctccccttacgatatggaggtaataggacagacgatcgacgatgcagccggagaggctttcgacaaatgtgccaaggtgatggggttgggttatcccggaggccccatcgtcaataagttggcttccgagggcaaccccgatgctttccgctttgcccgtcctcatgtgtccggttacgactatagcttcagcggactcaagacatcattcctctatactctgcgcgacaaactggccgaagatcccgacttcatagaaaagaacaaggccgatctgtgcgcatctcttcagcacacggtcatagacatcttgatgaagaaacttcgccaagcggccaaagatcatagcatcaaacaagtggccttggccggcggtgtatcggccaataccggactgcgcgatgcttttcatgaccatgcccgacgttatggctggactgtattcattcccaaattcgcctatacaacggacaatgctgctatggtagccatttccggatactataagtacttgcagggcgatttctgccccatcgatgctgttccattctcgcgcatcacggtctga

SEQ ID NO: 45729 - protein, 341 aa, Porphyromonas gingivalis W83
MKKDIIILGIESSCDDTSAAVVRNETMLSNVIAGQAVHKAYGGVVPELASRAHQQNIVPVVSEAIKRAGIRKEEIDAIAFTRGPGLLGSLLVGTSFAKGLSLSLGIPMLEVNHLHAHVLANFLREPGEESQHPSFPFLCLLVSGGNSQIILVRSPYDMEVIGQTIDDAAGEAFDKCAKVMGLGYPGGPIVNKLASEGNPDAFRFARPHVSGYDYSFSGLKTSFLYTLRDKLAEDPDFIEKNKADLCASLQHTVIDILMKKLRQAAKDHSIKQVALAGGVSANTGLRDAFHDHARRYGWTVFIPKFAYTTDNAAMVAISGYYKYLQGDFCPIDAVPFSRITV

SEQ ID NO: 45730 - DNA, 996 bp, Wolinella succinogenes DSM 1740
  CDS (1)..(996)
ttgattttaagcattgaaagcagttgcgatgatagctctatcgcgatcacacgcctagaggatagggcgattctatttcacaagaaaatctctcaagattccgctcatagtcctcatggcggggtggttccagaacttgcgagccgccttcatgccgtggcgctccctaaaatattagaggagtgcgcccccttcttccctcgcctcaaggctatcgccgtgaccaatgagccgggtcttagcgtcactcttttagagggcgtgatgatggccaaagcccttgcgcttgccctccatctcccccttatcgcagtcaaccacctcaaaggccacctctactcgctctttttagagcaagaatcacgattccctttggatgtgctgctcgtctcagggggacacaccatggtgcttcatgcacgctcttttggcgagattgagatcatcgggcagagtatggatgatagctttggcgaaagttttgataaagtcgccaaaatgctctctctaggctatcccggaggcccgatcgtggaatcttacgccaaagagggggacgcttcgcgattccctttgccccttcctcttgcgggtaaaaaagaggtcgcctttagcttctctggactcaaaaacgctgtgcgtctagtcatacaatccctgcaaaatcctccaaatgaacaagaaaaacgcgatatatgcgcctcttttcaagccactgcaatcgcccatctaatccaaaaatgccgcctctatctcgccacctccaatgccccttatttggctatcgtggggggagcgagcgcgaatctggctctccgagaggagatggaacggcttggtgagcattttggcaaaaaactccttctcgcccctttggcctactgctccgataatgccgcgatgattggacgcgccgcccttgaatcctacgccctaggagccttcacttcccccctagagctcaccgtgcgccctcgcaccccaagcctttgttaa

SEQ ID NO: 45731 - protein, 331 aa, Wolinella succinogenes DSM 1740
MILSIESSCDDSSIAITRLEDRAILFHKKISQDSAHSPHGGVVPELASRLHAVALPKILEECAPFFPRLKAIAVTNEPGLSVTLLEGVMMAKALALALHLPLIAVNHLKGHLYSLFLEQESRFPLDVLLVSGGHTMVLHARSFGEIEIIGQSMDDSFGESFDKVAKMLSLGYPGGPIVESYAKEGDASRFPLPLPLAGKKEVAFSFSGLKNAVRLVIQSLQNPPNEQEKRDICASFQATAIAHLIQKCRLYLATSNAPYLAIVGGASANLALREEMERLGEHFGKKLLLAPLAYCSDNAAMIGRAALESYALGAFTSPLELTVRPRTPSLC

SEQ ID NO: 45732 - DNA, 1029 bp, Gloeobacter violaceus PCC 7421
  CDS (1)..(1029)
gtgacaaccatctttgccatcgagaccagttgtgacgaaagcgccgccgccatcgtgcgcggtcggaccgtcgtcgcgtcgatcatcgcttcgcaaatcgacgtgcaccgcctgaccggcggtgttgtgccggaggtcgcctcgcgcgagcacctgcaggcgttgggcggggtgatcgcggcgtgttttgccgagggcggcctggggtgggccgacatcgacgctgtcgcctttacctgtgctcccggcctggtcggctcgttgctgatgggatcgatggcagccaagaccctggctctcgttcacgccaggccgctggtcggcatccaccacctcgaaggtcacatctactcggcttttttgagcgacccggccctggagccgccctttttgtgtctgctcgtctcggggggacacaccagcttggtggctgtcgaggatcatggccgctaccgcatcctggggcgcacccgcgacgacgccgtgggcgaagcctacgacaaggtggcgcgggtactgggacttggttacccgggcggtcctgcgatcgacaaattggcgcagcggggagacccgcgcgcctttgcgctgccgggggggcgggtcgaatcgcccttcgacaccagcttcagcggcctgaagaccgccgtgctgcgcctggccgaaaaacaccggctccagcgtctgcccatcgaccgggcggatctggccgcgagcttccagcgcaccgtggtagagaccctggccgagcgggtggagttggccctggcccacaccggctatgacacggtggtggtggcggggggcgtctccgccaaccgcggcttgcgcgaacgcctcgggcaagccggaccctaccgggccgttttcccgccgatgcacttttgtaccgacaacgcggcgatgatcgcctgcgccggggtggcccgcttcgagagggggttccgttcatctctcgatctgccggtgcaatcgcgcttgtcgctcgaagcgtgtgacagcctttaccagtgcctgccggtcccttga

SEQ ID NO: 45733 - protein, 342 aa, Gloeobacter violaceus PCC 7421
MTTIFAIETSCDESAAAIVRGRTVVASIIASQIDVHRLTGGVVPEVASREHLQALGGVIAACFAEGGLGWADIDAVAFTCAPGLVGSLLMGSMAAKTLALVHARPLVGIHHLEGHIYSAFLSDPALEPPFLCLLVSGGHTSLVAVEDHGRYRILGRTRDDAVGEAYDKVARVLGLGYPGGPAIDKLAQRGDPRAFALPGGRVESPFDTSFSGLKTAVLRLAEKHRLQRLPIDRADLAASFQRTVVETLAERVELALAHTGYDTVVVAGGVSANRGLRERLGQAGPYRAVFPPMHFCTDNAAMIACAGVARFERGFRSSLDLPVQSRLSLEACDSLYQCLPVP

SEQ ID NO: 45734 - DNA, 1014 bp, Photorhabdus luminescens subsp. laumondii TTO1
  CDS (1)..(1014)
atgcgagttttaggtatagaaacgtcctgcgatgaaaccggaatcgcaatttatgacgacgaagccggtttattggcaaatcaattatacagtcagattaaactgcatgctgattacggtggtgtcgtgcctgaattggcttcacgtgaccatatccgcaaaacagtgcccttaattcaagctgctttgaaagaagcaggattaacctgtaaagatattgatgcggtggcttatacagcaggtcctggtctggttggtgcattgttggtgggggcgacgattggccgttctctggcgtttgcttgggatgttcctgcgattcctgttcatcatatggaagggcatttactcgctccaatgctggaagataacagtcctgagttcccgtttgtagctttgctggtgtctggtggtcatacacagcttattagtgtgacgggtatcggtaaatatgagctacttggtgaatcaatagatgatgccgctggtgaagcgtttgataaaacagctaagttactgggattggattatccaggagggccggtactctccagaatggctcagaaaggagaagttgggcgttttgtatttcctcgcccgatgacagatcgtcctgggttggatttcagtttttcaggattgaaaacttttgcgtctaatactattcataacaacagcgatgatgagcagaccagagcggatattgcccgcgcttttgaagacgcagtggttgatacattagcgattaaatgtaagagagcgcttgagcagaccgggttcaagcgactagtgatggctggtggtgtcagcgccaaccgggcattgcggattaaaatggaagaggtcatggcaaaattgggtggcgaagtattttatgcgcgccctgaattctgtacagataacggtgccatgattgcgcttgccggcatgatccgcctaaaaggagaggtgaatgactcacttggcgtgatagtcaaagcccgctggccattgtcggaattacctccattataa

SEQ ID NO: 45735 - protein, 337 aa, Photorhabdus luminescens subsp. laumondii TTO1
MRVLGIETSCDETGIAIYDDEAGLLANQLYSQIKLHADYGGVVPELASRDHIRKTVPLIQAALKEAGLTCKDIDAVAYTAGPGLVGALLVGATIGRSLAFAWDVPAIPVHHMEGHLLAPMLEDNSPEFPFVALLVSGGHTQLISVTGIGKYELLGESIDDAAGEAFDKTAKLLGLDYPGGPVLSRMAQKGEVGRFVFPRPMTDRPGLDFSFSGLKTFASNTIHNNSDDEQTRADIARAFEDAVVDTLAIKCKRALEQTGFKRLVMAGGVSANRALRIKMEEVMAKLGGEVFYARPEFCTDNGAMIALAGMIRLKGEVNDSLGVIVKARWPLSELPPL

SEQ ID NO: 45736 - DNA, 1020 bp, Vibrio vulnificus YJ016
  CDS (1)..(1020)
atgcgcattctcggcattgaaacctcctgtgatgaaacaggaatcgccatttatgacgatgaaaaaggcctactggcccataaattatatagccaaattaaactgcatgccgattacggcggtgtcgtgcctgagctcgcttctcgtgaccacgtgaagaaaaccattcctcttattaaagaggcgttgaaagaagccaatttaacagcaaaagatattgatggtgttgcttacacagcagggccaggtttggttggggcacttttggtgggggcaacgatcggtcgaagcctcgcttacgcttggggagtgccagccgttccggttcatcatatggaaggtcacttgctcgcacctatgcttgaagacaacccaccgccgtttccatttgtagcggtattggtctcgggtggtcactcgatgatggtggaagtgaaaggcattggtgagtacaaaatcctaggcgaatccattgatgatgcggcgggtgaagcattcgataagacggcgaagctcatgggcctagattatccaggtggtccattgctgtctaaattggccgaaaaagggacgccgggtcgctttaagtttccgcgtccgatgaccaatgtgcccggtttggacatgagcttctctggtttgaaaacctttaccgcaaataccattgcggcgaatggtgatgatgaacaaacacgcgccgatattgcgtacgcttttgaagaggccgtgtgtgccacattggcgatcaaatgtaagcgcgcgctagagcaaacgggtatgaaacgtattgtgattgcgggtggggtgagtgccaaccgtcgtcttcgtgctgagctagaaaaactggcgcacaaagtgggtggggatgtctattatccacgtaccgagttttgtactgataatggtgcaatgatcgcgtatgcgggcatgcaacgtttgaagaataatgaagtgtcagatcttgcggtagaggcccgacctcgctggccaattgatcaattgacgccagtgatgaaataa

SEQ ID NO: 45737 - protein, 339 aa, Vibrio vulnificus YJ016
MRILGIETSCDETGIAIYDDEKGLLAHKLYSQIKLHADYGGVVPELASRDHVKKTIPLIKEALKEANLTAKDIDGVAYTAGPGLVGALLVGATIGRSLAYAWGVPAVPVHHMEGHLLAPMLEDNPPPFPFVAVLVSGGHSMMVEVKGIGEYKILGESIDDAAGEAFDKTAKLMGLDYPGGPLLSKLAEKGTPGRFKFPRPMTNVPGLDMSFSGLKTFTANTIAANGDDEQTRADIAYAFEEAVCATLAIKCKRALEQTGMKRIVIAGGVSANRRLRAELEKLAHKVGGDVYYPRTEFCTDNGAMIAYAGMQRLKNNEVSDLAVEARPRWPIDQLTPVMK

SEQ ID NO: 45738 - DNA, 1053 bp, Corynebacterium diphtheriae NCTC 13129
  CDS (1)..(1053)
atgattgttcttggtattgagtcgtcgtgtgatgagacgggtgtggggattattgatttggccgatgacggcacgatgacgattgtgggggatgcggtggcgtcgtcgatggagcagcatgcgcgttttggtggtgtggttccggagattgcgtcgcgtgctcatttggagtcgatgattccggtgatgaaggaggcattggcgcaggcgggggtggagcgtcctgatgcggtggctgcgacggtgggccctgggttggctggtgcgttgttggtgggggcgtcggctgctaaggcgtatgcggctgcgtggggtgttccgttttatggtgtgaatcatttgggtggccatgtggcggtggcgaatttggagggggaggagttgccgcattcgattgcgttgttggtgtcgggtgggcatacgcagattcttgaggttcaggcggtggggaagccgatgcgggagttggggtcgacgcttgacgacgccgccggcgaggcttatgacaaggtggcacggctgcttgggttgggttacccaggcgggccggttgtggataagcttgctgctcgcggtaatcgtaaggcgattcgtttcccgcgtggcctttcgcgtgccgacgatctgcgtggtgagcaccgctatgatttttcgttttcgggtgtgaaaacgtcggtggctcgttacgtggagtctgcggagcgcgagggccgtgtgatttctgtggaggatgtgtgtgcgtcgttccaggaggctgtggtggatgtgttgacgtcgaaggccatcatggcgtgtaaagatacgggtgcttcggtgctgttgcttggtggcggtgtggcggcgaattcgcgattgcgggagttggcggcggcgcgatgccaaagtgcgagcatcgagttgcgggtgccgagctttaagttatgcacggataatggcgtgatgattgctgcggtggcgtctcagttgattcatgagggtgcgcagccttcgggcttgtcggtgggaacggatacttctttggaagtggaaatcccgttggtgcattcgctgtag

SEQ ID NO: 45739 - protein, 350 aa, Corynebacterium diphtheriae NCTC 13129
MIVLGIESSCDETGVGIIDLADDGTMTIVGDAVASSMEQHARFGGVVPEIASRAHLESMIPVMKEALAQAGVERPDAVAATVGPGLAGALLVGASAAKAYAAAWGVPFYGVNHLGGHVAVANLEGEELPHSIALLVSGGHTQILEVQAVGKPMRELGSTLDDAAGEAYDKVARLLGLGYPGGPVVDKLAARGNRKAIRFPRGLSRADDLRGEHRYDFSFSGVKTSVARYVESAEREGRVISVEDVCASFQEAVVDVLTSKAIMACKDTGASVLLLGGGVAANSRLRELAAARCQSASIELRVPSFKLCTDNGVMIAAVASQLIHEGAQPSGLSVGTDTSLEVEIPLVHSL

SEQ ID NO: 45740 - DNA, 1170 bp, Rhodopseudomonas palustris CGA009
  CDS (1)..(1170)
atgattgcattccaagaccccgcaatgctacgcgaggcaaggagaacgccggttcgggcgcaaacgcaagggctcaatttgactagtgaacaagccttgctggtgctggggatcgagaccacctgcgatgaaaccgcagccgccgtggtcgagcggcgcgctgacggcagcgggcgcctcctctccaatatcgtgcgttcccagaccgatgaacacgccccctttggtggcgttgtcccggagatcgccgcgcgcgcccatgtcgatgtgctcgacggcatcatcgcggcggcgatgaacgaagccggcgtggcgttcgccagtctgtccggggttgcggcagccgccgggccagggctgatcggtggcgtgatcgtcggactgaccaccgccaaggcgattgcgctggtgcacggcactccgctgatcgcggtcaatcacctcgaagcccacgcgctgacgccccggctgaccgactcggtcgaatttccctactgtctgttcctcgcgtccggcggccacacccagatcgtcgcggtgctcggcgtcggcaattacgtccggctcggcaccacggtcgacgacgcgatcggcgaggcattcgacaagatcgccaagatgctcggcctgccctaccctggcggccctcaggtcgagcgcgccgcagaagccggcgatcccaaccgcttcgcatttccccgcccgatgctcgggcgccaggatgctaatttctctctgtccgggctgaagactgcggtccgcaacgaggccggtaaactgacgccgctcgatccgcaggacatcaacgatctgtgcgcgggctttcaggccgcggtgctggaatcggtggccgaccggctcggcgccgggctgcggctgttcaaggaacggttcgggccgccgaaggcgctggtcgcggccggcggcgcggctgccaatcaggcgatccgccggatgctgcgcgaagtcgccgccaaggtgcagaccacgctgatcgtgccgccgccggcgctgtgcaccgacaacggcgcgatgatcgcctgggccggagccgagcggctggcgctcggcctcaccgacacgatggataccgcgccgcgcgcgcgttggctgctcgacgccaacgccaccgcaccggcgaaatttgccaacacgcgtgccgggttctaa

SEQ ID NO: 45741 - protein, 389 aa, Rhodopseudomonas palustris CGA009
MIAFQDPAMLREARRTPVRAQTQGLNLTSEQALLVLGIETTCDETAAAVVERRADGSGRLLSNIVRSQTDEHAPFGGVVPEIAARAHVDVLDGIIAAAMNEAGVAFASLSGVAAAAGPGLIGGVIVGLTTAKAIALVHGTPLIAVNHLEAHALTPRLTDSVEFPYCLFLASGGHTQIVAVLGVGNYVRLGTTVDDAIGEAFDKIAKMLGLPYPGGPQVERAAEAGDPNRFAFPRPMLGRQDANFSLSGLKTAVRNEAGKLTPLDPQDINDLCAGFQAAVLESVADRLGAGLRLFKERFGPPKALVAAGGAAANQAIRRMLREVAAKVQTTLIVPPPALCTDNGAMIAWAGAERLALGLTDTMDTAPRARWLLDANATAPAKFANTRAGF

SEQ ID NO: 45742 - DNA, 1026 bp, Mycobacterium avium subsp. paratuberculosis str. k10
  CDS (1)..(1026)
gtgacgaccatcctggcgatcgaaacctcttgcgacgaaacgggagtcggcatcgcgcggctggacgccgacggcgcggtgaccctgctggccgacgaggtcgcctccagcgtcgacgagcacgtgcggttcggcggcgtggtgcccgagatcgcgtcgcgcgcacacctggaggccctggggcccaccatgcgccgcgccctgtccgccgccggcgtgaccaaacccgacgtcgtcgcggccaccatcgggcccgggctggccggtgccctgctggtgggagtcgctgcggccaaagcgtattcggcggcctggggggtgccgttctacgccgtcaaccacctgggcgggcacctggccgccgacgtctaccagcacgggccgctgcccgagtgcgtcgcgctgctggtctccggcggccacacccacctgctgcaggtgcgctcgctcggcgacccgatcgtcgagctgggcagcaccgtcgacgacgccgcgggcgaggcctacgacaaggtggcgcggctgctggggctgggctacccgggcggccgggtgctcgacgagctggcccgcaccggcgaccgggaggcgatcgtgttcccgcgcggcatgaccggcccgcgtgacgccccgtacgcgttcagtttctccgggctcaagacggccgtggcgcggtacctggaaagccacccggacgcggtgaacgccgacgtcgcggccggcttccaggaggccgtcgccgacgtactgacccgcaaggcggtgcgcgcggccaccgacctcggcgtcaccaccctgctgatcgcggggggagtggccgccaactcgcggctgcgcgagctggccgagcagcgctgcgcggcggccgggctgacgctgcgcataccccggccggggctgtgcaccgacaacggggcgatgatcgcgtcgttcgccgcgcatctggtggccgccggggcgccgccgtcgccgttggacgtgcccaccgatccgggcctgccggtggtgaaagcgcaggtcagctga

SEQ ID NO: 45743 - protein, 341 aa, Mycobacterium avium subsp. paratuberculosis str. k10
MTTILAIETSCDETGVGIARLDADGAVTLLADEVASSVDEHVRFGGVVPEIASRAHLEALGPTMRRALSAAGVTKPDVVAATIGPGLAGALLVGVAAAKAYSAAWGVPFYAVNHLGGHLAADVYQHGPLPECVALLVSGGHTHLLQVRSLGDPIVELGSTVDDAAGEAYDKVARLLGLGYPGGRVLDELARTGDREAIVFPRGMTGPRDAPYAFSFSGLKTAVARYLESHPDAVNADVAAGFQEAVADVLTRKAVRAATDLGVTTLLIAGGVAANSRLRELAEQRCAAAGLTLRIPRPGLCTDNGAMIASFAAHLVAAGAPPSPLDVPTDPGLPVVKAQVS

SEQ ID NO: 45744 - DNA, 945 bp, Nanoarchaeum equitans Kin4-M
  CDS (1)..(945)
atgaaagtattgggaatagaatgtactgcccacacatttggggttgggatatttgatagtgaaaaaggtgttttagccaatgaaaaggtaacttacaagggctatggtatacatcctagagaagcagcagaattacatttaaaagagtttgacaaagtattattaaaagcattagaaaaagccaacattagtttaaaagacatagacttaatagctgtttcctctgggcctggtttattacctacattaaaattaggcaattacatagcagtatatttaggaaaaaaattaaataaaccagtaattggggtaaaccatatagtagcacataatgaatttgctagatatttagctaaagcgaaagacccattgtttgtatatgtatcaggagcgaatacccaatttttagcaatagtaaataacagttggtttttggttggagaaactttagatatgggggtaggcaatttaatagacaaagtcgctagagatctaggattagaattcccaggaggaccaaaaatagaggaattggcaaaaaaaggtaaaaatttaatcgaattgccttatacaataaaaggtttgaacttacaattgggaggaatttatacatacataaaaagaattaaagatcaatatagcaaagaggacatagcatactctttacaagagtgggtatttgctttaatattagaaatagcagaaagagccatgcatatgttagataaaaaagaattaatactaactggaggggttgcatgcaacaatagactaaacgatatggcagaacaaatggctaaagaaaataattttaaattctatagattgccttgccaatatttaacagacaacggagcaatgattgcttatttagggtattattggtatagccaaggaatatattatgaaccaaaacccagaccttattggaggatttggatttaa

SEQ ID NO: 45745 - protein, 314 aa, Nanoarchaeum equitans Kin4-M
MKVLGIECTAHTFGVGIFDSEKGVLANEKVTYKGYGIHPREAAELHLKEFDKVLLKALEKANISLKDIDLIAVSSGPGLLPTLKLGNYIAVYLGKKLNKPVIGVNHIVAHNEFARYLAKAKDPLFVYVSGANTQFLAIVNNSWFLVGETLDMGVGNLIDKVARDLGLEFPGGPKIEELAKKGKNLIELPYTIKGLNLQLGGIYTYIKRIKDQYSKEDIAYSLQEWVFALILEIAERAMHMLDKKELILTGGVACNNRLNDMAEQMAKENNFKFYRLPCQYLTDNGAMIAYLGYYWYSQGIYYEPKPRPYWRIWI

SEQ ID NO: 45746 - DNA, 1008 bp, Wolbachia endosymbiont of Drosophila melanogaster
  CDS (1)..(1008)
atgaaaaccattttagctgttgaaacaagctgcgacgaaactgcagtagcgattgtaaatagtgacaagcaagtccttgctcacgaaattctctcccaagcagaacacaaaaaacgtggtggggtgatccctgaaatagcttcacgtgctcatatggagcatttaagtggtctaataaaaagcgccgtggaaaaatctaaccttaacttttgtgacctcaatgcaattgcagcaacatcaggaccaggactcataggtggattaatagttggtacaatgatggctaaagcaattgcgcatgtagcacaaaaaccattcattgcagtgaatcacttagaagcgcatgcattggttattaggttactgcatgaggtaaaatttccatttttagtcctactaatatcaggtggtcactgtcaatttttaattgcacaggatgtaggtaaatacattaaacttggagaaacgctcgatgattcactaggagaagcatttgataaagttgctaagatgctgggtttaagctacccaggaggcccattaattgaaaagttggctaaaaaaggcaatggcacaagattcaaactgccgagggcaatgataaaacgttctggatgtaacttttcgttttctgggattaaaacagcagtaaaaaacttagtacaagaacttaaaatgagcgagcaagatgtgtgtgatgtatgtgcttcgtttcaagagtgtattagtgacatactgctggacagggttagtaatgcaattattatggccgaatctttaaatatcaaaatcaatgactttgtgattaccggcggagttgcagcaaataatttcttgagagaaaaattaaaacaacacataaacttaaacatattttttccccctaacgacctatgtacagacaatgcaattatggttggatggacaggaattgaaaggttacagaaaaattatatagatccacttaattttgcaccaagacctaagtgggagttagagagttattaa

SEQ ID NO: 45747 - protein, 335 aa, Wolbachia endosymbiont of Drosophila melanogaster
MKTILAVETSCDETAVAIVNSDKQVLAHEILSQAEHKKRGGVIPEIASRAHMEHLSGLIKSAVEKSNLNFCDLNAIAATSGPGLIGGLIVGTMMAKAIAHVAQKPFIAVNHLEAHALVIRLLHEVKFPFLVLLISGGHCQFLIAQDVGKYIKLGETLDDSLGEAFDKVAKMLGLSYPGGPLIEKLAKKGNGTRFKLPRAMIKRSGCNFSFSGIKTAVKNLVQELKMSEQDVCDVCASFQECISDILLDRVSNAIIMAESLNIKINDFVITGGVAANNFLREKLKQHINLNIFFPPNDLCTDNAIMVGWTGIERLQKNYIDPLNFAPRPKWELESY

SEQ ID NO: 45748 - DNA, 1038 bp, Bdellovibrio bacteriovorus HD100
  CDS (1)..(1038)
gtgattgaaagagttctcgccattgaaaccagctgtgatgacacctctgtcgcgatcgttgatcgtaccggctgggttcactctgtggtggcggcctctcaggatctggatcacgaaatctatggcggcatcgtccctgaaattgccgcccgcaaccattccatcgctttaattccattaatcgaagaagcctttaagaaagccaacatgaattggtctgacgtgcagggtattgccgtcaccaatcgtccgggtttgatcggcgctttgattgtggggctggtgactgcgaagtccttgtctcaggcaaaacatttgcctttcttgggtgtgaaccacctggaagggcatttgctggcgccgtttttgcgcgatgataaatatgctccaccggaagattttggttacccatatgtgggtttggcgatcagcggggggcacacaagtttgtatcaaattaaaggactgggcgattatcgtatcttgggtgctaccaaggatgatgcggccggggagtgtttcgataaatttgcaaagatggcaggcctggggttcccgggtggagtgcgcgtcgatcaaatggccaaggcggggaatccgcaggctttcgaattcccccgcagcatgatccatgatgacactttcgacatgagcttctcgggattaaaatcttccggccagcgcatgcttgaacaactgggaccagaacttgtgcaggagcgtctgccggatctgtgcgcctcgttccaggaagccatcgtggatgtcctgatcgcgaagctggatcgggcggcgaaagtcttccgctccaagcgtgtgattctgaccggcggggtcagcgcgaattcgcgtcttcgtcagcgggctcaggaatgggccgacaaaaaaggttatactttggtgatcccacctctgcgttactgtactgataacgccgcgatgatcggttacgtcggtgctttgcgcatggctcgcggtgaagtgtcggctttggatctgggaccgtcccctcaagctcttgcatcggattttaaatga

SEQ ID NO: 45749 - protein, 345 aa, Bdellovibrio bacteriovorus HD100
MIERVLAIETSCDDTSVAIVDRTGWVHSVVAASQDLDHEIYGGIVPEIAARNHSIALIPLIEEAFKKANMNWSDVQGIAVTNRPGLIGALIVGLVTAKSLSQAKHLPFLGVNHLEGHLLAPFLRDDKYAPPEDFGYPYVGLAISGGHTSLYQIKGLGDYRILGATKDDAAGECFDKFAKMAGLGFPGGVRVDQMAKAGNPQAFEFPRSMIHDDTFDMSFSGLKSSGQRMLEQLGPELVQERLPDLCASFQEAIVDVLIAKLDRAAKVFRSKRVILTGGVSANSRLRQRAQEWADKKGYTLVIPPLRYCTDNAAMIGYVGALRMARGEVSALDLGPSPQALASDFK

SEQ ID NO: 45750 - DNA, 1017 bp, Treponema denticola ATCC 35405
  CDS (1)..(1017)
atgaagatattaggaatagaaagttcttgcgatgaaactgcggcggcagtcgtcgaggacggaaataaaattttaagcaatattgttgcaacacaaattccgttccacaaaatgtataacggcgtcgttcccgaaatagcaagccgaaaacataccgaatggattttgcccgttgttaaacaagccttggctgaagccggtctgagccttaaagaaatagacggcatcgctgccaccggaaggccgggactcatgggttcccttttagtggggcttacctttgcaaaaactcttgcatggtcttcaaataaaccctttattgccgtaaatcacatgctgggacatctatatgcaagccatctggaaaatgatatcccctacccatatctggggcttttagtttcaggcgggcactcgattatctgcaaggtaaataattttgacgacatcgaagtcctcggcaccacaatagatgatgctccgggggaagcctttgacaaggttgccaagttttataatctgggatacccgggaggagccgtaatcgacaaactcgccaaaagcggaaatcccaaggcggctaacttccccatgcctataatccacaaggaagggcataagtacgatgtttcctattcgggattaaaaaccgccgtcataaatcagatagaccaattttggaataaggactttgaaaaaacacccgagaacattgcagccgcattccaaacaagggcggtaaaaattttgctcaggcctcttttggatgcttcgatagatacgggcttaaaaacgatagtagcaggcggaggagttgcggccaattctctgttgagggaaaaacttgccgagcacaaggaattaaagtgcatatttccctcgcttaaattctgtacggataatgcggcgatgattgcaggcctcggttatcattacctaaaacgcggagacagaacgccctttaccgtcgaagcctccgcccgagttgaaggcttcagcaaaaaaggcaggcaatag

SEQ ID NO: 45751 - protein, 338 aa, Treponema denticola ATCC 35405
MKILGIESSCDETAAAVVEDGNKILSNIVATQIPFHKMYNGVVPEIASRKHTEWILPVVKQALAEAGLSLKEIDGIAATGRPGLMGSLLVGLTFAKTLAWSSNKPFIAVNHMLGHLYASHLENDIPYPYLGLLVSGGHSIICKVNNFDDIEVLGTTIDDAPGEAFDKVAKFYNLGYPGGAVIDKLAKSGNPKAANFPMPIIHKEGHKYDVSYSGLKTAVINQIDQFWNKDFEKTPENIAAAFQTRAVKILLRPLLDASIDTGLKTIVAGGGVAANSLLREKLAEHKELKCIFPSLKFCTDNAAMIAGLGYHYLKRGDRTPFTVEASARVEGFSKKGRQ

SEQ ID NO: 45752 - DNA, 960 bp, Mycoplasma mycoides subsp. mycoides SC str. PG1
  CDS (1)..(960)
atgaaaatcttagctattgagtcaagttgtgatgaattttctatttcgattattgataataataaaattcttacaaacattatttcatctcaaataaaagatcatcaagtatttggtggagttgttccagaattagcagcaagattacatgtacaaaactttaattgagtattaaaagcagcattaactgaagctaatttaaatatcaaagatattgattatgtagcttatacaaaatctccaggactaattggttctttgattgttggaaaacttgtagctgaaactattagtttatatataaacaaaccaattctagctctagatcatattcaaggacatatttttggagctagtattgaaaatgaatttatatatccagttttagcaatggtagtatctggtggtcatactcaaattaaaattattaattctgcaaatgattttgaaattattggatcaactagagatgatgctattggtgaatgttatgacaaagtagctagagttttaggactttcttatccaggaggaccaattttagataaattggctctaaaaggaaataaggattcttatttattacctgttttaaaagatgaagataattatgatttttcttattctggattaaaaactgcttgtataaatttgattcataatttgaatcaaaaaaatcaagaaattaatttagaagattttgcagctagttttcaatatacagcaacaaacattgttgaaaaaaaaatagaaaaagcgattaaagaatttaaaccaaaaacattaactgttgctggtggggtaagtgctaatagtgaaattagaaaaataattttaagattgggtgaaaaatacaatattaaaaatacatttgttcctaagatgagttattgtacagataatgctgctatgattgctaaattagcatatgaaaaaattcttttaaataacaaactataa

SEQ ID NO: 45753 - protein, 319 aa, Mycoplasma mycoides subsp. mycoides SC str. PG1
MKILAIESSCDEFSISIIDNNKILTNIISSQIKDHQVFGGVVPELAARLHVQNFNWVLKAALTEANLNIKDIDYVAYTKSPGLIGSLIVGKLVAETISLYINKPILALDHIQGHIFGASIENEFIYPVLAMVVSGGHTQIKIINSANDFEIIGSTRDDAIGECYDKVARVLGLSYPGGPILDKLALKGNKDSYLLPVLKDEDNYDFSYSGLKTACINLIHNLNQKNQEINLEDFAASFQYTATNIVEKKIEKAIKEFKPKTLTVAGGVSANSEIRKIILRLGEKYNIKNTFVPKMSYCTDNAAMIAKLAYEKILLNNKL

SEQ ID NO: 45754 - DNA, 1017 bp, Bacillus cereus ATCC 10987
  CDS (1)..(1017)
atggaaaaaaatacgattatacttggtattgaaacaagttgtgatgaaacagcagtagcggttgttaaaaatggaacggaaattattgcgaatgttgttgcatcacaaattgaaagtcataaacgttttggcggagttgtaccagagattgcgtcccgtcatcatgtagaagaaattacagttgtattagaagaagcgttaaaagaagcgaatatcacatttgatgatattgatgcaattgctgtcacagaaggacctggtttagtaggagcgcttctaataggggtgaacgcagcgaaagcagtggcatttgcacatgatatccccctagttggtgttcatcatatcgctggccacatttatgcgaaccgcttagtaaaagaagttcaattcccattactatcacttgttgtatctggtggacatacagagcttgtttatatgaaagaacatggttcatttgaagtaattggtgaaacgcgagatgatgcagcaggggaggcatatgataaagtagctcgtacgttatctatgccatatccaggtggccctcatattgatcgtcttgcacatgaaggggaaccaacaattgatttacctcgtgcatggctagaacctgattcgtatgatttcagttttagtggattgaaatcagcagttatcaacactgtgcataacgcaaaacaacgcgggatagaaattgcaccggaagatttagcagcaagtttccaagagagtgtaattgacgtattagtaacgaaagcatctcgtgcagcggatgcttataacgtaaagcaagtgcttcttgctggtggagttgctgcgaataaaggacttcgtgcacgtttagaagcagagtttgcacaaaaagaaaatgtagaactaattattcctcctctatctttatgtacagataatgcagctatgattgcggcggcaggtacaattgcgtatgaacaaggaaaacgtgctacattagctttaaatgcaaatccaggattagatattgaagcatag

SEQ ID NO: 45755 - protein, 338 aa, Bacillus cereus ATCC 10987
MEKNTIILGIETSCDETAVAVVKNGTEIIANVVASQIESHKRFGGVVPEIASRHHVEEITVVLEEALKEANITFDDIDAIAVTEGPGLVGALLIGVNAAKAVAFAHDIPLVGVHHIAGHIYANRLVKEVQFPLLSLVVSGGHTELVYMKEHGSFEVIGETRDDAAGEAYDKVARTLSMPYPGGPHIDRLAHEGEPTIDLPRAWLEPDSYDFSFSGLKSAVINTVHNAKQRGIEIAPEDLAASFQESVIDVLVTKASRAADAYNVKQVLLAGGVAANKGLRARLEAEFAQKENVELIIPPLSLCTDNAAMIAAAGTIAYEQGKRATLALNANPGLDIEA

SEQ ID NO: 45756 - DNA, 1158 bp, Eremothecium gossypii
  CDS (1)..(1158)
atggtaaatttgaataaggtccaacctcggagtggcggggaccactatcttgccctaggtatcgagggatcggcgaataaactgggcgttggaatactgaaacatcccatgctgtcccagcataagcagggaagcctttctcatgactgccaagcggagatactctcgaacattagagatacatacataacgcccccgggggagggctttctgcctcgtgatactgcgcgacaccaccggaactgggtcgtgaggctagtccggcgtgcacttgttgaggcgggcattgaagatcccaggctcctggacgtgatatgttttaccaagggcccgggtatgggggcgccgctgcactcagtggtcgtagcagcacggacaatgtcgatgttgtgggatgtgccccttgtcgcagttaatcactgcattggacatatcgagatggggcgcgaaatcacgaaagctgagaatccagtggtgctctacgtgagtggtggcaacacccaggtaatcgcgtattcggaaaaccgctaccggatcttcggcgagacacttgatatcgcgatcggcaactgccttgacaggtttgcgcgcacactaaagatccccaatgatccctctccgggctacaacatcgagcagctcgctaaacagtgcaagaacaaggacaggctggtggaactgccttatactgtgaaggggatggacctctccatgagcggtattctcgcccacatcgactcgctcgcgaaggacctatttcgtcgaaacacgaagaactacaagctcttcgaccgcgagaccggcaagcagctcgtcaccgtagaggacctgtgctactccctacaggagcacctgtttgccatgctcgtggagattaccgagcgtgccatggcacatgtgaactctaaccaggtgttgattgtcggcggtgtgggctgcaatgtccgactgcagcagatgatggcgagtatgtgccagagcagggccgacggccaagttcatgcgacggacgagcgcttctgtattgacaacggtgtcatgattgcacaggctggtctacttcaatatcgcatgggcgatatagtaaaagacttctcagagaccgttgtcacgcagaggttccggactgatgaggtttacgtatcgtggcgcgactaa

SEQ ID NO: 45757 - protein, 385 aa, Eremothecium gossypii
MVNLNKVQPRSGGDHYLALGIEGSANKLGVGILKHPMLSQHKQGSLSHDCQAEILSNIRDTYITPPGEGFLPRDTARHHRNWVVRLVRRALVEAGIEDPRLLDVICFTKGPGMGAPLHSVVVAARTMSMLWDVPLVAVNHCIGHIEMGREITKAENPVVLYVSGGNTQVIAYSENRYRIFGETLDIAIGNCLDRFARTLKIPNDPSPGYNIEQLAKQCKNKDRLVELPYTVKGMDLSMSGILAHIDSLAKDLFRRNTKNYKLFDRETGKQLVTVEDLCYSLQEHLFAMLVEITERAMAHVNSNQVLIVGGVGCNVRLQQMMASMCQSRADGQVHATDERFCIDNGVMIAQAGLLQYRMGDIVKDFSETVVTQRFRTDEVYVSWRD

SEQ ID NO: 45758 - DNA, 1155 bp, Eremothecium gossypii
  CDS (1)..(1155)
atgctggctcttccaggagccctgtggcggcgtctgggacggtcgtaccgcgttttaagcatcgaaacgtcgtgcgatgacacctgtgtcgcaattctggaccgcagctcgcgctaccgcgcacctgcggtggtgtgccactatcgagagacgctggacagcgccagcgacgggggtgttgtgccgacgaaagcgcacgagcaccatcagcggcggatcgggggactggtgggccgggcactggaatccgggcctgtggacctgatttgcgcgacacgcggaccggggatgcccgggtcgctgtctgcaggactgacgttcggcaaggccctaagcgtgggcctccggcggccgctggtcggggtgcaccacatggtggggcacttgttggtgccgcggttggccagcaacgggcgggagccgcagttcccgttcctgagcctgctggtgagcggcggacacacaatgctggtgctttcgcgcagcgcggtggaccacgaggtgctctgcaacacgatcgacgtcgctgtgggcgacgcgctggataagtgtgcgcgcgtgctaggtctgcgcggcaacatgattgcgcgggaaatggagcggttcatcgacgaagacccgccgggcgcgcggcgccgcgaactgcttccgctggtgctgcccacgccgctcgcgaacaaggcgaagcggcgcgacgtacaagcgttttcgttctgtccgttcatcactgcggtgaataggggccttgagggccacgcggcgccgctgtccgaggcggaacgccgggtagcagcatttcagattcaggaggccatattcgaccatttgattaccaagattaacctggtgctgcggctcaatgctgataaggttgctgatgtggcacagtttgtgtgttccggcggcgtatgcgccaaccggcgcctgcgtgccagactcgagactgaactattcagaccgttcgactcctttcactatccagctccagatctatgtacagacaatgcggtgatgatcggctgggcgggcatcgagctctacgagggacacggcctgacgacagacgttgccgcgctgaccattgcgaagtggccgatagatgagctgctagcagtgcctggttgggtcagcgcccggccagcgggtgatacgtag

SEQ ID NO: 45759 - protein, 384 aa, Eremothecium gossypii
MLALPGALWRRLGRSYRVLSIETSCDDTCVAILDRSSRYRAPAVVCHYRETLDSASDGGVVPTKAHEHHQRRIGGLVGRALESGPVDLICATRGPGMPGSLSAGLTFGKALSVGLRRPLVGVHHMVGHLLVPRLASNGREPQFPFLSLLVSGGHTMLVLSRSAVDHEVLCNTIDVAVGDALDKCARVLGLRGNMIAREMERFIDEDPPGARRRELLPLVLPTPLANKAKRRDVQAFSFCPFITAVNRGLEGHAAPLSEAERRVAAFQIQEAIFDHLITKINLVLRLNADKVADVAQFVCSGGVCANRRLRARLETELFRPFDSFHYPAPDLCTDNAVMIGWAGIELYEGHGLTTDVAALTIAKWPIDELLAVPGWVSARPAGDT

SEQ ID NO: 45760 - DNA, 1647 bp, Methanococcus maripaludis S2
  CDS (1)..(1647)
atggataattctaaagacgacttaatatgtattggatttgagggaactgctgaaaaatcaggtgttggaataattacctcaaagggcgaagttttgtttaacaaaacaataatttatactccgcctgtacagggaatacaccctagagaagccgcagatcaccacgcagaaacttttgtgaaacttttaaaagaagcattaaacgaagttccgcttgaaaaaattgatcttgtttcattttcactcggtcctggactcggtccaagtttgagggttactgcaacaactgcaagagcactttctctttcaataaataaacccataatcggggtaaatcactgtatcggccacgtggaaattggaaaattaacaactgatgcagtggacccgcttacattatatgtaagtggtggaaatactcaagttttggcatacactggaaaaaaataccgggtaattggtgaaactctcgatattgcgataggaaactgtctcgaccagtttgcaaggcactgtaatttaccgcatccgggtggggtatacgttgagaaatttgcaaaagatggaaataagtttataaaactcccatacaccgttaaaggaatggatctttctctttcagggttattaacgtctgcaatgaaaaaatacgattcaaaagaaagaattgaagatgtatgctactcattgcaggaaacttcattttcaatgctaacagaaatcaccgaaagagcgcttgcacatactaataaagccgaagtaatgcttgttgggggagttgctgcaaataatcggttaaaagaaatgcttaaggtaatgtgtgaagagcagaatgttgatttctacgttccagaaaaacagttttgtggcgataacggtgcaatgattgcatggcttgggatattgcagtatttaaatggaaaaagaatggatttgaaggatacaaaaccgatttcaaactacagaagtgacatggtcgaagttaactggattcatgacgaaagcaaaaacttgaatgatggaaatattaaatctcgaaaaattccaaaacatttgattggaaaaggcgctgaagccgatatatcaaaaggaaggtatttagaatttgaatctattacaaaagagcgagttaaaaaaggataccgtattttaaaactggatgaattgataaggacaagaagaacagtaaaagaagcaagatttttggcagcagttaaagaatgtggaattcatgctccaagcatttatgacatcgataaagagaataaaaaaattataatgggctacattcacggaaaaattgcaaaagacgaaattgaagaaggaaatatcgaattttgtaaaagtttaggggaaactattggaaaaatgcatggcagtggaattgtgcacaatgatttaacaacttcaaactttataatttcaaaaaatccatatataatagattttgggcttggaaaatacagcgatttaattgaagacaaagcaattgatttgatagtcttaaaaaaatcgataatgagcatccactatgataaatttgatttggtctggaataaaataatagacggatacaaaacgtatgaactggctgaatcggttttggaatgcataaaagaggttgaaaaacgggcaagatatctttaa

SEQ ID NO: 45761 - protein, 548 aa, Methanococcus maripaludis S2
MDNSKDDLICIGFEGTAEKSGVGIITSKGEVLFNKTIIYTPPVQGIHPREAADHHAETFVKLLKEALNEVPLEKIDLVSFSLGPGLGPSLRVTATTARALSLSINKPIIGVNHCIGHVEIGKLTTDAVDPLTLYVSGGNTQVLAYTGKKYRVIGETLDIAIGNCLDQFARHCNLPHPGGVYVEKFAKDGNKFIKLPYTVKGMDLSLSGLLTSAMKKYDSKERIEDVCYSLQETSFSMLTEITERALAHTNKAEVMLVGGVAANNRLKEMLKVMCEEQNVDFYVPEKQFCGDNGAMIAWLGILQYLNGKRMDLKDTKPISNYRSDMVEVNWIHDESKNLNDGNIKSRKIPKHLIGKGAEADISKGRYLEFESITKERVKKGYRILKLDELIRTRRTVKEARFLAAVKECGIHAPSIYDIDKENKKIIMGYIHGKIAKDEIEEGNIEFCKSLGETIGKMHGSGIVHNDLTTSNFIISKNPYIIDFGLGKYSDLIEDKAIDLIVLKKSIMSIHYDKFDLVWNKIIDGYKTYELAESVLECIKEVEKRARYL

SEQ ID NO: 45762 - DNA, 1053 bp, Anopheles gambiae str. PEST
  CDS (1)..(1053)
atgcttattaaaatggtggttgcaatcggattcgaaggtagtgccaacaaaattggtgtcggaatcgtccgggatggtgaagtgttggcgaacgagcgtgaaacgtacatcaccccgcccggtgaaggttttctaccaaaagaaacggcacagcatcaccggtcccgggtgctggacatactgaagcgagcgctggacgtgtcgggcatagcgcccgacgagatcgatgtcgtgtgctacacgaaaggccccggtatggcaccgcccctactagcggtggccatcgtcgctagaacgatagcgcaaatctggaacaaaccgatactgggggtgaaccattgcatcgggcacatcgagatgggccggctgataacgaaagccgttaatcccaccgtactgtacgtgagcggcggcaacacgcaaatcatttcgtacgcctgcaaacggtaccgcatcttcggcgaaacgatcgacattgcgatcggcaactgtttggatcgatttgcacgcatcatccacctttcgaatgacccgagcccgggatacaacatcgagcagatggcgaagaagggcaaaaactatgtcccgctgccgtattcggtcaagggtatggacatgagcttctcgggcatactgtcgttcctggagcagaaggcacgcccgaaaaggaagcagcagaaaatgcaaaccaaggcaacggaggaggaaaaatggaccgatgaggatctgtgcttttcgctgcaggagacgctgttcgcgatgctggtggaaactaccgaacgggccatggcgcataccggctcggccgaggtgctcatagtcggtggcgttggatgcaacgtgcgcctgcaggagatgatgggcataatgtgcgaggagcgcggtgccaagctatttgcgaccgacgaacggttctgtattgacaacggtgtgatgatagcgcacgccggttgggaaatgttccgcagcggatcgcgtatggcgtggaacgatgcgaccattacgcagcgcttccggacggacgaggtggaagtcacgtggcgggatgattga

SEQ ID NO: 45763 - protein, 350 aa, Anopheles gambiae str. PEST
MLIKMVVAIGFEGSANKIGVGIVRDGEVLANERETYITPPGEGFLPKETAQHHRSRVLDILKRALDVSGIAPDEIDVVCYTKGPGMAPPLLAVAIVARTIAQIWNKPILGVNHCIGHIEMGRLITKAVNPTVLYVSGGNTQIISYACKRYRIFGETIDIAIGNCLDRFARIIHLSNDPSPGYNIEQMAKKGKNYVPLPYSVKGMDMSFSGILSFLEQKARPKRKQQKMQTKATEEEKWTDEDLCFSLQETLFAMLVETTERAMAHTGSAEVLIVGGVGCNVRLQEMMGIMCEERGAKLFATDERFCIDNGVMIAHAGWEMFRSGSRMAWNDATITQRFRTDEVEVTWRDD

SEQ ID NO: 45764 - DNA, 1209 bp, Anopheles gambiae str. PEST
  CDS (1)..(1209)
atgcatttggcaacacaatcctccccggtagtgctgggaatcgaaacgagttgtgatgacaccggggcagctttggttaccggcaatgggacagttttgggagagtacattcattcccagcaaagcagtcacttgaggtttggtggaatcattccaccggtagcgcaagacatccaccgtgccaatatcgaatccgttgtgcaaaatgcgtttaaactagcaaatatgactcctaacgatatagatgcagttgctgtcaccaatcggccagggttacctctcagtctgatagtggggatgaggtatgcgaaacatatcgcccgctcctacaacaaaccgctcattcccatacaccatatgcaggcacacgcgttgatggcccgaatgacctctactatcccgtatccatttctctgcctgctagtaagcggtggtcactcgttgctggtatttgtggagagtactgcacgatttcgactgctcggcgaaaccttggacgatgcgccgggtgaagcgttggataaaatcgctcgtcggctgaagctgcggaacgtggccaagtatgcgcaaatgtctggtggtcaggctatcgaagcagcagcccagcaggctggcgcaaaagacacatctgcttacgaattcccgctaccactttctaaatatcgtgactgtcagttcagtttcgccggactgaaaaataccgccacgagacacatactcgaacgagaatccaccctccatcttgcgcctgatgctttgctgcccgattatgaagcgttttgtgcttgtttcttgaaaggagtcacacggcacatgctgcaccgaacgcagcgcgcgattgagtactgtgaacggcgcaaacttttttccgatgccgaaccacaccgcagtttagtcgtttcgggcggtgtggcttgcaatgacgttatattcaatgcgctcagctcgatggcggcccagtttgggtacagcacctaccggccaccgaaaaagttatgcaccgataacggcacaatgatagcgtggaacggcatggagaaactgctggcgaaagatactgccgaaatgacgacgaagtacgagcaggttgatataagcggaaagtgccctatcggcgatagtcttatcgatgatgtaaaagaagcgaacatagcatgcaagtgggctaaagtcgatatatttccaggcaaagaagaagtcagtagttag

SEQ ID NO: 45765 - protein, 402 aa, Anopheles gambiae str. PEST
MHLATQSSPVVLGIETSCDDTGAALVTGNGTVLGEYIHSQQSSHLRFGGIIPPVAQDIHRANIESVVQNAFKLANMTPNDIDAVAVTNRPGLPLSLIVGMRYAKHIARSYNKPLIPIHHMQAHALMARMTSTIPYPFLCLLVSGGHSLLVFVESTARFRLLGETLDDAPGEALDKIARRLKLRNVAKYAQMSGGQAIEAAAQQAGAKDTSAYEFPLPLSKYRDCQFSFAGLKNTATRHILERESTLHLAPDALLPDYEAFCACFLKGVTRHMLHRTQRAIEYCERRKLFSDAEPHRSLVVSGGVACNDVIFNALSSMAAQFGYSTYRPPKKLCTDNGTMIAWNGMEKLLAKDTAEMTTKYEQVDISGKCPIGDSLIDDVKEANIACKWAKVDIFPGKEEVSS

SEQ ID NO: 45766 - DNA, 1065 bp, Neurospora crassa
  CDS (1)..(1065)
atgcccgacgccaaaggccgccgcatcgctctcggatgcgaaggctccgccaacaagctcggcatcggcatcattgcgcacgaccccatcaccggcgaagcccttgtcctgtccaacgtgcgcgacaccttcgtctctcctcccggcaccggtttccttcccaaggacacagcccgacaccaccgtgcctactttgtgcgtgtagccaagaaggcgctcgccttgtcgggggtctccatctcggaaatcgactgcatctgctacaccaaggggcccgggatgggcgggcccctaacgtcggtggccgtgggcgcccgcacactcgcgctgctgtggggtaaagaattggtgggcgtgaaccactgtgtcgggcatatcgagatggggcgggcgataacgggggcgtcgaacccggtggtgctgtacgtgagcgggggtaatacgcaggtgattgcgtacgcggagcagcggtaccgtatctttggcgagacgctggatattgcagtgggtaattgcctggaccggttcgcgcgcacgctggagatcagcaacgacccggcgcccgggtacaatattgagcagctggccaagcaaggtgggcgagtcttgttggacttgccgtatgcggtcaagggaatggattgctcgttcagcggaatcctggggcgggcagatgacttggcggcgcagatgaaggcgggcgagccgggccccgacggcgaaccgtttacacccgcagatctgtgcttcagcttgcaggaaacggtatttgccatgcttgtcgagatcaccgagcgggctatggcgcacgtcggtagcaaccaggttcttattgttggcggtgtcggttgcaacgagcggctacaggagatgatgggcgcgatggcagcggagcgaggcggaagtgtctacgccaccgacgagcggttctgcatcgacaacggcatcatgattgctcatgctggtctattggcctacgagacgggcttccggacgccgcttgatgaaagcacatgtacacaacgcttcagaaccgacgaagtcttcgtcaagtggagggactaa

SEQ ID NO: 45767 - protein, 354 aa, Neurospora crassa
MPDAKGRRIALGCEGSANKLGIGIIAHDPITGEALVLSNVRDTFVSPPGTGFLPKDTARHHRAYFVRVAKKALALSGVSISEIDCICYTKGPGMGGPLTSVAVGARTLALLWGKELVGVNHCVGHIEMGRAITGASNPVVLYVSGGNTQVIAYAEQRYRIFGETLDIAVGNCLDRFARTLEISNDPAPGYNIEQLAKQGGRVLLDLPYAVKGMDCSFSGILGRADDLAAQMKAGEPGPDGEPFTPADLCFSLQETVFAMLVEITERAMAHVGSNQVLIVGGVGCNERLQEMMGAMAAERGGSVYATDERFCIDNGIMIAHAGLLAYETGFRTPLDESTCTQRFRTDEVFVKWRD

SEQ ID NO: 45768 - DNA, 1065 bp, Magnaporthe grisea 70-15
  CDS (1)..(1065)
atggccatcccatcaaaccctgccaagcgccgccgtatcgccctcggatgcgaaggcagcgcaaacaagttgggcatcggcatcatcgcccacccgcccgaaggtgaggttggcgacccggtggtgctctccaacgtccgggacaccttcgtctctcccccggggacgggcttcctgcccaaggatacggcggcgcaccaccgctccttcttcgtccgggtggcacagcaggccatccgggacgcgggcgtcacggtggccgaggtcgactgcatttgctatacaaaggggccggggatgggggcgcctctgacgagcactgccatcggcgcccgcacgctcgccctgctctgggacaagccgctcgtgggcgtcaaccactgcgtcggccacatcgagatgggccgcgccatcacgggcgccgacaaccccgtcgtgctgtacgtcagcggaggcaacacgcaggtcatcgcgtacgccgagcagcggtaccgcatctttggcgagacgcttgacatcgccgtcggcaactgccttgaccgcttcgcccgcaccttgaaaatcagtaacgacccggcacccggctacaacattgagcagctggccaagcagggctctgtgctcctggaccttccctacgccgtcaagggcatggactgctccttctcgggtatcctgactcgcgccgacgagctggccgcccagatggtagccaagccggaccttttcacccccgccgatctgtgcttcactctgcaggagaccgtctttgccatgctagtcgagatcacggaacgcgccatggcccatgttggtagcacgcaggttctcatcgtcggtggcgtgggatctaacgagaggctgcagcagatgatgggagccatggctaaagaccgcggcggcagcgtctacgccacggatgaacgattctgcatcgacaacggaatcatgatagcacatgccggtctcctcgcttacgagactggtttcaggacaccattagaagaaagcacatgtacgcaaaggttcaggacagacgaggtgcacgtcaaatggagagattag

SEQ ID NO: 45769 - protein, 354 aa, Magnaporthe grisea 70-15
MAIPSNPAKRRRIALGCEGSANKLGIGIIAHPPEGEVGDPVVLSNVRDTFVSPPGTGFLPKDTAAHHRSFFVRVAQQAIRDAGVTVAEVDCICYTKGPGMGAPLTSTAIGARTLALLWDKPLVGVNHCVGHIEMGRAITGADNPVVLYVSGGNTQVIAYAEQRYRIFGETLDIAVGNCLDRFARTLKISNDPAPGYNIEQLAKQGSVLLDLPYAVKGMDCSFSGILTRADELAAQMVAKPDLFTPADLCFTLQETVFAMLVEITERAMAHVGSTQVLIVGGVGSNERLQQMMGAMAKDRGGSVYATDERFCIDNGIMIAHAGLLAYETGFRTPLEESTCTQRFRTDEVHVKWRD

SEQ ID NO: 45770 - DNA, 1092 bp, Gibberella zeae PH-1
  CDS (1)..(1092)
atgacgcctgtcgaatttgactgtctaagcgagccgagggctacatgcatatgcaactcacctgtgcagtcctcatatatcgctcttggctgcgaaggctccgccaacaagctcggcatcggtgtcatcctccacacaccaaccgaaaccaagatcctctccaacctccgcgacacattcgtttcccctccaggcacagggttcctccccaaagacacagcagcccatcaccgcgcacacttcgtccgtcttgcacgcgaagccctcgccgaagcgaaaatcacacccgcagatgtcgactgcatctgctacacaaagggacccggtatgggcgccccgttgaactcggtcgccgtggccgccagagcgttgagtttgctctgggatagaccacttgtgggtgtgaatcactgcgtgggacacattgagatgggaagatatatcactggcgcggagaacccagttgtgctgtacgtttcgggtggtaactcgcaggttattgcatatgcggagcagcgatataggatatttggcgagacgctggatatagctgttggaaattgtctcgatcgatttgctcgtacgctcgagatcagtaacgaccctgcgccaggttacaatattgagcagctggccaagaagggaagtaaactactggacatcccttacgcagtcaagggaatggactgttcgttctccggcatcctagcgtctgctgacgccctcgctgcgcagatgaaagccggcgcggacttcacacccgaagatttgtgcttctcactacaagaaacagtatttgccatgttggtagagatcacagagcgagccatggcgcacgttggatcctcacaagtcctcattgtgggaggtgttggttgcaatgagagattgcaggagatgatgggacacatggcgcgcgagcgaggaggatccgtgtatgcgaccgacgagagattctgcatcgataatggaatcatgattgcgcatgctggattgttggcatatgagacaggattcagaacgtcattggaggagagtacctgtacgcagagatttaggaccgatgaggtattcatcaaatggagagattga

SEQ ID NO: 45771 - protein, 363 aa, Gibberella zeae PH-1
MTPVEFDCLSEPRATCICNSPVQSSYIALGCEGSANKLGIGVILHTPTETKILSNLRDTFVSPPGTGFLPKDTAAHHRAHFVRLAREALAEAKITPADVDCICYTKGPGMGAPLNSVAVAARALSLLWDRPLVGVNHCVGHIEMGRYITGAENPVVLYVSGGNSQVIAYAEQRYRIFGETLDIAVGNCLDRFARTLEISNDPAPGYNIEQLAKKGSKLLDIPYAVKGMDCSFSGILASADALAAQMKAGADFTPEDLCFSLQETVFAMLVEITERAMAHVGSSQVLIVGGVGCNERLQEMMGHMARERGGSVYATDERFCIDNGIMIAHAGLLAYETGFRTSLEESTCTQRFRTDEVFIKWRD

SEQ ID NO: 45772 - DNA, 1008 bp, Apis mellifera
  CDS (1)..(1008)
atgacaattgctattggattcgaaggtagtgcaaataaattaggtattggaattattcaagatcagaatattttatcaaatatacggcatacatatattactccaccaggtgaaggctttttacctcgtgaaactgcacaacatcatagagaatatatacttaatattctacaaaaagcattggatgaggctaaaataatattgaaagatgtagacataatatgttatacaaaaggaccaggaatgggtgcaccattaacagttactgcattagtagcaagaacaattgctcagatatataataaaccaataatagcagtaaatcattgtattggtcatatagaaatgggaagattgataacaggaagtataaatcccactgttctttatgtttctggtggaaatacacagattattgcatattctcaacagaaatattgtatttttggagaaacaatagatattgctgttgggaattgtttagatcgttttgcaagattgttaaaactttcaaatgatcctagtcctggttataatatagaacaattagcaaaaaaaggaaaaaaattagttccattaccttatgtagtaaaaggaatggatgtatcattttctggaattttaagttatatagaagaacatatttcttcttggcttgattcaaaagaatttacttcagaggatttatgtttctctttacaagaaacaatatttgctatgcttatagaaattacagaaagagcgatggcccatataaaatcatccgaagtattaattgttggtggtgtaggatgtaatgaaaaattacaagatatgatgaaaattatgtgcaaggaaaggaatgcaatactttatgctacggatgaacgattttgtatagataatggtgtaatgattgctgttgctggattacatcaatataaaagccaaggaaatactccatggacagaaacaacttgcatacaaaggtatagaacagatgatgtatatgtttcctggagagaataa

SEQ ID NO: 45773 - protein, 335 aa, Apis mellifera
MTIAIGFEGSANKLGIGIIQDQNILSNIRHTYITPPGEGFLPRETAQHHREYILNILQKALDEAKIILKDVDIICYTKGPGMGAPLTVTALVARTIAQIYNKPIIAVNHCIGHIEMGRLITGSINPTVLYVSGGNTQIIAYSQQKYCIFGETIDIAVGNCLDRFARLLKLSNDPSPGYNIEQLAKKGKKLVPLPYVVKGMDVSFSGILSYIEEHISSWLDSKEFTSEDLCFSLQETIFAMLIEITERAMAHIKSSEVLIVGGVGCNEKLQDMMKIMCKERNAILYATDERFCIDNGVMIAVAGLHQYKSQGNTPWTETTCIQRYRTDDVYVSWRE

SEQ ID NO: 45774 - DNA, 1149 bp, Apis mellifera
  CDS (1)..(1149)
atggatgatgaagaaaatacattaataagaaaactgcacaataaacctataattttaggaatagaatctagttgtgatgacacagcttttggaattgttgatagtaatggaaatattttaggcgaatcaattaattctcaatatttaactcatttaaattttggaggaataattcctacatttgcaagatcattgcatgtaaataatatcacaaaaacttgtgaagatgcattgagagctgcaaatctaagaataagagatattgatgcaatagctacaactgtaaagcatgtcttcctatcaaaaattggaggaaaaccatttataccaatacatcatatggaagctcatgctttaacagcaagaataaataaaaagattgattttccatatcttgctttattaatttctggaggtcattgtttattagcaattgttgaaaatgtaaataaattttatttacttggtactagtttaagtaatacacctggtgatgtttttaataaggttgcacgaagattaaaattaagaaatattccagaatttagtacattaaatggaggccaagctatagaacttgcagcaagtaaagcttcaaatgttaatcagtttttatttccacttataatgatgcaatttcgaaattgtaattttagtttttctggattattaaatttttgtaataattacattaaattagaagaagaaaaatataatatagttggagatatgataattcctgatgtatataatttttgtgcagcatttcaattagctttaacaacacacatttgtcaaagaactcaaagagcaatggaatttattaataaaatgtctttatttcctgaaaataaacagacattggttatttcaggaggagttgcatgtaataattttctagctaaagcattgaatattgtaagtacagaattaggttatacttttgtgagaactccttctaaattatgtaccgataatggaataatgatagcatggaatggagtagagaaatggatacaaaatatagatgttattagagatataaatgaaattgaaaaaattgaagcagaaaaagtagctacacttggagaaaattggattaaaaaagtagaagaagcaaatttaaaatgtaaatggttttgtatataa

SEQ ID NO: 45775 - protein, 382 aa, Apis mellifera
MDDEENTLIRKLHNKPIILGIESSCDDTAFGIVDSNGNILGESINSQYLTHLNFGGIIPTFARSLHVNNITKTCEDALRAANLRIRDIDAIATTVKHVFLSKIGGKPFIPIHHMEAHALTARINKKIDFPYLALLISGGHCLLAIVENVNKFYLLGTSLSNTPGDVFNKVARRLKLRNIPEFSTLNGGQAIELAASKASNVNQFLFPLIMMQFRNCNFSFSGLLNFCNNYIKLEEEKYNIVGDMIIPDVYNFCAAFQLALTTHICQRTQRAMEFINKMSLFPENKQTLVISGGVACNNFLAKALNIVSTELGYTFVRTPSKLCTDNGIMIAWNGVEKWIQNIDVIRDINEIEKIEAEKVATLGENWIKKVEEANLKCKWFCI

SEQ ID NO: 45776 - DNA, 1245 bp, Ustilago maydis 521
  CDS (1)..(1245)
atgtggctacaatacgtcagaagggccggccctctcggtcggctcttgacacggccacctttccgaccatcggcgcccccggatagaagaatcagcacatctcgaaattcctgccctttatcttccctcacaaccgtcaagcagcctcgactgatcctaggcatcgagacgtcatgtgacgactcctgcgcaagcatcgtctcgtccgaccgaaccatcctctcttccatcgtgaccaagcaagaccattcttccaccggcggcatccatccactctcggctgcacttgggcatcactccaacctcgcctcaaccattgctgcagcgatcgaacaggcaagaatcacggcatccgatttgcacgccatcgccgtcacccaaggccctggtatggctagcagtctcggtgttggcctttccgcagccaagacgctgtcagctgtgcttcacataccactaatttacgtacatcacatgcaggcacatgcattgacaccgctgcttaccgaaccggatccgcccaagttgcccttcttggtgctactggtctcgggtgggcataccatgctcgtcttggcgcgcagtgtgactcactttcggatcttggcgacgacgagcgacgattccatcggcgacgcctttgataaagtggcgagggatctgggtatcccatggacttcagcacccggagcagcgctcgaagcgctggcggcaagagcagaggcccatggtgatggtctcgtctttccgacgccgtgcaaaggtcaaccaactttctcctactctggtctcaaggctgcggttcaacgccacattgcatcttgctcacctgatgcaatggccgagtcggccaaatcatcgatagcagctgctttccaacgagcagcttgtgcgcagctcgaggacaagctaagcatggtgttgcgaccctctcatgtcagccaagattcgcgccatcgacctttcgctcgaatcgagttgctcgacggcgtgagcagcgacgacgtcaaaacagtcgtttgtagcggcggtgtagcgagcaatgctttcatccgatctcggttgagagagcatctcgaccgtctaggaaggacagatgtggacctacaattcccaccgctgtcgttatgcaccgacaatgctgcaatgatcgcatgggtcggccatctaatctaccaccagcgaactcgtgattatacacgtcatgcaaggcccaagtggagcttgcaagacattccgcaatag

SEQ ID NO: 45777 - protein, 414 aa, Ustilago maydis 521
MWLQYVRRAGPLGRLLTRPPFRPSAPPDRRISTSRNSCPLSSLTTVKQPRLILGIETSCDDSCASIVSSDRTILSSIVTKQDHSSTGGIHPLSAALGHHSNLASTIAAAIEQARITASDLHAIAVTQGPGMASSLGVGLSAAKTLSAVLHIPLIYVHHMQAHALTPLLTEPDPPKLPFLVLLVSGGHTMLVLARSVTHFRILATTSDDSIGDAFDKVARDLGIPWTSAPGAALEALAARAEAHGDGLVFPTPCKGQPTFSYSGLKAAVQRHIASCSPDAMAESAKSSIAAAFQRAACAQLEDKLSMVLRPSHVSQDSRHRPFARIELLDGVSSDDVKTVVCSGGVASNAFIRSRLREHLDRLGRTDVDLQFPPLSLCTDNAAMIAWVGHLIYHQRTRDYTRHARPKWSLQDIPQ

SEQ ID NO: 45778 - DNA, 1092 bp, Aspergillus nidulans FGSC A4
  CDS (1)..(1092)
atgattgccatcggtcttgaaggttccgccaacaaactcggcgtgggtatcatgttacaccctaaggacggtagcaccccgcaagtcctcgccaacatccgccacacatatgtctcccctcccggcgagggatttctccccaaagatacagcaaggcaccaccggtcctgggtcgtcagtctcgtgaagaaagcactcaaggaagcgcgtatctccgttgacgatgtggactgtatatgctacaccaagggaccaggaatgggagctccccttcagagtgtggcagtggctgcacggacgctaagcttactatgggggaaggaactagttggtgttaaccactgtgttggacatatcgaaatgggtcgtctaattaccggcgcatcgaacccggtcgtcctatacgtgtctggagggaatacacaagtaatcgcttacagctcgcaacggtatcgcatcttcggtgagactctcgatatcgcggtgggcaactgtcttgaccgattcgcgcgaacgctacatatctctaatgacccggctccggggtacaatattgagcaactcgccaaaaagggcaagcaactggtcgatttgccatacacagtaaaaggcatggactgctctatgtcaggcattcttgcagccattgatgctctcgccgcaacgtacggactaaacggagaacaaccggatgaggaggaagacgtaacagatgttacgcccgtttcagacggggctttagaaagccggaaaccaacccgggcagatctgtgcttttcgctgcaggagacggtattctcgatgttggtggaaattacagagcgcgccatggcacatgttgggtcgaaggaagttttgattgttggcggagtcggatgtaatgagaggctgcaggagatgatggggatcatggcgcgggatcgcggaggcagtgtgcatgccacggatgagaggttttgtattgacaacgggattatgattgcccaggctggtatgctcgcatataagacaggcttccggacgccgctcaaggaatctacgtgcacgcagcgcttccggacggatgatgtatttgtgcaatggagagattag

SEQ ID NO: 45779 - protein, 363 aa, Aspergillus nidulans FGSC A4
MIAIGLEGSANKLGVGIMLHPKDGSTPQVLANIRHTYVSPPGEGFLPKDTARHHRSWVVSLVKKALKEARISVDDVDCICYTKGPGMGAPLQSVAVAARTLSLLWGKELVGVNHCVGHIEMGRLITGASNPVVLYVSGGNTQVIAYSSQRYRIFGETLDIAVGNCLDRFARTLHISNDPAPGYNIEQLAKKGKQLVDLPYTVKGMDCSMSGILAAIDALAATYGLNGEQPDEEEDVTDVTPVSDGALESRKPTRADLCFSLQETVFSMLVEITERAMAHVGSKEVLIVGGVGCNERLQEMMGIMARDRGGSVHATDERFCIDNGIMIAQAGMLAYKTGFRTPLKESTCTQRFRTDDVFVQWRD

SEQ ID NO: 45780 - DNA, 1494 bp, Aspergillus nidulans FGSC A4
  CDS (1)..(1494)
atgctacatctgcgggctgtatccgcattcacggctggccgcagaaacatctggagaaatgcgcggctgacctcagattcgcgacgccgggggcttctaacgctcgcgatcgaaacatcctgcgacgacacttccgtagcaatagtccacaaaaatgacaaatccggcgctgcaaagattcactttctcgagaatatcaccccggacctcacagcctatcaaggcatccaccctgtgcgcgctctcgaatcgcaccagcagaatgtcgcaaaactagtcaacaaagctctgtcacatctcccttattcatctgcagaatcacaaaatgatcctacaaagattgtttcgctcggcgacggcaaccgccagaagccagactttatatctgtgacccgaggccccgggatgcggtcaaatctgtttgccggactcgatacggcaaagggactggctgttgcatggcaggtgccgtttgtgggtgtccatcatatgcaggcacacctcttaacgccgaggcttgtttccgctcttgctctctcaccgggctcttcgcccaacaataccgaccggcagaacgaaaagggggaactacagccagccttccccttcctctccatcctcgcctcaggcggacataccctcctcgttaactcttcctccctaacagaccaccgcatcctcgccacaacaacagacgttgcgctcggcgaagccctcgacaaagccgcgcgcgagatcctgccttcatccctgctcagcacatccaagaacaccatgtatggcaaactactagaacaatatgcgttccccaacggccgcgccgactatgcagattatgtcgcgcccaagtcccgaggtgacgaaatcgccgtctcaaaggtcgtctcgaagtacggatggagtctcacaacgccgtatgcgcagacgagagagctggcgtttagttttgcgttccttgccacggcagtgaatcatacccttgctaaagctagaaaacgcgccggagaaacaggcttatcagatgaagagcgtgtctttctagcccgcgaggtcatgcgcgtgacgttcgagcacctcgcgtcacggactatcatcgcactggaatcgctgtgccagtgggttccgctcgtcccaaataatcctaatgacaagcggcaaaagccgctcccgagcagtgtccccgtatcaacactcgtcgtttccggcggtgttgcggcgaataagttcctaatgcatgtgctgaggacgtggttggatggacggggctttgggcatgtaggtgttgtggcgccgcctattagtctatgtacagataatgcggcgatggtgggctgggcggggattgagatgtttgaggcagggtggaggagtgcgttcgaggcgagggcattgaggaagtgggggcttgaggagggtgatgagagtgacgggggtgaagatgggggtcaagggatactgggtgttggagggtggcagagggaggggaaggaatga

SEQ ID NO: 45781 - protein, 497 aa, Aspergillus nidulans FGSC A4
MLHLRAVSAFTAGRRNIWRNARLTSDSRRRGLLTLAIETSCDDTSVAIVHKNDKSGAAKIHFLENITPDLTAYQGIHPVRALESHQQNVAKLVNKALSHLPYSSAESQNDPTKIVSLGDGNRQKPDFISVTRGPGMRSNLFAGLDTAKGLAVAWQVPFVGVHHMQAHLLTPRLVSALALSPGSSPNNTDRQNEKGELQPAFPFLSILASGGHTLLVNSSSLTDHRILATTTDVALGEALDKAAREILPSSLLSTSKNTMYGKLLEQYAFPNGRADYADYVAPKSRGDEIAVSKVVSKYGWSLTTPYAQTRELAFSFAFLATAVNHTLAKARKRAGETGLSDEERVFLAREVMRVTFEHLASRTIIALESLCQWVPLVPNNPNDKRQKPLPSSVPVSTLVVSGGVAANKFLMHVLRTWLDGRGFGHVGVVAPPISLCTDNAAMVGWAGIEMFEAGWRSAFEARALRKWGLEEGDESDGGEDGGQGILGVGGWQREGKE

SEQ ID NO: 45782 - DNA, 1122 bp, Candida glabrata CBS138
  CDS (1)..(1122)
atggtcgatttgaacggtatttctcccaagaacaaaggctattatgttgcattgggtctcgagggctctgctaacaagctaggtgttggtgtcatcaagcagttcgtcgatggctctcccactgaaatagtgtctaacatcagagacacatacatcacgccgccaggagaagggttcttgccccgtgacaccgctagacaccacaagaactggtgcgtgcggttagtgaagagggcgctggcagaggcaggtgtcactcccggacaactggatgctatatgcttcactaaaggcccaggtatgggtgcaccgctgcactccgtggttatcgtggccaggaccgtgtccttgctgtgggatgtgccattggtgccagtaaaccattgtatcgggcacatagagatgggtagagagatcacaggcgcccagaacccggtggtgttatacgtgagtggtggtaatactcaggttattgcgtacagtaatcagaaatacagaatatttggtgaaaccttggatatcgccataggaaactgtttggataggtttgcccgtaccttgaagataccgaatgacccatccccaggttacaacatagaacaaatggctctcaagtgtaagaataaagaaagattggtggaacttccgtacactgtgaaaggtatggatttgtcactaagtggtatactggcatacattgattctttagccaaggatctgtttaggaaaaactatagcaacaaactcctgtttgacaagaaaacccatgaacagctagtcacggttgaggacctttgctacgcgctgcaggaaacgttgttctcgatgctagtcgaaattacagaacgtgcaatggcccacgtcaattctgcacatgtattgatagtaggtggtgttggttgtaacttgagattacaagagatgatggagcagatgtgcatggatagagccaacggtcatgtatacgcaacggacgagagattctgtatagacaatggtgtcatgattgctcaggcaggtttgttgcagtatagaatgggagactacgttaaggacttcaaagaaactgttgtaacacaaaagttcagaactgatgaagtcttggtatcttggagggactag

SEQ ID NO: 45783 - protein, 373 aa, Candida glabrata CBS138
MVDLNGISPKNKGYYVALGLEGSANKLGVGVIKQFVDGSPTEIVSNIRDTYITPPGEGFLPRDTARHHKNWCVRLVKRALAEAGVTPGQLDAICFTKGPGMGAPLHSVVIVARTVSLLWDVPLVPVNHCIGHIEMGREITGAQNPVVLYVSGGNTQVIAYSNQKYRIFGETLDIAIGNCLDRFARTLKIPNDPSPGYNIEQMALKCKNKERLVELPYTVKGMDLSLSGILAYIDSLAKDLFRKNYSNKLLFDKKTHEQLVTVEDLCYALQETLFSMLVEITERAMAHVNSAHVLIVGGVGCNLRLQEMMEQMCMDRANGHVYATDERFCIDNGVMIAQAGLLQYRMGDYVKDFKETVVTQKFRTDEVLVSWRD

SEQ ID NO: 45784 - DNA, 1188 bp, Candida glabrata CBS138
  CDS (1)..(1188)
atgatgttgtctacttcgtggagatcaacaggaaacctaactagaagtcttccattaaggatcaaccgattctacaaagtgcttgcgattgaaacctcatgcgatgatacctgtgtgtcaatcctggatagatttgcagaaactcaaccaccaagggtgttggttaatctgaagagcacactaaacagctcagaatatggtggtattatcccaactatggcacatgaacaccatcagatgaaaataggttcactagtacaagaagctttaactgcacacaaatgtacttctcctaaagaaaacccatcaatcgatctgatttgtgttaccagaggaccaggcatgacaggatcactatcggcgggactgacatttgccaaaggtttatccgttggcctgaataagccgctcattggcgttcaccatatgcttgggcatcttcttataccgagaatggcaagcaatggttctgcaccagagtacccttttattagcttactcgtcagtggtggccacagtatgctggttttatcagagagcattgacaaacatgagatactctgcaatacgttagatattgccatcggcgattctcttgataaatgtggccgcgaactgggattcaaaggaaatatgattgcaaaagaaatggatgcctttataaatgaagataaaaatgatgtggatcacaattgcatattagagaaacttccgaatccgttgcatggacctaataacgcccatgtacaagcattttcattttccccatttgtctcagttataaaagacaacatacaaaactacaataatctaactgacgcccagttaaggagtatgtcaattcagatacaaaatgctgtcttcaagcatctgataacgaagatacaatatgtagtgaagaaaaatgctgataaattaaaaaacgtaacaggttttgtttgctctggtggagttagtggcaatccgaccttgagagaaaccttagaaagagaattagcgtcgaggttccaaaacttttactatccaagaaatgatctctgtaccgataattcgattatgataggctgggcaggaatagaaatttatgaaaagttaggactaattagtgattattccataacaccgatacgccaatggccaatgaacgagctcttaacggtttctggttggaagaagagaatattgtag

SEQ ID NO: 45785 - protein, 395 aa, Candida glabrata CBS138
MMLSTSWRSTGNLTRSLPLRINRFYKVLAIETSCDDTCVSILDRFAETQPPRVLVNLKSTLNSSEYGGIIPTMAHEHHQMKIGSLVQEALTAHKCTSPKENPSIDLICVTRGPGMTGSLSAGLTFAKGLSVGLNKPLIGVHHMLGHLLIPRMASNGSAPEYPFISLLVSGGHSMLVLSESIDKHEILCNTLDIAIGDSLDKCGRELGFKGNMIAKEMDAFINEDKNDVDHNCILEKLPNPLHGPNNAHVQAFSFSPFVSVIKDNIQNYNNLTDAQLRSMSIQIQNAVFKHLITKIQYVVKKNADKLKNVTGFVCSGGVSGNPTLRETLERELASRFQNFYYPRNDLCTDNSIMIGWAGIEIYEKLGLISDYSITPIRQWPMNELLTVSGWKKRIL

SEQ ID NO: 45786 - DNA, 1173 bp, Kluyveromyces lactis NRRL Y-1140
  CDS (1)..(1173)
atgtttaattgttacaagagtctaccgagaagtttggtttttcgaagagcataccgggttttagcgattgaaacgtcatgcgatgatacctgtgtagcgattttggatcgtgggacaaaggataggccagccgacgtgctgtgccatttgaagtccactttagacagcgtagagtatggcggtgttataccgacccgtgcgcatgagcatcatcagaaaaatatagcatcagtggtcaagtctgcactaaagaccacgaaatcacagaataagatcgatttggtatgtgctactaggggtcccgggatgccaggatcgttatctgtgggactagacgttggaaaagccctctctgttgcatgggacaaaccgttcattggtgttcaccatatgttaggccatttgttgataccgagactcgagactgatggtttgaaacctcagtacccgtttataacgttacttgtcagtggtgggcatacaatgttggtactttcaactgatgttgataaacacgagattctatgtgatactatagacatagctattggggattctttggataagactgcaagggagttgggaataaaaggtaacatgattgctaaggaaatggaatccttcataaacgaggaagatatcaatgtggtaagggcaggtattacatcagtaaaacccatgagattgcctacgccactaaagaaccagaatgggaggatgaacatgcaggctttttcattttcaccctttttgacggcagtgagacagcatctctcacaacccatcggcgaatacacggcggaagaaagaagatatatggcttatcaagtacaggaaagcatctttaaccatataataactaaactcaaccttgttctcaagttaaattctaaaaggctctccaatgtcaaacattttgtgtgttcaggtggggtgggcgccaatatgagacttcgtcatcggctagagacagatttgatacgtaattttgattctttccattatccaaaactagagtactgtacggataatgctgtgatgataggatgggctggaattgaactttatgagtcgcttggacttacctcagatttatctgttacacctatcagaaaatggccactaacagacatcttgaatgttcctggatggataatgaaaactcagtattga

SEQ ID NO: 45787 - protein, 390 aa, Kluyveromyces lactis NRRL Y-1140
MFNCYKSLPRSLVFRRAYRVLAIETSCDDTCVAILDRGTKDRPADVLCHLKSTLDSVEYGGVIPTRAHEHHQKNIASVVKSALKTTKSQNKIDLVCATRGPGMPGSLSVGLDVGKALSVAWDKPFIGVHHMLGHLLIPRLETDGLKPQYPFITLLVSGGHTMLVLSTDVDKHEILCDTIDIAIGDSLDKTARELGIKGNMIAKEMESFINEEDINVVRAGITSVKPMRLPTPLKNQNGRMNMQAFSFSPFLTAVRQHLSQPIGEYTAEERRYMAYQVQESIFNHIITKLNLVLKLNSKRLSNVKHFVCSGGVGANMRLRHRLETDLIRNFDSFHYPKLEYCTDNAVMIGWAGIELYESLGLTSDLSVTPIRKWPLTDILNVPGWIMKTQY

SEQ ID NO: 45788 - DNA, 1158 bp, Kluyveromyces lactis NRRL Y-1140
  CDS (1)..(1158)
atggtgaatttaaacggcattccaccaagaggtaaaaggaactattatttggcaattggtcttgaaggatctgccaacaagttaggcgttggtattatcaagcacccagtgctagaaaaacatgaagatagtgacctttcgtatgagtgtgatgttgaaatattggctaatattagagatacatatgtgacaccgccaggagaagggtttttaccaagagatactgcaagacatcataggaattgggtggtacgaatcattagaaaggcattaacggaggccaagatcgatgatcccacaaagatcgatgtgatatgtttcactagaggacctggaatgggtgctcctttgcattgtgtggttatagctgcaaggactttgtcattgatgtgggacataccattagttggggttaaccactgtgtggggcatatcgagatggggagagagatcacaggagctaaaaatcctgtcgtgctctatgttagtggaggtaacactcaagttattgcttactccgagaaaagatatcgaatctttggtgaaacgttggacatcgccattgggaattgtttagacagatttgcaagaactttgaagataccgaatgcaccatcgcctggttacaacattgaacaactggctaaacagtgtaagaataaagaaaaattagtggtattaccatacactgttaagggaatggatctgtcaatgagtggtattttgcaatatattgacactttagcgaaagacctattcaaaaagaacttgaagaataaattattatttgattcaagaacaggagaacagcttgtgactgtagaagacctatgttactctttacaggaaaatttatttgccatgcttgtggagattaccgaacgtgcaatggcccatgtaaactcaaaccaagtgctaatagtgggtggtgttggatgcaacgttaggcttcaagagatgatggcccaaatgtgtaaagacaggtccaatggacaagtacacgcaactgatgacagattctgtattgataatggtgtgatgattgcccaggcaggcctattagagtacagaacaggccactttgttaaggatctttctgaaaccattgtcacgcagaagtttagaaccgatgaggtttatatcgcatggagagaataa

SEQ ID NO: 45789 - protein, 385 aa, Kluyveromyces lactis NRRL Y-1140
MVNLNGIPPRGKRNYYLAIGLEGSANKLGVGIIKHPVLEKHEDSDLSYECDVEILANIRDTYVTPPGEGFLPRDTARHHRNWVVRIIRKALTEAKIDDPTKIDVICFTRGPGMGAPLHCVVIAARTLSLMWDIPLVGVNHCVGHIEMGREITGAKNPVVLYVSGGNTQVIAYSEKRYRIFGETLDIAIGNCLDRFARTLKIPNAPSPGYNIEQLAKQCKNKEKLVVLPYTVKGMDLSMSGILQYIDTLAKDLFKKNLKNKLLFDSRTGEQLVTVEDLCYSLQENLFAMLVEITERAMAHVNSNQVLIVGGVGCNVRLQEMMAQMCKDRSNGQVHATDDRFCIDNGVMIAQAGLLEYRTGHFVKDLSETIVTQKFRTDEVYIAWRE

SEQ ID NO: 45790 - DNA, 1122 bp, Debaryomyces hansenii CBS767
  CDS (1)..(1122)
atgacggttgatttagaccaatatgccaaacctggtaaagattactatcttgctttaggtctcgaaggttctgccaataaactaggcgttggtgttataaaacacaacctaggacaactttcgttagataatagagctgaaatattgtccaacgttagggatacttacgtaactcctcctggagaaggatttttaccaagagatacagcacgtcatcatagaaattgggctgttcgtataatcaaaaaagcattaattgaagcaaaggtgaaaggtagcgaccttgattgtatttgctttactcaaggaccaggtatgggtgcacctctacagagtgtagttattgcagcaaggacattatcacaattatgggatttgccattggtgggtgtgaaccattgtgttggtcatattgaaatgggtagagaaataactggagctgataacccagtcgtattgtatgtgagtggaggaaatacccaagtcattgcatattccagacaaagatatagaatatttggcgaaactttggatattgctataggaaattgtctagatcgtttcgctagaactttacgaatccctaacgaaccagcaccagggtataatattgaacaaatggcaaaaaaggggaaacatttggtacctttgccttatactgttaaaggaatggatttatcaatgtctggtatcttagctcatgttgattctttagcaaaagatttatttgctgaaaataaaaacaaaaaattaatcgatgacgaaacaggagagcaaattacatctgaagatctttgcttttctcttcaagagacattattttcgatgctcgtagaaataacagagagagctatggcccatgtacaaagtaatcaagtattaatagttgggggtgtcggctccaatgaaagattacaacaaatgatggaattaatggttaatgacaggaaaaatgggtcaatttttgcaactgacgagagattttgtattgataatggtataatgattgctcatgctggtttgttaggttatagaatgggacaaactaatgaattatggaacactgtctgcactcagagattcagaactgatgaggtattcgttaaatggagggatgattaa

SEQ ID NO: 45791 - protein, 373 aa, Debaryomyces hansenii CBS767
MTVDLDQYAKPGKDYYLALGLEGSANKLGVGVIKHNLGQLSLDNRAEILSNVRDTYVTPPGEGFLPRDTARHHRNWAVRIIKKALIEAKVKGSDLDCICFTQGPGMGAPLQSVVIAARTLSQLWDLPLVGVNHCVGHIEMGREITGADNPVVLYVSGGNTQVIAYSRQRYRIFGETLDIAIGNCLDRFARTLRIPNEPAPGYNIEQMAKKGKHLVPLPYTVKGMDLSMSGILAHVDSLAKDLFAENKNKKLIDDETGEQITSEDLCFSLQETLFSMLVEITERAMAHVQSNQVLIVGGVGSNERLQQMMELMVNDRKNGSIFATDERFCIDNGIMIAHAGLLGYRMGQTNELWNTVCTQRFRTDEVFVKWRDD

SEQ ID NO: 45792 - DNA, 1329 bp, Debaryomyces hansenii CBS767
  CDS (1)..(1329)
atgatacgatcgagcatatcgagaggaattttaccaagaaggattggtggatattatggcggtagatgttacatggttttggcgctcgaatcatcttgcgatgatgcgtgtgtagctcttcttgataaatattcaaaagatcaagcaccaaaggttatagaccaatttaaagagacattgaactcatctgggactggtggaattattcccacagatgcacacgagtttcatcaatttacgattgcaaatttggtagctaaattctgtaagaaacacaatcttaattcaacttcaccaccagatttgatatgttgcacgcgaggtcctggtatggtaggctcgttgagtgctagtttacaatttgcaaagggactttcagtaagttggaataagccattgataggagtccatcatatgttggggcatattttgatagcaaatttaccaaagagtcaacaacccgaaatggaggcacctaaatatccatttttaagtctactttgtagtgggggccataccatgctcgtacttctgaaatctctcactgagcatgagataatcattgatacggtggatattgcggccggtgattctatcgacaagtgtgccagggagttgggtttagtaggaaatatgttgggaaaggaattagaaagctacgtcaaagccattcctgaggacttgaaaaaaaaattcgaaaacacagatacaaagtcaagagataatgagtttaaatttcagctttctctccctctaagaagtcccaagcacctaaaaattcccgaaaagttagaattttcttttgcatcatttttgagtacaattcaaggttacaggacaaaatattttaacggtaaagattttgatgagatgacaaaaatgttcattgcatttaagcttcaagaattggttcttgaccatatggttaacagaataaatatcgcattgattaaacacgggattgatacaataaactacacgaaagcagatggaaaatttaagggtgttcaagactttatttgttcaggaggagttgcatcgaatcaacgattaagaaataaacttcataacaatttaaattacagaagcttgactaaagaatcagaatcgcatattcttaatttccattttcccgatttagcattatgtactgacaatgccattatgataggggttgcaggtattgaaatatttgaaaatctaaaagttaaatccgacttgaatattttgccaattagaaaatggccaatggatgagttattgaaagttgacgggtgggttcaattgaatgatgaagaaattaataaaatacgaaatttagatctataa

SEQ ID NO: 45793 - protein, 442 aa, Debaryomyces hansenii CBS767
MIRSSISRGILPRRIGGYYGGRCYMVLALESSCDDACVALLDKYSKDQAPKVIDQFKETLNSSGTGGIIPTDAHEFHQFTIANLVAKFCKKHNLNSTSPPDLICCTRGPGMVGSLSASLQFAKGLSVSWNKPLIGVHHMLGHILIANLPKSQQPEMEAPKYPFLSLLCSGGHTMLVLLKSLTEHEIIIDTVDIAAGDSIDKCARELGLVGNMLGKELESYVKAIPEDLKKKFENTDTKSRDNEFKFQLSLPLRSPKHLKIPEKLEFSFASFLSTIQGYRTKYFNGKDFDEMTKMFIAFKLQELVLDHMVNRINIALIKHGIDTINYTKADGKFKGVQDFICSGGVASNQRLRNKLHNNLNYRSLTKESESHILNFHFPDLALCTDNAIMIGVAGIEIFENLKVKSDLNILPIRKWPMDELLKVDGWVQLNDEEINKIRNLDL

SEQ ID NO: 45794 - DNA, 1071 bp, Yarrowia lipolytica CLIB99
  CDS (1)..(1071)
atgacgacttatctgagcttgggactggaaggcagcgccaacaaactgggggtgggcgtaatcaaacacacggtgacggatgccaacgccgaaaacggcttttccaccgacattctgtccaacattcgagacacctacatcactcctccaggcgagggattcttgccacgagacacagctcgtcaccaccgaaactgggtggttcgaatcatcaaacgggcactcgacgaggccaagatatccgaccctacaaaactgcattgcatttcgttcacccagggtcccggtatgggggctcctttgcagagcgtggtgattgctgcacgaaccattgctcaaatgtggggagttccgcttgtgggcgtcaaccattgcgtgggacacattgagatgggccgaactatcacgggcgccacaaaccccgtggttctgtacgtctctggaggaaatacacaagtgattgcgtactccaaacagcgatatcgaatctttggagagactcttgatattgctgtcggtaactgcttggatcggtttgcacgggtgctgaagatccccaacgccccctcaccaggatacaatatcgagcagctagccaagaagggcaaaaagtacgttccattgccatacaccgtcaagggcatggacctgagcatgtctggtgtgttgcagtttgtggagtctctggcaaagcggtttcaggcaggagatctggtggttgatggacatcaggtgaccgccgaagatctgtgcttttcgctacaagaaacgctctttgccatgctcgtcgaaatcactgaaagagccatggcccatgtcaactctcagcaagtacttattgtgggaggtgttgggtgcaacgagcgactccaggagatgatgggaatcatggcacgtgaccgaaacggctccgtctacgccaccgacgagcgtttctgcatcgataacggtatcatgattgcccatgctggtcttctggcatggagacagggctttgagacgaaaatggaaaagacccagtgcactcagagattcagaactgacgaggtactggtagattggagagtttaa

SEQ ID NO: 45795 - protein, 356 aa, Yarrowia lipolytica CLIB99
MTTYLSLGLEGSANKLGVGVIKHTVTDANAENGFSTDILSNIRDTYITPPGEGFLPRDTARHHRNWVVRIIKRALDEAKISDPTKLHCISFTQGPGMGAPLQSVVIAARTIAQMWGVPLVGVNHCVGHIEMGRTITGATNPVVLYVSGGNTQVIAYSKQRYRIFGETLDIAVGNCLDRFARVLKIPNAPSPGYNIEQLAKKGKKYVPLPYTVKGMDLSMSGVLQFVESLAKRFQAGDLVVDGHQVTAEDLCFSLQETLFAMLVEITERAMAHVNSQQVLIVGGVGCNERLQEMMGIMARDRNGSVYATDERFCIDNGIMIAHAGLLAWRQGFETKMEKTQCTQRFRTDEVLVDWRV

SEQ ID NO: 45796 - DNA, 1131 bp, Yarrowia lipolytica CLIB99
  CDS (1)..(1131)
atgagagcttatgctgcctcatccaggggcccattgcaacggcgactgctacacacctcacgatccctgacatacaacgtcttggccatcgaaacgtcctgtgacgatacctgcgcagccatcatctcacgtgaccgcgagaagaacacggcagcgctcatagaccatgtcaaaatcactttggactcgtctctacaaggaggaatcaatcccgctctggccaccgctcaccaccatcagagcgtagggcctttaataagagatgtgctaaaaaaacacgccgacacaacaattgacctggtttgtgccaccagaggacctggacttccaggctgcttgtcttcaggtgtcacctttgcaaaaggtctctctttaggcctgggagtcccctatcttggagtccatcatatgttggctcatttactgactcctcgtttgttcgaggccgctgagggttattcgggtcataagaccgagtttccatttttatcccttcttgtctctggaggccataccatgcttgttctcagcaaatctctatatgaccacactgtgttgtgcaatactgcagatgtagcaattggggatgcgctcgacaagtgcgctcggacgttgggattccagggaaacatgctaggcaaggtaatggaccagtattgtcgatctgcagacactccatcatctcaatggagcattcccatgcctgtagacaacaagaacgacattcgatactcgtttgcagcctttcattcttacattggaatgaagaagaaggagacacaggctgaaaccactccagaattggccctggaagtccaaacagccattttcaaccatctcatgaagaaaacgaaagccgctttcaatatctacaagaaggagattgcctctgccaccaccctggtctgctctggaggagttgctgccaaccccagactgagagaagctcttcaggaactgtgtgccaagtacaaactcgaggctgtgttcccagatccctattggtgtactgacaacgctgccatgatcggatgggcaggtattgagctacatgaagacgggtatagaagcgatctggagggcttccagattcccaagtggcctctggccgagtttgagaaagagatctag

SEQ ID NO: 45797 - protein, 376 aa, Yarrowia lipolytica CLIB99
MRAYAASSRGPLQRRLLHTSRSLTYNVLAIETSCDDTCAAIISRDREKNTAALIDHVKITLDSSLQGGINPALATAHHHQSVGPLIRDVLKKHADTTIDLVCATRGPGLPGCLSSGVTFAKGLSLGLGVPYLGVHHMLAHLLTPRLFEAAEGYSGHKTEFPFLSLLVSGGHTMLVLSKSLYDHTVLCNTADVAIGDALDKCARTLGFQGNMLGKVMDQYCRSADTPSSQWSIPMPVDNKNDIRYSFAAFHSYIGMKKKETQAETTPELALEVQTAIFNHLMKKTKAAFNIYKKEIASATTLVCSGGVAANPRLREALQELCAKYKLEAVFPDPYWCTDNAAMIGWAGIELHEDGYRSDLEGFQIPKWPLAEFEKEI

SEQ ID NO: 45798 - DNA, 1737 bp, Pan troglodytes
  CDS (1)..(1737)
atgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctactgtactctgtggcttcccaacatgttgttatgggatttactcatcttttatacccagagcttcacaacgtgcaaagtgcagtgaagtgggagaaacggtttacactgtccgacgagaaacacttccgttctttggtaaccctgctagggggcgccgctagattccatcctatttctccgatgaaagtatcaggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaaccagttgtgatgatacagcagctgctgtggtggatgaaactggaaatgtgttgggagaagcaatacattcccaaactgaagttcatttaagaacaggtgggattgttcctccagcagctcaacagcttcacagagaaaatattcaacgaatagtacaagaagctctttctgccagtagaatctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagctgcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaacgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatga

SEQ ID NO: 45799 - protein, 578 aa, Pan troglodytes
MNSRGMWLTYALGVGLLHIVLLSIPFFSVPVAWTLTNIIHNLGMYVFLHAVKGTPFETPDQGKARLLTHWEQLDYGVQFTSSRKFFTISPIILLYSVASQHVVMGFTHLLYPELHNVQSAVKWEKRFTLSDEKHFRSLVTLLGGAARFHPISPMKVSGIIYRVSMLILTKTAGVFFKPSKRKVYEFLRSFNFHPGTLFLHKIVLGIETSCDDTAAAVVDETGNVLGEAIHSQTEVHLRTGGIVPPAAQQLHRENIQRIVQEALSASRISPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDKVARRLSLIKHPECSTMSGGKAIEHLAKQGNRFHFDIKPPLHHAKNCDFSFTGLQHVTDKIIMKKEKEEGIEKGQILSSAADIAATVQHTMACHLVKRTHRAILFCKQRDLLPQNNAVLVASGGVASNFYIRRALEILTNATQCTLLCPPPRLCTDNGIMIAWNGIERLRAGLGILHDIEGIRYEPKCPLGVDISKEVGEASIKVPQLKMEI

SEQ ID NO: 45800 - DNA, 972 bp, Thermus thermophilus HB27
  CDS (1)..(972)
gtgtgggtcttggggattgacacctcctgcgacgacaccggggtgggcctcgtgcgggacggaaaggtggtggtgaacctggtggcgagccaggtgcgcctgcacgaggcctttggcggcgtggtgccggagctcgcaagccgcgagcacttaaaggccctccccctcctcgtggaaagggccctggccgaggcgggccttaggcctaaggacttagacctcgtggccgccacccggggccccgggctcatcggggccctcctcgtggggtacaccttcgccaaggggatggccttcgccctggaccggcccttctacgccgtccaccacctggagggccacatcgccgccgcctggcccgaagggctacccccccccttcctcgccctggtggcctcgggggggcacacccacctctacgaggtcttagacctcggccgctaccgcctcctcggggccacccgggacgacgctgccggggaggcctttgacaaggtggcgaggcttttgggcctcggctttcccggggggcccgaggtggagcgcctggccgaggaggcggaggaagccattcccttccccgtgcccttaaggggacaggaggggtacgacttcagcttctccgggctcaagaccaaggccctccacctggtggagaagggccttcccaaggccgccctcgctaagggctttcaggaggcggccatcgctcacctcgccgaggtggtcctgaaggcggcgaaggacacgggccaccgggtcctcctcgtggccgggggggtggcggcgaaccgggcgctccaggagcgcttcaaggaggcgggcctggaggtgcattttcctccccggggcctttcccaggacaacggggccatgatcgccctcgccgcctggcgccgccaccaaaggggcttccccccaagccccctctccttgggggccacggcctactggcccttggaggaggcctga

SEQ ID NO: 45801 - protein, 323 aa, Thermus thermophilus HB27
MWVLGIDTSCDDTGVGLVRDGKVVVNLVASQVRLHEAFGGVVPELASREHLKALPLLVERALAEAGLRPKDLDLVAATRGPGLIGALLVGYTFAKGMAFALDRPFYAVHHLEGHIAAAWPEGLPPPFLALVASGGHTHLYEVLDLGRYRLLGATRDDAAGEAFDKVARLLGLGFPGGPEVERLAEEAEEAIPFPVPLRGQEGYDFSFSGLKTKALHLVEKGLPKAALAKGFQEAAIAHLAEVVLKAAKDTGHRVLLVAGGVAANRALQERFKEAGLEVHFPPRGLSQDNGAMIALAAWRRHQRGFPPSPLSLGATAYWPLEEA

SEQ ID NO: 45802 - DNA, 1032 bp, Parachlamydia sp. UWE25
  CDS (1)..(1032)
atgttagttttgggaatagaaagtacttgtgatgaaacagcgtgtgccatcgttcgtgatggaaaagatattttgtcaaacattgtcgcttcacaaattgatttacacaaagaatacggaggcgttgttcctgaactggcttgtcgaaggcatattgatttaattattccagtcattgatcaagctcttaatcaagcaaaattaacacttgaacaaattgatttaattgcggttgcaaatggcccagggttaattggagctttactgattggtttaaatactgctaaagcactcgctttagcccttcgaaaaccttttattggcattaatcacgtggaagctcatttatatgcagcaattatgtcacaccctcaagattttcaatttccttgtttaggcgtcgttctgtctggcggtcatactgctcttgttttaattaaacaaattggtcaatacgaacttatcgggcaaactgtggatgatgcagtcggagaagcttttgataaagtcgctaagatgcttaatcttccctatcctggtggaccagaaatagaaaatttagcaaggcacggccgttctgttaaatttaattttaaagctggacaagtgaaaggtcgccctttggatttttctttcagcggactaaaaacagcagtcctttatgctattaaagatcctaaagcgcttaaagagatggttcttttatcctccgaaatgactcaagatatcgcagcaagtttccaagaagccgcttgcagtgatattgtgaaaaaatctctattggctgcaaaacaatatggtgtcaatactctcttatttggggggggtgtaacgaataattgttacttaagaaaattattttctgtggccaattcaaacttaaactatatatggccttctgccggtttaagtttggataatgctgccatgatcgcaggtcttggatactaccgttatcaattacaaaacaaaagtgattccatggatttagaaccattaacacgaacccctttacaatccgtaaaagaatag

SEQ ID NO: 45803 - protein, 343 aa, Parachlamydia sp. UWE25
MLVLGIESTCDETACAIVRDGKDILSNIVASQIDLHKEYGGVVPELACRRHIDLIIPVIDQALNQAKLTLEQIDLIAVANGPGLIGALLIGLNTAKALALALRKPFIGINHVEAHLYAAIMSHPQDFQFPCLGVVLSGGHTALVLIKQIGQYELIGQTVDDAVGEAFDKVAKMLNLPYPGGPEIENLARHGRSVKFNFKAGQVKGRPLDFSFSGLKTAVLYAIKDPKALKEMVLLSSEMTQDIAASFQEAACSDIVKKSLLAAKQYGVNTLLFGGGVTNNCYLRKLFSVANSNLNYIWPSAGLSLDNAAMIAGLGYYRYQLQNKSDSMDLEPLTRTPLQSVKE

SEQ ID NO: 45804 - DNA, 1086 bp, Desulfovibrio vulgaris subsp. vulgaris str. Hildenborough
  CDS (1)..(1086)
atgctctgtatcggaatagagacctcgtgcgatgagacgggccttgcgcttgtacgtgacggcaggcttgtgcatgccgtcatgtccagtcaggcagacatccatgcgctgttcggtggtgtcgtgccagagatcgcgtcgcgcgagcactacaggctcataggccccttgtacgacctgcttcttcgggaagcgggcgtcgggcctactgaactcgacgcggttgcggtggcccgtggcccggggctgctgggcagcctgctcgtggggatggccttcgccaaggggctcgcactcgggttcgatattccgctcgtgggcgtgaaccatctccatgcgcacctccttgccgcggggctggaacgcgaactggtgttccctgccctcggattgcttgtttccggggggcatacgcatatctatcgcatcgagtcgccggtctcgttccgtctgctggggcggacgctcgatgatgccgctggggaggcctacgacaaggttgcgaagatgttgcgtcttccctatcctggggggcgtattctcgaccagcagggacgtcgtggcatagctgacccacgcctgtttcctcgtccgtatacggacaatgacaacctcgatttcagtttcagcgggctcaagaccgctgtgcagacccacttgtcgcgccacccggagcttgtaccatcccccgatgccgctcaagccgtcgccggaggacatgatgcacctgaagggctgcggaacatgtgcgcctcattcaacgaggcggtggcagagacgttatgcatcaagctggggcgtgcccttgatggcgacgacggagtgggggtgcgggcgctcatcgtcgccggaggcgtcgccgccaacagctatgtgcgagagcacacggcccgcttggctgtatcccgggggcttgagcttatcgtcccgtctccaccactttgcaccgacaacgggtcgatgatcgcgtatgcggggtggctgttacgtcagggggggctttcgcacagcctcgaccttgaggccgtaccccgcgggcgtgccatccctgatgactaccgtcagggacctgccgggtgctcttga

SEQ ID NO: 45805 - protein, 361 aa, Desulfovibrio vulgaris subsp. vulgaris str. Hildenborough
MLCIGIETSCDETGLALVRDGRLVHAVMSSQADIHALFGGVVPEIASREHYRLIGPLYDLLLREAGVGPTELDAVAVARGPGLLGSLLVGMAFAKGLALGFDIPLVGVNHLHAHLLAAGLERELVFPALGLLVSGGHTHIYRIESPVSFRLLGRTLDDAAGEAYDKVAKMLRLPYPGGRILDQQGRRGIADPRLFPRPYTDNDNLDFSFSGLKTAVQTHLSRHPELVPSPDAAQAVAGGHDAPEGLRNMCASFNEAVAETLCIKLGRALDGDDGVGVRALIVAGGVAANSYVREHTARLAVSRGLELIVPSPPLCTDNGSMIAYAGWLLRQGGLSHSLDLEAVPRGRAIPDDYRQGPAGCS

SEQ ID NO: 45806 - DNA, 1023 bp, Listeria monocytogenes str. 4b F2365
  CDS (1)..(1023)
atgaaaaaaaatacattaattcttggaatagaatctagctgcgatgaaacagctgcttctgttgtaaaaaatggtaatgaaattatatcgagtgtggtggcttctcaaattgagagccataaacgatttggcggggtagttcctgaaatcgcatcaagacatcatgtggagcaaattacgcttgtgattgaagaagctttaaaacaagcaaatgtgacgatggatgatttagacgggatagctgtgacagaaggtccaggtctagttggtgcgctgcttatcggtgtgaatgcggctaaaacgctcgcttttatgcacaatttacctttagttggcgtgcatcatattgctggccatatttatgcaaatcgttttgaaactgaattcaaatttccgctactttcattagttgtcagcggcggtcatactgaactagttttaatgaaagcagataatgagtttgaaattatcggggagacaagggacgatgcagctggtgaagcttatgataaagtggcacgtacacttggtctcgcatacccaggcggcgtgcaaattgataaacttgccaaagacggcgaagatacttttcatttcccaagagcgatgatggatgagggttcgtttgattttagttttagtggattgaagtcttcctttattaacacgcttcataatttaaggcagcgtggtgaggagccaaatccaaacgatatggcggcgagttttcaagcaagcgttgtggatgttttagtaagcaaaacgattcgtgctgctaaacaatacgatgtgaaacaactgcttcttgcgggaggcgtggcagcgaaccaaggtttacgagaacgccttattcaagaagtaaaactagagcttccagagacagaactgattattccaccattagccttatgcggagacaatgcggcaatgattgctgctgcagggactgtgagtttcttacaaggaaaacgtagtggttttgatatgaatgcgaatccgggattattgctggaagatatataa

SEQ ID NO: 45807 - protein, 340 aa, Listeria monocytogenes str. 4b F2365
MKKNTLILGIESSCDETAASVVKNGNEIISSVVASQIESHKRFGGVVPEIASRHHVEQITLVIEEALKQANVTMDDLDGIAVTEGPGLVGALLIGVNAAKTLAFMHNLPLVGVHHIAGHIYANRFETEFKFPLLSLVVSGGHTELVLMKADNEFEIIGETRDDAAGEAYDKVARTLGLAYPGGVQIDKLAKDGEDTFHFPRAMMDEGSFDFSFSGLKSSFINTLHNLRQRGEEPNPNDMAASFQASVVDVLVSKTIRAAKQYDVKQLLLAGGVAANQGLRERLIQEVKLELPETELIIPPLALCGDNAAMIAAAGTVSFLQGKRSGFDMNANPGLLLEDI

SEQ ID NO: 45808 - DNA, 918 bp, Mycoplasma mobile 163K
  CDS (1)..(918)
atgataattttaggaattgagagtagtcatgatgatacttctattgcaattttagaaaataaaaaagttttatttcaattaagtttaagtcaagttaaaacacatgaaaaatttgggggtactataccagaaattgctagtagagaacatgtaaaaaatattaacattcttttgacaatgttaatagaaaaatttgatttatcaaaacttgattacattgcttatacagaaaaaccaggattaatcggagccttacaaataggatttttatttgcaagtgctctttctatttctttaaataaaaaattaattcctataaatcatcttgaagctcatttttttagtagtgaaataacaaatgaaattttgtacccagcagtaggactagttgtttcagggggacatagtctaatttattatgttaaaaatgtaaattctttagaaattattggtgaaacactggatgatgcaattggagaagtttttgataaaatttctagaaaacttaatttaggtttccctggaggaccaatcattgatagaatttcaagtgaaattgttggagatatcaaatttacaatccctaaaacagaaagggatttagatttttcgtttagtggaattaaaactcaagttataaattacataaataattctaaaaatttagatattaataatgttgcgtctagcttccaaaaaacaacaattgattatattgaggaaaaacttaaattagcaattaaaaaacaccatccacaatctcttgttgtaggtggtggtgttagtgcaaatacagaattgagaaaaagattatctacgttgcatgcaaatgttttatttccaaaaaaagaatatacaacagataatggagctatgattgcaataacagcttttttgaaattaaataagtctagttaa

SEQ ID NO: 45809 - protein, 305 aa, Mycoplasma mobile 163K
MIILGIESSHDDTSIAILENKKVLFQLSLSQVKTHEKFGGTIPEIASREHVKNINILLTMLIEKFDLSKLDYIAYTEKPGLIGALQIGFLFASALSISLNKKLIPINHLEAHFFSSEITNEILYPAVGLVVSGGHSLIYYVKNVNSLEIIGETLDDAIGEVFDKISRKLNLGFPGGPIIDRISSEIVGDIKFTIPKTERDLDFSFSGIKTQVINYINNSKNLDINNVASSFQKTTIDYIEEKLKLAIKKHHPQSLVVGGGVSANTELRKRLSTLHANVLFPKKEYTTDNGAMIAITAFLKLNKSS

SEQ ID NO: 45810 - DNA, 1590 bp, Picrophilus torridus DSM 9790
  CDS (1)..(1590)
atgatcgttcttggtcttgaaggcaccgcacatacaataagtgccggcatcgttgatgagaaatcaatattatcaaatgtatcatcgacatatgttccggagcacggcggcatacatccaagggaggctgcagtgcatcatgctgataaaatatacgatgttataaaaagatcgtttgataacgccggtttaaaaccggaggatctcgatctaatagcgttttcaatgggtcctggccttgggccatgccttcgggttgtctcaaccgccgccagggcactttcaattaaatattcaaagccattgcttggtgtgaaccatccccttggccacgttgagataggaagaaagctctctggtgcaagggatccaataatgctatatatatcaggtggaaacacgcaggtaatagcacatttaaacggcagataccgagtccttggggaaaccatggacataggccttggaaacatgcttgataaatttgccagggaccttggaataccatttccgggtggccctgtaatagaaagaatggcccttgatggcaaggatcttcttgaactgccatattcagtaaagggcatggatacatcattttcagggatttacaccgcggcgaaaaggtatctgtcccttggtaaaaataaaaatgatatatgctacagcctccaggaaacatcattttccatggttgttgaggtgcttgagcgtgcgatgtactacacaaataaaaacgagatcctgctggctggtggtgtggccagaaacgatagattaagatcaatggttaatgatatggcaagggactcaggttataaggcatatctaacggataaagagtactgcatggacaacggtgcaatgatagcccaggccggtatgcttatgtacatgcacggtgccaggcaggacataatggaaacaaggataaatcaaaggtttagaatagacgaggttcctgctccatggataaaggatgaaaacagcatatcatttaaggataagggtgccgaatcaataataacaaatggtgaattctatggcaggagtgttgttttcaagaagaggcctgaaaaatcataccgtgataaaaggctcgatcttaagataaggcttgaaagaatgaaaaatgaattctatataatgtattatctccataaaacaggtaatgctcccattgtatacgatttcgatagatttgacatggttttaacaattgaaagaataaatggcttaacaatgaacgattactttaaaagcaaatatgatgaaaacgttataagaatgatagcagatgccgttgcaaaaatgcatggtttaaggatatcgcatggcgatttaacaccgaacaatattattatatctgataaaatatattttatagatacaagcatgggtcatttaagatgcagcgatgaggacattgccgatgatctatttttattatacgagtcaatgaagagcctttacgtaaatggccatgaaatgataaagcattttgaaaatgagtattcaaaaaacgttgaggattataattattataaagaattgataaaaaagatagagtcaagaagaagatacgtttaa

SEQ ID NO: 45811 - protein, 529 aa, Picrophilus torridus DSM 9790
MIVLGLEGTAHTISAGIVDEKSILSNVSSTYVPEHGGIHPREAAVHHADKIYDVIKRSFDNAGLKPEDLDLIAFSMGPGLGPCLRVVSTAARALSIKYSKPLLGVNHPLGHVEIGRKLSGARDPIMLYISGGNTQVIAHLNGRYRVLGETMDIGLGNMLDKFARDLGIPFPGGPVIERMALDGKDLLELPYSVKGMDTSFSGIYTAAKRYLSLGKNKNDICYSLQETSFSMVVEVLERAMYYTNKNEILLAGGVARNDRLRSMVNDMARDSGYKAYLTDKEYCMDNGAMIAQAGMLMYMHGARQDIMETRINQRFRIDEVPAPWIKDENSISFKDKGAESIITNGEFYGRSVVFKKRPEKSYRDKRLDLKIRLERMKNEFYIMYYLHKTGNAPIVYDFDRFDMVLTIERINGLTMNDYFKSKYDENVIRMIADAVAKMHGLRISHGDLTPNNIIISDKIYFIDTSMGHLRCSDEDIADDLFLLYESMKSLYVNGHEMIKHFENEYSKNVEDYNYYKELIKKIESRRRYV

SEQ ID NO: 45812 - DNA, 1095 bp, Bartonella quintana str. Toulouse
  CDS (1)..(1095)
atgcgcctattgggaatagaaacaagttgtgatgaaactgctgctgctgttattgaacacaatattgaaggaaacagccaaattctttccaatattgtttggagccaaacggataatcatgcaccttacggcggtgtggttcctgaaattgctgctcgtgcccatgttgaaattctcgatgatttaattctgaaagctcttaccgacgctcatacaaaattgaaagacattgatgccattgcggtcacaagtggtcctggtttgataggaggacttttagtaggcgttatgagtgcaaaagcgctgtctcttgccactggaaaaccttttattgctgtaaatcatctggaaggacatgctttaacagccgtgctaacgcataatgttgcttttccctatttattgcttttggtttcaggtggccatacacaaacaatccttgtgcatgaagtgggcaattaccaacgtttaggaaccaccattgatgatgcattgggagaagcttttgataaaacagcaaaactcttaggccttccttaccctggcggcccagcacttgaaaaggcagctttgttgggtgataaaaatcgtatttctcttccacgacctttgaaaggtgaaaaacgattagatttttctttttccggtctcaaaactgctgtccgacaagccgcgacagctatgtcccctcttacagaaaacgatgttgctgacattgcagcaagttttcaagcagccgttaccgatacagtgtatgatcgcgttcatttggctttgcagtactttacccatcagtatccactctctcattacaaagggcgccgtcctcctgctttagttgtcgcaggcggagtagcagcaaaccaagccattcgattgacactacaagaacttgcacaccaacatggctttgaatttatagcgccccctctttccttgtgtaccgacaacgctgcaatgattgcctttgctggtgcacaaaagttcgcccggggagaaaaaaactcctttgatattgcccctcgctcacggtggccattggatgaaaaagctgctcctttaatcgggacaggacgccgtggaacaaaagcataa

SEQ ID NO: 45813 - protein, 364 aa, Bartonella quintana str. Toulouse
MRLLGIETSCDETAAAVIEHNIEGNSQILSNIVWSQTDNHAPYGGVVPEIAARAHVEILDDLILKALTDAHTKLKDIDAIAVTSGPGLIGGLLVGVMSAKALSLATGKPFIAVNHLEGHALTAVLTHNVAFPYLLLLVSGGHTQTILVHEVGNYQRLGTTIDDALGEAFDKTAKLLGLPYPGGPALEKAALLGDKNRISLPRPLKGEKRLDFSFSGLKTAVRQAATAMSPLTENDVADIAASFQAAVTDTVYDRVHLALQYFTHQYPLSHYKGRRPPALVVAGGVAANQAIRLTLQELAHQHGFEFIAPPLSLCTDNAAMIAFAGAQKFARGEKNSFDIAPRSRWPLDEKAAPLIGTGRRGTKA

SEQ ID NO: 45814 - DNA, 1095 bp, Bartonella henselae str. Houston-1
  CDS (1)..(1095)
atgcgtctgttaggaatagaaacaagttgcgatgaaactgctactgctgttattgaacacactattggaggaaacagccaaattctttccaatattgtttggagccaaacggatcatcatgcaccttacggcggtgttgttcctgaaattgctgctcgtgcccatgttgaaattcttgatgagttgattctgaaagctctaagagacgctcatacaaaactgaaggacattgatgccattgcagtcacaaatggtcctggtttgataggaggacttttagtaggcgttatgagtgctaaagcactgtctcttgccactggaaaaccttttattggcgtcaatcatctggaaggccatgctttgacagcggtactcacgcataatgttcattttccctatttattgttgttagtttcaggtggacatacacaaacaatccttgttcacggagtaggcaattaccagcgtttaggaaccactattgacgatgcattaggagaagcttttgataaaacagcaaaactcttaggccttccttaccctggaggcccagcaattgaaaaagccgctttattgggcaataaaaaccgtattcctcttccacgacctttaaaaggtgaaaaacgattagatttttctttttctggtctaaaaactgccgttcgacaagccgcaacagctatctcccctctcacagaaagcgatgttgctgacattgcagcaagttttcaagcagccgttaccgatacagtatatgatcgcgtttatttagctttgcaacactttacccagcagtatcctctttctcgtcatcaaggaccgcgtcctcctgctttagttgttgcaggaggagtagcagcaaaccaagctattcgattaacactgcaagaacttgccgatcaacagggctttgaatttatcgctcctcctctttccttatgcaccgacaatgctgcaatgattgcttttgccggtgcacaaagactggcacgaggagaaaaaagctcccttgacattgctcctcgttcacgctggccattggatgaaaaatccgctcccttaattggaacaggacgccgtggaacaaaagcataa

SEQ ID NO: 45815 - protein, 364 aa, Bartonella henselae str. Houston-1
MRLLGIETSCDETATAVIEHTIGGNSQILSNIVWSQTDHHAPYGGVVPEIAARAHVEILDELILKALRDAHTKLKDIDAIAVTNGPGLIGGLLVGVMSAKALSLATGKPFIGVNHLEGHALTAVLTHNVHFPYLLLLVSGGHTQTILVHGVGNYQRLGTTIDDALGEAFDKTAKLLGLPYPGGPAIEKAALLGNKNRIPLPRPLKGEKRLDFSFSGLKTAVRQAATAISPLTESDVADIAASFQAAVTDTVYDRVYLALQHFTQQYPLSRHQGPRPPALVVAGGVAANQAIRLTLQELADQQGFEFIAPPLSLCTDNAAMIAFAGAQRLARGEKSSLDIAPRSRWPLDEKSAPLIGTGRRGTKA

SEQ ID NO: 45816 - DNA, 1023 bp, Acinetobacter sp. ADP1
  CDS (1)..(1023)
atgattgttttgggtcttgaaacatcgtgtgatgaaacaggtctggcgctttatgacagtgaaaagggcttgctcggacaagtactctacagtcagattaaactgcatgctgaatatggtggtgtagttcccgagcttgcgtctcgtgatcatgtcagaaaaatgattccacttcttgatcagcttttaaacgacagccaagtaaaaaaatctcagattgatgcagtggcgtacacgcgcgggcctggtctgatgggcgccctcatgacaggtgctttatttggccgaactctggcatttgcactcaataaacctgccattggtgttcatcatatggaaggtcacatgcttgcaccgctactttctgcaacgccaccagaatttccatttgttgccttattggtatcgggtggtcacactcaactcatggctgcttatggtatcggtcaatatgagttgcttggtgagtctattgatgatgctgcgggtgaggcattcgataaagtcgctaaaatgatgggattaccttatccgggtggaccaaatattgcaaaattagctttgcaggggaacccagaaacatttgaatttcctcgccccatgcttcatcaaggcttagacttttcttttagcggcctaaaaacgtcagtttctgttcagctcaaaaaattgggtgaagaaaatcgtgatgctgatattgcggcttctttccaagaggcgattgtcgatacattggtgaagaaatctgtgaaggctttaaagcagacaggtttaaaacgtctagtgattgcgggtggtgtgagtgccaatcagcgattacgtgagcgccttgagcattcattatcaaaaatcaagtcacaagtttattatgctgaacctgcattatgtacagataatggtgcaatgattgcatttgcaggctatcaacgtttaaaggctgggcaatgtgatgatttggtggtcactaccacaccgcgctggccaatgactgaattgagtcgtccagcagagataatcgaataa

SEQ ID NO: 45817 - protein, 340 aa, Acinetobacter sp. ADP1
MIVLGLETSCDETGLALYDSEKGLLGQVLYSQIKLHAEYGGVVPELASRDHVRKMIPLLDQLLNDSQVKKSQIDAVAYTRGPGLMGALMTGALFGRTLAFALNKPAIGVHHMEGHMLAPLLSATPPEFPFVALLVSGGHTQLMAAYGIGQYELLGESIDDAAGEAFDKVAKMMGLPYPGGPNIAKLALQGNPETFEFPRPMLHQGLDFSFSGLKTSVSVQLKKLGEENRDADIAASFQEAIVDTLVKKSVKALKQTGLKRLVIAGGVSANQRLRERLEHSLSKIKSQVYYAEPALCTDNGAMIAFAGYQRLKAGQCDDLVVTTTPRWPMTELSRPAEIIE

SEQ ID NO: 45818 - DNA, 1014 bp, Erwinia carotovora subsp. atroseptica SCRI1043
  CDS (1)..(1014)
atgcgcgtattgggtatcgaaacatcctgtgatgaaaccggagtggctatttatgacacggaggcgggtttactcgccaatcagctatacagtcaggtcaaattacatgctgattacggtggcgtcgtgcctgagctcgcctcacgcgatcacgtgcgcaaaacggttcctttgattcaggcagcgctgcgtgaagctgggttacaggctgacgatatcgatggtgtggcttacaccgccggccctggtttggttggcgcgttattggtgggggcgacagtcggcaggtcgttggcgttcgcttgggaggtgccagcggtccctgtgcaccatatggaagggcatttgctggcgccgatgctggaagataatcctccagcgtttcccttcgtagcgctgctggtttctggtggtcatacgcagctcatcagcgtgacaggcattggcgaataccgcttgctgggtgagtcggttgacgatgcggcgggtgaagcgtttgataaaacggcgaagttgctgggattggattatcccggtggtccaatgctgtcgaaaatggcgcaggcaggtgattcccaacgctttacctttccgcgtccgatgaccgatcgtccggggttagatttcagcttttccgggctaaaaacgtttgctgcgaatacgatccgtagcaacggtgatgacgatcaaacgcgtgccgatattgcgcgtgcctttgaggatgccgtcgtggatacgctggccatcaagtgtcgtcgtgcgttggatgatacgggctttaaacgactggtcatggccggtggtgtaagcgccaatcgaacattgcgccagcgcttaggtgaggtgatggcaaaacgcggtggtgaagtgttttacgcgcgtcccgaattctgcacggataatggcgcgatgattgcctatgcgggcagcgtacgtctacttcatggtgcgagccagacgctgggcgtatctgttcgtccacgttggccgttggctgatttgcctgcggtgtag

SEQ ID NO: 45819 - protein, 337 aa, Erwinia carotovora subsp. atroseptica SCRI1043
MRVLGIETSCDETGVAIYDTEAGLLANQLYSQVKLHADYGGVVPELASRDHVRKTVPLIQAALREAGLQADDIDGVAYTAGPGLVGALLVGATVGRSLAFAWEVPAVPVHHMEGHLLAPMLEDNPPAFPFVALLVSGGHTQLISVTGIGEYRLLGESVDDAAGEAFDKTAKLLGLDYPGGPMLSKMAQAGDSQRFTFPRPMTDRPGLDFSFSGLKTFAANTIRSNGDDDQTRADIARAFEDAVVDTLAIKCRRALDDTGFKRLVMAGGVSANRTLRQRLGEVMAKRGGEVFYARPEFCTDNGAMIAYAGSVRLLHGASQTLGVSVRPRWPLADLPAV

SEQ ID NO: 45820 - DNA, 954 bp, Mesoplasma florum L1
  CDS (1)..(954)
atgaaaatattagcaattgaatcaagttgtgatgaattttcaatttcaataattgatgatggaaaaatattaacaaatattatttcatcacaaatagatcaacacgttaattttggtggtgttgttcctgaactagctgcaagactacatttagaaaatatatcttgagtaatcaaatctgcacttgaatcttcaaatacaaaaattgaagaaattgatcatgttgcatatactgaaaaacctggtttaataggttctttaatcataggtaaattagttgctgaaactatcgctagttatattgataaaccattaatgccattacatcatattgaaggtcacatttatggagcatcaattgagaatgagtttgtttatccggtactagctatggttgttagtggaggacatacgcaaattgaaatcgttaactcacctaatgaatttgaggtaattggtgcaactcttgatgatgctattggtgaatgttatgacaaggtagctagagtaatgggattaggttatccgggtggaccaaaaattgacaaattggctcaaaaaggaaataaagaagcttttatatttcctatatctaaaaatgatgatagttatgacttttcatattcaggattaaaaacagcagtcattaatattattcataatttaactcaaaaaggtgaggaaataccggttgcagatattgctgctagttttcaatatgcagcaacaaaaatagttgaaaaaaaactagaaaaagcaattattcaatttaaaccaaaaacattaacagttgctggtggtgttagtgctaatagtgaaattagaaacataataatgtcattgggtaaaaaatataatataacaaacacatttgttccaaagatggaatattgcacagataatgcagcaatgatagcgaaattagcgtacgaaaagttgaaaagtagtaattaa

SEQ ID NO: 45821 - protein, 317 aa, Mesoplasma florum L1
MKILAIESSCDEFSISIIDDGKILTNIISSQIDQHVNFGGVVPELAARLHLENISWVIKSALESSNTKIEEIDHVAYTEKPGLIGSLIIGKLVAETIASYIDKPLMPLHHIEGHIYGASIENEFVYPVLAMVVSGGHTQIEIVNSPNEFEVIGATLDDAIGECYDKVARVMGLGYPGGPKIDKLAQKGNKEAFIFPISKNDDSYDFSYSGLKTAVINIIHNLTQKGEEIPVADIAASFQYAATKIVEKKLEKAIIQFKPKTLTVAGGVSANSEIRNIIMSLGKKYNITNTFVPKMEYCTDNAAMIAKLAYEKLKSSN

SEQ ID NO: 45822 - DNA, 1044 bp, Propionibacterium acnes KPA171202
  CDS (1)..(1044)
atgtctgaaccgctcattctgggcatcgagtcatcgtgcgacgagaccggagttggcatcgttcggggcaatgacttgctcgccaacgaggtcgcctcttcgatggaacagcacgtgcgcttcggtggagtcgtgccggaagtggcatcccgagcccacttggaggccatcgtcccggtgttggacaaggccgcctcgaccgccggggtggacctgtccgagctcgacggtattgctgtgacagccggtccaggcctggctggggcactcgtcgtcggcctgtcggcggccaaagctttagcaagctggctcaacaagcctctgtacggcgtcaaccatctggctggacatgtcgccgtcgacctgcttgagcacggtgagctgccgatgccatgtggggctctgctcgtctcaggcggccataccagcttgctgtgggtaaacgacatcgccacagacattattgaggtcggctcgacgatcgacgacgctgctggcgaggcctacgacaaagtggcccgcgtgcttggcctgccgtacccgggtgggccggtcatcgacaaggctgccgccgagggggacccgacagcgattcgtttcccacgcggactgacggctcgccacgacatggttaagcatcgcttcgactactccttttccggccttaagaccgcggtgagtcggtgggtggagacccagcagcgtgacggagttgagttccgcatcgctgacgtcgccgccagtttccaggaggccgttgccgacgttctcactgcgaaagccgtcgacatgtgccaggagtatggcctcactcacttcctcatcggcggcggagtcgcggcgaactctcgtctgcggactctgcttgctgagcggatggcggacgccggcgttgagttgcgacggccgcgtccgggcctatgcaccgacaatggggccatgatcgcggccttaggtgtgcaggttgtcaaggcggggctgcctgcgtcggccatggatatttcggctgattcaggattgcccatcgagacggtgctcgtctga

SEQ ID NO: 45823 - protein, 347 aa, Propionibacterium acnes KPA171202
MSEPLILGIESSCDETGVGIVRGNDLLANEVASSMEQHVRFGGVVPEVASRAHLEAIVPVLDKAASTAGVDLSELDGIAVTAGPGLAGALVVGLSAAKALASWLNKPLYGVNHLAGHVAVDLLEHGELPMPCGALLVSGGHTSLLWVNDIATDIIEVGSTIDDAAGEAYDKVARVLGLPYPGGPVIDKAAAEGDPTAIRFPRGLTARHDMVKHRFDYSFSGLKTAVSRWVETQQRDGVEFRIADVAASFQEAVADVLTAKAVDMCQEYGLTHFLIGGGVAANSRLRTLLAERMADAGVELRRPRPGLCTDNGAMIAALGVQVVKAGLPASAMDISADSGLPIETVLV

SEQ ID NO: 45824 - DNA, 1083 bp, Leifsonia xyli subsp. xyli str. CTCB07
  CDS (1)..(1083)
atgaaccgcacagcatcgacggaggagggccctctcgtcctcggcatcgagacgtcctgcgacgagaccggcatcggcatcgtccgcggcaccacgatgctcgccaatgtgatcgcctcctcgatggaggagcacgcgcgctacggcggggtcgtgcccgaggtcgcggcccgcgcccacctcgaagcgctgaccccggcgctccggaccgctgtggccgacgctggcatcgacctggccgccgtggacgccgtggccgtgacgagcggaccgggtctctccggggcgctcatggtcggcgtcggcgctgcgaaggcgctcgcgctctccctcggcaaaccgctgtacgccgtgaaccacctcgtcggccatgtcggcgccgatctgctggacgcggacggcgggcccgggcatcccgtggagctgccgactgtcgcgttgctggtctccggcgggcacacctcgctgctgctcgtgcgcgacctcgtctccgatgtcgagctgctgggcgagacgatcgacgacgcggcgggggaggcgttcgacaaggtcgcccgcctcctgggtctgccctacccgggtggaccgcagatcgaccgcgtcgccgccgcgggcgatccccgcgccatccggtttccacgcgggctcacgaagccgcaggacctcgaacggcaccgctacgacttctccttctcgggggtgaagaccgccgtcgcgcgctgggtcgagaagcggcaggacgccggagaggaggtccctgtcgccgacgtcgccgcgtctttccgcgaggcggtggcggatgtgctgctcacgaaggccatcgccgcgtgcctcgaccatggcgtcccccgcctgctgctcggcggcggcgtcgtggccaacgcgcgtgtgcggcagctcgcggcggagcgggccgcggcagcgggggtggagctgcgcatccccgcgctctcgctctgcaccgacaacggcgcgatgatcgccgccctcggcgcgcagctcatcatggccgggcatgagccgagcgggcttggtttcggggccgactcgacgctgccggtcaccgatgtccacgtggtttga

SEQ ID NO: 45825 - protein, 360 aa, Leifsonia xyli subsp. xyli str. CTCB07
MNRTASTEEGPLVLGIETSCDETGIGIVRGTTMLANVIASSMEEHARYGGVVPEVAARAHLEALTPALRTAVADAGIDLAAVDAVAVTSGPGLSGALMVGVGAAKALALSLGKPLYAVNHLVGHVGADLLDADGGPGHPVELPTVALLVSGGHTSLLLVRDLVSDVELLGETIDDAAGEAFDKVARLLGLPYPGGPQIDRVAAAGDPRAIRFPRGLTKPQDLERHRYDFSFSGVKTAVARWVEKRQDAGEEVPVADVAASFREAVADVLLTKAIAACLDHGVPRLLLGGGVVANARVRQLAAERAAAAGVELRIPALSLCTDNGAMIAALGAQLIMAGHEPSGLGFGADSTLPVTDVHVV

SEQ ID NO: 45826 - DNA, 1035 bp, Desulfotalea psychrophila LSv54
  CDS (1)..(1035)
atgtattccaggaagataaatatgataatattaggcatagaaagttcctgtgatgacacctctgcagccgttgtaatagacggaacggcaatacagtcaaacgtcatcagtggtcaggaagaaattcataattgttttggaggtgttgtccctgaacttgcctccagaagtcatctcagcgccatccaacccgttgttgaaaaggccctgtctgacgctaagatcagccttgatgatattgatctcattgctaccacccaggggccgggattgagtggctcgctgttggtgggctattcctacgctaaatccctctctctggtgaaaaagattccctttgtcggagtagatcatatggcaggtcatgctcttgccatcctcttggaggaagagaccccagattttccctttatcgccctcaccgcctccggtggcacctcgtcaatttttttggtgaagagtagtacggattttgagcttctggggcgcacccgcgatgatgcagcaggcgaggcctttgacaaggttgccaaggtcctgggccttccctatccgggaggtccccatatcgcagcccatgcagagacgggcgatgaaaaaagtatcaaattccccagagcatggctggataaggatggttttgacttcagctttagtggcttgaagacagctgttcttaattatcacaataaaattgtgcaaaaaaatggtagtattacaaaagaagaaagggctgatatctgtgcctctttccaacaggctgttatagatgttttagtgactaaaactattaatgcagcaaggacacatggtatttcaacagtcgtcctcggtggaggggtctcctccaacagggccctgcgcctggccttttcccatgagtgcgataaatgtaagcttcaattttttgttccggcagcaaagctctgtacagacaatgcagcaatgattgccgttgccggctatcataaatacctgcgttttggacctggtaatctaagcgatgacgtttattcacgttcacaactgggatag

SEQ ID NO: 45827 - protein, 344 aa, Desulfotalea psychrophila LSv54
MYSRKINMIILGIESSCDDTSAAVVIDGTAIQSNVISGQEEIHNCFGGVVPELASRSHLSAIQPVVEKALSDAKISLDDIDLIATTQGPGLSGSLLVGYSYAKSLSLVKKIPFVGVDHMAGHALAILLEEETPDFPFIALTASGGTSSIFLVKSSTDFELLGRTRDDAAGEAFDKVAKVLGLPYPGGPHIAAHAETGDEKSIKFPRAWLDKDGFDFSFSGLKTAVLNYHNKIVQKNGSITKEERADICASFQQAVIDVLVTKTINAARTHGISTVVLGGGVSSNRALRLAFSHECDKCKLQFFVPAAKLCTDNAAMIAVAGYHKYLRFGPGNLSDDVYSRSQLG

SEQ ID NO: 45828 - DNA, 1017 bp, Borrelia garinii PBi
  CDS (1)..(1017)
atgaaagtacttggaatagaaacctcttgtgacgactgttgcatagctgtagtagaaaacggcattcatattttaagcaatataaaattaaatcaaaaagaacataaaaaatattacggagtagtacccgaaattgcctcaagacttcatactgaagctattatgtctgtttgtataaaagcactaaaaaaggcaaatactaaaatatctgaaattgacttaatagctgtaacatctagacccggacttattggatctttaatagttggattaaactttgccaaaggtttggcaatttcattaaaaaaacctattatttgcattgaccacatcttagcccatctttacgctcctttaatgagctcaaaaatagaatatccatttatatcattattattaagcggtggacatacattgattgctaaacaaaaaaattttgatgatgttgaaatacttggaaaaactctagatgattcttgtggggaagctttcgacaaagtagcaaagcattataatatgggatttccaggaggtccaaacatcgaacaaatatctaaaaatggagatgaaaacacatttaaatttccagttaccacctttagaaaaaaagaaaactggtatgatttttcatactctgggctaaaaacggcctgcatacatcaactcgaaaaattcaaaagcaaagataatccaacaacaaaaaataatatagctgcaagcttccaaaaagctgcctttgaaaatttaatcaccccgctaagaagagcaatcaaagatactcaaatcaacaaattggtaatagcaggcggtgttgcaagcaatttatacttaagagaaaaaataaataaattaaaaatacaaacttactatcctcctcttgatctttgcacagataatggagcaatgattgcgggacttggatttaatatgtatttaaaatatggagaaagtccaatcgaaaccgatgtaaattcaagaatagaaaattataagaaccaatacaggagaagaaaatag

SEQ ID NO: 45829 - protein, 338 aa, Borrelia garinii PBi
MKVLGIETSCDDCCIAVVENGIHILSNIKLNQKEHKKYYGVVPEIASRLHTEAIMSVCIKALKKANTKISEIDLIAVTSRPGLIGSLIVGLNFAKGLAISLKKPIICIDHILAHLYAPLMSSKIEYPFISLLLSGGHTLIAKQKNFDDVEILGKTLDDSCGEAFDKVAKHYNMGFPGGPNIEQISKNGDENTFKFPVTTFRKKENWYDFSYSGLKTACIHQLEKFKSKDNPTTKNNIAASFQKAAFENLITPLRRAIKDTQINKLVIAGGVASNLYLREKINKLKIQTYYPPLDLCTDNGAMIAGLGFNMYLKYGESPIETDVNSRIENYKNQYRRRK

SEQ ID NO: 45830 - DNA, 963 bp, Symbiobacterium thermophilum IAM 14863
  CDS (1)..(963)
gtgcagacgaggctgtttctcgggattgataccagctactacacctgttccgtggcgctggtggacgaggacgggcggctgctggaggatcagcgccgcctgatctccgtggcggaaggcgaacggggtgtggcgcccaacgaggccgtgtgggcgcacctgaacgccctgcccgacctggcggagccggtgctgcgcagacacggccggtcggtggcggcggtggccgcctcggtgaagccccggccggtggagggatcatacctcccgcccttccgggtcggggaggggtttggccgcgcgctcgcgtcggccctgggcgtgcccttctacccgaccacccaccaggagatgcacattcaggccggcctctggtcggcggacacgccgccccggggtgaccggttcctggcggtgcacctgtcgggagggaccaccgagctcattcgggtgacccggcggcccggcggcttcggcgaggagctgctgggcggcacccaggacctgcacgccggccagttcgtcgaccgggtcggggtggccctggggctgcccttcccggccggaccgcatctggagcggctagccgcgtccggcgagccggggcgcgtgcggctgccctccgcggtgcgggggtacaccgtatcgttctcggggccggagagcgcggcacagcggctggtgggacaggccgcgcccgccgacctggccctggccgtgttgcacacggtggcccggacggtggagaagtggctgctgcacgcgatggaggagaccgggctccgggaggtcctcatcgtcggcggcgtggcggccaatcagatcgtacgggcacgcctgcgccaccggctggagcaccccgccgtcggggcgcgcctcgcctttgcccagccgcggttcagcacggacaacgcagtcggcacggccctgctcgcacgggcgtgccacggcgtgtcgtcatag

SEQ ID NO: 45831 - protein, 320 aa, Symbiobacterium thermophilum IAM 14863
MQTRLFLGIDTSYYTCSVALVDEDGRLLEDQRRLISVAEGERGVAPNEAVWAHLNALPDLAEPVLRRHGRSVAAVAASVKPRPVEGSYLPPFRVGEGFGRALASALGVPFYPTTHQEMHIQAGLWSADTPPRGDRFLAVHLSGGTTELIRVTRRPGGFGEELLGGTQDLHAGQFVDRVGVALGLPFPAGPHLERLAASGEPGRVRLPSAVRGYTVSFSGPESAAQRLVGQAAPADLALAVLHTVARTVEKWLLHAMEETGLREVLIVGGVAANQIVRARLRHRLEHPAVGARLAFAQPRFSTDNAVGTALLARACHGVSS

SEQ ID NO: 45832 - DNA, 1026 bp, Symbiobacterium thermophilum IAM 14863
  CDS (1)..(1026)
gtgaaggggttgtcggaagggctgatcctcggtatcgagtcctcctgcgacgagacggcggcggccgtcgtcgcgggcgggcgcagggtgctgtccaataccgtcgcgagtcaggtggacctcttccgcaagtacggaggggtcgtgcctgagatcgcctcgcgccggcacctggagctgatcctgcccgtgatccgggaggcgctgcagatggccggcgtcacgttggagcagatcgacgcggtcgccgtcacccacggtcccggcctggtgggcacgctgctggtggggctgtcagccgcgaaggccctggccttcggcctggacaagcccctgatcggcgtgaaccacctgcagggccatatctacgccaacttcctggtggagcccccgcctgagttcccgctggtctgcctggtggtctcgggcggccatacggacctgatctacatggccggccacggccggatggagctgctcggccgcaccctggacgacgcggccggcgaggctttcgacaaggtggcccgctccgtggggctcggttaccccggcggcccgcaggtggagaagctggcccggtcgggcgacccggaggccgtgccgctgccgcgcgcccacacggaggggccttacgacttctccttctcgggcctgaagaccgcggtgctccagtacgtccagcgcaccggtcccctgaacgatcagcagcgggcggacctcgcggcgtcgttccagcgggcggtgacgtcggtgctggtggagcgcacggtgaaggcggcggaggcgaagggcgttcggcaggtgatcctggccgggggcgtcgccgccaacggcgccctgcgggaggagatgcgcgccgcactggagccccgggggatccgcctcggctacccgccgccggtgctctgtaccgacaacgcggccatgatcgccgccgccggctactacctctggcgggccggcgtccgccacgacctggacctgaacgccgtgcccgggctggggctcggcatcggcggctga

SEQ ID NO: 45833 - protein, 341 aa, Symbiobacterium thermophilum IAM 14863
MKGLSEGLILGIESSCDETAAAVVAGGRRVLSNTVASQVDLFRKYGGVVPEIASRRHLELILPVIREALQMAGVTLEQIDAVAVTHGPGLVGTLLVGLSAAKALAFGLDKPLIGVNHLQGHIYANFLVEPPPEFPLVCLVVSGGHTDLIYMAGHGRMELLGRTLDDAAGEAFDKVARSVGLGYPGGPQVEKLARSGDPEAVPLPRAHTEGPYDFSFSGLKTAVLQYVQRTGPLNDQQRADLAASFQRAVTSVLVERTVKAAEAKGVRQVILAGGVAANGALREEMRAALEPRGIRLGYPPPVLCTDNAAMIAAAGYYLWRAGVRHDLDLNAVPGLGLGIGG

SEQ ID NO: 45834 - DNA, 1035 bp, Mannheimia succiniciproducens MBEL55E
  CDS (1)..(1035)
atgcgaatcttaggaatcgaaacatcttgcgacgagacgggcgtcgctatttacgatgaagacaaagggctgattgccaaccagctttatacgcaaattgcgctgcacgccgattacggcggcgttgtgcccgaacttgcttcgcgcgatcatatccgaaaaaccgctccgttaattgaagctgcattgcaggaagcgaatttaaccgcaaaagacattgacgggattgcctatacctgcggtccgggattagtaggtgcgttattggtcggttccaccatcgcccgttcgcttgcctatgcctggaacgtgcctgctgtcggcgttcatcatatggagggacatttattggcgccgatgttggaagatgccgacaacagaccgcaatttccctttattgcgctgcttgtttccggcggtcatacccaattagtcaaagttgagggtgtcggcaaatatgaagtaatgggcgaaagcattgatgatgccgccggcgaagcctttgataaaacggcaaaattattgggcttggattatcccggcggtgcggcgctttcccgtttggcggaaaaaggcagtgccggacgttttgtttttccgaaaccgatgacggatcgccccggattggatttcagcttttcgggtttgaaaacctttgccgccaataccattaatcaggcaattaaaaacgaaggcgaactcagcgagcagacgaaagcggatatcgcccatgccttccaaaccgccgtggtggaaactctcgcgataaaatgcaaacgcgcgttaaaggaaaccggttataaacgtttagtgatcgccggcggagtaagtgccaataaacagcttcgtcaggggcttgcaaacctgatggacgatttaaaaggacgggtcttttatcccgccccgcaattttgtacggataacggcgcaatgatttcttatgtgggttatctgcgtttgaaacacggcgaacgcaccgaccttgctatcgaagtgaaacctcgctggccgatgatcgaacttgaagcaatttag

SEQ ID NO: 45835 - protein, 344 aa, Mannheimia succiniciproducens MBEL55E
MRILGIETSCDETGVAIYDEDKGLIANQLYTQIALHADYGGVVPELASRDHIRKTAPLIEAALQEANLTAKDIDGIAYTCGPGLVGALLVGSTIARSLAYAWNVPAVGVHHMEGHLLAPMLEDADNRPQFPFIALLVSGGHTQLVKVEGVGKYEVMGESIDDAAGEAFDKTAKLLGLDYPGGAALSRLAEKGSAGRFVFPKPMTDRPGLDFSFSGLKTFAANTINQAIKNEGELSEQTKADIAHAFQTAVVETLAIKCKRALKETGYKRLVIAGGVSANKQLRQGLANLMDDLKGRVFYPAPQFCTDNGAMISYVGYLRLKHGERTDLAIEVKPRWPMIELEAI

SEQ ID NO: 45836 - DNA, 1020 bp, Bacteroides fragilis YCH46
  CDS (1)..(1020)
atgagtacaattatattaggaattgaatcttcctgtgacgatacatcagctgcagttattaaagatggttatttgttatcgaatgtggtatctagccaggctgtacacgaagcttatggtggagtagtaccggaattggcatcgcgtgctcaccaacagaatatagtacctgtggtgcatgaagcgttgaagcgtgcaggagtgaccaaggaagagctgagtgcggtagcctttacaagggggcctgggttgatggggtcattgctggttggagtatcttttgcaaagggttttgcacgttcattaaatatcccgatgattgatgttaatcatctgacaggacacgtgttagcgcattttattaaagaggaaggagaagcaaatgaacagcccgattttccattcctttgtttgctggtatccggaggtaattctcaaattatattggtgaaagcatataatgatatggagattctgggacagactattgacgatgctgccggagaagcaattgataaatgttcgaaagtaatgggacttggttatccggggggacctataattgaccgtttggcacgtcagggcaatccgaaggcttatacttttagtaaacctcatatttctggtttggattatagttttagcggattgaaaacgtcgtttctttactctctgcgtgattggatgaaagaggatcccgatttcatcgaacaccataagaacgatttggcagcttcgcttgaagcaacggtagtagacattttgatggataaacttcgtaaagcagccaagcaatataaaattaatgaagtggctgtagcgggcggtgtttctgctaacaacggtttgcgtaatgcctttcgtgagcatgcagagaaatatggttggaaaatttttattcccaagttcagctatactacagataatgccgcaatgatcgctatcaccggatattttaaatatcaggataaagatttctgctctatagaacagcctgcttattcacgtgtaactttgtaa

SEQ ID NO: 45837 - protein, 339 aa, Bacteroides fragilis YCH46
MSTIILGIESSCDDTSAAVIKDGYLLSNVVSSQAVHEAYGGVVPELASRAHQQNIVPVVHEALKRAGVTKEELSAVAFTRGPGLMGSLLVGVSFAKGFARSLNIPMIDVNHLTGHVLAHFIKEEGEANEQPDFPFLCLLVSGGNSQIILVKAYNDMEILGQTIDDAAGEAIDKCSKVMGLGYPGGPIIDRLARQGNPKAYTFSKPHISGLDYSFSGLKTSFLYSLRDWMKEDPDFIEHHKNDLAASLEATVVDILMDKLRKAAKQYKINEVAVAGGVSANNGLRNAFREHAEKYGWKIFIPKFSYTTDNAAMIAITGYFKYQDKDFCSIEQPAYSRVTL

SEQ ID NO: 45838 - DNA, 1014 bp, Methylococcus capsulatus str. Bath
  CDS (1)..(1014)
gtgttggtcttgggcatcgaaacttcctgcgacgaaacgggcgtcgcgctttatgactcgagcaaggggctgctggcgcaccggctctacagtcaagtcgacgagcatgcgatgtatggtggcgtggtgccggaaatcgcatcgcgcgaccatctgcgcaagctcctcccgctggtccgcgaagtgttggccgcagggggcgtccggcgtaccgcgatcggcgggatcgcctacacggccggaccgggcctgatcggagcgctcctcgtcggggcggccgtggcccgcagcctcgcctgggcctggagcgtccctgccatcgctgtccatcacatggaaggccatctgctggcgccgctgctggaacccgagcctcccgaattccccttcgtcgcactcctggtttccggcggccacactctgttggtcgaggtgcgtggcatcggggtctaccaggtgctgggcgaatcgctggacgatgcggccggcgaggctttcgacaaaaccgcaaagcttctcgggctgggttatcccggtgggccggcattggcccgcctcgccgagaaagggcgcgccgaacggttccatttcccccgtccgatgacggacaggccgggtctcgatttcagtttcagcggactcaagacccacgcattgaacgtgcttgccgcgctgccggggacgccgcaggacaaggcggacatcgcctgcgcattccaggcggccatcgtcgatacgttggtgctgaagtgtcgccgggcgatgcgggaaaccgggttggggcgcctggtcgtcgcagggggcgtgagcgccaatcaggcagtgcgcaaggggcttcaggcgatggctgaaagcgagcgctaccgggtttacttcccaaggccggagttctgcaccgacaatggggcgatgatcgccttcgccggttgctggcgtcttcgggccggccagttcgaaccgtcggcgatcgaggcgagggcacgctgggcgatggaaacgctcacagccgtttag

SEQ ID NO: 45839 - protein, 337 aa, Methylococcus capsulatus str. Bath
MLVLGIETSCDETGVALYDSSKGLLAHRLYSQVDEHAMYGGVVPEIASRDHLRKLLPLVREVLAAGGVRRTAIGGIAYTAGPGLIGALLVGAAVARSLAWAWSVPAIAVHHMEGHLLAPLLEPEPPEFPFVALLVSGGHTLLVEVRGIGVYQVLGESLDDAAGEAFDKTAKLLGLGYPGGPALARLAEKGRAERFHFPRPMTDRPGLDFSFSGLKTHALNVLAALPGTPQDKADIACAFQAAIVDTLVLKCRRAMRETGLGRLVVAGGVSANQAVRKGLQAMAESERYRVYFPRPEFCTDNGAMIAFAGCWRLRAGQFEPSAIEARARWAMETLTAV

SEQ ID NO: 45840 - DNA, 1035 bp, Nocardia farcinica IFM 10152
  CDS (1)..(1035)
atgggcatcgaatcctcctgcgacgagacgggagtgggcatcgtccggtggcatccggacggcacctgcgaactgctcgccgacgaggtcgcctccagcgtcgaccagcacgcccggttcggcggggtggtgccggagatcgcctcgcgcgcccacctcgaggcgatcgtgcccgccatgcgacgcgcgctctccgcggcgggcatcgccaaaccggacgcgctggccgtcaccatcgggccggggctggcgggtgcgctgctggtcggtgtcgccgccgcgaaagcctatgcggcggcgtgggatgtgccgttctacgcgctgaatcacctcggcgggcacgtggccgtcgacaccctcgagcacgggccgatgccgccgtgcgtggcgctgctcgtctccggcgggcacacccatctgctgcacgtgaccgatctggccgcgcccatcgtcgaattgggcagcaccgtcgacgacgcggcgggcgaggccttcgacaaggtcgcccggctgctcggactcggcttccccggcggccccgcgctcgatgccgcggcccgcgacggcgacccgcacgcgatcgccttcccgcgcggcatgaccgggccgcgcgacccgcgctacgacttctccttctccggcctcaagaccgcggtcgctcgccacgtggaggccgcccagcgcgccggcgtcgccatcgccgacctgccgatccccgacatcgccgcgtccttccaggaggcggtggccgacgtgctgaccatgaaggccgtccgcgcggcccaggacatgggggtcgacaccctggtgctcggcggcggcgcgacggccaactcccgcattcgctcgctggccgaggaacgctgcgcggcagcgggtttgacgctgcgggtgcccaagccgcggctgtgcaccgacaacggcgtgatgatcgcggcgctgggggcccatgtcatcgcgggtggggcacggccatcgccgctgacggtggccagcgatcccgggctgccggtgtcggtcagccagatcgcctga

SEQ ID NO: 45841 - protein, 344 aa, Nocardia farcinica IFM 10152
MGIESSCDETGVGIVRWHPDGTCELLADEVASSVDQHARFGGVVPEIASRAHLEAIVPAMRRALSAAGIAKPDALAVTIGPGLAGALLVGVAAAKAYAAAWDVPFYALNHLGGHVAVDTLEHGPMPPCVALLVSGGHTHLLHVTDLAAPIVELGSTVDDAAGEAFDKVARLLGLGFPGGPALDAAARDGDPHAIAFPRGMTGPRDPRYDFSFSGLKTAVARHVEAAQRAGVAIADLPIPDIAASFQEAVADVLTMKAVRAAQDMGVDTLVLGGGATANSRIRSLAEERCAAAGLTLRVPKPRLCTDNGVMIAALGAHVIAGGARPSPLTVASDPGLPVSVSQIA

SEQ ID NO: 45842 - DNA, 1002 bp, Legionella pneumophila str. Paris
  CDS (1)..(1002)
atgcttgtattgggtatagagtcttcctgtgatgaaacaggtgttgctgtctatgattcagaatcaggattattgtcccacgccttgcattcacaaattgccactcatcgtgtacatggcggtgttgttccagaactggcatcaagagatcatgtgaattacttggttcctttagtcgatgaggtactaactaaagcgcaaattcgtaaaaaccaattggatggaatagcctacaccgcaggacccggattaattggcgctttgttagttggttcctgctttgccaaaagtctcgcctacgccttaaatattccggcattggcaattcaccatttggaagcccatctgttagccgcaaaaatggaaaccccatcccttgattttccctttattgctctgttagtttccggtggccattgtcaactaatagaagtaaacaacattggtgagtatcgattattaggggatactctcgacgatgcagtaggagaagcctttgacaagacagccaaactgatggggattccctatcctggaggagccgtgttggcaaatttggctgatcaatgtttatcaactccctatcaatttccccgccccatgactgacaggccaggcttggactttagttttagcggactaaaaactcatgccttaaatacctggaaccaaagtgaaaaaaaagaaagcgaccgctccgaaattgcaaaagcattccaacaagcagtagttgaaacactaattataaaatgcaaaagagccattaaagagtcgcaatcaaagcgccttgtggtagccggtggagtaggggccaataaagccttgcgtagcgctttgcaaaaatggattaaagacatcaaaggggaagtgtatttccccgctctggaatattgcacagataatggtgcaatggtcgcttatgcaggatgtttgcgcatgatgcggggggagagtgatggggggtggggggttatggttaaacctcgttggcccctcgcttga

SEQ ID NO: 45843 - protein, 333 aa, Legionella pneumophila str. Paris
MLVLGIESSCDETGVAVYDSESGLLSHALHSQIATHRVHGGVVPELASRDHVNYLVPLVDEVLTKAQIRKNQLDGIAYTAGPGLIGALLVGSCFAKSLAYALNIPALAIHHLEAHLLAAKMETPSLDFPFIALLVSGGHCQLIEVNNIGEYRLLGDTLDDAVGEAFDKTAKLMGIPYPGGAVLANLADQCLSTPYQFPRPMTDRPGLDFSFSGLKTHALNTWNQSEKKESDRSEIAKAFQQAVVETLIIKCKRAIKESQSKRLVVAGGVGANKALRSALQKWIKDIKGEVYFPALEYCTDNGAMVAYAGCLRMMRGESDGGWGVMVKPRWPLA

SEQ ID NO: 45844 - DNA, 1020 bp, Photobacterium profundum SS9
  CDS (1)..(1020)
atgcgtatattgggcatcgaaacgtcttgtgatgaaactggcgttgcgattttcgatgatgagcaaggtttactgtcacatgagctttacagtcaggtgaaattgcatgctgattatggtggcgttgtacccgagttagcttctcgtgatcacgttaaaaaaaccattccgttaatcaaagaagcattgaaaaaagcggggttaacaccagcagatcttgatggtattgcttataccgcaggcccgggtttggttggggcgttattagtgggtgcaaccattggtcgtagcctcgcatattcgtggggtttacccgctgtggctgtacaccatatggaagggcatttactggctccaatgctagaagataacgcccctgatttcccatttgtggcattgctggtttctggcggtcataccatgatggttgaagtgcaaggtattggtgagtatcaaattttaggcgaatctgttgatgatgccgcaggtgaagcttttgataaaacagccaagcttatgggtttagattaccctggtggtccgttgttatcaaagctggctgaaaagggcacgaaagggcgttttaaattccctcgtcctatgacagatcgacctggtttagacttcagtttttcgggcctaaagacgtttgctgcaaatacgatccgagccaacgacgatgacgaacaaacgcgtgctgatattgcatttgctttccaagaagcggtggttgatacattggcaattaagtgtaaacgggcactgaaacaaacgggtttgaaacgtttggttatcgctggcggggtaagtgctaattcttacttacgccaagagttaggttcgttgatgacaaaactgaatggtgaggtcttttatcctcgaacagagttttgtacagataacggtgcaatgatcgcgtatgcaggaatgcaacgattgaaaaatcaagaattgatggacttgagtgtaaaagcgtacccacgctggccgatcgatcagttgaaaccgttaaataaataa

SEQ ID NO: 45845 - protein, 339 aa, Photobacterium profundum SS9
MRILGIETSCDETGVAIFDDEQGLLSHELYSQVKLHADYGGVVPELASRDHVKKTIPLIKEALKKAGLTPADLDGIAYTAGPGLVGALLVGATIGRSLAYSWGLPAVAVHHMEGHLLAPMLEDNAPDFPFVALLVSGGHTMMVEVQGIGEYQILGESVDDAAGEAFDKTAKLMGLDYPGGPLLSKLAEKGTKGRFKFPRPMTDRPGLDFSFSGLKTFAANTIRANDDDEQTRADIAFAFQEAVVDTLAIKCKRALKQTGLKRLVIAGGVSANSYLRQELGSLMTKLNGEVFYPRTEFCTDNGAMIAYAGMQRLKNQELMDLSVKAYPRWPIDQLKPLNK

SEQ ID NO: 45846 - DNA, 1029 bp, Geobacillus kaustophilus HTA426
  CDS (1)..(1029)
gtgggtgaagctgagatgaatgaggacgtgtatgtattaggcattgaaacgagctgcgatgaaacggcggcagcagtcgtgaaaaacggaagagaggttttatcgaatgtagtggcgtcgcaaatggaaagccatcggcggtttggcggcgtcgtgccggaaattgcttcccgccatcatgtggagcaaattacgctcgttattgaggaagcgatgcagcaggccggcgtatcgtttgcgagccttgatgcggtggcggtgacggccggaccggggcttgtcggagcgcttcttgtcggggtcaacgcggcgaaagcgttagcgttcgcccatggattgccgcttattggagtgcatcatatcgccggtcatatttacgccaatcaattagtggccgaaatgaagttcccgctgttggcgctcgtcgtttccggtggtcatacggaactagtgttcatgaaggagcatgggaattttgcggtgatcggtgaaacgcgcgatgacgctgccggtgaggcgtatgacaaggtggcgcgggctttaggccttccgtacccaggaggaccgcacatcgaccggctggctcatgagggagagccagtgattgatttgccgcgagcgtggcttgaggaaggttcgtatgatttcagcttcagcggcttaaaatcggcggttctcaatgcgctccacaacgcgaagcagcgcggcgaggagatcgatccgagacagatggccgcgagctttcaggccagcgtcgtcgatgtgctggtgacgaaaacggtgcaggccgccaaagaataccgcgtacggcaagtgctgctcgccgggggggtggcggccaaccgcgggctgcgggctgcactgcaggataaaatgaaagagctccccgatgtggagcttgtcatcccgccgttatcgctatgcaccgataatgctgcgatgattgccgttgcgggaacagtgttatatcaacaaggaaagcgggctgatttggcgctcaacgccaatccaagcttgccgcttgtctag

SEQ ID NO: 45847 - protein, 342 aa, Geobacillus kaustophilus HTA426
MGEAEMNEDVYVLGIETSCDETAAAVVKNGREVLSNVVASQMESHRRFGGVVPEIASRHHVEQITLVIEEAMQQAGVSFASLDAVAVTAGPGLVGALLVGVNAAKALAFAHGLPLIGVHHIAGHIYANQLVAEMKFPLLALVVSGGHTELVFMKEHGNFAVIGETRDDAAGEAYDKVARALGLPYPGGPHIDRLAHEGEPVIDLPRAWLEEGSYDFSFSGLKSAVLNALHNAKQRGEEIDPRQMAASFQASVVDVLVTKTVQAAKEYRVRQVLLAGGVAANRGLRAALQDKMKELPDVELVIPPLSLCTDNAAMIAVAGTVLYQQGKRADLALNANPSLPLV

SEQ ID NO: 45848 - DNA, 1026 bp, Anaplasma marginale str. St. Maries
  CDS (1)..(1026)
atgtccggtgtggggtgcattttggggatagagaccagttgtgatgagacagcagttgcagtcttaaatcagcgcagcgtactgtcacatgaagtattatcccagaaggagcactcgtcttttggtggtgtggtaccggagattgcagcaagggcccattctgattttctacatgttctggtctccaaggctatgggtggtgctcatatagggtttagtgatctaagcgcgattgcggtaacatctggccctggattggtgggttcacttatagttggtgtaatgcttgccaaggcaattgcatatgtggcacataaacccatcattgctgtgaatcaccttgaggctcatgcactagtggcacgtatgatttatgctgaccttgaatttccattcctagtgttgatcatatctggggggcactgccaattcttgatcgcacatgatgtcggtaggtatacaaaacttggtgaatcggttgacgactcgctgggggagagctttgataaagtggccagaatgcttggcctagggtatccaggtgggcctgaggtggaaagttgtgctctcaagggggatgcgcacaggtttccgtttcctagggccctgaaaagcaggccggggtgcaacttttcgttttctgggctcaaaaccgcggtgcgctataccatcgccaaggagggaaagttagacaaccaggctttatatgacatttgtgcgtcattccagcaatgcgttggtgaaattttggtgagtagaattgcgaatgcgatggcggcggcgaaatctgccgatagtagcatcagtaaaatggttgtaagtggaggcgtagccgccaacaattttttgcgcggcagcatacgcaaatgtgccaatgaactcggatttgatgcaatattccctccccaagagctgtgcacggataacggtattatggtcggatgggccgggctcgaaaacctacgcaagggcaatttctcgtccttagagctcattcccagggctcgctggcccctctgcccgtag

SEQ ID NO: 45849 - protein, 341 aa, Anaplasma marginale str. St. Maries
MSGVGCILGIETSCDETAVAVLNQRSVLSHEVLSQKEHSSFGGVVPEIAARAHSDFLHVLVSKAMGGAHIGFSDLSAIAVTSGPGLVGSLIVGVMLAKAIAYVAHKPIIAVNHLEAHALVARMIYADLEFPFLVLIISGGHCQFLIAHDVGRYTKLGESVDDSLGESFDKVARMLGLGYPGGPEVESCALKGDAHRFPFPRALKSRPGCNFSFSGLKTAVRYTIAKEGKLDNQALYDICASFQQCVGEILVSRIANAMAAAKSADSSISKMVVSGGVAANNFLRGSIRKCANELGFDAIFPPQELCTDNGIMVGWAGLENLRKGNFSSLELIPRARWPLCP

SEQ ID NO: 45850 - DNA, 1035 bp, Idiomarina loihiensis L2TR
  CDS (1)..(1035)
atgcgggtattgggtattgaaacgtcttgtgatgaaacgggtgttgcggtgtacgacaccgaaaaaggcttattagcccaccagttgtactcgcaggtgaaactgcatgccgactacggcggcgtagtgcccgagctggcatctcgtgaccacgtgcgcaagaccttaccgttgattaaagctgcgctcaaagaggccgggatttcgcatcagcaactggatggtattgcttatacaatggggcctgggctggttggtgctctgttagttggtgcttgtattggtcgtagtctggcttttggatggaatttacccgcggttggagttcatcatatggaaggccatttgctggcgcctatgctggaagaaaaccagcccgaatttccttttgtcgccttgttggtttccggcgggcatactcaactggttcaagtaaaaggtataggcgattatcatttgctgggcgaatcagtagacgacgccgcaggcgaggcttttgataaaacagctaagctaatggggcttgattatcccggggggccgcgattggctgctttggctgaacagggcaacagcgatcgttttacctttcccagaccaatgacagacagaccaggtcttaatttttctttcagtggtttgaaaacttctgcggctaatactctggccgctaatgacagtgatgagcagaccctggcggatattgcgcgggcatttgaagatgcggtggttgataccttggtgattaaatgtcgccgggcgctaaaagaaaccggttacaagcgtttggtcgttgccggtggggtcagtgccaataagcatttacgcgcaaaacttgaagctttattagaaaaacaaaagggccagatattttacccgcgtacggaattttgtactgataacggtgcgatgatcgccttagcgggcgctctgcgtttagaagcgggagaacgtgagccattggcagtgaaaacacacccaagatggccgatgacagatttgaaacccatggtgaatattagcgacgccgtttaa

SEQ ID NO: 45851 - protein, 344 aa, Idiomarina loihiensis L2TR
MRVLGIETSCDETGVAVYDTEKGLLAHQLYSQVKLHADYGGVVPELASRDHVRKTLPLIKAALKEAGISHQQLDGIAYTMGPGLVGALLVGACIGRSLAFGWNLPAVGVHHMEGHLLAPMLEENQPEFPFVALLVSGGHTQLVQVKGIGDYHLLGESVDDAAGEAFDKTAKLMGLDYPGGPRLAALAEQGNSDRFTFPRPMTDRPGLNFSFSGLKTSAANTLAANDSDEQTLADIARAFEDAVVDTLVIKCRRALKETGYKRLVVAGGVSANKHLRAKLEALLEKQKGQIFYPRTEFCTDNGAMIALAGALRLEAGEREPLAVKTHPRWPMTDLKPMVNISDAV

SEQ ID NO: 45852 - DNA, 1029 bp, Azoarcus sp. EbN1
  CDS (1)..(1029)
atgaaagtactgggaatcgagacttcgtgcgacgaaacgggcgtggcgatcttcgacacggcggccggtttgctcgggcattgcgtccacacgcagatcgcgctgcatgccgcatacggcggcgtagtcccggagcttgcgtcgcgcgatcacatccgccgcctgccgctgctggtgaagcagacgctggatgcggctggctgcgagctgtcgcaactcgatgcgatcgcctacacggccggcccgggacttgccggtgcgctgctcgtcggcgcgagcttcgccgagtcgctgggattggcgctcgctgtaccggttttgcccattcatcatctcgaagggcacctgctgtccccgctgctcgccgccgatccgccggcgtttccgtttgtcgcgttgctcgtgtccggcggccatacgcagttgatgagggtgacgggagtgggggaatacgccctgctcggagagtcggtggacgatgcggccggagaggcattcgacaagacggcgaagctcctcgggctcggctatccgggcgggccgcaactggccgctttggcagagcgtggacaaacgggacgtttccgcctgccgcgtcctatgctgcgttcgggggatcttgatttcagcttcagcggactcaagacggcagtcctcaacgtcgtgtcggcaccgacttggcgggccgaggacgtggccgacctggcggcggacttccaggcggcagtggtcgaggtgctgtgcgcgaaggcgctgcgtgcgctcgagcagaccgggctggcccgactcgtcgtggccggcggggtgggagccaatcgccacctgcgcgagcgactcgatgcctcgacgcggcgcaagggctgtcgggtgtattacccggaacccgaactgtgcacggataatggcgcgatgatcgcattcgccggcgcactgcgtgccgctgccgggcagcgcggcggcgaaactccggcagtgcgcgtgtttcctcgctggccgttggccgaactgcattcccccgtccagccgtaa

SEQ ID NO: 45853 - protein, 342 aa, Azoarcus sp. EbN1
MKVLGIETSCDETGVAIFDTAAGLLGHCVHTQIALHAAYGGVVPELASRDHIRRLPLLVKQTLDAAGCELSQLDAIAYTAGPGLAGALLVGASFAESLGLALAVPVLPIHHLEGHLLSPLLAADPPAFPFVALLVSGGHTQLMRVTGVGEYALLGESVDDAAGEAFDKTAKLLGLGYPGGPQLAALAERGQTGRFRLPRPMLRSGDLDFSFSGLKTAVLNVVSAPTWRAEDVADLAADFQAAVVEVLCAKALRALEQTGLARLVVAGGVGANRHLRERLDASTRRKGCRVYYPEPELCTDNGAMIAFAGALRAAAGQRGGETPAVRVFPRWPLAELHSPVQP

SEQ ID NO: 45854 - DNA, 1092 bp, Zymomonas mobilis subsp. mobilis ZM4
  CDS (1)..(1092)
atgatagttgctctaccgccccttatggtggcagaaaagccccctatggcattagttttaggtcttgagtcgagttgcgacgaaacagcagtcgcattagttgataatgatggtaatattatttccagtcatttggcaacacaagaaattttacatcgtccttatggcggtgtagttccagaaattgcggcaagagcccatgtcgagcgtctagagccgttagtaagaaaggttttaaatgaatcaggaaaaaatttatcagaaatagatgccattgcagcaactgcggggccaggcttaattggcggcgttatggttggttttgtaacaggaaaagcactttctcttgcctgtaaaaaaccactgattgcgattaaccacctagaaggtcacgccttaacccctcgtttagcagataaaactctgtcttttccttatttattattgcttatctctggtggtcattgccaaattctactggttaaaaatgtgggcgaatatcgccgcctagcaacaacaattgatgacgctggcggtgaagcctttgacaaaacggctaaaattttaggattaggctttcctggaggcccagctgtagaaagagaagctttgaatggcgatccaatggcggttcccttacctaggccattaattaaaagcaaagaacctcatttctcttttgcaggacttaaaaccgcggttttaagagcatatcaatctggcatttataaaagacacgatattgcagcatcattccaacaggctgttattgattgcttagtcaatcgtagcgaaaaagctctcaaaaagattgaaggcgaaaatattcaaatcaacgcctttgttattgctggaggtatggctgcgaatcaagccatccgtcctgcacttacggatctagcagaagcacataatttacctttgattgcaccgccgccttcgctatgcactgataatggcgctatgatcgcatgggcgggcgtcgaacggtttcgtctgggaatgattgataatcttgagagtccagcgcgagcaagatggccgttagaccctcatgctgaaaaagcacgcggtgccggagtaaaagcgtag

SEQ ID NO: 45855 - protein, 363 aa, Zymomonas mobilis subsp. mobilis ZM4
MIVALPPLMVAEKPPMALVLGLESSCDETAVALVDNDGNIISSHLATQEILHRPYGGVVPEIAARAHVERLEPLVRKVLNESGKNLSEIDAIAATAGPGLIGGVMVGFVTGKALSLACKKPLIAINHLEGHALTPRLADKTLSFPYLLLLISGGHCQILLVKNVGEYRRLATTIDDAGGEAFDKTAKILGLGFPGGPAVEREALNGDPMAVPLPRPLIKSKEPHFSFAGLKTAVLRAYQSGIYKRHDIAASFQQAVIDCLVNRSEKALKKIEGENIQINAFVIAGGMAANQAIRPALTDLAEAHNLPLIAPPPSLCTDNGAMIAWAGVERFRLGMIDNLESPARARWPLDPHAEKARGAGVKA

SEQ ID NO: 45856 - DNA, 1098 bp, Silicibacter pomeroyi DSS-3
  CDS (1)..(1098)
atggcgcaaaccctgacgatactcgggctggaaagcagttgcgacgataccgccgccgcagtggtgcgccagaccgaggggcaggcggccgagatcctgtcctcggtcgtgcatggccaggccgatctgcacagcgcctatggcggtgtggtgcccgagatcgccgcccgcgcccatgccgaaaagctggatatctgcgtgcgccaggcgctgaccgaggcgggtgtttccctgaccgatctggatgcggtggcggtgactgccgggccgggcctgatcggcggggtgatgtcgggagtgatgtgcgccaagggaatcgccgccgcgaccggcctgccgctgatcggggtgaaccatctggcgggtcacgcgctgaccccgcgcctgaccgaccagatcgcctatccctatctgatgctgctggtctcgggcgggcattgccaatacctgatcgcgcacgggcccgaacaattttcacggcttggcgggaccatcgacgatgccccgggcgaggcctttgacaagaccgcgcgcctgctgggcctgccccagccgggcggcccctcggtcgagggcgaggcgcggcaaggtgaccccaagcggttccgctttccccggcccttgctggaccggcccgattgcgacctgtccttttcagggctgaagacagcgctgatgcggatgcgcgaccagctggttggcgaaaagggcgggctgacccggcaggatcgcgccgatctgtgcgccgggtttcaggccgccgtggtagatacgcttgcggaaaagacccggcgtgcgctgacgctttatctggatgaggcgccggcggagccggttgtcgcggtcgccggtggggtggcggcaaacgccgccatccgcgcggcgctggagacggtctgcgccgaggcgggtgcccggttcaccgcgccgccgctgcgcctgtgcaccgacaacgcggcgatgatcgcctatgccgggctcgaacgcttccgcagtggcgcccgcgacgggctggacctgaccgcccggccccgctggccacttgatcaaagcagcccggcgatgctgggcagtggcaagaagggcgccaaggcatga

SEQ ID NO: 45857 - protein, 365 aa, Silicibacter pomeroyi DSS-3
MAQTLTILGLESSCDDTAAAVVRQTEGQAAEILSSVVHGQADLHSAYGGVVPEIAARAHAEKLDICVRQALTEAGVSLTDLDAVAVTAGPGLIGGVMSGVMCAKGIAAATGLPLIGVNHLAGHALTPRLTDQIAYPYLMLLVSGGHCQYLIAHGPEQFSRLGGTIDDAPGEAFDKTARLLGLPQPGGPSVEGEARQGDPKRFRFPRPLLDRPDCDLSFSGLKTALMRMRDQLVGEKGGLTRQDRADLCAGFQAAVVDTLAEKTRRALTLYLDEAPAEPVVAVAGGVAANAAIRAALETVCAEAGARFTAPPLRLCTDNAAMIAYAGLERFRSGARDGLDLTARPRWPLDQSSPAMLGSGKKGAKA

SEQ ID NO: 45858 - DNA, 1011 bp, Francisella tularensis subsp. tularensis Schu 4
  CDS (1)..(1011)
atgatagtacttggtattgagagctcctgtgatgaaacaggtttagcgatatatgattattcaaaaaagaaattaattgcagatgaattatatagccaagtcaaattgcataagaagtatggtggtgttgtaccggaacttgcctcgcgtgagcatatcgctaagcttaatcttttagctaagaaaatattcaaagaaactggtcttagctttgaagatattgattgtatagcatataccgcgatgcctggtttagttggtgcattgatggttggagctacatttgccaaaacactaggcttaatccataatattgatacaattgcagttcatcaccttgagggtcatcttttatcaccattattggatcacaatagtaatatagaatatcctttcgtagccttgctagtttctggaggacatacacaactatttgaggtaaaagagtttggtgagtatagtttactaggggaatcaattgatgatgcagcaggtgaggcatttgataagacgactaagcttttaggtatgggttatcctggtggagttgaggtggcaaatttagctgatcaagctactgataagtctaagtatattctaccaaggccgatgaaaaataaacctaatttagattttagctttagtggtttaaaaactgctgtgctaaatacatggtatgatgagcaagatcagtcattagagaataaggcaaatctatgctacgcattccaagatgcggctatagatgtattggtttctaaatgtgctaaagcattacaaaaaactaaaaatacaagattggttatttcaggcggagtcagtgcaaataaactattgcgtcatcagctagatttattggctaaaaatagaggatatcaaatattttttcctccaatgaaatattgtacagataatggtgcaatgattgctctagcgggagcatataggtatgtaaatggttttaaggactctaatttagagattaatgttaaagcaagatcaccactctag

SEQ ID NO: 45859 - protein, 336 aa, Francisella tularensis subsp. tularensis Schu 4
MIVLGIESSCDETGLAIYDYSKKKLIADELYSQVKLHKKYGGVVPELASREHIAKLNLLAKKIFKETGLSFEDIDCIAYTAMPGLVGALMVGATFAKTLGLIHNIDTIAVHHLEGHLLSPLLDHNSNIEYPFVALLVSGGHTQLFEVKEFGEYSLLGESIDDAAGEAFDKTTKLLGMGYPGGVEVANLADQATDKSKYILPRPMKNKPNLDFSFSGLKTAVLNTWYDEQDQSLENKANLCYAFQDAAIDVLVSKCAKALQKTKNTRLVISGGVSANKLLRHQLDLLAKNRGYQIFFPPMKYCTDNGAMIALAGAYRYVNGFKDSNLEINVKARSPL

SEQ ID NO: 45860 - DNA, 1050 bp, Synechococcus elongatus PCC 6301
  CDS (1)..(1050)
atgacaaccgttttagcagttgaaacaagttgtgatgaaacagcggtggcgatcgtaaaggatcgtcacattctcagcagcattgtcagttcgcagattgatctgcaccgtcgctacggcggagttgtgccggaaatggcggcgcggcagcatctagaaaccgtcaatcccgcgatcgcgctcgccctctctgaggcaggccttgattggtcggcgatcgatgggattgcagcgacggttgcacccggtttagtcggcgctctactagttggcactatggctgctaagacactggcgctgctgcacaacaaaccgtttttgggcgttcatcacctcgaaggtcatattttcgcggcctatttacaggagccctccttggagccgccgttcctgtcgctgctggtttcgggcgggcacaccagcctgattcgagtcgatggctgtggccaataccgaacccttgggcaaacccgcgatgatgcggccggtgaagcctttgataaagtcgcccgactgatgggcttgggctatcccggtgggcccgtgatcgatcgcctcgcagccaatggcaatcccaaagcgtttccgctgccagaaggccaaatttccctgccgggtggggggtatcacccctacgactgcagctttagtggtctcaaaacagcaatgttgcggctttgcgatcgcctgcgggcagaatctgaagaccttccgatcgcggatctggcagccagcttccaagcgacagtggctcgcagcctgaccaaacgagcgatcgcagcagccttggatgaggggttaaccacgatcgccgtggggggcggggttgcagctaatcgcggtctgcgcgaacaactgggcaaagcggcagctgagcatggcatcacaacgctctttccgccgctttcgctctgtaccgacaacgctgccatgattgcctgtgcggcagcggctcacctcgcagtgggcgatcgctcggatctaagcctgaccgtgcgatcgcgcttgcccctagaagctgtggctgagctctatcagcggtccgcctag

SEQ ID NO: 45861 - protein, 349 aa, Synechococcus elongatus PCC 6301
MTTVLAVETSCDETAVAIVKDRHILSSIVSSQIDLHRRYGGVVPEMAARQHLETVNPAIALALSEAGLDWSAIDGIAATVAPGLVGALLVGTMAAKTLALLHNKPFLGVHHLEGHIFAAYLQEPSLEPPFLSLLVSGGHTSLIRVDGCGQYRTLGQTRDDAAGEAFDKVARLMGLGYPGGPVIDRLAANGNPKAFPLPEGQISLPGGGYHPYDCSFSGLKTAMLRLCDRLRAESEDLPIADLAASFQATVARSLTKRAIAAALDEGLTTIAVGGGVAANRGLREQLGKAAAEHGITTLFPPLSLCTDNAAMIACAAAAHLAVGDRSDLSLTVRSRLPLEAVAELYQRSA

SEQ ID NO: 45862 - DNA, 1047 bp, Ehrlichia ruminantium str. Welgevonden
  CDS (1)..(1047)
gtggtaagcaatttgctaaaagtagtattagcaatagagacaagctgtgatgaaacagctgttgctgtcgtaagaagtgataagcaagttttatcacataaggtactttcacaaaaagaacatgtagtctatggtggagttgtacctgaaattgcttctcgtgcacatattaactatttatatgacttaacctctcaatctattgaggaatcaggatgcgacttagcagatattgatgctatagcagttacttcaggtccaggtcttattggaggactaattataggtgtaatgatggctaaagctatttccagcgttactaataagcctattattgaggttaatcatctagaagcacatactttgctaatacgaatgtttcatgatattgattttccatttttagtattgatcatatctggcggacattgtcagtttttaatagttcatgatgttggatgttatcaaagattaggttcttctttagatgactcccttggtgaagtatttgataaagtagcaagaatgttaaatttgggatatcctggagggccaattattgaacaaaaatccataatgggtgatagcaaaagtttttttctaccacgtgcattaatcaatcgttttggatgtgatttttctttttccggtattaagacggcagtaagaaatattgttgtaaatcaaaaatatatagataatgattttatatgtaatatttcagcttcttttcaagattgtattggtgatatattggtaaacaggattactaatgctattcatatgtcacaagctataaattgtaagattaataagttagtagtaactggaggtgttgcagctaatcacctattacgtaatcgtatatcaatttgtgtaaaagataataattttgaggtgctatatcctccaactgagttatgtactgataatggaattatggttgggtgggctggtattgaaaatttatctaaaggttatgtttctaatttagattttgctccaaaagcaagatggccgttagaaagcataaaaaggtctagttaa

SEQ ID NO: 45863 - protein, 348 aa, Ehrlichia ruminantium str. Welgevonden
MVSNLLKVVLAIETSCDETAVAVVRSDKQVLSHKVLSQKEHVVYGGVVPEIASRAHINYLYDLTSQSIEESGCDLADIDAIAVTSGPGLIGGLIIGVMMAKAISSVTNKPIIEVNHLEAHTLLIRMFHDIDFPFLVLIISGGHCQFLIVHDVGCYQRLGSSLDDSLGEVFDKVARMLNLGYPGGPIIEQKSIMGDSKSFFLPRALINRFGCDFSFSGIKTAVRNIVVNQKYIDNDFICNISASFQDCIGDILVNRITNAIHMSQAINCKINKLVVTGGVAANHLLRNRISICVKDNNFEVLYPPTELCTDNGIMVGWAGIENLSKGYVSNLDFAPKARWPLESIKRSS

SEQ ID NO: 45864 - DNA, 981 bp, Dehalococcoides ethenogenes 195
  CDS (1)..(981)
atgaagatactcggtatagaaagctcctgtgatgaaaccgctgccgcagtagtggcagacggggtaaatattttatccaaccgggtatcctcgcagatagatatccactcccgttacggcggggtagtccccgaagtggcttcccgccagcacctgctttccatattaccggtcataagtgacgcacttaaggaagcacgtaccggatttgatgaaatttcggccatagctgtaaccaacgggccgggtctggcaggctctctgatagtgggggtaaatgccgccaaagccatagccgccgcccgcggcatacccctggtggcggtaaaccacctgcacggccatatctatgccaactggctttccggcaggataccggaattcccctgcctgtgcctgactgtctcaggcgggcataccgacctggtgctgatgaaagggcatggtcagtatcagctgctgggacgtacccgtgatgatgccgccggagaagcctttgacaaagccgccagaatactgggtttaagctatccaggcgggccggccatagacagagcttcgcaggacggtgaggcagtactggatttgccgcgctcgtggatacccggcagccatgacttcagctttagcggactgaaaaccgccctgctccggctggtggaaaacggcgaagtctgttcggtaaatgacgccgccgccagctttcaaaaagcggtggtagatgtactggtaaccaagaccctgaactgcgcccatgagtacaacgtaaagcagatactgctggcaggcggagtggccgccaataacctgctgcgtaaacagctaagcgaacaatcccctctgccggtttccataccacccataggcttatgtaccgacaatgccgccgtaatagcctcctgcggctatttccgctttatatccggcggtcaggacaggctggacatggatgtactgccggcgctgtccgttgtttcctga

SEQ ID NO: 45865 - protein, 326 aa, Dehalococcoides ethenogenes 195
MKILGIESSCDETAAAVVADGVNILSNRVSSQIDIHSRYGGVVPEVASRQHLLSILPVISDALKEARTGFDEISAIAVTNGPGLAGSLIVGVNAAKAIAAARGIPLVAVNHLHGHIYANWLSGRIPEFPCLCLTVSGGHTDLVLMKGHGQYQLLGRTRDDAAGEAFDKAARILGLSYPGGPAIDRASQDGEAVLDLPRSWIPGSHDFSFSGLKTALLRLVENGEVCSVNDAAASFQKAVVDVLVTKTLNCAHEYNVKQILLAGGVAANNLLRKQLSEQSPLPVSIPPIGLCTDNAAVIASCGYFRFISGGQDRLDMDVLPALSVVS

SEQ ID NO: 45866 - DNA, 1026 bp, Azotobacter vinelandii
  CDS (1)..(1026)
atgctcgttctggggctggaaacctcctgcgacgaaaccggcgtcgcgctttacgacagccggcgcggcctgctggccgacgcgctgttcagccagatcgatctgcaccgcatctatggcggggtagtgcccgaactggcctcgcgggatcacgtcaagcgcatgctgccgctcttgcgccaggtgctcgacgaatccggctgccgcaccggggacatcgacggcatcgcctataccgcaggacccggcctggtcggcgcgctgctggtcggcgcctcctgcgcccaggcgctggcgctggcctggggggttccggcgctcggcgtgcatcacatggagggtcatctgctggcgccgatgctggaggaacagccgccgcagtttcccttcgtcgccctgctggtttccggcggtcatacccaactggtgcgggtcgacggcatcggtcgctaccaggtgctcggcgagtcgctggacgacgccgccggcgaggctttcgataagaccgccaagctgctcggcctcggttatcccggcggtccggagatcgcccgcttggcacaggacggccggcccgggcgtttcgtcttcccgcggccgatgaccgaccggccaggcctggagttcagcttcagcggcctcaagaccttcgccctgaatacctggcagcactgccgggcgagcggcgacgacggcgagcaatcgcgccgcgatatcgctctggccttccagcaggcggtggtggagacgctgatcatcaagtgccggcgggcgctgaagcagaccggcctgaagcgtctggtcatcgccggcggggtgagtgccaaccaggcgttgcgttcggcgctggagcggatgctcggcgaactggatggccaggtgttctacgcccggccgcgcttctgcaccgacaacggcgcgatgatcgcctatgctggctgccagcgtttgctggccggccagcgggatgggccggcgattcaggtccatgcgcgctggccgatggagaccctgccggcgctctga

SEQ ID NO: 45867 - protein, 341 aa, Azotobacter vinelandii
MLVLGLETSCDETGVALYDSRRGLLADALFSQIDLHRIYGGVVPELASRDHVKRMLPLLRQVLDESGCRTGDIDGIAYTAGPGLVGALLVGASCAQALALAWGVPALGVHHMEGHLLAPMLEEQPPQFPFVALLVSGGHTQLVRVDGIGRYQVLGESLDDAAGEAFDKTAKLLGLGYPGGPEIARLAQDGRPGRFVFPRPMTDRPGLEFSFSGLKTFALNTWQHCRASGDDGEQSRRDIALAFQQAVVETLIIKCRRALKQTGLKRLVIAGGVSANQALRSALERMLGELDGQVFYARPRFCTDNGAMIAYAGCQRLLAGQRDGPAIQVHARWPMETLPAL

SEQ ID NO: 45868 - DNA, 909 bp, Desulfitobacterium hafniense DCB-2
  CDS (1)..(909)
ttggcgattgtggatgagcaggctgaactggtctatgaaaacaggaagatcttgactgttccggaaggggagagagggcttgctcaatcggcagccctttttcagcatgttcagaatttgcctcaactggtgaccgcagtgcctcctcaatattgggagaaagtcagcgctttgggagtaagcaccgcgccccgtcctatccaagagtcctatatgccggtttttcttcccggatatggtgtggcagcggccatggcttccgctcggtgcatccctctggttgaaaccagtcatcaggaaggacacttagcggcaggaatagcctccagcaagctgaaagagccacatttcctggccattcatatttcaggaggaaccacggagcttctggaagtccatcatacacagcccgggaaacttgatatacagcttttaggtgggacaacggatcttcatgccggtcaattcgtggatcgggtaggagtccgcttaggactgcccttccctgcgggtaaaagcttggaggagctggcccgtcaggctgatcccggggcagcggcatggcttccttccgctgtcaggggctttgaagtgagcttttccggagtggagaccgctgcccaaagattgatcgatcaaggtaagaatcccgccgacgtggctcgtgccgtggaagggtgtattgtgcgaaccttagggaaattattgcaggcaggaatggaaaagaccacactgtcggagattctcattgtgggtggtgtagcttccaatcaatttatccgccaagagctgaaaaagagactggcccgacatgctaatctccactgggcggagcctgattggagccgggataacgcgattggtgtagccctgcttgcccttgaaaaagtcaggggatgtataatttag

SEQ ID NO: 45869 - protein, 302 aa, Desulfitobacterium hafniense DCB-2
MAIVDEQAELVYENRKILTVPEGERGLAQSAALFQHVQNLPQLVTAVPPQYWEKVSALGVSTAPRPIQESYMPVFLPGYGVAAAMASARCIPLVETSHQEGHLAAGIASSKLKEPHFLAIHISGGTTELLEVHHTQPGKLDIQLLGGTTDLHAGQFVDRVGVRLGLPFPAGKSLEELARQADPGAAAWLPSAVRGFEVSFSGVETAAQRLIDQGKNPADVARAVEGCIVRTLGKLLQAGMEKTTLSEILIVGGVASNQFIRQELKKRLARHANLHWAEPDWSRDNAIGVALLALEKVRGCII

SEQ ID NO: 45870 - DNA, 1044 bp, Bifidobacterium longum DJO10A
  CDS (1)..(1044)
atgagcgaaccggttgtactgggtattgaatccacctgcgacgaaaccgcagccgccatcgtacgcggccgcgaactgctctccaacgtcgtggcctcatccatggaggaacacgcgcgatacggcggcgtgatccccgaaatcgcctcccgtgcgcacgccgaggccttcgtgccatgcgtgtccaaggcgctcgccgacgcgaacatgacgttggcggatgtggacgccatcgccgtgtccgccggtcccggactggccggttgcctggccgtgggcgtgtccggcgccaaggcgctggcctgggctgcgaacaagccgatctacggcatcaaccatgtgatcgggcacatcgccgtcactcagctgcagttcggcccgttccccaaggacacgctggcgctgatcgtctccggcggccacacctcgctgctgcacgtggaagacatgccgcgcaaaatcgacgtggttggtaccacgctggatgacgcggcgggggagtgcttcgacaaggtcgcccgcctgctcggcttcccgtatccgggcggcccgcacatcgaccgccacggccagaacggcgacccgcacgccatcaaggtgccgatgggcctgacacaaggcaaggccggtgccgcgcacccgtatgatttcagtttctccggtgtcaagaccgccgtggctcgctgggtggaaagcgagcaggccgccggccatgagattccggtggacgacgtgtgcgcctccctggccgattccgtggccaccgtgctggcccgtaaggccatgcgcggctgccggcagtacgattccaacacgctgatcgtgggcggcggcttctccgccaactcgcagctgcgcgccaaactgctcgaattcggcgagaagtacggcgtcgacgtccgtatcccgcaaatcaagctctgcaccgacaacggtgccatggtcgccatgctcggcgtgaacctggtcgaagccggcgtggcccccagcgcccccgacttcccgattgactccgccatgcccctgaccaaggtttcgatgtaa

SEQ ID NO: 45871 - protein, 347 aa, Bifidobacterium longum DJO10A
MSEPVVLGIESTCDETAAAIVRGRELLSNVVASSMEEHARYGGVIPEIASRAHAEAFVPCVSKALADANMTLADVDAIAVSAGPGLAGCLAVGVSGAKALAWAANKPIYGINHVIGHIAVTQLQFGPFPKDTLALIVSGGHTSLLHVEDMPRKIDVVGTTLDDAAGECFDKVARLLGFPYPGGPHIDRHGQNGDPHAIKVPMGLTQGKAGAAHPYDFSFSGVKTAVARWVESEQAAGHEIPVDDVCASLADSVATVLARKAMRGCRQYDSNTLIVGGGFSANSQLRAKLLEFGEKYGVDVRIPQIKLCTDNGAMVAMLGVNLVEAGVAPSAPDFPIDSAMPLTKVSM

SEQ ID NO: 45872 - DNA, 1053 bp, Desulfovibrio desulfuricans G20
  CDS (1)..(1053)
atggatgacggccgtctggtcgatgctgtgatgtccacacaggcggagctgcatgcgctttttggcggggttgtgcctgaactggcctcgcgcgagcattaccggctgattgggcgcatgtttgattcgcttatgctccggtgcggacttggcgttcaggatattgatgtgatttctgtagcccgtgggccgggtttgctgggcagcctcctcgtgggggtggggtttgccaaggggctggcattggccggaggccagcggctggtaggtgtcaatcatctgcatgctcacctgctggctgcggggctggagcaccgccttgtttttcctgctctgggagttcttgtttccggcgggcatacccatctttaccggattgattcgcctcgtaatttcacgctggtggggcgcactctggatgatgccgccggtgaggcctttgataaagtggcaaaaatgctcaatctgccgtatcccggcggacgttttattgatgtattggggcatatggctgaccctgatgacagcatgttcccgcggccctacaccgataatgacaatctcgatttcagcttcagcggcttgaagacagcagtttccacgtggttgaaagctcacggtggcacagcgcttgccgctccgccggcggaatccgagctgcaggccatgctgcagaacaatgtgctgccgtcgggtatgcctgcagatatgccgcttgtgtgcgcatcatttaatgcggctgtggctgatacgttgtacattaaagcccgcagggcgttgcagcgtctgggagggcgtgggcaaatccggtctgtggtggtcgcgggcggggtggctgcaaacagccgtgtgcgtacttcaatgcaacgtcttgccgccgaagaaggcctgcacttgcatttgccgtcccctgcattatgtactgacaacggggccatgattgcctacacgggctggttgctggcatccgaagggcttcatcattcgctcgaactggaaactatgccgagagggcgtgttattccggatgattacatttatgatgcccactga

SEQ ID NO: 45873 - protein, 350 aa, Desulfovibrio desulfuricans G20
MDDGRLVDAVMSTQAELHALFGGVVPELASREHYRLIGRMFDSLMLRCGLGVQDIDVISVARGPGLLGSLLVGVGFAKGLALAGGQRLVGVNHLHAHLLAAGLEHRLVFPALGVLVSGGHTHLYRIDSPRNFTLVGRTLDDAAGEAFDKVAKMLNLPYPGGRFIDVLGHMADPDDSMFPRPYTDNDNLDFSFSGLKTAVSTWLKAHGGTALAAPPAESELQAMLQNNVLPSGMPADMPLVCASFNAAVADTLYIKARRALQRLGGRGQIRSVVVAGGVAANSRVRTSMQRLAAEEGLHLHLPSPALCTDNGAMIAYTGWLLASEGLHHSLELETMPRGRVIPDDYIYDAH

SEQ ID NO: 45874 - DNA, 1044 bp, Actinobacillus pleuropneumoniae serovar 1 str. 4074
  CDS (1)..(1044)
atgcgaattttaggtattgaaacttcctgtgacgaaacgggagtggcaatttatgatgaagagaaaggcttggtggcaaaccaactttatagccaaatcgaaatgcatgcggattacggcggcgtcgtgccggagttggcttcacgtgatcatatccgtaaaacgttaccgctgattcaagaagcgttaaaagaagcgaatttaactgcagccgatattgacggtgtggtttataccgcaggtccgggcttagtcggagcgttattagtcggctcgacaatcgcccgttcgctcgcctatgcgtggaacgtgcccgcactcggcgtacaccatatggaaggacatttaatggcgccgatgttggaagataacccgccggcgtttccgtttgtggcgttattgatttcgggcggacatacccagcttgttaaagtggagggcgtagggcagtatgaaattttaggcgaatcgattgacgatgccgccggcgaagcctttgataaaaccggcaaattactcggattggattatccggcgggcgtggcggtttcgcagttggctgagaaaggtacgccgaatcgttttgtatttcctcgtccgatgacggacagaccggggctggatttcagcttttccggcttaaagacctttgccgctaatacgattaatgccaatttagacgagaacgggcggctggacgaacaaactcgctgtgatattgctcacgctttccaacaagcggtggtggacacgattatcatcaaatgtaagcgagctttacagcaaaccggctataaacgtcttgtgatggcgggcggtgtaagtgctaacaagcaattacgtaccgatttggcggagatgatgaaaaatttaaaaggcgaggtttattaccctcgtccgcaattttgtaccgataacggtgcaatgattgcttataccgggtttttacgcttaaaaaacggtgaaaccagcgatttaagcatcagcgtaaaacctcggtggaatatgaccgaacttcctgatatttcaacgacaggcggttag

SEQ ID NO: 45875 - protein, 347 aa, Actinobacillus pleuropneumoniae serovar 1 str. 4074
MRILGIETSCDETGVAIYDEEKGLVANQLYSQIEMHADYGGVVPELASRDHIRKTLPLIQEALKEANLTAADIDGVVYTAGPGLVGALLVGSTIARSLAYAWNVPALGVHHMEGHLMAPMLEDNPPAFPFVALLISGGHTQLVKVEGVGQYEILGESIDDAAGEAFDKTGKLLGLDYPAGVAVSQLAEKGTPNRFVFPRPMTDRPGLDFSFSGLKTFAANTINANLDENGRLDEQTRCDIAHAFQQAVVDTIIIKCKRALQQTGYKRLVMAGGVSANKQLRTDLAEMMKNLKGEVYYPRPQFCTDNGAMIAYTGFLRLKNGETSDLSISVKPRWNMTELPDISTTGG

SEQ ID NO: 45876 - DNA, 1026 bp, Fusobacterium nucleatum subsp. vincentii ATCC 49256
  CDS (1)..(1026)
atgattattttaggtatagaaagttcatgtgatgaaacttctattgcagttgtaaaggatgggaaagagattttatcaaacaatatttcttctcagattgaaattcataaagaatatggtggagttgttccagaaattgcttcaaggcaacatattaaaaatatagccactgtacttgaagaaagtttagaagaagcaaaaatcaccttagatgatgtggattatatagcagtaacttatgccccaggattaattggggctttacttgtgggaatttcatttgcaaaaggtttatcttatgcaaaaaatattcctattattccagttcatcatattaagggacatatgtatgcaaattttttggaacataatgtagaattaccttgtatttctcttgttgtatctggtggacatactaatattatatatatagataaagatcataattttattaatattggagaaaccttagatgatgcagtcggagaaagctgtgataaggttgcaagagttttaggacttggatatcctgggggacctgtaatagataagatgtattataaaggagatagaaattttctaaaaattactaaaccgaaagtttcaagatttgattttagtttttcaggaataaaaacagctattataaattttgataataatatgaaaatgaaaaatcaagaatataagaaagaagatttagcagcttcatttttaggaactgttgtggatattctatgtgataaaactttggatgcagcagttgaaaaagatgtaaaaactattatgcttgcaggtggtgttgcagctaattcacttttaagaagtcaacttacagaaaaagcaactgaaaaaggaattaaagttatatatccaagtatgaaactatgcacggataatgcagctatgatagcagaggcagcatattataagctaaaaaatactaaaaataaagaagattgttttgcaggtttagacttaaatggtgttgcaagtttaatggttagtgatgaaaaagctatataa

SEQ ID NO: 45877 - protein, 341 aa, Fusobacterium nucleatum subsp. vincentii ATCC 49256
MIILGIESSCDETSIAVVKDGKEILSNNISSQIEIHKEYGGVVPEIASRQHIKNIATVLEESLEEAKITLDDVDYIAVTYAPGLIGALLVGISFAKGLSYAKNIPIIPVHHIKGHMYANFLEHNVELPCISLVVSGGHTNIIYIDKDHNFINIGETLDDAVGESCDKVARVLGLGYPGGPVIDKMYYKGDRNFLKITKPKVSRFDFSFSGIKTAIINFDNNMKMKNQEYKKEDLAASFLGTVVDILCDKTLDAAVEKDVKTIMLAGGVAANSLLRSQLTEKATEKGIKVIYPSMKLCTDNAAMIAEAAYYKLKNTKNKEDCFAGLDLNGVASLMVSDEKAI

SEQ ID NO: 45878 - DNA, 1050 bp, Psychrobacter sp. 273-4
  CDS (1)..(1050)
atgaaagtattgggtttagagacttcttgtgatgagaccggtctggcgattttcgatagcgaacagataaatagcgagaataaaggtctgcttgggcaagtattgtattcacaaatagagctgcacgccctttacggcggcgttgtgcctgagcttgccagtcgcgatcatattcgtaagctggtgcctctgtttaatgagctgttggcccaatgtaatatcagcaaagatgagattgatgctatcgcttataccaagggtccggggcttatcggcgcgctgatgacgggtgcattgtttggtcgtagcttggcttatggtctagatattccagcgattggcattcatcatatggaagggcatttattggcaccgctgatgggtctcaatccaccagcgtttccatttgtgtcgctattagtgtccggtggacatacgctactcattgccgcccacggtatcggacaatatgaaatcctcggcgagtccatcgatgatgcggcgggcgaatgttttgataaagccgcaaagatgttgggcttgccctatccgggcggtcctaatattgctaaattggcggaaaacggcaatccgaatgcttatagtctgcccagaccgatgttacatcgcggtttggatttttcttttagcggtatgaaaacggctgtgcacaatcttatcaaggacactgacggttcaggaaatggttctgatagcgacccgcaagtccgcgctgatattgctgccagttttcagcatgctgtcgttgataccttggtgaaaaaatgcgtcaaagcgcttaagcaagtggatatgagccgattggtaatagcaggcggtgtcagtgccaatagccatttgcgtgaaactctcgagcgtgagctggctaaaatcaatgccactgttcattatgcgccgcctgctttatgtactgataatggtgcaatgattgcttatgccggttatgagcgtttgcaagcagggcagtccgatgatttagcggtgagctgtgtgccacgttggccaatgacagaactgcctgcggtttaa

SEQ ID NO: 45879 - protein, 349 aa, Psychrobacter sp. 273-4
MKVLGLETSCDETGLAIFDSEQINSENKGLLGQVLYSQIELHALYGGVVPELASRDHIRKLVPLFNELLAQCNISKDEIDAIAYTKGPGLIGALMTGALFGRSLAYGLDIPAIGIHHMEGHLLAPLMGLNPPAFPFVSLLVSGGHTLLIAAHGIGQYEILGESIDDAAGECFDKAAKMLGLPYPGGPNIAKLAENGNPNAYSLPRPMLHRGLDFSFSGMKTAVHNLIKDTDGSGNGSDSDPQVRADIAASFQHAVVDTLVKKCVKALKQVDMSRLVIAGGVSANSHLRETLERELAKINATVHYAPPALCTDNGAMIAYAGYERLQAGQSDDLAVSCVPRWPMTELPAV

SEQ ID NO: 45880 - DNA, 1044 bp, Dechloromonas aromatica RCB
  CDS (1)..(1044)
atgtgtgccatgctgatcctcggtgtcgaatcctcctgtgacgaaaccggcattgcgctctacgacagcgaagccggcctgttatcccatgccctgtattcccaggtggcaatgcatgccgagtacggcggcgtcgtgccggagctggcatcgcgcgaccatatccgccgggtcgtgccattgttgcgcgaggcgctcgggcaggccggaaaaatgctggatgaggtcgatgccgtcgcttacacacgcggtcccggtctggctggcgccttgctggttggctgcgcctttgccgaagcgctggcgctggccatcgacaaaccgaccattccggtgcatcaccttgaaggccacttgctgtcgccgctgctgtcgagcgatccgccgaccttcccatttgttgcgctgctggtctccggcggacatacccaattgatgaaggtgaccggcgttggcgagtacgaactgctcggcgaaacgctggacgatgcagcgggtgaagctttcgacaagagtgccaagctgctcggcctgccttatcccggtggtgccttactgtcgaagctggccgaacagggaacgcccggggttcatgaattgccgcgaccgatgctgcattccggtgatctgagtttcagcttttccggcttgaagacagcggtcctgacgttggttcgcgagcacgccgatgcaatgagcgacgagttcaaggccaatgcggcgcgggcctttcaggaggccattgtcgaggtgttggtcaagaagtcgctgaaggcgatgaagcagaccggactgaaacagctggtggtggccggtggggtcggcgccaacaagcagttgcgcaccaccttgaacgacgaggccaaacgcaagcgtttccgtgtctattaccccgaactggaattctgtaccgataacggcgcgatgattgcgctggccggttgcttgcgtttgcagtccggctcgccgtccaaggcggcagggagttttgccgtgcagccacgctggccattgatggaaatgtcggtcagcccaacgaagtag

SEQ ID NO: 45881 - protein, 347 aa, Dechloromonas aromatica RCB
MCAMLILGVESSCDETGIALYDSEAGLLSHALYSQVAMHAEYGGVVPELASRDHIRRVVPLLREALGQAGKMLDEVDAVAYTRGPGLAGALLVGCAFAEALALAIDKPTIPVHHLEGHLLSPLLSSDPPTFPFVALLVSGGHTQLMKVTGVGEYELLGETLDDAAGEAFDKSAKLLGLPYPGGALLSKLAEQGTPGVHELPRPMLHSGDLSFSFSGLKTAVLTLVREHADAMSDEFKANAARAFQEAIVEVLVKKSLKAMKQTGLKQLVVAGGVGANKQLRTTLNDEAKRKRFRVYYPELEFCTDNGAMIALAGCLRLQSGSPSKAAGSFAVQPRWPLMEMSVSPTK

SEQ ID NO: 45882 - DNA, 1035 bp, Rickettsia rickettsii
  CDS (1)..(1035)
atgataaaaattttaggtatagaatcaagctgtgatgatacagctgtttctataatcaccgaaaatcgagaaatcttatctaatataatcatttcacaaaatacagaacatgcagtttttggaggggtagtacctgaaattgctgcacgttctcacttatcgcatctagataaagcattaaaaaatgttttaaaagaaagcaacactaaattaacggacattagtacaattgctgcaacttccggtccaggtttaatcggcggtgttatagttggctcaatgtttgcaagatcactaagcagtgctttaaaaaaaccctttattgcaattaatcatttagaaggtcatgctttaaccgcaagactaaccgataatattccttatccttatttactcttgttagcttcaggcggacattgccaatttgtagcagttttaggtctcggaaaatataaaatactaggatctactatagatgatgccgtaggcgaagcctttgacaaggtagccaaaatgctaaacttagcttttcccggaggacctgaaattgagaaaagagcaaaacttggcgatcctcataaatataaatttccaaaacctataattaacagcggtaattgcaatatgtccttttcaggacttaaaactgccgtgcgtactttaataatgaatttaaaggaaattaatgacactgtaatcaatgatatagcagcaagttttcaatttactataggagaaattctaagtagtaaggtacaagatgctattagagcatatgaacaaataacaaataattttgataagaagaatatagttattgccggcggtgtcgctgctaataaatatttacaaaaaatattaagtagctgtgctaaaacatatggttatcggcttatttatccacctatccacttatgcaccgataatgctgcaatgattgcatatgcaggacttgagcgttacaataataagttatttactcctttgaatttctctccaaaagctaggtggagtttagaggatattagtaattaa

SEQ ID NO: 45883 - protein, 344 aa, Rickettsia rickettsii
MIKILGIESSCDDTAVSIITENREILSNIIISQNTEHAVFGGVVPEIAARSHLSHLDKALKNVLKESNTKLTDISTIAATSGPGLIGGVIVGSMFARSLSSALKKPFIAINHLEGHALTARLTDNIPYPYLLLLASGGHCQFVAVLGLGKYKILGSTIDDAVGEAFDKVAKMLNLAFPGGPEIEKRAKLGDPHKYKFPKPIINSGNCNMSFSGLKTAVRTLIMNLKEINDTVINDIAASFQFTIGEILSSKVQDAIRAYEQITNNFDKKNIVIAGGVAANKYLQKILSSCAKTYGYRLIYPPIHLCTDNAAMIAYAGLERYNNKLFTPLNFSPKARWSLEDISN

SEQ ID NO: 45884 - DNA, 1029 bp, Haemophilus influenzae R2846
  CDS (1)..(1029)
atgaaaatcttaggcattgaaacttcctgtgatgaaacgggcgtggcgatttatgatgaagaaaaagggttaattgctaatcaactttatactcaaattgccctgcatgcagattatggtggtgtggttcctgaattagcatcacgcgatcatattcggaaaacagcgcctcttattaaagcggcattagaagaagctaagttaacggcgagcgatattgatggtgttgcttatacgagtggccctgggcttgttggcgcattgcttgttggtgctacgattgcacgttctttagcctatgcttggaatgtgccagcgattggtgttcatcatatggaagggcatttacttgcgccaatgcttgatgaaaattcaccgcactttccttttgttgctctgttggtatcgggtggccacactcaattagtgcgtgtcgatggtgtaggaaaatatgaagtgataggagaatctattgatgatgctgctggcgaagcctttgataaaacagcaaaattacttggattagattatccgggcggtgcggcactttctcgtttagcggaaaaaggcacgccaaatcgctttatatttccacgcccaatgacagatcgtgcaggtcttgattttagtttttctggtttaaaaacatttgccgcgaatacagttaatcaagcgattaaaaacgagggcgaactgacagaacaaactaaagtagatattgcttatgctttccaagatgcggtggtagatactcttgccattaaatgtaagcgtgcattgaaagaaacaggttataaacgtttagtgattgcgggaggggtgagcgcaaataaaaaactccgagaaacgcttgcgcacttaatgcaaaatttaggtggcgaagtgttttatcctcaacctcaattttgtacagataatggcgcaatgattgcttacacaggtttgttacgtttaaaacaaggtcagcatagcgatctggctattgatgttaagcctcgttgggcaatgacggaattactggcaatttag

SEQ ID NO: 45885 - protein, 342 aa, Haemophilus influenzae R2846
MKILGIETSCDETGVAIYDEEKGLIANQLYTQIALHADYGGVVPELASRDHIRKTAPLIKAALEEAKLTASDIDGVAYTSGPGLVGALLVGATIARSLAYAWNVPAIGVHHMEGHLLAPMLDENSPHFPFVALLVSGGHTQLVRVDGVGKYEVIGESIDDAAGEAFDKTAKLLGLDYPGGAALSRLAEKGTPNRFIFPRPMTDRAGLDFSFSGLKTFAANTVNQAIKNEGELTEQTKVDIAYAFQDAVVDTLAIKCKRALKETGYKRLVIAGGVSANKKLRETLAHLMQNLGGEVFYPQPQFCTDNGAMIAYTGLLRLKQGQHSDLAIDVKPRWAMTELLAI

SEQ ID NO: 45886 - DNA, 1041 bp, Anabaena variabilis ATCC 29413
  CDS (1)..(1041)
atgacaactgttttagcaatcgaaactagctgtgatgaaactgccgtggcaattgttaacaatcgtcaagtttgcagcagtatcatagcttcacaaattccagtccaccagcagtacggtggagtggtaccggaggtagcctcacgagcgcacttggaaacgataaatgacgcgatcgctcaagcgatggatcaagctcaactaggttgggataaaatcgatgggatcgctgccacttgtgcgcctggacttgtaggagcgctgttagtggggctaactgctgccaaaactttagcaatcttacacaataaaccatttttgggagttcaccaccttgaaggtcacatctacgcgacttatttgagtgagccaactttagatcccccttttcttagcttactggtttctgggggacatacaagcttaatttacgttaaggaatgtggcaggtatgaaagtctgggtgaaactcgtgatgatgctgctggggaagcttttgacaaagtagctaggctattaaagctgggttatcctggcggcccagtcattgataaactagcgcaaacaggtaattctcaagcctttgcgttgccggaaggaaaagtgtccttagctggtgggggatatcatccctatgatggcagttttagcggcttaaagacggctgtactgcgtttagtgcagcaattagagagggatggagatccattgcctatagaggacatttccgccagcttccaggcgacagtagccaaggcattaaccaagagagcgatcgcctgtgctttagactatggtctagataccattgctgtaggtggtggggtagccgctaacagtggtttgagacagcacctacaagcagcagccaccgcaaataatctccgcgtcctctttccccccctaaaattctgtaccgataacgccgccatgatagcctgcgctgccgccgatcacttatcacggggtcatctatcccccatcaccttaggcgtagagtcacgcctcagtcttagccaagtgatgaagttatatcagtaa

SEQ ID NO: 45887 - protein, 346 aa, Anabaena variabilis ATCC 29413
MTTVLAIETSCDETAVAIVNNRQVCSSIIASQIPVHQQYGGVVPEVASRAHLETINDAIAQAMDQAQLGWDKIDGIAATCAPGLVGALLVGLTAAKTLAILHNKPFLGVHHLEGHIYATYLSEPTLDPPFLSLLVSGGHTSLIYVKECGRYESLGETRDDAAGEAFDKVARLLKLGYPGGPVIDKLAQTGNSQAFALPEGKVSLAGGGYHPYDGSFSGLKTAVLRLVQQLERDGDPLPIEDISASFQATVAKALTKRAIACALDYGLDTIAVGGGVAANSGLRQHLQAAATANNLRVLFPPLKFCTDNAAMIACAAADHLSRGHLSPITLGVESRLSLSQVMKLYQ

SEQ ID NO: 45888 - DNA, 1035 bp, Ralstonia eutropha JMP134
  CDS (1)..(1035)
atgcttgtcctcggcatcgaatcttcctgcgacgaaaccggcctggccctctacgacaccgaggccggcctgctctcgcacgccctgcattcgcagatcgccatgcaccgtgactacggcggcgtagtgcctgaactggcctcgcgcgaccatattcgccgcgtgctgccgctgctgcagcaggtgctcgatgaagcgggccgcagccgcgcggacatcgacgccattgccttcacccagggtcctgggcttgcgggcgcgctgctggtcggcgcttcggtcgccaatgcgctgggcttcgcgctgaacgtgccgatggtgggtgtccaccacctggaaggccacctgctgtcgccgctgcttacgcgcgagccaccgccgttcccgttcatcgccttgctggtttcaggcggccacacgcagctcatggaagtgaaaggcatcggcgactatacgctgctcggcgaaacgctcgacgatgccgccggcgaggccttcgacaagaccgccaagctgctcggcctcggttatccgggcggaccggaagtgtcgcgccttgccgagttcggcacgcccggcgcgttcgacctcccccggccgatgctgcattcgggcaacctcgatttctcgtttgccgggctcaagaccgccgtgctgacgcagacgcgcaagctcgccaacacctgcgagcaggaccgcgccaacctcgcgcgcgcgttcgtcgatgcgatcgtcgatgtgctcgctgcgaagtcctttgccgcgctcaagcagaccggccacaagcggctcgtcgtggccggcggcgtgggcgccaaccggcaattgcgcgaacgcctgaaccagctcggcaagcagcgcaagatcgacgtctattacccggaccttgcgttctgcaccgacaacggcgcgatgattgctctcgctggcgccatgcggttgcaggcagcacctgatctcgcgcagcacagctacggctatggcgtgacgccgcgatgggatctggctgatatccgcctgccttcggccgcctga

SEQ ID NO: 45889 - protein, 344 aa, Ralstonia eutropha JMP134
MLVLGIESSCDETGLALYDTEAGLLSHALHSQIAMHRDYGGVVPELASRDHIRRVLPLLQQVLDEAGRSRADIDAIAFTQGPGLAGALLVGASVANALGFALNVPMVGVHHLEGHLLSPLLTREPPPFPFIALLVSGGHTQLMEVKGIGDYTLLGETLDDAAGEAFDKTAKLLGLGYPGGPEVSRLAEFGTPGAFDLPRPMLHSGNLDFSFAGLKTAVLTQTRKLANTCEQDRANLARAFVDAIVDVLAAKSFAALKQTGHKRLVVAGGVGANRQLRERLNQLGKQRKIDVYYPDLAFCTDNGAMIALAGAMRLQAAPDLAQHSYGYGVTPRWDLADIRLPSAA

SEQ ID NO: 45890 - DNA, 1047 bp, Crocosphaera watsonii WH 8501
  CDS (1)..(1047)
atgaagacgatattagccattgaaacaagttgtgatgaaaccgccgttgctattgttaatgagcagaagatttatagtagtattgttgcctctcaaattgacttacataaacgttatggtggggtggttccggaagaagcatctcgtcaacatcttttaaccattaacccctgtgttgaagaagcgttacaagtagcaaaattaacttggaatgatatcgatggcatcgctgcaacggttgcaccaggattaattggagctttaatggtaggagaaacagcagggaaaaccttagccatgattcatcaaaaaccattcttaggaattcatcatttagaaggtcatatttatgcaacttatctgagtcaacccgattggaaaccgccctttttatgtttattagtatccgggggtcataccagtctcattcatgttaaagattgtggtatttatgaacaactaggaaatactcatgacgatgcagcaggagaagcttttgataaagtagccagattattaaatttaggctatccagggggaccagttattgataaattagccactcgaggcaacccgaaaaggtttagtttaccagagggcaaaatctctttaccccaagggggttatcatccctacgacttcagttttagtggtttaaaaacagcagttttacgattagtagaaaagctcaaacaagaaaattctgaatccttacccattgcagatttagcggcgagttttcaagaaaccgttgcccgttccttaaccaaaaaaactattacttgcgctttagatcataacctcactcatattgccgttggtggtggggtagctgccaatagtggtttgagagatcatcttcaagaagcagcgaagaaacataatttaacagtccatttcccccccctcaaactttgcaccgataacgctgccatgataggttgtgcagcctgtgatcacctgaaaagaggtcatatttcctcctggaatttaggggtacaatctcgtttaccaattactgatgtcatgactttatatttaggttag

SEQ ID NO: 45891 - protein, 348 aa, Crocosphaera watsonii WH 8501
MKTILAIETSCDETAVAIVNEQKIYSSIVASQIDLHKRYGGVVPEEASRQHLLTINPCVEEALQVAKLTWNDIDGIAATVAPGLIGALMVGETAGKTLAMIHQKPFLGIHHLEGHIYATYLSQPDWKPPFLCLLVSGGHTSLIHVKDCGIYEQLGNTHDDAAGEAFDKVARLLNLGYPGGPVIDKLATRGNPKRFSLPEGKISLPQGGYHPYDFSFSGLKTAVLRLVEKLKQENSESLPIADLAASFQETVARSLTKKTITCALDHNLTHIAVGGGVAANSGLRDHLQEAAKKHNLTVHFPPLKLCTDNAAMIGCAACDHLKRGHISSWNLGVQSRLPITDVMTLYLG

SEQ ID NO: 45892 - DNA, 990 bp, Rubrobacter xylanophilus DSM 9941
  CDS (1)..(990)
atgatcctggccatagagacctcctgcgacgacacctgcgcggcggtggtggagccggacggccgccgcgccctctccaacgccgtccacacccagaccgagcacgcccgctacggcggcgtggtgccagaggtcgcctcccgggcgcacctcgagcgcatggacggcgtcgtccgcaaggcgctctccgacgccggcgtctcgctggaccagatagaccgggtggcggtaaccgtccggcccggcctgatcggggcgctcctcgtgggggtggccgcggccaagggggtcgcctacgcccggcggctgccgctcgtcccggtgaaccacctggaggggcacgtggccgccgcctacctggaggcccccgacctcgagccgcccttcgtggccctggtcgcctccggggggcacacggccctgtacgcggtgggcgaggaccgcgggatgcgcctgctcggggagaccctcgacgacgccgcgggcgaggccctggacaagggggcgaggatgctggggctgggctttccgggcggccccgccatctccagggctgccgcgggcggggacccggagcgctacggcttccccgtggccctcaaggggagggacaacctggacttctccttctccggcctgaagaccagcctcctctacaggatccgggagctcggccccgagcgggtgcggcgagagctcccgcacctcgcggcgagctacgaggccgccgtggtggaggcgctcgcccgcaagctgctgcgcgccgccgagctccgggaggccggggccgtcgtggtggccggcggggtggcggccaacgggcggctgcgcgagaggctccggcgcgagtgcgccgggcgggggctcaggctcgtgatcccgcaccccagcctctgcacggacaacgccgccatgatcggggcggccgccgcccacaccccgaagatcccctggccggagtacctctcgctcaacgcccgcagcgtctga

SEQ ID NO: 45893 - protein, 329 aa, Rubrobacter xylanophilus DSM 9941
MILAIETSCDDTCAAVVEPDGRRALSNAVHTQTEHARYGGVVPEVASRAHLERMDGVVRKALSDAGVSLDQIDRVAVTVRPGLIGALLVGVAAAKGVAYARRLPLVPVNHLEGHVAAAYLEAPDLEPPFVALVASGGHTALYAVGEDRGMRLLGETLDDAAGEALDKGARMLGLGFPGGPAISRAAAGGDPERYGFPVALKGRDNLDFSFSGLKTSLLYRIRELGPERVRRELPHLAASYEAAVVEALARKLLRAAELREAGAVVVAGGVAANGRLRERLRRECAGRGLRLVIPHPSLCTDNAAMIGAAAAHTPKIPWPEYLSLNARSV

SEQ ID NO: 45894 - DNA, 1008 bp, Methanococcoides burtonii DSM 6242
  CDS (1)..(1008)
ttgacaactgttctcggtatagaaggcacagcctggaatttaagcgcagcaattgttgacgaagatgatgttatcgcagaggtgactgagacatatcggccaaaaaccggaggtattcatccaagggaagctgcgcaacatcatgctttgcatgcatccgatgttattgaaagattgctgaaggaatatagggataagggtcattcccctgaaaatatcgatgctattgcgttttcgcagggcccgggtttgggggcatgtctgaggacggtcgcgacatctgcaagggcactggcattgtcgctggatattccgcttgtgggtgtgaaccactgtatcggacatgttgagataggacgctggaaaacaccggcagttgatcctgtggtgctgtatgtcagtggtgggaactcgcaggtgcttgctcacagggctggaaagtataggatattcggggaaacccttgatatcggcatagggaatgcccttgataaatttgcaaggggtgcagggctgacccatcccggtggtcccaaggtggaagagtatgccagaaaagctacgaattatgtgaaaatgccatatgttgtaaagggtatggatttctcattttcagggctatccacggctgccacagatgcgctgaaggacaattcccttgaagatgtctgttattctttccaggagaatgcttttgcaatgcttgtggaggttacggagcgtgcactggcccatacaggtaagagcgaagtgcttcttgcaggaggggtgggtgcgaacatgcgacttcgtgaaatgcttgatctcatgtgtgaggacagaggtgcgagcttctatgtgcctgaaagacgtttcatgggtgacaatggtgccatgatagcttatacaggtctgttgatgttcaattcagggaccactttaccgattgaaaattctcatgtggacccgagcttcaggccggatactgtcgatgtgacctggatagctgatgaaaaggaggttctgtga

SEQ ID NO: 45895 - protein, 335 aa, Methanococcoides burtonii DSM 6242
MTTVLGIEGTAWNLSAAIVDEDDVIAEVTETYRPKTGGIHPREAAQHHALHASDVIERLLKEYRDKGHSPENIDAIAFSQGPGLGACLRTVATSARALALSLDIPLVGVNHCIGHVEIGRWKTPAVDPVVLYVSGGNSQVLAHRAGKYRIFGETLDIGIGNALDKFARGAGLTHPGGPKVEEYARKATNYVKMPYVVKGMDFSFSGLSTAATDALKDNSLEDVCYSFQENAFAMLVEVTERALAHTGKSEVLLAGGVGANMRLREMLDLMCEDRGASFYVPERRFMGDNGAMIAYTGLLMFNSGTTLPIENSHVDPSFRPDTVDVTWIADEKEVL

SEQ ID NO: 45896 - DNA, 1095 bp, Rhodobacter sphaeroides 2.4.1
  CDS (1)..(1095)
atgtcccgtccgctcacctttctcggcatcgagagcagctgtgacgacaccgcggcggccgtggtgcgcgcggagggcacgcgggcggagatcctctcttcggtggtggacgggcagacggcgctgcatgcggccttcggcggcgtggtgcccgagatcgcggcccgtgcccatgccgaacggctggacctctgcgtcgaacgcgcgctggaggaggcgggcctcggactgcgcgacctcgacgggatcgcggtgacggcggggccggggctgatcggcggcgttctgtcgggcgtcatgctggccaaggggcttgcggcgggcaccggcctgccgctcgtgggggtgaaccatctggcgggccacgcgctcacgccgcggctgacggacgggctcgccttcccttatctcatgcttctggtgtcgggtgggcattgccagttcctgatcgcgcgtggagcggaagagttttcgcgcctcggaggttccatcgacgatgcgccgggcgaggctttcgacaagacggcgaagctgctgggcctgccgcagccgggcgggccttcggtcgaggccgaggcggcagcgggcgatccgcgccgcttcgcctttccacggccgatgctcgaccggccgggctgcgacatgtccttctcggggctgaagaccgcgcttctgcgggcgcgcgacgggctcgtggccgagaagggcgggctcacgcgggccgaccgggccgacctctgcgcgggctttcaggccgcggtggtcgaggtgctggccgaaaagacccgccgcgcgctggcggtctatgcggccgagggcgcggccgagcccgcgctggccgtggcgggcggggtcgcggccaacgggccgatccgggcggcgctgacccgcgtggccgaggcggcaggcgtgcgcttcctcgccccgccgctccggctctgcaccgacaatgcggcgatgatcgcctgggccgggattgagcggttccgcgccggcggccgcgacgggatggagctgtccgcccgcccgcgctggccgctcgaccgcagcgcgccggcgctgatcggctcgggcaggaagggggccaaggcatga

SEQ ID NO: 45897 - protein, 364 aa, Rhodobacter sphaeroides 2.4.1
MSRPLTFLGIESSCDDTAAAVVRAEGTRAEILSSVVDGQTALHAAFGGVVPEIAARAHAERLDLCVERALEEAGLGLRDLDGIAVTAGPGLIGGVLSGVMLAKGLAAGTGLPLVGVNHLAGHALTPRLTDGLAFPYLMLLVSGGHCQFLIARGAEEFSRLGGSIDDAPGEAFDKTAKLLGLPQPGGPSVEAEAAAGDPRRFAFPRPMLDRPGCDMSFSGLKTALLRARDGLVAEKGGLTRADRADLCAGFQAAVVEVLAEKTRRALAVYAAEGAAEPALAVAGGVAANGPIRAALTRVAEAAGVRFLAPPLRLCTDNAAMIAWAGIERFRAGGRDGMELSARPRWPLDRSAPALIGSGRKGAKA

SEQ ID NO: 45898 - DNA, 1035 bp, Magnetospirillum magnetotacticum MS-1
  CDS (1)..(1035)
ttgggcatcgaaagctcctgtgacgaaaccgccgccgcattggtcaacgaccatcgcgagatcctgggcgaggtggtcttgtcgcaactggacgagcaccgcccctttggcggtgtggtgccggaaatcgccgcgcgctcccatctcacccatctggaccggctggtggccgaggccatgcgccgggccggtgcgggctttgccgatctcgacgcggtggcggccaccggcggccccggcctgatcggcggcgtcatggtgggcgtgatgaccggcaaggccattgcgctggcctcgggcaagccctttctggccatcaaccatctggaaggccatgcgctgacggcgcgtctcacccacgacatcgcctttccctatctgctgctgctggcctcgggcgggcattgccagttgctggcggtggaaggggtgggtcaatacacccgtctcggcaccaccatcgacgacgcggcgggcgaggcctttgacaagctggccaagatggccgcgctcggctatcccggcggtccggcggtggaagccgcggccgccggtggcgatccggcccgctttaccctgccccggcccctgaagggcaagcccggctgtgatttcagcttttcaggcctgaagaatgccgcccgcctgctgatcgaaagcctgccccagccgctttcggcgcaagatcaggccgacgtggcccgcgcctttcaggacgcggtggccgattccatggccgaccgggtgcgccggggcgtgcgcgagatgaagacccgctggcctgctacccgccatctggtggtggcgggcggtgtcgccgccaatacggcgctgcgccagatcctggttcggatcggagccgaaacggggcttgaatttcttgctccgccgctgaagctgtgcaccgacaatgccgccatgatcgcctgggcggggatcgagcgtctgcgcctgggccaatgcgacgatctttccttcgcgccgcgtccgcgctggcccctggatcccaatgcgcgtaagggagccaaggcgtga

SEQ ID NO: 45899 - protein, 344 aa, Magnetospirillum magnetotacticum MS-1
MGIESSCDETAAALVNDHREILGEVVLSQLDEHRPFGGVVPEIAARSHLTHLDRLVAEAMRRAGAGFADLDAVAATGGPGLIGGVMVGVMTGKAIALASGKPFLAINHLEGHALTARLTHDIAFPYLLLLASGGHCQLLAVEGVGQYTRLGTTIDDAAGEAFDKLAKMAALGYPGGPAVEAAAAGGDPARFTLPRPLKGKPGCDFSFSGLKNAARLLIESLPQPLSAQDQADVARAFQDAVADSMADRVRRGVREMKTRWPATRHLVVAGGVAANTALRQILVRIGAETGLEFLAPPLKLCTDNAAMIAWAGIERLRLGQCDDLSFAPRPRWPLDPNARKGAKA

SEQ ID NO: 45900 - DNA, 1053 bp, Ehrlichia canis str. Jake
  CDS (1)..(1053)
atgaagaaatcagtaaaagtagtactagggatagaaacaagttgtgatgagactgctgttgctattgtaaacagtaacaaggaagttttatcacataaaattctttcgcaaaaagaacatgcagaatatggtggagttgttccagaaattgcttctcgtgctcatattaattatttatatgatttaactgttagttgtatagaagagtcgcaactttctttaaataatatagatgctgttgctgttacttctggtccagggcttattggtgggttaatagttggtgtgatgatagctaaaggtattgctagtgttactggtaagcctataattgagattaatcatttagaagctcatgctttaattgttcgcatgttttatgaaattaattttccatttttgttgttgataatatctggtgggcattgtcagtttttaatagtttataatgtaggttgttatcataaattaggttcttctttagatgattctttaggtgaagtgtttgataaagtagcaaaaatgttgaatcttgggtatcctggggggccagttattgagaaaaaatctttgagtggggatagtaaaagctttgttttaccgagagcattgactggccgttgtggatgtgatttttcattttctggtcttaaaactgctgtaaggaatattattatgaatcatgaatatatagataataaattgatatgtgacatttcagcatcttttcaagagtgtgttggtgatatattggtaaatagaattaataatgcaattgcaatgtcaaaagctatagataaaagaattgataaattagtagttactggtggtgttgcagcaaataaattgttacgtgaacgtatgttaagatgtgcttctgataataattttgaaatattttatcctccaagtaagttgtgtactgataatggtattatgatagggtgggctggtattgaaaatttagtgaaagattatgtttcaaatttagattttgctccgaaggcaagatggcctttggaaagtttaaggtctaatataatgaaagagtag

SEQ ID NO: 45901 - protein, 350 aa, Ehrlichia canis str. Jake
MKKSVKVVLGIETSCDETAVAIVNSNKEVLSHKILSQKEHAEYGGVVPEIASRAHINYLYDLTVSCIEESQLSLNNIDAVAVTSGPGLIGGLIVGVMIAKGIASVTGKPIIEINHLEAHALIVRMFYEINFPFLLLIISGGHCQFLIVYNVGCYHKLGSSLDDSLGEVFDKVAKMLNLGYPGGPVIEKKSLSGDSKSFVLPRALTGRCGCDFSFSGLKTAVRNIIMNHEYIDNKLICDISASFQECVGDILVNRINNAIAMSKAIDKRIDKLVVTGGVAANKLLRERMLRCASDNNFEIFYPPSKLCTDNGIMIGWAGIENLVKDYVSNLDFAPKARWPLESLRSNIMKE

SEQ ID NO: 45902 - DNA, 1047 bp, Rubrivivax gelatinosus PM1
  CDS (1)..(1047)
atgctgattctcggcttcgaatcttcctgcgacgaaaccggcgtggcgctggtggcggccgaccatggcgagcgcccgcgactgcttgcccacgccttgcacagccaggtcgccatgcacgaggcctacggcggtgtcgtgcccgaactcgcctcgcgcgatcacatccgtcgggccttgccgctgacgcgacaggtgcttgccgaggcgggccgggcgttggccgatgtcgacgtggtggcctacacgcgcggtcccgggctggctggcgcgctgctggtcggcagcgcggtggcctgcgcgctcgccgcggcgctggaccggccggtgctgggcatccatcatttggagggtcatctgctgtcgcccttcctgtcggtcgatccgccgcagttcccgttcgtggcgctgctggtctcgggcgggcacacgcagctgatgcgggtcgacggtgtgggcgattacgcgttgcttggcgaaacgatcgacgacgcggccggcgaggccttcgacaagtcggccaagttgctcggcctgggctaccccggcggacctgcgcttgcccgccttgcggagttcggtgacccgaccgcctatgcgctgccgcggccgttgctgcaccgggatacgctcgatttttccttcgccggactcaagaccgcggtacgcacccaggttctgaagctcggtgagggcgtctgcgagcagccgcgtgccgacctcgcggctgccacgcaggccgcgatcgtggaggtgctggtgaagaagtcgctcgccgcgctgcgggccaccaggctgcagcggctggtggtggccggtggtgtgggggcgaatcgcagcctgcggtcgcagctcgatgccgcttgcgcgaagcgcggcgtgcgtgtgcactatccggaggtgtcgctgtgcaccgacaacggcgcgatgatcgcgctggccgcggccatgcggctgcaggccggccgcgcgaccgcacgacgcgaccacgcgttcgacgtgcagccgcgctggccgctcgccgcgctggacgtcggggtgccctga

SEQ ID NO: 45903 - protein, 348 aa, Rubrivivax gelatinosus PM1
MLILGFESSCDETGVALVAADHGERPRLLAHALHSQVAMHEAYGGVVPELASRDHIRRALPLTRQVLAEAGRALADVDVVAYTRGPGLAGALLVGSAVACALAAALDRPVLGIHHLEGHLLSPFLSVDPPQFPFVALLVSGGHTQLMRVDGVGDYALLGETIDDAAGEAFDKSAKLLGLGYPGGPALARLAEFGDPTAYALPRPLLHRDTLDFSFAGLKTAVRTQVLKLGEGVCEQPRADLAAATQAAIVEVLVKKSLAALRATRLQRLVVAGGVGANRSLRSQLDAACAKRGVRVHYPEVSLCTDNGAMIALAAAMRLQAGRATARRDHAFDVQPRWPLAALDVGVP

SEQ ID NO: 45904 - DNA, 1089 bp, Rhodospirillum rubrum
  CDS (1)..(1089)
atgagcatgccctttcgcgttctcggaatcgagacaagttgtgacgaaaccgccgccgcggtggtcgaaccggccgccgacgggcgcggtgggcgaattatggccgaagcactcctctcccaggttgaggagcaccgcccctatggcggggtcgtgcccgaaatcgccgcgcgctcacaccttgaccacgtggactccctggtgatccgcgcccttggcgaggccgggctgacggttcacgacatcgacgccgtcgccgccaccggcggacccgggctgatcggcggggtgatcgtcggcgtgatgacggccaaggccatcgcccaggtggcgggcaagccgttcatcgccgtcaaccatctggaaggccacgccctgaccgtgcggatgaccgccggcatcgatttcccctatctgctgcttctggcctcgggcgggcattgccagcttctggcggtcgagggggtggggcgggccaagcgcctgggcaccaccatcgacgacgccgccggcgaggccttcgacaaggtggccaagatgctgggcctgggttatccgggcggaccggcggtggagcgggcggcccggcgcggcgatccccggcgctttcgcctgccgcgccccctgctcgaccgcccgggctgcgacctgtctttctcggggctgaagaccgccgtgcgccagaccgtggaaaagctgccgcccgggccgttgagcgagggcgatatcgccgatctctgcgccagtttccaggccgccgtcgccgactgtctggccgaccgctgccgggtggccgccgggatcttcagcgcccgccatggccgtggccggccgctggtggtggccggcggcgtggcggccaacgccagcttgcgcgccgccctgaccgaggtcgcccgccaagccgatatgaccttcgtcgccccgcccttggcgctgtgcaccgacaacgcggcgatgatcgcctgggtcggcgtcgagcgcctgcgcctggggctggtcgacaccatggacttcaaaccccgcccgcgctggccgctcgaccccgacgcgcccaaggcggccggagccggaggcgtaaaagcttaa

SEQ ID NO: 45905 - protein, 362 aa, Rhodospirillum rubrum
MSMPFRVLGIETSCDETAAAVVEPAADGRGGRIMAEALLSQVEEHRPYGGVVPEIAARSHLDHVDSLVIRALGEAGLTVHDIDAVAATGGPGLIGGVIVGVMTAKAIAQVAGKPFIAVNHLEGHALTVRMTAGIDFPYLLLLASGGHCQLLAVEGVGRAKRLGTTIDDAAGEAFDKVAKMLGLGYPGGPAVERAARRGDPRRFRLPRPLLDRPGCDLSFSGLKTAVRQTVEKLPPGPLSEGDIADLCASFQAAVADCLADRCRVAAGIFSARHGRGRPLVVAGGVAANASLRAALTEVARQADMTFVAPPLALCTDNAAMIAWVGVERLRLGLVDTMDFKPRPRWPLDPDAPKAAGAGGVKA

SEQ ID NO: 45906 - DNA, 1068 bp, Burkholderia fungorum LB400
  CDS (1)..(1068)
atgtcgttgcccgtgcgtccgcccaagcccacccatcacatgctcgttctcggcatcgaaagctcctgcgacgaaaccggtctcgcgctctacgacacagagcgcggcctgctcgcgcacgcgctgcattcgcagattgcgatgcaccgggaatacggcggcgtggtgccggaactggcgtcgcgcgatcacatccggcgcgcgttgccgctgctggaagaggtgatggaacgcgccggcacggctgccggcgacatcgacgcaatcgcctatacgcagggcccgggccttgcgggcgcgctgctggtcggcgcgagcgtcgccaatgcgctggctatggcgtgggacaagccgaccatcggtatccatcatctggaagggcatttgctctcgccgctgctggtggacgaaccgccgccatttccgtttgtcgcgctgctggtgtccggcggccacacgcagttgatgcgcgtgacggacgtgggcgtctacgagacgctcggcgaaacactggacgacgccgccggcgaagccttcgacaaaaccgccaagctgctcggcctcggttatccgggcggcccggaagtctcgcgtatggcggaattcggcacgcccggcgcagtggtgctgccgcgcccgatgctgcattccggcgatctcgatttcagcttcagcggtttgaagaccgctgtgcttacgcacgcgaagaagctcggcggcgcgaatatctgtgagcaggcaaaagccgatctggcacgcggtttcgtcgacgcggcggttgaagtcctggcggccaagtcgctggccgcgctcaagaaaaccggcctcaaccggctggtcgtcgcaggcggcgtcggcgcgaaccggcagctgcgcgaggcgctttccgcagccgcgaagaagcgcaatttctacgtgcactaccctgacttgtcgctgtgcacggataacggcgcgatgatcgcgctggccggcgctttgcggctgcaacgctggccggaccagtcgggcaaggactacgcgttcacggtgaagccgcgctgggatctgacgtcactcgcacgctag

SEQ ID NO: 45907 - protein, 355 aa, Burkholderia fungorum LB400
MSLPVRPPKPTHHMLVLGIESSCDETGLALYDTERGLLAHALHSQIAMHREYGGVVPELASRDHIRRALPLLEEVMERAGTAAGDIDAIAYTQGPGLAGALLVGASVANALAMAWDKPTIGIHHLEGHLLSPLLVDEPPPFPFVALLVSGGHTQLMRVTDVGVYETLGETLDDAAGEAFDKTAKLLGLGYPGGPEVSRMAEFGTPGAVVLPRPMLHSGDLDFSFSGLKTAVLTHAKKLGGANICEQAKADLARGFVDAAVEVLAAKSLAALKKTGLNRLVVAGGVGANRQLREALSAAAKKRNFYVHYPDLSLCTDNGAMIALAGALRLQRWPDQSGKDYAFTVKPRWDLTSLAR

SEQ ID NO: 45908 - DNA, 1017 bp, Enterococcus faecium
  CDS (1)..(1017)
atgaatgaagaattgattctggcgattgaatcaagttgtgatgaaacgagtgtagcggtcgttagaaatggaacagagatcttatctaacatcgttgcttctcaaataaacagtcataaacgttttggtggcgtagtacctgaagtagctagccgccatcacgtagaacaaatcaccttatgcttggaagatgcactggtagaagctggtgtgtcggcagaagatttatcggcagtcgctgtcacttatggaccaggacttgtcggctcgttgctgattggtatttctgcagctaaggcttttgcttgggcacaccaattgccgcttattcctgtaaaccatatggcagggcatatctatgcagcccgtctggttaaaccattccagtttccattgatggcacttcttgttagcggaggacatacagaattagtctatatgcaagaagatggatcatatgaaatcattggggagacaagagatgacgcagcaggagaagcttatgacaaagttggaagagtattaggtctttcttacccaagcggaaaagaaatcgatcagctagctcatcagggaaaagataattaccattttccgcgagcgatgatccatgaagataattatgatttcagttttagcggattaaaaagtgcatttatcaatttggtgcataatgcacaacagcgtggagaagatctagacaaaaatgatttagcagctagctttcaagcaagtgtgatcgatgtattgattactaaaacacttcgagcttgtcaaaattatccagtcaagcaactgattatagctggaggtgtagcggccaatcaagggttgcgtgaaggattgcaggatgctttggcagctaaactccctgaggtagaactagtgattccccctcttcgactttgtggagataatgctgcaatgattggagcagcagcacatgtggaaatgcaaaaaagaaattttgctagctatcagttgaatgctgatccaagcttggttttatctgaataa

SEQ ID NO: 45909 - protein, 338 aa, Enterococcus faecium
MNEELILAIESSCDETSVAVVRNGTEILSNIVASQINSHKRFGGVVPEVASRHHVEQITLCLEDALVEAGVSAEDLSAVAVTYGPGLVGSLLIGISAAKAFAWAHQLPLIPVNHMAGHIYAARLVKPFQFPLMALLVSGGHTELVYMQEDGSYEIIGETRDDAAGEAYDKVGRVLGLSYPSGKEIDQLAHQGKDNYHFPRAMIHEDNYDFSFSGLKSAFINLVHNAQQRGEDLDKNDLAASFQASVIDVLITKTLRACQNYPVKQLIIAGGVAANQGLREGLQDALAAKLPEVELVIPPLRLCGDNAAMIGAAAHVEMQKRNFASYQLNADPSLVLSE

SEQ ID NO: 45910 - DNA, 1062 bp, Magnetococcus sp. MC-1
  CDS (1)..(1062)
atgttacgggttttaggcatagagagcagttgcgacgagaccgccgccgctgtggtggaaggggcagaacatggtcacccccatggggtggtggtgcgctccaatgtggtgtggagccagttggaggtacacgccctctacggcggggtggtgcccgaactggccagccgggcccacatacgccatatacagccggtgattgagcaggctttggctgaggctggggtgcgaccccagcagttggatgccattgcggttacggtggctcccgggttggtgggcgcactgctggtgggggtagcggcggcgcaggggttggcggtggcgctggataagccgctggtgccggtacaccacatggaagggcacctgatgagcccttttctcatggcgggcgtggtacctgccatggagttcccctttgtggccttactggtctccggtgggcacaccctgttgctgcacgcccgtgattttggcgactaccagctgctggggcagacccgtgacgatgcggtgggggaggcgtttgacaagggggcgcgcatgctgggcttggggtatcccggtggtccagaggtcgccgccttggcccagtcgggggatcggcaggcggtggcttttccccgtgtgttgctggaccgcagccaatttgatttctccttttctggcctaaaaaccgccttgcgtacccatcttcttaaattcccgccggagtccggtggtccctctttggccgatgtggccgccagttatcaagaggccattgtggataccctggtgattaaatccttgagcgcctgccgccatgtgggggtgtcgcgtttggtgattgccggtggagtaggggccaatagacgattgcgggaaaaattggccaaacaagctcttaaacagggtgtgcaactctacgctccccccatccacctgtgtactgataatggcgcgatgatcgcctctgccggcgtgtgccgcttggccaggggggatcaagcgcggggggtggtgaatgcggtgccccggctgccgattcatgaactggagaaaatttatggccgttga

SEQ ID NO: 45911 - protein, 353 aa, Magnetococcus sp. MC-1
MLRVLGIESSCDETAAAVVEGAEHGHPHGVVVRSNVVWSQLEVHALYGGVVPELASRAHIRHIQPVIEQALAEAGVRPQQLDAIAVTVAPGLVGALLVGVAAAQGLAVALDKPLVPVHHMEGHLMSPFLMAGVVPAMEFPFVALLVSGGHTLLLHARDFGDYQLLGQTRDDAVGEAFDKGARMLGLGYPGGPEVAALAQSGDRQAVAFPRVLLDRSQFDFSFSGLKTALRTHLLKFPPESGGPSLADVAASYQEAIVDTLVIKSLSACRHVGVSRLVIAGGVGANRRLREKLAKQALKQGVQLYAPPIHLCTDNGAMIASAGVCRLARGDQARGVVNAVPRLPIHELEKIYGR

SEQ ID NO: 45912 - DNA, 1044 bp, Thermobifida fusca
  CDS (1)..(1044)
atgaccactgccagccagccgcccctgatcatggggatcgagagttcctgcgatgagaccggggtcgctttcgtgcgcggctgtgaactgctcgccgacgaggttgcgtccagcgtcgatgagcacgcccggttcggcggcgtggtgcccgaggtcgccagccgcgcccacttggaggcgatgacccccaccgtgcgccgggccgcggaacgcgccggggtgcggctgtccgatgtcgacgcgatcgcggtcaccgtggggcctggcctggcgggggcgctcctggtcggcctgtccgcggccaaagcctacgcgctcgccctggacaaaccgctgtacggggtgaaccacctggtcggccacgtcgccgttgaccagttggagcacgggccgctccccaaaccggtggtggcgctcctcgtgtccggcgggcacacgtccctcctcctcgtccgggacttggcgaccgacgtgcaactgctcggcgagaccgtggacgacgccgcgggcgaggcctacgacaaagtggcgcgcctgctcaacctgccgtatccagggggaccgccgatcgaccgcgccgcccgcgacggggacggcaccgccatccacttcccgcgcggcaaatggggggacggaacctacgacttctcgttctccgggttgaagaccgccgtggcccgctgggtagaggacgcggaacggcaggggaggcccgtgagcgtgcccgacgtggccgcagcgttccaggaggcggtcgcggacgtcctgacccgcaaggcagtggacgcgtgccgggagcacggggtgcgccacctggtgatcagcggcggggtggccgctaattcgcggctgagggcgctcgcggaagagcggtgcgccgcggcagggatcgaagtgcgtgtgccccggcctcggctgtgcaccgacaacggggcgatgatcgcggcactgggcgcggaagtggtggccgcggggctaccgccgtccccgctggacatggccgtggacacttcgctgccggtgagcagcgtgctcgtgaactga

SEQ ID NO: 45913 - protein, 347 aa, Thermobifida fusca
MTTASQPPLIMGIESSCDETGVAFVRGCELLADEVASSVDEHARFGGVVPEVASRAHLEAMTPTVRRAAERAGVRLSDVDAIAVTVGPGLAGALLVGLSAAKAYALALDKPLYGVNHLVGHVAVDQLEHGPLPKPVVALLVSGGHTSLLLVRDLATDVQLLGETVDDAAGEAYDKVARLLNLPYPGGPPIDRAARDGDGTAIHFPRGKWGDGTYDFSFSGLKTAVARWVEDAERQGRPVSVPDVAAAFQEAVADVLTRKAVDACREHGVRHLVISGGVAANSRLRALAEERCAAAGIEVRVPRPRLCTDNGAMIAALGAEVVAAGLPPSPLDMAVDTSLPVSSVLVN

SEQ ID NO: 45914 - DNA, 1638 bp, Methanosarcina barkeri str. fusaro
  CDS (1)..(1638)
ttgaaaaacacgttcatccttggaatcgagggcactgcctggaacctgagtgccgcaatcgtgaccgaaaccgagattattgccgaggtcacagagacctacaaacccacggccggtgggattcaccccagggaagcagcccagcatcatgcaaagtacgcagccagcgttataaaaaggcttcttgcagaggcaaaagagaagggagtcaagccttcagatattgacgggatagctttttcccagggacctgggcttgggccgtgcctgaggacggttgcaacggcagccagaatgctttccatatcccttggcattccacttataggtgtcaaccactgcattgctcatattgagattgggatctggagaactcctgcaatggaccctgtcgttctttacgtaagtggggccaattctcaggttatttcctatatgggagggcggtatagagtctttggggaaaccctggatatagggcttggaaatgcccttgataaatttgcgcgaggggctaacctaccgcatcccggagggccaaagattgaggcatacgcaaaaaacgcaacgaaatatatccatcttccttatgtgataaaaggcatggacctttccttttccggactttccacggcagccagtgaagccttgaaaaaagctcctcttgaagatgtctgctattcttaccaggaaacagcttttgcaatggttgttgaggttgcagagcgagcacttgctcacaccggaaaaaaagaagtcttgctggcaggaggagttggggcgaacacaaggctccgggaaatgttaaatgatatgtgcgaggccagaggcgcgaagttctatgtgcccgaaaaacgctttatgggagataacgggacaatgatcgcatatactgggcttctaatgtataagtccggaaacactctttcccttgaagattctcgcgtaaatcccagttaccggactgatgatgtgaaagtgacctggatccaggaagaaaagatgaaaagagttcctgaaatttcccccggaacttccctcaagcttggggaactgctggacaatggagccgaggctattgtttacctggaagaagggcctgaagggaagaaaatacttgttaaggaaagagtcccgaaggcttacaggtataaagagattgatgagaggatcaggactgaaagaaaccggacagaagcccgcttgatgtctgaatctcgacgccatggggtttctacgccgattatctatgatgtggaagatttcaagcttaagatgcagtatattgatggtgtccccataaaatacctggttactcctgagctttcagaaaaagtaggagaacttgtaggaaaactacacagtgcgggtatagtacatggggaccttacgacctcaaatatcctgcttgcaggcgagagactttatctccttgacttcgggcttgcttattacgacaaaggacttgaggccagaggggtagacgtccatgtacttttccagacttttgagagtacccaccgcaatcatgaggcccttatcgaagctttcaaaaaagggtaccggagaacttttatagattcagaggatgtactcacgcgtgttgaagagataaaaaagagggctcgttatgcataa

SEQ ID NO: 45915 - protein, 545 aa, Methanosarcina barkeri str. fusaro
MKNTFILGIEGTAWNLSAAIVTETEIIAEVTETYKPTAGGIHPREAAQHHAKYAASVIKRLLAEAKEKGVKPSDIDGIAFSQGPGLGPCLRTVATAARMLSISLGIPLIGVNHCIAHIEIGIWRTPAMDPVVLYVSGANSQVISYMGGRYRVFGETLDIGLGNALDKFARGANLPHPGGPKIEAYAKNATKYIHLPYVIKGMDLSFSGLSTAASEALKKAPLEDVCYSYQETAFAMVVEVAERALAHTGKKEVLLAGGVGANTRLREMLNDMCEARGAKFYVPEKRFMGDNGTMIAYTGLLMYKSGNTLSLEDSRVNPSYRTDDVKVTWIQEEKMKRVPEISPGTSLKLGELLDNGAEAIVYLEEGPEGKKILVKERVPKAYRYKEIDERIRTERNRTEARLMSESRRHGVSTPIIYDVEDFKLKMQYIDGVPIKYLVTPELSEKVGELVGKLHSAGIVHGDLTTSNILLAGERLYLLDFGLAYYDKGLEARGVDVHVLFQTFESTHRNHEALIEAFKKGYRRTFIDSEDVLTRVEEIKKRARYA

SEQ ID NO: 45916 - DNA, 1026 bp, Geobacter metallireducens GS-15
  CDS (1)..(1026)
atgctcattctcacgatcgaaacatcctgcgacgaaaccgccgccgcggtggtccgcgacgggcgcacggtgctgtcgagcatcgttgcgacccaggtgaaggaccatgccgtctacgggggggttgtccctgagatagcctcccgcaaacatctggagagcatcccggtcgtcatcgacgaagccctccgcactgcttcggtctccctcgacgccatcgagggggtcgccgtgacccaggggccgggactggccggggcacttctggtgggtaccgccgttgccaaggccatcgcctttgcccgccggctccccatcgttggggtgaaccatatcgaagggcacctctcggccattttcctggagcgagaggtggcgtttcccttcgtggccctcgccgtctcgggggggcatacccatctctaccgggtcgacggcatcggccgctacaccaccctcggccagacccgcgacgacgctgccggcgaggccttcgacaaagtcgcaaagctcttgggactcccctatccgggcggggttgagatcgatcgccttgccgccgagggggacccagccagcatttccttcccccggccgctcctccacgacggcagcttcaacttcagcttcagcggcctcaagactgcggttctgaaccatgtccgcaagaatccggtccaggaggatggccagcaactccgggacctctgcgcttcgtttcaacgggccgcctgcgacgtgctcgtgacgaaaacgctccttgccgcagagaccgaggggatcggtcgggtcgtggttgccggcggcgttgcctgcaatagcgccctgcgccgcgacatggcccgggaggctgctgacaggggaatcgagctcgccatcccttctccttccctctgtagcgataacgccgccatgctggcggttcccggtgatttctacctctcccgggggatcagcgacggcctctccctggacgccttggtaaactggcccttggatacgatccggacgaggctggagtcgtga

SEQ ID NO: 45917 - protein, 341 aa, Geobacter metallireducens GS-15
MLILTIETSCDETAAAVVRDGRTVLSSIVATQVKDHAVYGGVVPEIASRKHLESIPVVIDEALRTASVSLDAIEGVAVTQGPGLAGALLVGTAVAKAIAFARRLPIVGVNHIEGHLSAIFLEREVAFPFVALAVSGGHTHLYRVDGIGRYTTLGQTRDDAAGEAFDKVAKLLGLPYPGGVEIDRLAAEGDPASISFPRPLLHDGSFNFSFSGLKTAVLNHVRKNPVQEDGQQLRDLCASFQRAACDVLVTKTLLAAETEGIGRVVVAGGVACNSALRRDMAREAADRGIELAIPSPSLCSDNAAMLAVPGDFYLSRGISDGLSLDALVNWPLDTIRTRLES

SEQ ID NO: 45918 - DNA, 1053 bp, Novosphingobium aromaticivorans DSM 12444
  CDS (1)..(1053)
atggccctgatccttggcatagaatccagctgcgatgaaaccgccgccgcggtgatcgacagcaatggcgcgtcgctcgaagcgcgcatcgtggcgcagcgcatcgcctcgcaggacgaagcgcatcgaccctatggcggcgtcgttccggaaatcgcggcgcgcgcgcacgccgaagtgctcagtccgatgatcgcggcggtgctggccgacgcggggatcgggctggacgacctcgatgccatcgccgcgaccgcggggccggggttgatcggcggcgtcatggtcggtctcgttaccggaaaggcgctggccatggcggcggacaagccgctgatcgcggtcaaccacctggaaggccacgcgctttcgccgcgactggccgaaccctcgttgcaatacccctacctgttgctgctggtttcgggcggacattgccagatcctggaagttgcgggggtcgggcagttccgccgccttgccaccaccatcgacgatgccttgggcgaagcgttcgacaagaccgcgaagatcctcggcctcggctatccaggtgggccggcggtggaacggatggcgcgagagggcaaccccaaggccgtgcccctgccgcgcccgctggtcggcagcggggagccgcacttctcgttcgcgggcctgaagagcgcggtcatgcgggcgaaggatgccggtgttcacggggacgccgacatcgccgcttcattccagcaggcggcgatagattgcgtgatcgatcgcacccgcatcgcgcttgagactgcttctccgggcatgacggcgctggtggtggctggaggcgtcgccgccaatgccgccttgcgtggcgcgctggaaggactggcggagagccacgggctttcgctggtcgcgccgccgccgaaactgtgcacagacaacgctgcgatgattggttgggctggcgcggaacgccttgctctgggatatgtcgatccacttgacgtggcggcgcgtccgcgctggccgctcgacgagaacgccgcgccggtgcgcggagcaggggtaaaggcatga

SEQ ID NO: 45919 - protein, 350 aa, Novosphingobium aromaticivorans DSM 12444
MALILGIESSCDETAAAVIDSNGASLEARIVAQRIASQDEAHRPYGGVVPEIAARAHAEVLSPMIAAVLADAGIGLDDLDAIAATAGPGLIGGVMVGLVTGKALAMAADKPLIAVNHLEGHALSPRLAEPSLQYPYLLLLVSGGHCQILEVAGVGQFRRLATTIDDALGEAFDKTAKILGLGYPGGPAVERMAREGNPKAVPLPRPLVGSGEPHFSFAGLKSAVMRAKDAGVHGDADIAASFQQAAIDCVIDRTRIALETASPGMTALVVAGGVAANAALRGALEGLAESHGLSLVAPPPKLCTDNAAMIGWAGAERLALGYVDPLDVAARPRWPLDENAAPVRGAGVKA

SEQ ID NO: 45920 - DNA, 1596 bp, Ferroplasma acidarmanus
  CDS (1)..(1596)
atgaaagtcctgcggcttgagggcacagctcatacaataagtgccggtatcgtagacgataatagaatcatttcaaatttctcatcaacttacataccaaaaaatggtggcatacatccaagggaagcagcaatccaccacgccgataacatattgcctgttatgaagaaagcatttgaagaaagtggcctatcacctggccagataaacctggtggctttttccatgggccccggcctagggccgtgtttgagggttgtagctacagctgccagggcattttcaattaaatacgggattccattaataggtgttaaccacccgctcgggcatgtggaaataggaaggaaactttccggggcaaaggatcctataatgttatatatttccggggggaatacacagattatagcacatgaagaaaattcctataaagttcttggggagaccatggatattgggctgggaaatctgctggacaaactggcaagggatgtaggcataccatttccaggaggaccaaaaatagaggaatttgctttaaaaggtgataaattgctggatttgccatactctgtaaagggaatggatacatcattttcaggaatttatacagcagccaggaattatataggaagggaatccatagaaaatatatgctatagcgtccaggaaacaaccttttccatgctggtagaggttttagaacgggcattatattatacagataaaagggagattttacttgcaggaggggtagccagaaacgatcggctccgttcaatggtttcacatatggcaaagtcatctggatatgttgcctatcttacagataaaaaatactgtatggataatggtgccatgatcgcacaggcaggcatgttaatgtatctttctgggcagaggcagcatataatggatacaaaggtaaatcaaagtttcaggatcgatgaagtcaaggttccctggattaactcaaaaaagcctgttataagcaataacaggggggcagaagcattgatttcagaatcgcagttttatggtaggaaaactattacaaaacagcgcgtagaaaaagaatacagaaatcaggaactggatcgcaaaataagaacagaaagaatgaaaaatgagtttaaccttatattcaggctaaaaagcaatggaataaattctcctattctgtatgattttgataagtataatttcacattagttatgcaaaaacttgatggtataacactcaataaactaatcaggtctggggataactatatggcggttataaataaacttggccagataataggagaaatgcataacctattaatctcacatggcgatctgaaccccaacaatatcatggttgttgggccagatatatatctaatagaccccagcatgggaaaatttaattgtgaaatagaagatatggcagatgacattttcctcctcacagaatcatttaaaaatctgtattcaaactatgatgtgcttgaaaatcattttataagttcttataaggaaaaatccaccaattatgtagaaattataaaaacgctggatgaaataaagcaaagaaggagatatgtttga

SEQ ID NO: 45921 - protein, 531 aa, Ferroplasma acidarmanus
MKVLRLEGTAHTISAGIVDDNRIISNFSSTYIPKNGGIHPREAAIHHADNILPVMKKAFEESGLSPGQINLVAFSMGPGLGPCLRVVATAARAFSIKYGIPLIGVNHPLGHVEIGRKLSGAKDPIMLYISGGNTQIIAHEENSYKVLGETMDIGLGNLLDKLARDVGIPFPGGPKIEEFALKGDKLLDLPYSVKGMDTSFSGIYTAARNYIGRESIENICYSVQETTFSMLVEVLERALYYTDKREILLAGGVARNDRLRSMVSHMAKSSGYVAYLTDKKYCMDNGAMIAQAGMLMYLSGQRQHIMDTKVNQSFRIDEVKVPWINSKKPVISNNRGAEALISESQFYGRKTITKQRVEKEYRNQELDRKIRTERMKNEFNLIFRLKSNGINSPILYDFDKYNFTLVMQKLDGITLNKLIRSGDNYMAVINKLGQIIGEMHNLLISHGDLNPNNIMVVGPDIYLIDPSMGKFNCEIEDMADDIFLLTESFKNLYSNYDVLENHFISSYKEKSTNYVEIIKTLDEIKQRRRYV

SEQ ID NO: 45922 - DNA, 1017 bp, Cytophaga hutchinsonii
  CDS (1)..(1017)
atgtcagttacactattagccatcgaatcttcctgtgatgaaacagctgcggctgtcattcaggatgggaatatactatgtaatatagttgcttcacagcgaattcacgagaaatatgggggaattgtaccggaattagcttcacgggcacatcaacaacatatcattccagtggtagcgcaagcactccttgaagcaaatatacaaaaatcagacctgaatgcagtggcttgtacctctggccccggattattaggtgcattattggtgggcgtttctttttccaaagcatttgcgtcggccttacacattccggtgatcaaagtgaatcacatgaaagcgcatattctggcacattttattggtgatgtaaaaccgtcttttccatttatttgtatgactgtgagtggcggacatacgcagctggtgattgtgcggaattatttagaaatggaagtagtaggagaaacccaggacgatgccgttggggaagcattcgacaaaacagctaaattaatgggtcttccttacccaggtggaccattgattgattcgtatgcaaaacaaggaaatccgctggcatttccgttcccaaccgttgatatgcccggatataattattctttcagcggtataaagacagcttttatgtatttcctgaaaaaaaatacagccgttgatccggattttattcagaaaaatttacctgatatttgtgccagtgtacagcatgcgctgatagatgtactgatgcgtaagctgaagcgtttggttgtcgatacgggtatcaacagggtagcgatagcgggcggtgtttcggcaaattccggattgcggaaagccatggaacaaaaacgcgagcaggaaggttgggatgtatacatacccgcgtttgaatattgtaccgataatgcagccatgattgctgtagctggatatcaccagtatttagaaaatgattttgcaggatgggatctgtctccggaaccaagattgcgcataggaggagggttataa

SEQ ID NO: 45923 - protein, 338 aa, Cytophaga hutchinsonii
MSVTLLAIESSCDETAAAVIQDGNILCNIVASQRIHEKYGGIVPELASRAHQQHIIPVVAQALLEANIQKSDLNAVACTSGPGLLGALLVGVSFSKAFASALHIPVIKVNHMKAHILAHFIGDVKPSFPFICMTVSGGHTQLVIVRNYLEMEVVGETQDDAVGEAFDKTAKLMGLPYPGGPLIDSYAKQGNPLAFPFPTVDMPGYNYSFSGIKTAFMYFLKKNTAVDPDFIQKNLPDICASVQHALIDVLMRKLKRLVVDTGINRVAIAGGVSANSGLRKAMEQKREQEGWDVYIPAFEYCTDNAAMIAVAGYHQYLENDFAGWDLSPEPRLRIGGGL

SEQ ID NO: 45924 - DNA, 1020 bp, Clostridium thermocellum ATCC 27405
  CDS (1)..(1020)
atgaaagatattcttatactggggatagagacaagctgtgatgagacttcggcatcggttgtgaaaaacgggcgtcaggtgctttcaaatgttatctcatcccaggttgctcttcatcaaaaatatggaggggtcgtacctgaaattgcttcaagaaagcatgtagagctcattatgccggtaatacatcaaagccttgaggaagccggaatcaaaatagagcaagtggacgccataggtgtgacctacgggcccggtttggtcggagcccttctggtcggactttcggcggctaaagccttggcatttgccctggacaaaccccttatcggagtacatcatattgaagggcacatagctgccaactatatagaacacagcttattggagcccccttttgtatgtctggttgcatccggaggccacagccatattgtgtatgtacaggattacgacaaatttgagataatggggaaaaccagggatgatgctgccggagaggcatttgacaaagttgccagagctgtcgggctgggatatcccggaggtccgataattgataaaaccgcaaagcttggaaacagcaaggcaattgactttccgagggtgcattttggcgaccaaagtttggatttcagctttagcggccttaaaacagctgtactgaattacattaactccatggagcaaaaaggtgaaaagtacagcgtggaggatgtgtgcgccagctttcaggcggctgtggtggatgttcttacggataatctcatttcagccgccaggataaaaggtgttaaaaaagtggctctggccggcggagtggctgcaaattcccttttgcgcagcgagcttgtggaaaaggccaaaggacttggcctggaagtattttatccaaagccggtactttgcaccgacaacgctgcaatgatagcctgtgccgcttattatgaatttctgagggggcatacatccgatgtgtatttaaatgccatacccggattaaagttgggtgagaggtaa

SEQ ID NO: 45925 - protein, 339 aa, Clostridium thermocellum ATCC 27405
MKDILILGIETSCDETSASVVKNGRQVLSNVISSQVALHQKYGGVVPEIASRKHVELIMPVIHQSLEEAGIKIEQVDAIGVTYGPGLVGALLVGLSAAKALAFALDKPLIGVHHIEGHIAANYIEHSLLEPPFVCLVASGGHSHIVYVQDYDKFEIMGKTRDDAAGEAFDKVARAVGLGYPGGPIIDKTAKLGNSKAIDFPRVHFGDQSLDFSFSGLKTAVLNYINSMEQKGEKYSVEDVCASFQAAVVDVLTDNLISAARIKGVKKVALAGGVAANSLLRSELVEKAKGLGLEVFYPKPVLCTDNAAMIACAAYYEFLRGHTSDVYLNAIPGLKLGER

SEQ ID NO: 45926 - DNA, 1026 bp, Microbulbifer degradans 2-40
  CDS (1)..(1026)
atgcgagttttgggaatagaaacctcctgcgatgagaccggtgtagctatttacgatagtgaagcgggcttgcttggccacaccctgtacagtcaggtggcggtgcacgccgagtatggtggcgtggtgccagagttggccagccgcgaccatgtgcgcaagttgttgccgttggtggatggtttgctagataacaccgactcgcgcaataaaatagatgccattgcttatacgtctggcccggggttaattggcgcgcttttggttggcgcgtgttttggccgcggtttggcaatggcgtggggttgccccgcaattggcgtgcaccatatggaaggccatttgctggccccaatgttggaagatgctccgccggccttcccgtttgtggcgctgttggtgtcgggtggccacacccagctggtagaggtgcagggcattggtaaatatgtgctgttgggcgagtcgctagatgatgctgccggtgaagccttcgataaagccgccaaaatgatggatttggattaccccggtgggccaaatattgccaagcttgctaccaagggcgatgtttcgcggtttaagtttccgcgccctatgaccgatcgcccagggttagattttagttttagtggtttgaaaacttttacccttaataccgttgccaagtatgcagatgaaaccggcttgccggacgatcaaacctgcgccgatattgcctgcgcgtttcaagaagccgtggtggacacgttagttattaaatgccgccgcgcgctgcagcaaactaaattaaatactttggttatagccggtggtgtatcggctaatgttcgcctgcgcgagcgtttagaagccgctttggcaaaaattaattcacaggtttactatgctcgcccagagttttgcaccgataacggcgcaatgattgcctacgccggttgccagcgtttgcttgcggggcaggtagagccgttagctattaacgtttcgccgcgttgggcgctagataccttgcctgctatttag

SEQ ID NO: 45927 - protein, 341 aa, Microbulbifer degradans 2-40
MRVLGIETSCDETGVAIYDSEAGLLGHTLYSQVAVHAEYGGVVPELASRDHVRKLLPLVDGLLDNTDSRNKIDAIAYTSGPGLIGALLVGACFGRGLAMAWGCPAIGVHHMEGHLLAPMLEDAPPAFPFVALLVSGGHTQLVEVQGIGKYVLLGESLDDAAGEAFDKAAKMMDLDYPGGPNIAKLATKGDVSRFKFPRPMTDRPGLDFSFSGLKTFTLNTVAKYADETGLPDDQTCADIACAFQEAVVDTLVIKCRRALQQTKLNTLVIAGGVSANVRLRERLEAALAKINSQVYYARPEFCTDNGAMIAYAGCQRLLAGQVEPLAINVSPRWALDTLPAI

SEQ ID NO: 45928 - DNA, 1026 bp, Oenococcus oeni PSU-1
  CDS (1)..(1026)
atgaatgagaaaacagatgatataatattagcctttgaatcttcagccgatgaaacgagtgcggcagttgttaaaaacggtaatacaattctcagcaatgttgtcgccactcaaattgccagccaccaaaggtttggtggaatcgttcccgaagttgccagccgccatcatctagaatggatcaatcgcgtaacggaagaagctttgacaaaagccggtattaatgatcctgaacggcaattgtccgcggtggcagcaacttacggtcctggtttagttggatctttattggttggtctgatggcagggaaaacatttgctatggtccatcatttaccttttattgccgttaaccatttagccgggcacatcagtgcagccaactttgtcaaagcaacggtttatccggcattggcaattatggtttccggaggtcatacggaattactttggatggaaaaagagaatacttttcaaatcatcggtacaacgcttgatgatgctgccggcgaagcatttgataaagttggtcggattcttggccttaaatatccagctggcaaagaaattcaagaaatggctggtcacggtaaggctgttattaaatttccaattgcacataccgaagacgattttgatttttctttttccggtttgaaatcatctgtattaaactacgttcaccatcacgaacaggtctcagaagaattcaataggaacgatgttgctgcaagttttcaaaaagcagtcgttgaagcaattaccgaaaagagtagattggcaattgaaaagtttcaaccaaaggagctattgctcggtggcggcgttgctgccaacttggctttacgaactgcttttgaaaatttatcgaaagaatataaaattgaacttacggaagcaccgattaaattatccggtgataatgcagcaatgatcggtgcagctgcttatcttaattacaaacagagattatttgcaccacttgatttgaatgttgatccatctttaaattttgcaagaatgtga

SEQ ID NO: 45929 - protein, 341 aa, Oenococcus oeni PSU-1
MNEKTDDIILAFESSADETSAAVVKNGNTILSNVVATQIASHQRFGGIVPEVASRHHLEWINRVTEEALTKAGINDPERQLSAVAATYGPGLVGSLLVGLMAGKTFAMVHHLPFIAVNHLAGHISAANFVKATVYPALAIMVSGGHTELLWMEKENTFQIIGTTLDDAAGEAFDKVGRILGLKYPAGKEIQEMAGHGKAVIKFPIAHTEDDFDFSFSGLKSSVLNYVHHHEQVSEEFNRNDVAASFQKAVVEAITEKSRLAIEKFQPKELLLGGGVAANLALRTAFENLSKEYKIELTEAPIKLSGDNAAMIGAAAYLNYKQRLFAPLDLNVDPSLNFARM

SEQ ID NO: 45930 - DNA, 1038 bp, Pediococcus pentosaceus ATCC 25745
  CDS (1)..(1038)
atggatcaaactagtttaattttagcaatcgaatcaagttgtgatgaaactagtgttgcagttattaaaaatggtgacattattttatctaacataattgcaacacaaattaatagccatcagcgctttggcggggtggttccggaagttgccagtcgccatcatatcgagcaaattaccatctgcattgaacaagccttaaagcaagctgaagtacgtaaagaggacctcgatgctgtagcagttacgtatggacccggattagttggggcacttttagtgggcgtttcagctgctaaagcttttgcttttgcaaatgaattaccattaatcccagttaatcacatgattggacatatctacgctgcacgttttgtaaaacccattgtttttccagccttagctctccttgtttcggggggtcatacagaactagtatatatgccaaccgaaaatgaatttaaaattatcggtgagactcgtgatgatgcagccggtgaagcctatgataaagtggggcgcgtaatgggtttgaagtatccagcgggtaaagcaatcgacgaacttgctcaccaaggcgaagacatcttcaagttcccacgagcaatggaacacgaagataattttgattttagtttcagtggtttgaagagtgcttttattaatacagtgcatcatgcagatcaaattaatgaagaacttagtaaaaaagatttagcagcaagcttccaacaaagcgtgatagatgttatcacggctaaaacggttcgggcttgcgagcagttagaaataaaacaattaattttagctggaggagttgcagctaaccgtggtttacgggatactttagataaagaacttggcgaaaaatttaatcatttagatttcgttaaggcacctttggatctttgtggtgataatggagcaatgattggtgctgctggtgaaatgttaatgcgacaccaagtttttgctgatatgacgttaaatgctgatccaagtttagaatttgattgggaaccagaagcaattaagtaa

SEQ ID NO: 45931 - protein, 345 aa, Pediococcus pentosaceus ATCC 25745
MDQTSLILAIESSCDETSVAVIKNGDIILSNIIATQINSHQRFGGVVPEVASRHHIEQITICIEQALKQAEVRKEDLDAVAVTYGPGLVGALLVGVSAAKAFAFANELPLIPVNHMIGHIYAARFVKPIVFPALALLVSGGHTELVYMPTENEFKIIGETRDDAAGEAYDKVGRVMGLKYPAGKAIDELAHQGEDIFKFPRAMEHEDNFDFSFSGLKSAFINTVHHADQINEELSKKDLAASFQQSVIDVITAKTVRACEQLEIKQLILAGGVAANRGLRDTLDKELGEKFNHLDFVKAPLDLCGDNGAMIGAAGEMLMRHQVFADMTLNADPSLEFDWEPEAIK

SEQ ID NO: 45932 - DNA, 978 bp, Trichodesmium erythraeum IMS101
  CDS (1)..(978)
atgacaacggttttagctatagaaacaagttgtgatgaaacatctgtggcaattgttaaaaatcgtcaagttttaagtaacattgtgaagtcacaaattaatatccatagcttttatggaggagtagttccagaggtagcttcacgacaacatttagaaataattaatcaggcgatcgctcaagctttcagagaagcaaatttagactggccagacattgatggtattggagctacttgcgcccctggtctagttggcgctctgttagttggcctgacggcggccaaaaccttagctattgtccatgaaaagccctttgtgggagtccatcacttagaaggtcatatttatgcaacctacctaagccaacccgagttagtaccaccttttctttgtttgttagtttctggaggtcataccagtttgatttatgtcaaaaattgtggggaatatgaaactttagggcaaacaagagatgatgcagcaggagaagcttttgacaaagtagctagattattaaaacttggctatcccggtggacctgtaattgataaattagctgcagagggtaataaattagcattttctctccctgaagggaaaatttctttgcctggaggaggctatcatccttatgattttagtttcagtggactcaaaactgcagtattgcgattagtccagaaaatagaacaagaaggtaatgaattattatcagggtcttcagtaactaaagacattgcagccagctttcaagaaactgtagcaaaagggctaacaaaaagagctatcgcttgtgcattagactatagcttaaacacaattgctattggcggtggtgtagcagctaatagtagtttgcgacagcacttaagtagagcagtagaaagtcataacttgcaagtactatttccctcactcagattttgtacggataatgcagccatgataggttgtgtgcggctcgttggccactaa

SEQ ID NO: 45933 - protein, 325 aa, Trichodesmium erythraeum IMS101
MTTVLAIETSCDETSVAIVKNRQVLSNIVKSQINIHSFYGGVVPEVASRQHLEIINQAIAQAFREANLDWPDIDGIGATCAPGLVGALLVGLTAAKTLAIVHEKPFVGVHHLEGHIYATYLSQPELVPPFLCLLVSGGHTSLIYVKNCGEYETLGQTRDDAAGEAFDKVARLLKLGYPGGPVIDKLAAEGNKLAFSLPEGKISLPGGGYHPYDFSFSGLKTAVLRLVQKIEQEGNELLSGSSVTKDIAASFQETVAKGLTKRAIACALDYSLNTIAIGGGVAANSSLRQHLSRAVESHNLQVLFPSLRFCTDNAAMIGCVRLVGH

SEQ ID NO: 45934 - DNA, 1029 bp, Moorella thermoacetica ATCC 39073
  CDS (1)..(1029)
atggtaaaggaattggcgacagaaacgaatatcctggccatcgagagttcctgtgatgagacggcggcggccattgtcagcgacggcaccagggtccgggccaacatcatcgcctcccagatcgccgttcaccgccgctttggcggcgtggtgccggaaatagcttcccgccaccatatggagaatatagtaccggtggtatcggaggccctggctacagccggcctggcctttagcgatgtggacgccgtggcggtgacctatggtcccggactggtaggggccctgctggtgggtgtcgcttacgccaagagcctggcctacgccctgggtaagcccctcatcggtgtccaccacctcctggggcatatctatgccggttttctggcctaccctggcctgcccttgccggcggtctccctggtggtctcgggcgggcataccaacctggtctacctggaggatcacaccacccgtcgtatcctggggtcaacccgggatgacgccgccggggaagccttcgacaaggtggccagggtcctggggttgccctatccgggcgggccggagctggaaaaactggcccgggaaggcaatccccgggccattcctttcccccgggcctggctggaggaaaacagccttgatttcagctttagcggcctgaaatctgcggtcatcaactacctgcaccacgcccgccaggtgggccaggaggttaaccgggccgacgtggctgccagtttccaggcggcggtggccgaggtcctggtgaccaagaccctgctggcggctaccagctaccgggccaggtctatccttctcgccggtggggtggcggccaattcggtcctgcgccgggaacttcgttcagccggggagcaggcgggcctcccggtcttttttccaccgcgggaactctgcaccgacaacgcggccatgatcggctgtgccgcttattaccagtacctgcgccgggattttgcccctttaagcctcaacgctatccccgatttaccccttaattga

SEQ ID NO: 45935 - protein, 342 aa, Moorella thermoacetica ATCC 39073
MVKELATETNILAIESSCDETAAAIVSDGTRVRANIIASQIAVHRRFGGVVPEIASRHHMENIVPVVSEALATAGLAFSDVDAVAVTYGPGLVGALLVGVAYAKSLAYALGKPLIGVHHLLGHIYAGFLAYPGLPLPAVSLVVSGGHTNLVYLEDHTTRRILGSTRDDAAGEAFDKVARVLGLPYPGGPELEKLAREGNPRAIPFPRAWLEENSLDFSFSGLKSAVINYLHHARQVGQEVNRADVAASFQAAVAEVLVTKTLLAATSYRARSILLAGGVAANSVLRRELRSAGEQAGLPVFFPPRELCTDNAAMIGCAAYYQYLRRDFAPLSLNAIPDLPLN

SEQ ID NO: 45936 - DNA, 1020 bp, Thiobacillus denitrificans ATCC 25259
  CDS (1)..(1020)
atgctcggtatcgaatcttcctgcgacgaaaccggtgtcgcgctgtacgacagcgcagagggcctcgtggcgcacgccttacattcgcagatcgcgatgcacaacgcgtacggcggtgtcgtgcccgagctcgcctcgcgtgaccatattcgacggattctgccgctgacccgccaggtgttcgaggaaagcggccgcctgctttccgaactcggcggcgtcgccttcacgcaggggccaggcctggccggtgcgctcctcgtcggcgctggaatgggccgggcgttggcgtttgccctccgcgtgccggcgatcggcgtccatcatctcgaggggcatctgttgtcgccgctcatttccgatacgccgccggcgttcccgttcgtcgccttgctggtatcgggtggccacacccaactgatgctcgtttcggcggtggggcaatacacgctccttggcgagacgctcgacgacgccgcgggcgaagccttcgacaagacggcgcaattgctcgggctcggatacccggggggaccggctttgtcgcgcctcgcggcggcgggcgacgcaacgcgcttcgcgctgccgcggccgatgctcaattcgggggacttcgatttcagcttcagcggcttgaagaccgcagtgctgacgctcgtgcgcaaacagggcctgggacaggcggccgacatcgccgctgcgttcgaagccgccgcggtcgatgtgctggtcggcaaaagtcttgcggcgtgtcggcacgccgcggcgaaccgtctcgtcgtcgccggcggcgtcggcgccaacgcgcggctgcgcgagcggcttaccgccgagggcggccgcgccggcgtcagcgtgttctatccgtcgctcgaattctgcaccgacaacggcgcaatgatcgcgttcgccggggctcagcgcctggcatccgtggcagatcgtgtggcgcgcgcgtcagacctcgacttcgcggtcaagccgcgctgggcactggcttcgcttggcccggtcgagtga

SEQ ID NO: 45937 - protein, 339 aa, Thiobacillus denitrificans ATCC 25259
MLGIESSCDETGVALYDSAEGLVAHALHSQIAMHNAYGGVVPELASRDHIRRILPLTRQVFEESGRLLSELGGVAFTQGPGLAGALLVGAGMGRALAFALRVPAIGVHHLEGHLLSPLISDTPPAFPFVALLVSGGHTQLMLVSAVGQYTLLGETLDDAAGEAFDKTAQLLGLGYPGGPALSRLAAAGDATRFALPRPMLNSGDFDFSFSGLKTAVLTLVRKQGLGQAADIAAAFEAAAVDVLVGKSLAACRHAAANRLVVAGGVGANARLRERLTAEGGRAGVSVFYPSLEFCTDNGAMIAFAGAQRLASVADRVARASDLDFAVKPRWALASLGPVE

SEQ ID NO: 45938 - DNA, 1098 bp, Silicibacter sp. TM1040
  CDS (1)..(1098)
atgactcagacgctcacacttcttggactggaaagcagttgcgacgacacagcagccgccgttgtacgacagacgacaggcgccaaggcggaaatcctgtcgtcgatcgtgttcggccagaccgagcttcacagcgcgtatggcggcgtggtgcccgagatcgccgcgcgcgcccatgctgaaaaactcgacagttgcgtgcgcgacgctctcgccgaggccggcctcaccctaggcgacctggatgccatcgccgtcaccgcaggcccagggctgatcgggggcgtgatgtctggcgtgatgtgcgcaaaagggatctctgctgccaccggactgccactgatcggagtgaatcaccttgccgggcatgctctgacgccgcgcctgactgacgatatcacctatccctacttgatgctgctggtgtcaggtggccattgccaatatctgatcgcacgcgggccagagacgttctcgcgccttggcggcacaatagacgatgcacccggcgaagcctttgacaagaccgcgcgacttcttgggttgccacaacccggaggaccgtctgtacaggcggaggcagagcatggcgatccggagcggttccgctttccacgccctctgcttgatcgccctgattgcaacctgtctttttcggggttgaaaaccgccttgatgcgaatgcgggaccagatcatcgcagaaaagggaggcctgacacgtcaggatcgcgccgatctctgtgctggttttcaggcggcaatcgttgacacacttgtggaaaaaacccgtcgcgccctccggctctatctcgaggataagccccagcacccaacgttggccgtggccggaggtgtcgctgccaatactgaaatccggaacggattgatggctctatgctttgagttagagactgattttctcgcaccccctttggcgctttgcaccgataacgcagcgatgatcgcctatgcaggactggagcgctacaaaaccggagcgcgtgatggcatgtcgctttcggcacgtccgcgctggccgctggataaaaccagcccagcgctgatcggcagcggcaagaaaggggccaaggcatga

SEQ ID NO: 45939 - protein, 365 aa, Silicibacter sp. TM1040
MTQTLTLLGLESSCDDTAAAVVRQTTGAKAEILSSIVFGQTELHSAYGGVVPEIAARAHAEKLDSCVRDALAEAGLTLGDLDAIAVTAGPGLIGGVMSGVMCAKGISAATGLPLIGVNHLAGHALTPRLTDDITYPYLMLLVSGGHCQYLIARGPETFSRLGGTIDDAPGEAFDKTARLLGLPQPGGPSVQAEAEHGDPERFRFPRPLLDRPDCNLSFSGLKTALMRMRDQIIAEKGGLTRQDRADLCAGFQAAIVDTLVEKTRRALRLYLEDKPQHPTLAVAGGVAANTEIRNGLMALCFELETDFLAPPLALCTDNAAMIAYAGLERYKTGARDGMSLSARPRWPLDKTSPALIGSGKKGAKA

SEQ ID NO: 45940 - DNA, 1047 bp, Lactobacillus gasseri
  CDS (1)..(1047)
ttgacaaaaaaagatattcgaattttagcatttgaaagctcatgtgatgaaacttctaccgccgtaattaaaaatgggcgtgaaatcgaaagcttaattgtggctactcaaattaaaagtcaccaacgttttggtggggtagtgccagaagtagcaagccgtcaccatattgaagtaattacgcaaattactaaggaagctttagctgaagcaaacgctacttgggatgatattgatgcaattgctgttacctatggaccaggcctagttggagctttgttaattggggttagtgccgcaaaagcagcttcaatggcaactggaattccattgattggcgttgatcacattatgggccacattatggcagcgcaattaaaggatgaaattgaatatccagcacttgccttgcaagtttctggtggtcatactgaaattgtcttgatgaaagatccgatccactttgagattgtgggcgatacaagagacgatgcagctggtgaagcttatgacaagattggtcgtgttttaggagttaattatccagcaggtaagacgattgatgagtgggcacataaaggtaaagatactttccacttcccacgtgcaatgatggaagatgatgattatgacttttcattatcaggattaaagagtgcctttatcaacacttgccaccatgcagatcaaattcatgaaaagcttgataagtatgacttagctgccagttttcaagcatcagttgttgatgtgttaagccacaagacaattagagcgatcaaagaatataagcccaagacattcatcttaggcggcggtgtcgccgcgaaccacggtttacgtgatagattagcagaagagattgaaaagttgcctgctgatattaagccaaaggtgattttaccggacttgaaactttgcggagacaatgcggcaatgattggagcagctgcatataacttgtacaaggctggtaagtttagtgatgagaatttgaatgcagatccatcacttgagttgccatatgcggatagtatgctgaaatag

SEQ ID NO: 45941 - protein, 348 aa, Lactobacillus gasseri
MTKKDIRILAFESSCDETSTAVIKNGREIESLIVATQIKSHQRFGGVVPEVASRHHIEVITQITKEALAEANATWDDIDAIAVTYGPGLVGALLIGVSAAKAASMATGIPLIGVDHIMGHIMAAQLKDEIEYPALALQVSGGHTEIVLMKDPIHFEIVGDTRDDAAGEAYDKIGRVLGVNYPAGKTIDEWAHKGKDTFHFPRAMMEDDDYDFSLSGLKSAFINTCHHADQIHEKLDKYDLAASFQASVVDVLSHKTIRAIKEYKPKTFILGGGVAANHGLRDRLAEEIEKLPADIKPKVILPDLKLCGDNAAMIGAAAYNLYKAGKFSDENLNADPSLELPYADSMLK

SEQ ID NO: 45942 - DNA, 1017 bp, Leuconostoc mesenteroides subsp. mesenteroides ATCC 8293
  CDS (1)..(1017)
ttgactaaaataatttcctttgaatcaagtgcggatgaaacaagtgtcgccattgttgaagacggtcacattgtgctaagcaacagtgtggctacccaaattaattcacatcaacgctttggtggtattgttcctgaagtggccagtagacatcatattgaatggattactcgggtactaaatgatgctttaaacacggctcatgtagaacccaaagcgcttgatgcggttgctgtgacatatgggccgggactagtcggctctttattagttggtttaatgggggcgaaaacatttgctctggcgcatggtttaccagttattccagttaatcacttagcaggtcatattgcggcggcaaattttaacaagccaattaaatatccagcgatggcattaatggtttctggtggacatactgaacttgtattgatgcgtgaagaaaaccaatttgaagtcattggcgaaacacgtgatgatgcagctggagaaagctttgataaagttgggcggctattaaatttgccgtatcctgctgggaagacaattgatgagatggctcatagaggccaaccaaccattaaatttccaactgccatggcacatgaagataactatgattttagtttttctggtttgaagagtgcggtaattaattatgtgcatcacgccaatcaaaaagaggaaacaatcaatcagaatgatttggcgactagctttcaaaatgctgttgttgatgcattaattggtcgaacaaaacgagcattagaaaattttcctgttaaaagttttgtattagctggtggtgtcgccgcaaattctcaattacgtgaagaattgactatgctattaaacgattttccaaagacagaatttatccctgttccgatgcagtatacaggggataatgcagcaatgattggtgctgcgggttattggaattacaagaaaaatatttttgctgatttagatttaaacacggatccgggattggattttgaattgttacaatcctga

SEQ ID NO: 45943 - protein, 338 aa, Leuconostoc mesenteroides subsp. mesenteroides ATCC 8293
MTKIISFESSADETSVAIVEDGHIVLSNSVATQINSHQRFGGIVPEVASRHHIEWITRVLNDALNTAHVEPKALDAVAVTYGPGLVGSLLVGLMGAKTFALAHGLPVIPVNHLAGHIAAANFNKPIKYPAMALMVSGGHTELVLMREENQFEVIGETRDDAAGESFDKVGRLLNLPYPAGKTIDEMAHRGQPTIKFPTAMAHEDNYDFSFSGLKSAVINYVHHANQKEETINQNDLATSFQNAVVDALIGRTKRALENFPVKSFVLAGGVAANSQLREELTMLLNDFPKTEFIPVPMQYTGDNAAMIGAAGYWNYKKNIFADLDLNTDPGLDFELLQS

SEQ ID NO: 45944 - DNA, 1008 bp, Exiguobacterium sp. 255-15
  CDS (1)..(1008)
atgacacagccgttgatattagcgattgaatcaagttgtgacgagacagctgcggctgtcgtccgcggagggacagacgtcttatcgaacgtcgtatcctctcaaattgaaagccacaaacgttttggaggagtagttccggaagtcgcgtcccgtcatcacgtggaacggatcacgtatgtcatcgatgacgcgttaacggaagccggtgtcagaatcgatgagatcgatgcgattgccgtgacggaaggtccgggacttgtcggagcgttactcgtcggtgtcagtgcggcaaaagcattggcatttgcccacggtaagccacttcttggtgtccaccacatcgccggtcacatctatgccaaccgtttggaacaagaacttcgctttccactcgtctgtttgattgcatccggcggacacacggaactgatttacatgccggaagacggcgtgtatgaagtcatcggtgaaacgcgcgatgatgcagcgggcgaagcctatgataaagtagcacggaccttgaaacttccttatccgggtggtccgcggattgatcaattggcgcaaaccggtcaggatacattccatttcccacgaatttggctcgaaaaagagtcgtatgacttcagcttcagcggactcaaatcgtctgtcatcaatgccgttcataacgcggaacaacgcggcgaagtcatcattccggaagacctggctgccagttttcaggcaagcgtcgtcgaagtgctcgtcacaaaagcgatccgtgccgtcaaagaaaagggcggcaaacagttgcttattgcgggtggcgtcgcggccaaccgcggactgcgggcaggattgacggaagcctgttcacgtgaaggcatcgaactggtcattccgccgatgcacttatgcggtgataatgccgcgatgattggagcggcagcgattcacccttaccgggcaggccgccaatcgacacttgccatgaatgccgaacctgggctagatttaaagtaa

SEQ ID NO: 45945 - protein, 335 aa, Exiguobacterium sp. 255-15
MTQPLILAIESSCDETAAAVVRGGTDVLSNVVSSQIESHKRFGGVVPEVASRHHVERITYVIDDALTEAGVRIDEIDAIAVTEGPGLVGALLVGVSAAKALAFAHGKPLLGVHHIAGHIYANRLEQELRFPLVCLIASGGHTELIYMPEDGVYEVIGETRDDAAGEAYDKVARTLKLPYPGGPRIDQLAQTGQDTFHFPRIWLEKESYDFSFSGLKSSVINAVHNAEQRGEVIIPEDLAASFQASVVEVLVTKAIRAVKEKGGKQLLIAGGVAANRGLRAGLTEACSREGIELVIPPMHLCGDNAAMIGAAAIHPYRAGRQSTLAMNAEPGLDLK

SEQ ID NO: 45946 - DNA, 1074 bp, Chloroflexus aurantiacus
  CDS (1)..(1074)
atgactatgaatgaattgcccgccaatttcacgattctggcattggaaacctcttgtgacgagacggctgctgcagtggtgcgtggtgggcggacggtgctgagcaatgttgtcgcgtcccaaatggcgacccatgaacgctacggtggggttgtgccggaaattgcttcgcgccagcacattctcagtctggcaccggtcgtgcgggcagccctggctgtcctgccaaacggttgggctgatgtgcatgcagtagctgccactcatgggccagggctgagcggtgcactgctcaccggtcttaatgcggccaaggccatggcatggcgacgcggtttgccttttgtggcagttaaccatctcgaagcgcacctttacgccggatggttgggtagtgatccgccgccaccatttccactcgttgccctgctggtgagcggagggcatacgttgctggtactcttgcgcgatcacggtaactatcaactgcttgggcaaacccgtgacgatgcagccggtgaagcctttgataaagtagcgcgtattttggggttgggctacccaggcgggccggcaattcaggctgctgctgccaatgccactcctggtggtgtgctgccacgggcctggttgcgtgacagctacgatttttcgtttagcggtttgaaaacagccgtccttcatcgtgtgcaggatcggctggctcagcaaagccgactgagcggacggaagggagccggtgagacgccgcagctcgatgccccgtttgtggcgcagatggcttacgcctttcaggagtcggtagttgatgtgctggtcaccaaaaccgttgatgcggcgcggcgttatcaggcgcaggcgatcctccttgccggtggtgtcgccgctaatcggcggttgcgcgaagagctaatccggcgcgccagtgtgccagtccatttaccggcctttgatctctgcaccgataacgctgcaatggttgctgccgctgcattttaccggtttcacagcggtgtgcagtacggctgggacgttgatgtgacggcaaatctaccgctggaacaggcgaattaa

SEQ ID NO: 45947 - protein, 357 aa, Chloroflexus aurantiacus
MTMNELPANFTILALETSCDETAAAVVRGGRTVLSNVVASQMATHERYGGVVPEIASRQHILSLAPVVRAALAVLPNGWADVHAVAATHGPGLSGALLTGLNAAKAMAWRRGLPFVAVNHLEAHLYAGWLGSDPPPPFPLVALLVSGGHTLLVLLRDHGNYQLLGQTRDDAAGEAFDKVARILGLGYPGGPAIQAAAANATPGGVLPRAWLRDSYDFSFSGLKTAVLHRVQDRLAQQSRLSGRKGAGETPQLDAPFVAQMAYAFQESVVDVLVTKTVDAARRYQAQAILLAGGVAANRRLREELIRRASVPVHLPAFDLCTDNAAMVAAAAFYRFHSGVQYGWDVDVTANLPLEQAN

SEQ ID NO: 45948 - DNA, 1002 bp, Polaromonas sp. JS666
  CDS (1)..(1002)
atggcgctggtggatgccggcggcagcgaggtgccgcgcctgctctcgcatgccttgttcagccagatccagatgcaccaggcgtatggcggcgtggtgcccgagctggccagtcgtgaccacatacggcgggtcctgcccttgacgcgccaggtcatggcgcaggccgggcggtcgctggcgcaggtggatgtggtggcttacacgcgcgggccggggctggctggcgcactgctggtgggcgccggcgttgcctgcgccctggcggccgcgctgggcaagccggtgatgggcgtgcaccatctggaggggcatttgctgtcgccgttcctgagtgccgatccgccggtgtttccgtttgtggccctgctggtttccggcgggcacacccaactgatgcgggtggaccgtgtcggcagttacgagctgctgggagaaaccatcgatgacgcggcgggcgaggcctttgacaagtcggcaaagctgatgggtttgccctatcccggggggccgcatctggctgacctggcacggcagggcgatggcaccgccttcaaattgccccgacccttgctgcacagcggagacctcgatttttcgttcgcggggctgaaaaccgcggtgctgacccaagccaaaaaactgggtcctgaactggaaaaccgcaaagcggatctggctgcggccacccaggcggccatcgtggatgtactggtcaagaaatcgctggccgccatggcgcaaaccggcctgaagcgactcgtcgttgcgggcggcgtgggggccaatgccctgctgcgcagccagctgaatgcggcctgccagcaacgcggcatccgcgtgcattacccggagctgcacctgtgcacggacaacggcgcgatgatcgcgctggccgccggcatgcgcctgcaggccggcctggaaacgctgcagcgcggctacacctttgacgtgaagccgcgctggagtttgacccccacggtcgctcgctccgcgtag

SEQ ID NO: 45949 - protein, 333 aa, Polaromonas sp. JS666
MALVDAGGSEVPRLLSHALFSQIQMHQAYGGVVPELASRDHIRRVLPLTRQVMAQAGRSLAQVDVVAYTRGPGLAGALLVGAGVACALAAALGKPVMGVHHLEGHLLSPFLSADPPVFPFVALLVSGGHTQLMRVDRVGSYELLGETIDDAAGEAFDKSAKLMGLPYPGGPHLADLARQGDGTAFKLPRPLLHSGDLDFSFAGLKTAVLTQAKKLGPELENRKADLAAATQAAIVDVLVKKSLAAMAQTGLKRLVVAGGVGANALLRSQLNAACQQRGIRVHYPELHLCTDNGAMIALAAGMRLQAGLETLQRGYTFDVKPRWSLTPTVARSA

SEQ ID NO: 45950 - DNA, 1008 bp, Campylobacter lari RM2100
  CDS (1)..(1008)
atgaaaagcttaatccttgctatagaaagctcttgtgatgatagttctattgcaattattgataaaaatacatatgagtgtaaatttcataaaaaaatctctcaagaacaagaacatagccaatatggcggggttgtgcctgagcttgctgcaaggttacacacccaagctttgccaaatattttaagtcaatgtgaaaaatattttaataatttatgtgccatagcagttacaaatgagcctgggcttagtgtgagtttgataggtggggtggctatggctaagatacttgctattagtttaaatttaccattaattgcgataaatcacttaaaaggacatatctactctatgtttttaggtaaaaaagcttgttttgatatgggcgtgttgcttgtaagtggtgggcataccatggtgctttttattgataatcaagggcaaattacagaaatagcaagaacaaatgatgatagctttggagaaagttttgataaagtagctaagatgatgaatttgggctatcctggtggggttatcatagaaaatttagctaaaaatgcaaaagaaagtaatttagaatttagcatacccttgcttcattctaaagaattagcttatagtttttcaggccttaaaaaccaagtgcgcttagaaattttaaaagaagaattaactcaaagtagaaaaaatcaaatcgcctttgcctttcaaaaaacagctatagcacatattatgaataagctagaaaaaatttttaaagagtataaatttaaacgctttggtatagtaggtggagctagtgcaaatttaagtttaagaagtcaaatagagcatttgtgtcaaagctatcagtgtgagcttttacttgccccacttgagtattgttcagataatgctttgatgatagcaagagcagcatgtgaagcttatgagcgtaaagaatttgtaagtattgaagatgatcttataagcccgaaggtcaaaaatttacaaggtgtattatga

SEQ ID NO: 45951 - protein, 335 aa, Campylobacter lari RM2100
MKSLILAIESSCDDSSIAIIDKNTYECKFHKKISQEQEHSQYGGVVPELAARLHTQALPNILSQCEKYFNNLCAIAVTNEPGLSVSLIGGVAMAKILAISLNLPLIAINHLKGHIYSMFLGKKACFDMGVLLVSGGHTMVLFIDNQGQITEIARTNDDSFGESFDKVAKMMNLGYPGGVIIENLAKNAKESNLEFSIPLLHSKELAYSFSGLKNQVRLEILKEELTQSRKNQIAFAFQKTAIAHIMNKLEKIFKEYKFKRFGIVGGASANLSLRSQIEHLCQSYQCELLLAPLEYCSDNALMIARAACEAYERKEFVSIEDDLISPKVKNLQGVL

SEQ ID NO: 45952 - DNA, 1008 bp, Brachydanio rerio
  CDS (1)..(1008)
atgacgatagtgattggttttgaaggcagtgctaataagatcggcattggtattattaaagatggagaagtgctgtcaaacccaagacgaacttacatcaccccacctggacaagggttcctaccgggcgaaactgccaaacaccatcgcagtgtgatcctcacggtcctccaggaggctctcgatgaagcaggcctgaaagctgcagatattgattgtgtcgcgtacacaaaagggcctggaatgggggctccgctggtgacagtagccattgtggccaggacagtcgcccaactgtggggcaagccgctgttgggagtcaaccactgtattgggcacatagagatgggccgattgatcaccaatgcccaaaaccccactgtactgtatgtgagcggaggaaacactcaggtcattgcatattctgaacgacgttacagaatatttggagaaactatcgacattgctgtgggaaactgcttggatcggtttgcccgggtcattaagatatcaaatgatcccagtcccggatacaacattgaacagatggcaaaaaagggcaacaagtatatcgagctgccatacacagtcaaggggatggatgtgtcattttctgggattttgtcctatatcgaggacgccgctcacaaaatgttgagtacagatcagtgcacgcctgaggatttgtgtttctcccttcaagagactgtgttcgctatgctggtggagatcacagaaagagccatggcccactgcggctctcaggaggtcctgattgtcggtggagtcggctgtaatctccgcctgcaggagatgatgggggtcatgtgtaaagaacgaggcgctcgaatttttgccacagatgagagcttttgtatcgacaacggagccatgattgcacaggccggttgggaaatgttccgctctggtcacgtgaccgagcttccagactcctggattacacaaaggtacaggacagatgaagtggaggtcacatggcgagactga

SEQ ID NO: 45953 - protein, 335 aa, Brachydanio rerio
MTIVIGFEGSANKIGIGIIKDGEVLSNPRRTYITPPGQGFLPGETAKHHRSVILTVLQEALDEAGLKAADIDCVAYTKGPGMGAPLVTVAIVARTVAQLWGKPLLGVNHCIGHIEMGRLITNAQNPTVLYVSGGNTQVIAYSERRYRIFGETIDIAVGNCLDRFARVIKISNDPSPGYNIEQMAKKGNKYIELPYTVKGMDVSFSGILSYIEDAAHKMLSTDQCTPEDLCFSLQETVFAMLVEITERAMAHCGSQEVLIVGGVGCNLRLQEMMGVMCKERGARIFATDESFCIDNGAMIAQAGWEMFRSGHVTELPDSWITQRYRTDEVEVTWRD

SEQ ID NO: 45954 - DNA, 1143 bp, Oryza sativa
  CDS (1)..(1143)
atgacgtcatcgccggcggcgaggcgccggccgccgggtccgctggcgctggggctggagtcgtcggcgaacaagatcggcatcggcgtcgtctccctctcgggggagatcctctccaacccgcgtcacacctacgtcaccccgccggggcacggcttcctgccgcgggagacggcgcaccaccacctcgcccacctcctcccgctcctccgcgcggcgctgggcgaggccggggtgacccccgccgacctcgcctgcgtgtgctacaccaaggggcccgggatgggcgcgccgctccaggtcgccgccgccgcggcgcgcgcgctctcgctgctctgggggaagccgctcgtcggcgtgaaccactgcgtcgcgcacgtcgagatgggccgcgcggtcaccggcgccgtcgaccccgtcgtgctctacgtctccggcgggaacacgcaggtcatcgcgtacagcgaagggaggtacaggatcttcggcgagaccatcgacatcgcggtggggaactgcctcgatcgctttgccagggtgcttgagctgtccaatgatcctagccctgggtataacatcgagcagcttgcgaagaagggagagaagttcattgatctcccttatgttgtaaagggtatggacgtgtcatttagtggcatactgagcttcattgaagctacagcaattgagaagcttaaaaataatgagtgcacgcctgcagatctatgctactcattgcaggaaactctctttgctatgcttgttgaaatcactgagcgtgccatggcacattgtgattcgaaggatgttcttattgttggtggtgttgggtgcaatgaacgtttgcaagagatgatgaggataatgtgttcagaaagagggggtaggctgttcgcaaccgatgatcgatactgtattgacaacggggcaatgattgcatacactggtttactggcatacgcacatggcatgaccactcccctagaggagtccacttttactcaaagattccgaacggacgaagttcatgcaatctggagggagaaggagatgccagtgttaactaacatccgtgcccatgcaatggctgaagtatccaaagatgaagcttccgttccgactccaattgctgtagattcatga

SEQ ID NO: 45955 - protein, 380 aa, Oryza sativa
MTSSPAARRRPPGPLALGLESSANKIGIGVVSLSGEILSNPRHTYVTPPGHGFLPRETAHHHLAHLLPLLRAALGEAGVTPADLACVCYTKGPGMGAPLQVAAAAARALSLLWGKPLVGVNHCVAHVEMGRAVTGAVDPVVLYVSGGNTQVIAYSEGRYRIFGETIDIAVGNCLDRFARVLELSNDPSPGYNIEQLAKKGEKFIDLPYVVKGMDVSFSGILSFIEATAIEKLKNNECTPADLCYSLQETLFAMLVEITERAMAHCDSKDVLIVGGVGCNERLQEMMRIMCSERGGRLFATDDRYCIDNGAMIAYTGLLAYAHGMTTPLEESTFTQRFRTDEVHAIWREKEMPVLTNIRAHAMAEVSKDEASVPTPIAVDS

SEQ ID NO: 45956 - DNA, 1245 bp, Mus musculus
  CDS (1)..(1245)
atgctaatgttaagaaggacagcaggagctattcccaagcccccaaagagtaaagtttatggatttttaagaagatttagtgttcatcccagaactctctcttgtcataaactggtcctgggaattgaaaccagctgtgatgacacaggagcggctgtggtggatgaaactgggaatgtgctgggggaagcactgcactcccaaactcaggttcatctgaaaacaggtgggattgttcctccagtagctcaacaacttcacagagaaaatattcaacgaatagtagaagaaactctttctgccagtagaatcaccccaagcgatctctcggcaattgcaactaccatcaaaccgggactggccctaagcttaggagtcggcttatcctttagcttacagctagtaaatcggtttaaaaagccgttcatcccgattcatcacatggaggctcacgcactgactattaggctcaccaataaagtagaatttccttttctagttcttttgatttctggcggtcactgcctgttggcattagtccaaggtgtttccgatttcctgctccttgggaagtctttggacatagcgccaggcgacatgcttgacaaggtggcaagaagactttctttaatcaaacatccagaatgttctacaatgagtggtggaaaagctatagaacatttggccaaagacggaaatagattccattttactatcaatccacctatgcagaatgctaagaattgcgatttttcttttacgggacttcaacatattactgataagctaataacacacaaggaaaaagaagaaggcattgagaaggggcaaatcctgtcatcagctgcagacattgctgctgcggtacagcatgcaacagcgtgccaccttgcaaaaagaacacatcgtgctattctgttttgcaagcagaaaaatttgctatctccagctaacgcagtattagttgtatctggaggtgttgcaagtaacttgtacatccgaaaagcattggaaattgtcgcaaatgcaacgcagtgcacgttgctgtgtccccctccaagactgtgcactgacaatggcatcatgattgcatggaatggaattgaaagattacgtgctggcttgggcgttttacatgatgtagaagacatccgatatgaaccaaaatgtcctcttggaatagacatatccagagaagttgcagaagctgccataaaagtaccgcgattaaaaatggcactttga

SEQ ID NO: 45957 - protein, 414 aa, Mus musculus
MLMLRRTAGAIPKPPKSKVYGFLRRFSVHPRTLSCHKLVLGIETSCDDTGAAVVDETGNVLGEALHSQTQVHLKTGGIVPPVAQQLHRENIQRIVEETLSASRITPSDLSAIATTIKPGLALSLGVGLSFSLQLVNRFKKPFIPIHHMEAHALTIRLTNKVEFPFLVLLISGGHCLLALVQGVSDFLLLGKSLDIAPGDMLDKVARRLSLIKHPECSTMSGGKAIEHLAKDGNRFHFTINPPMQNAKNCDFSFTGLQHITDKLITHKEKEEGIEKGQILSSAADIAAAVQHATACHLAKRTHRAILFCKQKNLLSPANAVLVVSGGVASNLYIRKALEIVANATQCTLLCPPPRLCTDNGIMIAWNGIERLRAGLGVLHDVEDIRYEPKCPLGIDISREVAEAAIKVPRLKMAL

SEQ ID NO: 45958 - DNA, 1023 bp, uncultured bacterium 578
  CDS (1)..(1023)
gtggttaatccaagacttcttacattaggcattgaatcttcttgcgatgaaacaggggtaggcatctatagtagtgaagatggccttatagctcataaacttttttcacaaattgaattacatgctgaatatggcggtgtagttcctgagctagcttctagagatcatatccaaagagccttgccattgattaaagaggcgctaattgatagcaatattagattagaagatttaactggcatttcttataccgcaggtcctggtttatcaggtgcattactagtgggtagttcaattgctcaaagtctggcatgggggctaggaattcctgcattaggagttcatcatatggaggggcacctcttggcacctcttctgcagtcagatcaacctcaatttccatttatagctttacttgtttctggtggacacaccttacttgtagaggttactagaataggtgaatataagatactaggtcaatccctagatgatgcagtgggtgaagcctttgataaaacagcaaaaattcttggattgggctatccaggtggtcctgctttagcaaaattagcaaatcaaggggttaaagggcgatttaattttccaaggccaatgactgataggccaggtcttgattttagttttagtgggctaaaaacatttgcacgaaatacctatattaattttccaaaagaaaaagcaaatattgcaaatgcttttgaagttgctgctactgaaacattgaccattaaatgcaggcgtgctcttgaacagaccggtttaaaaaccttagttgtagctggaggggttagtgctaatatatcactcagatcgactttaaatgatatggcaaaaaaacttgatgtggatgttttttatccagcacatgagttttgtactgataatggtgctatgattgcactggcaggccactttcgttttctttcagggcaaagaaatgatcactatgaaatttcgattaagccccgctggagtcttgaagagcttcaatcagtatag

SEQ ID NO: 45959 - protein, 340 aa, uncultured bacterium 578
MVNPRLLTLGIESSCDETGVGIYSSEDGLIAHKLFSQIELHAEYGGVVPELASRDHIQRALPLIKEALIDSNIRLEDLTGISYTAGPGLSGALLVGSSIAQSLAWGLGIPALGVHHMEGHLLAPLLQSDQPQFPFIALLVSGGHTLLVEVTRIGEYKILGQSLDDAVGEAFDKTAKILGLGYPGGPALAKLANQGVKGRFNFPRPMTDRPGLDFSFSGLKTFARNTYINFPKEKANIANAFEVAATETLTIKCRRALEQTGLKTLVVAGGVSANISLRSTLNDMAKKLDVDVFYPAHEFCTDNGAMIALAGHFRFLSGQRNDHYEISIKPRWSLEELQSV

SEQ ID NO: 45960 - DNA, 957 bp, Spiroplasma kunkelii
  CDS (1)..(957)
atggtaattcttgcaattgagacaagctgtgacgaaactagtattgctatttttaagaatcgaaaaattttagcaaatattatttcatcacaaattaaggaacatacaaaatacggtggagttgtgctagaacttgcttcgcggttacatttaaaaaacttttcttatgttctacttgaagctttgcaaaaagctaatattcatataacagaattacaatacattgcatacacagcaaaacctggtttaattggagcactacatattggaaaaacaatagcagaaacattgtctaattatttagaaattccaattttacctttaaaccatttatatggtcatatctatgctagtgcaatcgataatgattttttatttcctcttttagcagtgctagttagtggtggccacactcagttaatattaatgaaaaaacatttgaattttaaaattttaggttcaacattggatgatgcaattggtgaatgttatgataaggttgctcgaatgctggacttagggtatccgggtggacctgttattgataagcttgcagcgacaggaacaacaacacaatataatttaccactaccattaaatgatcaaagttataatttttcttttagcggattaaaatcagctgtagctaatttaattgcaaaagaacaacgtaatactaaaattaacttgtctaatttttgtgcgacatttcaaaaaacatgtgttgatattattatgcgaaaaacaatattagcaattcaaaattttcagccgcaaatggttacgttagtcggtggagtttcagctaatagcgcattacgagcagcaattttaaatttagcaacaccaaatttaaaaatagttattccaaaattagaatattgtactgataatgctgcaatgattgctcgcttagcagcacaagaactactggaaaataatataaaaggagattag

SEQ ID NO: 45961 - protein, 318 aa, Spiroplasma kunkelii
MVILAIETSCDETSIAIFKNRKILANIISSQIKEHTKYGGVVLELASRLHLKNFSYVLLEALQKANIHITELQYIAYTAKPGLIGALHIGKTIAETLSNYLEIPILPLNHLYGHIYASAIDNDFLFPLLAVLVSGGHTQLILMKKHLNFKILGSTLDDAIGECYDKVARMLDLGYPGGPVIDKLAATGTTTQYNLPLPLNDQSYNFSFSGLKSAVANLIAKEQRNTKINLSNFCATFQKTCVDIIMRKTILAIQNFQPQMVTLVGGVSANSALRAAILNLATPNLKIVIPKLEYCTDNAAMIARLAAQELLENNIKGD

SEQ ID NO: 45962 - DNA, 1053 bp, Cryptosporidium parvum
  CDS (1)..(1053)
atggagggatctaataatgaagttctaatttcccttgggattgagtcaagcgcaaacaaggtaggagtcggaatagtaacatctaaaggagaaatcttggcaaatgaaaaaatgacatttgtgggaccacctggctctggatttttacccagagaaactgcagaatttcatagaaataatatattgcatttggttaaacaggctttagaaaaatccggaataaataagaattcaataacaattatttcatttacacaaggaccaggaatgggtgcacctttagcggttggagctctagttgcaagaatgttgagcatgctttggtcaaaacctttaatcggagtaaatcattgcgttgctcacatagaaatgggaagactcgtaactaaagttgaaaatcctatagtactatatgcgtcaggaggaaacactcaaataataggttatgccaacaaaagatacaaaattttaggtgaaactttggatattgcaatcgggaactgcattgatagatttgctagagttatgaaacttgacaattatcctgcagcaggataccatattgaacaaatggcaaaaaaaggaaagaatttaatttcacttccttatgttgttaaaggcatggatttatcattttccggaattctaacttttggagaagaactaatagcagagaaacaaaaagaatttaataatgatgaacaaaaattacaatctttttatcaagatttctgcttttctttgcaagagaccctttttgcaatgttaattgaagttacagaaagagcaatcagtctattaaactcagattcaatcttactagtcggaggtgttggatgcaatttaaggttgattgaaatgatggaacaaatggcaaaggatagaggagctattgtatgtagcatggatgatagttattgcattgataacggagcaatgattgctcatacaggattattagcataccaaaaaaatttcatcacaaaagtggaagagtctgcagtatctcaaagatttagaactgatcaagttgagatattatggagagagtga

SEQ ID NO: 45963 - protein, 350 aa, Cryptosporidium parvum
MEGSNNEVLISLGIESSANKVGVGIVTSKGEILANEKMTFVGPPGSGFLPRETAEFHRNNILHLVKQALEKSGINKNSITIISFTQGPGMGAPLAVGALVARMLSMLWSKPLIGVNHCVAHIEMGRLVTKVENPIVLYASGGNTQIIGYANKRYKILGETLDIAIGNCIDRFARVMKLDNYPAAGYHIEQMAKKGKNLISLPYVVKGMDLSFSGILTFGEELIAEKQKEFNNDEQKLQSFYQDFCFSLQETLFAMLIEVTERAISLLNSDSILLVGGVGCNLRLIEMMEQMAKDRGAIVCSMDDSYCIDNGAMIAHTGLLAYQKNFITKVEESAVSQRFRTDQVEILWRE

SEQ ID NO: 45964 - DNA, 972 bp, Drosophila melanogaster
  CDS (1)..(972)
atggaggcggcgcaattgaagccggaccaactgacggccatcgcggtgaccacgcgtcccggactgccgctgagtttgctggtgggcgtgcgctttgcacggcacctggcccgtcgcctgcagaagcccctgctgcccgttcaccacatggaggcgcacgcgctgcaggcccgcatggaacatccggagcagatcggctaccccttcctctgcttgctggccagcggcggccactgtcagttggtggtggctaacggccccggtcgccttacgcttcttggccaaacactggatgatgcgcccggcgaggcctttgacaagatcggtcggcgactacgcctgcacattctgccggagtaccgcttgtggaacggaggacgggccattgagcatgccgcccagctggccagcgatccgctggcctacgagtttccgctgccacttgcccagcagcggaactgcaacttcagcttcgccggcatcaagaacaactccttccgggccatccgagcgcgcgagcgggcagagcggacacctccggacggagtcatcagcaactacggcgacttctgcgccggcctgctgcgctctgtcagccggcacctgatgcaccgcacgcagcgggcaattgagtactgcctcctgccgcacaggcagctcttcggtgacaccccgcccacactggtcatgtccggcggtgtggccaacaacgatgccatatacgccaacatcgaacatctggccgcgcagtatggctgcaggagcttccgtccatcgaagcggtactgctccgacaacggcgtcatgatcgcctggcacggcgttgagcaactgctgcaggataaagaggccagcacgcgctacgactacgacagcattgatatccagggcagcgcgggattcgccgagtcgcacgaggaagctgtcgctgcggcggccataaaatgcaagtggatacagccactggtttga

SEQ ID NO: 45965 - protein, 323 aa, Drosophila melanogaster
MEAAQLKPDQLTAIAVTTRPGLPLSLLVGVRFARHLARRLQKPLLPVHHMEAHALQARMEHPEQIGYPFLCLLASGGHCQLVVANGPGRLTLLGQTLDDAPGEAFDKIGRRLRLHILPEYRLWNGGRAIEHAAQLASDPLAYEFPLPLAQQRNCNFSFAGIKNNSFRAIRARERAERTPPDGVISNYGDFCAGLLRSVSRHLMHRTQRAIEYCLLPHRQLFGDTPPTLVMSGGVANNDAIYANIEHLAAQYGCRSFRPSKRYCSDNGVMIAWHGVEQLLQDKEASTRYDYDSIDIQGSAGFAESHEEAVAAAAIKCKWIQPLV

SEQ ID NO: 45966 - DNA, 1245 bp, Homo sapiens
  CDS (1)..(1245)
atgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaacgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatga

SEQ ID NO: 45967 - protein, 414 aa, Homo sapiens
MLILTKTAGVFFKPSKRKVYEFLRSFNFHPGTLFLHKIVLGIETSCDDTAAAVVDETGNVLGEAIHSQTEVHLKTGGIVPPAAQQLHRENIQRIVQEALSASGVSPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDKVARRLSLIKHPECSTMSGGKAIEHLAKQGNRFHFDIKPPLHHAKNCDFSFTGLQHVTDKIIMKKEKEEGIEKGQILSSAADIAATVQHTMACHLVKRTHRAILFCKQRDLLPQNNAVLVASGGVASNFYIRRALEILTNATQCTLLCPPPRLCTDNGIMIAWNGIERLRAGLGILHDIEGIRYEPKCPLGVDISKEVGEASIKVPQLKMEI

SEQ ID NO: 45968 - DNA, 1095 bp, Homo sapiens
  CDS (1)..(1095)
atgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagacttcctttaataaaacatccagagtgctccaccatgagtggtgggaaagccatagaacatttggccaaacaaggaaatagatttcattttgacatcaaacctcccttgcatcatgctaaaaattgtgattttccttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctgtatccgcagagctctggaaattttaacaaacgcaacacagtgcactttgttgtgtcctcctcccagactatgcactgataatggcattatgattgcatga

SEQ ID NO: 45969 - protein, 364 aa, Homo sapiens [sequence omitted]

SEQ ID NO: 45970 - DNA, 1014 bp, Caenorhabditis elegans
  CDS (1)..(1014)
atggtctgcgtaatcggaatcgaaggatcggccaataaaattggggtgggaataatccgtgacggagtagtgctctcaaatccgcgagcaacatttcatgctccaccgggtgaaggatttcgtccaacagaaaccgcccaacatcaccgtcaacaaattgttcgattagttggagaagctattaaactggcaaatattcagaatccagagcttgaaattgatggaattgcatatacaaagggtcctggaatgggggctccacttcaggttggagcaattgtcgcacgaactctatccctcacatggaaaaagccaattattccagttaatcactgtgttggacacattgaaatgggcagacttatcacgggagctgataatcctgttgttttgtatgttagcggtggaaatactcaggtaatctcatatacgaagaaaagataccgaatctttggtgaaacaatcgatattgccgtcggaaactgtttggatcgatttgcccgtgttctcaagctcccgaatgcaccatctccgggatataacattgagcagcttgcgaaaaacggaaaaaagcttatggaactaccgtattctgtgaaaggaatggatgtttcactctcaggaattctgtcacttatcgagaaaaaagcgccaaaactcatcgaatctggggattttacaccggaagacttgtgtttctcacttcaagagaccgtttttgcaatgcttattgagattaccgaaagagcaatggctcatacgtcgagcaaggagttgctcattgttggcggggttggatgtaatctgagattgcaggaaatggcatcagcaatgtgtgcggaaagaggtgctcacttatttgcaactgatgaacgattctgtattgataacggtgcaatgattgcaagagccggcgagctcatgttggcctccggaatgcgtttcgaccttcgtaaaaccacaaccacccagcgatatagaacggatcaggttcacgttgaatggagagattaa

SEQ ID NO: 45971 - protein, 337 aa, Caenorhabditis elegans
MVCVIGIEGSANKIGVGIIRDGVVLSNPRATFHAPPGEGFRPTETAQHHRQQIVRLVGEAIKLANIQNPELEIDGIAYTKGPGMGAPLQVGAIVARTLSLTWKKPIIPVNHCVGHIEMGRLITGADNPVVLYVSGGNTQVISYTKKRYRIFGETIDIAVGNCLDRFARVLKLPNAPSPGYNIEQLAKNGKKLMELPYSVKGMDVSLSGILSLIEKKAPKLIESGDFTPEDLCFSLQETVFAMLIEITERAMAHTSSKELLIVGGVGCNLRLQEMASAMCAERGAHLFATDERFCIDNGAMIARAGELMLASGMRFDLRKTTTTQRYRTDQVHVEWRD

SEQ ID NO: 45972 - DNA, 1026 bp, Riemerella anatipestifer
  CDS (1)..(1026)
atgaaacaatctattatcttaggtatagaatcctcttgtgatgatacttctgccgctattatttctggtagaaaaattctttctaatgtagccgctactcaagccattcataatgagtacggtggcgtggtgccagagctggcctctagggcacatcagcaaaatatcattcctgtcatagagcaatctatacaaaaagcaaatatacaacaaaatgagatttgtgccataggttttacgagaggtcctggacttttgggctctttactggtaggaacttcctttgcgaagtctttagcaatgagtttggaagctccattgatagaggttaatcaccttcaggctcatattttggctcattttatagaagatgccaatcctaatccgcccaagtttccttttttatgccttacagtaagtggtgggcatacaatgattgtcttggttaaagactattttgatatggaaattattgggaaaaccatagatgatgccgcaggtgaagcctttgataaaataggaaaaatatttgatttagattatcctgctggacctatcatagataagaaatctcaaaatggaagtcctaatgcatttacatttaataagcctaaactagagggctacgactattcttttagcggaattaaaacttcggtgttgtactttatacaaaaagaattaaagaaaaatcctcagtttgtcaatgaaaatatagatgatttgtgtgcatctgttcagaaaaatattattgaaatattgatgacaaaactagagaaagctgctagtgatttaggcattaaagaaatagcgatagctggtggggtttcggctaactctgccttgagacaagctatgagagaaaacgaacaaaagttaggttggaatatctatattcccaaatttgaatatactacggacaatgctgcaatgatagcaatggtagcccaactaaaatacgaaaggggagagtttgccaacctttctacaacggctactgcaagatatgagttaaatgtaaagtaa

SEQ ID NO: 45973 - protein, 341 aa, Riemerella anatipestifer
MKQSIILGIESSCDDTSAAIISGRKILSNVAATQAIHNEYGGVVPELASRAHQQNIIPVIEQSIQKANIQQNEICAIGFTRGPGLLGSLLVGTSFAKSLAMSLEAPLIEVNHLQAHILAHFIEDANPNPPKFPFLCLTVSGGHTMIVLVKDYFDMEIIGKTIDDAAGEAFDKIGKIFDLDYPAGPIIDKKSQNGSPNAFTFNKPKLEGYDYSFSGIKTSVLYFIQKELKKNPQFVNENIDDLCASVQKNIIEILMTKLEKAASDLGIKEIAIAGGVSANSALRQAMRENEQKLGWNIYIPKFEYTTDNAAMIAMVAQLKYERGEFANLSTTATARYELNVK

SEQ ID NO: 45974 - DNA, 1008 bp, Aquifex aeolicus
  CDS (1)..(1008)
atgaggacattagcagttgagacctcgtgtgatgaaaccgctcttgctatttatgacgaccaaaaaggcgtactgggaaacgtaatactttcacaggccgtagttcactcccccttcggtggggtcgttcccgaactctctgcaagggagcacacgagaaacatacttcctatattcgacagactcttaaaggaaagccgaataaatcttgaggagatagactttatttcctttaccctaactcccggattgatactttcgctcgtggtgggtgtagcctttgcaaaggcccttgcctacgagtacagaaaacctttagttcccgttcaccacctggaaggtcacatatactctgttttcctagaaaaaaaggttgaatatccctttctcgctctgataatttcaggtgggcacacggatctttaccttgtaagggactttgggaggtacgattttctcggaggtactctggacgacgctgtcggggaagcctacgacaaagttgcaaaaatgctcggtctgggataccccggaggtcccataatagaccgactggctaaagagggaaagaaattataccctttacccaaaccacttatggaggaaggaaacttaaacttctccttcagtgggcttaaaacggcgatactgaacctcttaaaaaaggaaaaaaacgtaaggaaagaggatatcgcttactcattccaggaaacggtggtagaaatactactcgaaaaaagcctctgggctatgaaaaaaacggggataaaaaggcttgttgtggtaggaggagtgtccgcaaactcgaggctgagggaagtgttcaaaaaagcttctcaagagtacggttttgaactctacataccgcatccgagtctctctacggacaacgcccttatgatagcttacgccggtatggagaggttcaagaggggtgttgtagcacctctggatgtaaatccccaacccaatattcccctggaggagttcggaaggatatggacttga

SEQ ID NO: 45975 - protein, 335 aa, Aquifex aeolicus
MRTLAVETSCDETALAIYDDQKGVLGNVILSQAVVHSPFGGVVPELSAREHTRNILPIFDRLLKESRINLEEIDFISFTLTPGLILSLVVGVAFAKALAYEYRKPLVPVHHLEGHIYSVFLEKKVEYPFLALIISGGHTDLYLVRDFGRYDFLGGTLDDAVGEAYDKVAKMLGLGYPGGPIIDRLAKEGKKLYPLPKPLMEEGNLNFSFSGLKTAILNLLKKEKNVRKEDIAYSFQETVVEILLEKSLWAMKKTGIKRLVVVGGVSANSRLREVFKKASQEYGFELYIPHPSLSTDNALMIAYAGMERFKRGVVAPLDVNPQPNIPLEEFGRIWT

SEQ ID NO: 45976 - DNA, 1041 bp, Borrelia burgdorferi
  CDS (1)..(1041)
atgaaagtgcttggaatagaaacctcttgtgacgactgttgcgtagctgtagtagaaaatggaattcatattttaagcaatataaaattaaatcaaaccgaacacaaaaaatattacggcatagtgcctgagattgcctcaagacttcatacggaagctattatgtctgtttgtataaaagcactaaaaaaggcaaatactaaaatatctgaaattgacttaatagctgtaacatctagacctggacttattggatctttaatagttggattaaactttgccaaaggtctagcaatttcattaaaaaagcccattatttgcattgatcacatcttgggtcatctttacgcccctttaatgcactcaaaaatagaatatccatttatatcattattattaagtggtggacatacattgattgctaaacaaaaaaatttcgatgatgttgaaatacttggaagaactctagatgatgcttgtggagaggcttttgataaagtggcaaaacattatgatatgggatttccgggaggtccaaacatcgaacaaatatctaaaaatggagatgaaaatacatttcaatttccagttaccacctttaaaaaaaaagaaaactggtatgatttttcatactctggactaaaaacagcttgcatacaccaactcgaaaaattcaaaagcaaagataacccaacaacaaaaaataatatagctgcaagcttccaaaaagctgcctttgaaaatctaatcaccccactaaaaagggcaataaaagatactcaaatcaacaaattggtaatagcaggaggtgttgcaagcaatttatatttaagagaaaaaatagataagcttaaaatacaaacttactaccctcctcttgacctttgcacagacaatggagcaatgattgcgggacttggatttaatatgtatttaaaatatggagaaagtccaattgaaattgatgcaaattcaagaatagaaaattataaaaaccagtatagggggaaaaataatgaaaagaattttagcaatgcatga

SEQ ID NO: 45977 - protein, 346 aa, Borrelia burgdorferi
MKVLGIETSCDDCCVAVVENGIHILSNIKLNQTEHKKYYGIVPEIASRLHTEAIMSVCIKALKKANTKISEIDLIAVTSRPGLIGSLIVGLNFAKGLAISLKKPIICIDHILGHLYAPLMHSKIEYPFISLLLSGGHTLIAKQKNFDDVEILGRTLDDACGEAFDKVAKHYDMGFPGGPNIEQISKNGDENTFQFPVTTFKKKENWYDFSYSGLKTACIHQLEKFKSKDNPTTKNNIAASFQKAAFENLITPLKRAIKDTQINKLVIAGGVASNLYLREKIDKLKIQTYYPPLDLCTDNGAMIAGLGFNMYLKYGESPIEIDANSRIENYKNQYRGKNNEKNFSNA

SEQ ID NO: 45978 - DNA, 1014 bp, Buchnera aphidicola
  CDS (1)..(1014)
atgaaagttttaggtattgaaacatcctgtgatgatactggtatagctatttatgatgtttctaaaggtttgttaattaatgaattacatagtcaaaaaaaaatacatgctaattatggaggtattattccagaattagcatctcgtgaacatacaaggaaaataatttttttattagataaaatttttaaagaaaaaaatattatgaaggaaattgatcttattgcatatactgcgggacctggtttagctggttctttattagttggtgctacatttgcatgttctttaggtttttctttaaatattcctgttttacctgttaatcatatggaagcgcatttattatcaccaatgttagagtataagtcaatgcaatttccatttatcgcattgttagtttccggaaaacatacacaaataatcgctgcttatgaattaggaaaatatgaaatattaggaaattctttagatgatgcagcaggtgaagcttttgataaagtatcaaaaatgttaggattgaaatatccgagtggacgtgaactatctagtttagctgctcagggaataaaaaattatttttattttcctcgacctatgatacatcattcaagcttaaattttagtttttcaggtttaaaaacttttacttctaaagttattagtaataatactttaaatattcaacaaaaagctaatattgcaagagcttttgaagatgcagtaattgatgtactattaattaaaactaaaaaagcgttatacaagaaaggatggaaacgtttagttatagcaggcggtgtcagtgcaaatactgtattacgcaaaagatcgaaagacatgatggaaaacgtttttcatggaaaagttttttattcttcattaaaattttgtacagataatggtgccatgattgcctatcttggatctctacgttataaagaagcaagcgtttctcaattggagataattgtgaaaccaaaatggtctatagataagttatcttatatttaa

SEQ ID NO: 45979 - protein, 337 aa, Buchnera aphidicola
MKVLGIETSCDDTGIAIYDVSKGLLINELHSQKKIHANYGGIIPELASREHTRKIIFLLDKIFKEKNIMKEIDLIAYTAGPGLAGSLLVGATFACSLGFSLNIPVLPVNHMEAHLLSPMLEYKSMQFPFIALLVSGKHTQIIAAYELGKYEILGNSLDDAAGEAFDKVSKMLGLKYPSGRELSSLAAQGIKNYFYFPRPMIHHSSLNFSFSGLKTFTSKVISNNTLNIQQKANIARAFEDAVIDVLLIKTKKALYKKGWKRLVIAGGVSANTVLRKRSKDMMENVFHGKVFYSSLKFCTDNGAMIAYLGSLRYKEASVSQLEIIVKPKWSIDKLSYI

SEQ ID NO: 45980 - DNA, 1647 bp, Haloarcula marismortui
  CDS (1)..(1647)
atgcgtattctgggtatcgaaggtaccgcctgggcagctagtgcttcggtgtttgagacgccggacccggcccgggtaaccgacgacgatcacgttttcatcgaaactgacgcgtacgcgccagacagcggcggcatccacccgcgcgaggccgccgagcatatgggcgaagccatcccgaccgtcgtcgagacggctatcgaacacacacacgggcgcgccggcagggacggagacgacagcgcaccgatcgacgccgtcgcctttgcccgcggtccggggctgggaccctgcttgcgaatcgtcgccacggccgcccgggcggtcgcccagcggttcgacgtgccgctggtcggcgtgaaccacatggtcgcccacctcgaagtgggccgccaccgctcgggcttcgattcgccggtgtgcctcaacgcctccggcgcgaacgcccacattctgggctaccggaacggccggtatcgcgtgctgggcgagacgatggacaccggcgtcggcaacgccatcgacaagttcacgcgccacatcggctggtcccatcccggcgggccgaaggtcgaacagcacgcccgggacggcgagtaccacgaactgccctacgtcgtcaaggggatggacttctccttttcgggcatcatgagcgccgccaagcaggcagtcgacgacggcgtcccggtcgagaacgtctgccgcgggatggaggaaaccatcttcgcgatgctgacggaagtctccgagcgggcgctgtcgctgaccggggccgacgaactggtgcttggcggcggcgtcggccagaacgcccgtctccagcggatgctcggtgagatgtgtgagcaacgcgaggcagaattctacgctccggaaaaccgcttcctgcgggacaacgccgggatgatagcgatgctcggcgcgaagatgtacgcggctggcgacaccatcgccatcgaggactcccgcatcgattcgaacttccggcccgacgaagtggccgtcacctggcggggacccgaggagtcggtggacagctaccggatgggaggcgacgaagttcagggcgcagaggcgaccgtccacttcgatggggaccgggtgatcaaggtgcgcgtgccgcggagctaccgccacccgacgctggacgagcgtctcaggactgagcggacccggcaggaagcccggctcaccagcgaggcgcgccgcaacggcgtcccgacgccgctggtccgagatgtcgacccacaggagtcgcgcattgtcttccagcgcgtgggcgacacagacctccgcgaggggctgtccgaggggcgggtcgcggacgttggccgctggctcgctcgcatccacgacgccggcttcgtgcacggcgacccgacgacccggaacgtccgggtgggtggccgtgacgagcaggcggaccggaccaccctcatcgacttcggactcggctactacacgcaggaggccgaggaccacgcgatggaccttcacgtcctcgcccagtcgctcgccgggaccgcggacgaccccgagacgctgctgtcggccgccgaggacgcctaccggaccgagagcgaccacgccgacgcggtgttcgctagcctcgacgacatcgagggccggggtcggtatcagtag

SEQ ID NO: 45981 - protein, 548 aa, Haloarcula marismortui
MRILGIEGTAWAASASVFETPDPARVTDDDHVFIETDAYAPDSGGIHPREAAEHMGEAIPTVVETAIEHTHGRAGRDGDDSAPIDAVAFARGPGLGPCLRIVATAARAVAQRFDVPLVGVNHMVAHLEVGRHRSGFDSPVCLNASGANAHILGYRNGRYRVLGETMDTGVGNAIDKFTRHIGWSHPGGPKVEQHARDGEYHELPYVVKGMDFSFSGIMSAAKQAVDDGVPVENVCRGMEETIFAMLTEVSERALSLTGADELVLGGGVGQNARLQRMLGEMCEQREAEFYAPENRFLRDNAGMIAMLGAKMYAAGDTIAIEDSRIDSNFRPDEVAVTWRGPEESVDSYRMGGDEVQGAEATVHFDGDRVIKVRVPRSYRHPTLDERLRTERTRQEARLTSEARRNGVPTPLVRDVDPQESRIVFQRVGDTDLREGLSEGRVADVGRWLARIHDAGFVHGDPTTRNVRVGGRDEQADRTTLIDFGLGYYTQEAEDHAMDLHVLAQSLAGTADDPETLLSAAEDAYRTESDHADAVFASLDDIEGRGRYQ

SEQ ID NO: 45982 - DNA, 1023 bp, Helicobacter pylori J99
  CDS (1)..(1023)
atgattttaagcattgaaagttcttgcgatgacagctctttagcccttacaagaatagaggacgccaagctcatcgctcattttaaaatctctcaagaaaagcaccacagctcttatgggggcgttgtgcctgagattgcatcgcgcctgcatgctgagaatttgccgcttttattagaacgcgttaaaataagcttgaataaggatttttccaaaattaaagccatcgctatcactaatcagccaggtttgagcgttactttaatagagggtttgatgatggcaaaagccttgagcttgtctttgaatttacccttgattttggaagatcatttgagagggcatgtgtattcgctctttatcaatgaaaaacaaacccgcatgcctttaagcgtgctgctagtctctggggggcattctttaattttagaggctagagattatgaagacattaaaatcgttgccacgagtttagacgatagctttggggagagttttgataaggtttcaaaaatgcttgatttaggctatccaggaggccccatagtggaaaaattagcccttgattatgcacacccaaacgagcctttaatgttccctatccctttaaaaaacagcccgaatttggcttttagtttttcaggtttaaaaaatgcggtgcgtttggaggttgaaaaaaacgcccataatttgaacgatgaggtaaaacaaaagattggctatcattttcaaagcgcggctatcgagcatttaatccagcagactaaacgctattttaaaatcaaacgccctaaaatttttggcattgtggggggagcgagccaaaatctagccttaagaaaggcgtttgaggatttgtgtgctgagtttgattgcgagcttgttttagcccctttagaattttgcagcgacaatgccgccatgatagggcgatcaagcctagaagcttatcaaaaaaagcgctttatccctttagaaaaagccgatatttcgccaagaacgctgttaaaaaattttgagtga

SEQ ID NO: 45983 - protein, 340 aa, Helicobacter pylori J99
MILSIESSCDDSSLALTRIEDAKLIAHFKISQEKHHSSYGGVVPEIASRLHAENLPLLLERVKISLNKDFSKIKAIAITNQPGLSVTLIEGLMMAKALSLSLNLPLILEDHLRGHVYSLFINEKQTRMPLSVLLVSGGHSLILEARDYEDIKIVATSLDDSFGESFDKVSKMLDLGYPGGPIVEKLALDYAHPNEPLMFPIPLKNSPNLAFSFSGLKNAVRLEVEKNAHNLNDEVKQKIGYHFQSAAIEHLIQQTKRYFKIKRPKIFGIVGGASQNLALRKAFEDLCAEFDCELVLAPLEFCSDNAAMIGRSSLEAYQKKRFIPLEKADISPRTLLKNFE

SEQ ID NO: 45984 - DNA, 1608 bp, Methanococcus jannaschii
  CDS (1)..(1608)
atgatttgcttaggattagaaggaactgcagaaaaaactggggtagggattgttacctctgatggagaggttttatttaataaaactatcatgtataaacccccaaaacagggtattaatccaagagaggctgctgaccatcatgctgaaacatttcctaagcttataaaagaggcttttgaagtagttgataaaaatgagattgatttaattgcattctcccaagggccgggattagggccgagtttgagggtaactgcaaccgtagcaagaactttatctttaacattaaaaaaaccaataattggggttaatcattgcattgcccatatagagattggtaagctaactacagaggcagaagaccctctaactctatatgttagtggtggaaacacccaagttatagcttatgtctcaaaaaaatatagggtatttggagagacgttagatatagctgttggtaactgcttagaccagtttgcaagatatgtgaatttgccacatcccggggggccttatatagaggaattggcaaggaaagggaaaaagcttgttgatttaccttacactgttaaaggcatggatatagcattctctggattgctaacagcggctatgagagcttatgatgctggagagagattggaagatatctgctactccctacaagaatatgccttctcaatgctaactgagattacagaaagggctttagctcacacaaataaaggagaggtcatgctcgttggtggagtagcggcaaataacagattgagagagatgctcaaagctatgtgtgagggtcagaatgttgatttttacgtccctcctaaggagttttgtggagacaatggagctatgattgcatggcttggtttattgatgcataaaaatggaagatggatgagtttggatgaaacaaagataattccaaattataggactgatatggttgaagttaattggataaaagaaattaaaggcaagaagagaaagattccagaacatttaattggtaagggggcagaggcagatattaagagagatagctatttagattttgatgtaattattaaggagagagttaaaaaaggctatagggatgagagattagatgaaaatataagaaagagtagaactgcaagagaggcaaggtatttagcattggttaaagattttggtatcccagctccatacatatttgatgttgatttagataacaagagaattatgatgagttatatcaacggaaagttagctaaggatgttattgaggataatttagatattgcatacaaaattggagaaatcgttggaaaactgcataaaaacgatgtaattcataatgacttaactacatccaactttatatttgataaagatttatatatcattgattttggtttaggaaagatttcaaatcttgatgaagataaggcagttgatttaatcgtctttaaaaaggctgtgttatcaactcatcatgaaaagtttgatgaaatctgggagagatttttagagggttataaaagtgtttatgataggtgggagattatactggagttaatgaaggatgttgaaagaagagcaagatatgtagagtaa

SEQ ID NO: 45985 - protein, 535 aa, Methanococcus jannaschii
MICLGLEGTAEKTGVGIVTSDGEVLFNKTIMYKPPKQGINPREAADHHAETFPKLIKEAFEVVDKNEIDLIAFSQGPGLGPSLRVTATVARTLSLTLKKPIIGVNHCIAHIEIGKLTTEAEDPLTLYVSGGNTQVIAYVSKKYRVFGETLDIAVGNCLDQFARYVNLPHPGGPYIEELARKGKKLVDLPYTVKGMDIAFSGLLTAAMRAYDAGERLEDICYSLQEYAFSMLTEITERALAHTNKGEVMLVGGVAANNRLREMLKAMCEGQNVDFYVPPKEFCGDNGAMIAWLGLLMHKNGRWMSLDETKIIPNYRTDMVEVNWIKEIKGKKRKIPEHLIGKGAEADIKRDSYLDFDVIIKERVKKGYRDERLDENIRKSRTAREARYLALVKDFGIPAPYIFDVDLDNKRIMMSYINGKLAKDVIEDNLDIAYKIGEIVGKLHKNDVIHNDLTTSNFIFDKDLYIIDFGLGKISNLDEDKAVDLIVFKKAVLSTHHEKFDEIWERFLEGYKSVYDRWEIILELMKDVERRARYVE

SEQ ID NO: 45986 - DNA, 1605 bp, Methanobacterium thermoautotrophicum
  CDS (1)..(1605)
atgttgtgtcttggtatagagggaactgcagagaagacaggtgttggtatcgtcgatgaggctggaaacgtcctatcactgcggggaaagccacttatacctgaaaagggaggtatacatcccagggaggctgctgaacaccatgcaaaatggataccccgtctcattgctgaggcatgccgtgatgcaggtgttgaactcggggaaataggactgatatcgttttcgaggggtccgggccttggaccagccctcaggaccgttgcaacagcagctagaacactcgcactttcacttgatgttccgatagttggtgttaaccactgcataggtcacatagagataggccggctcaccacaggggccagtgaccctgtttcactctatgtgagcggcgggaacacccaggtcatagccttcaacgagggaaggtaccgtgtcttcggtgaaaccctcgacatagccgtcggtaacatgctcgaccagtttgcaagggaatctggtctgggacacccgggcggtccggtcattgagcagcttgcattgaaggcctcagagtacattgaacttccctacagcgttaaggggatggatatatccttctcagggcttctaacggctgctttaagaaaaatggaggctggtgcaagccttgaggatctggcttacagcatccaggagacagcgttttccatgctggtggaggttacagagcgggccctggcatacacagaaaagaatcaggtcctcctctgtggtggagtggctgttaacaggcgtctgagggatatgctgagggagatgtgccaggagcaccacgtggaattccacatgcctccccctgagtactgtggtgataacggtgcgatgattgcctggctcggtcagctcgtctacaagtacagggggccggatgccctggaggacaccacggtggtgcagcgttaccggaccgatgaggtggatgtcccctggatgagggaatcagaggcaggaatagagctcccccctgacatcctggccaagggtgccgaggcaaatatctacaggggccagtggattgggaggccctgcataataaaggagaggatatccaagggttacagaatacctgaaattgatcagaagctcaggtcatccaggacccggagggaggccaggctcatcaaccaggccaagggcgccggtgtgcacacaccagtactgttcgatgtcgaccctgatggaggggttatggtcatggaggaggttcgcggcaccccattcagggacgctgttgaggatacagagctctgttcaaggatcggtgaggccatagggaggctccatcacgcgggtataatacacggggatctcacaggatccaacataatcatcagggggggtgatgtggtcttcatagactttggacttgggaggttctcagatgaaatcgaggatatgggtgtggatctccttgtcctcaaaaagtcccttgaaagcacccactacgccctggccggcgagtgtttcagcagggtccttgaggggtacggtaagataatagatgctgacatccagtcaaagataagggagatagagtcccggggaagatacactgactga

SEQ ID NO: 45987 - protein, 534 aa, Methanobacterium thermoautotrophicum
MLCLGIEGTAEKTGVGIVDEAGNVLSLRGKPLIPEKGGIHPREAAEHHAKWIPRLIAEACRDAGVELGEIGLISFSRGPGLGPALRTVATAARTLALSLDVPIVGVNHCIGHIEIGRLTTGASDPVSLYVSGGNTQVIAFNEGRYRVFGETLDIAVGNMLDQFARESGLGHPGGPVIEQLALKASEYIELPYSVKGMDISFSGLLTAALRKMEAGASLEDLAYSIQETAFSMLVEVTERALAYTEKNQVLLCGGVAVNRRLRDMLREMCQEHHVEFHMPPPEYCGDNGAMIAWLGQLVYKYRGPDALEDTTVVQRYRTDEVDVPWMRESEAGIELPPDILAKGAEANIYRGQWIGRPCIIKERISKGYRIPEIDQKLRSSRTRREARLINQAKGAGVHTPVLFDVDPDGGVMVMEEVRGTPFRDAVEDTELCSRIGEAIGRLHHAGIIHGDLTGSNIIIRGGDVVFIDFGLGRFSDEIEDMGVDLLVLKKSLESTHYALAGECFSRVLEGYGKIIDADIQSKIREIESRGRYTD

SEQ ID NO: 45988 - DNA, 1008 bp, Mus musculus
  CDS (1)..(1008)
atgcccgcggtgctggggttcgaaggcagcgccaacaagatcggcgtgggcgtggtccgcgacggcacggtgctggcgaacccgcggcgcacttacgtcacggccccgggcacgggattccttccaggtgacacggccaggcaccatcgagctgttatcctagacctactgcaggaggcgctagcagaggcaggattgacctccaaggacattgattgcattgctttcaccaaaggtcctggcatgggagccccattggcttctgtagctgttgttgcccgtacagtggcccagttgtggaataagcctttgcttggcgtgaaccactgcataggccacattgaaatgggccgtctcatcactggagccgttaacccaactgtcctgtatgtgagcggaggaaatacccaggtgatttcctactcagaacatcgttatcgcatctttggagaaactattgatatcgccgtgggaaactgcctggatcgttttgctcgggtgctgaagatttccaatgaccccagtccaggctacaacattgagcagatggcaaagcgaggcaagaagctagtcgagctgccatatactgtaaaggggatggatgtctcgttttcagggattctgtctttcattgaggatgcagcgcagcgaatgctggccactggagagtgtactcctgaagacctgtgtttctccttacaggaaaccgtgtttgcaatgctagtggaaatcacggagcgagccatggcacactgtggctccaaggaagccctcatcgtcggaggagttggatgtaacctgaggctgcaggagatgatggggacaatgtgccaggagcggggagcccagctctttgcaacagatgagagattctgcgttgacaatggagccatgatagcacaagctggttgggagatgtttcaggctgggcacaggactcctctcaaagattctgcaattactcagaggtataggacagatgaagtggaagtgacatggagggactaa

SEQ ID NO: 45989 - protein, 335 aa, Mus musculus
MPAVLGFEGSANKIGVGVVRDGTVLANPRRTYVTAPGTGFLPGDTARHHRAVILDLLQEALAEAGLTSKDIDCIAFTKGPGMGAPLASVAVVARTVAQLWNKPLLGVNHCIGHIEMGRLITGAVNPTVLYVSGGNTQVISYSEHRYRIFGETIDIAVGNCLDRFARVLKISNDPSPGYNIEQMAKRGKKLVELPYTVKGMDVSFSGILSFIEDAAQRMLATGECTPEDLCFSLQETVFAMLVEITERAMAHCGSKEALIVGGVGCNLRLQEMMGTMCQERGAQLFATDERFCVDNGAMIAQAGWEMFQAGHRTPLKDSAITQRYRTDEVEVTWRD

SEQ ID NO: 45990 - DNA, 978 bp, Pasteurella haemolytica
  CDS (1)..(978)
atgcgaattttaggtattgaaacctcttgtgatgaaaccggtgttgccatttatgatgaagacaaaggcttagtggcaaaccagctttatagccaaattgatatgcacgccgattacggtggcgtagtccctgaactggcttctcgagaccatatccgtaaaacgttgccactaattcaagaagccttaaaagaggccaatctgcaaccctcggatattgacggcattgcctatactgccggcccaggcttggtcggggctttattggtcggctcaaccattgcccgttcgctggcttatgcttggaatgttccggcattgggcgttcaccatatggaagggcatttacttgccccaatgttggaagaaaatgcccctgaatttccgtttgtggcattattgatttcaggtggacacacccaactggtaaaagttgacggcgttgggcaatacgaactactcggggaatcaattgatgatgctgccggtgaagcctttgacaaaacaggcaaactactcggtttggattaccctgccggtgtagcgatgtcaaaattagccgaatccggcacgccaaatcgttttaaattccctcgtccaatgaccgacagaccgggactggatttcagtttctccggtttaaaaacctttgctgcgaatacgattaaagccaatcttaatgaaaatggtgaactcgatgagcaaaccaaatgcgatattgcccacgcattccaacaagccgtggttgatactattttaattaaatgcaagcgagcgttagagcaaaccggctataaacgcttagtaatggcaggcggcgtaagtgccaataaacaattacgagcagaccttgcggaaatgatgaaaaaattaaaaggcgaagtattctaccctcgcccacaattttgcactgacaacggcgcaatgattgcctacactggctttcttcgcttaaaaacgatgaacaaaccgacttaa

SEQ ID NO: 45991 - protein, 325 aa, Pasteurella haemolytica
MRILGIETSCDETGVAIYDEDKGLVANQLYSQIDMHADYGGVVPELASRDHIRKTLPLIQEALKEANLQPSDIDGIAYTAGPGLVGALLVGSTIARSLAYAWNVPALGVHHMEGHLLAPMLEENAPEFPFVALLISGGHTQLVKVDGVGQYELLGESIDDAAGEAFDKTGKLLGLDYPAGVAMSKLAESGTPNRFKFPRPMTDRPGLDFSFSGLKTFAANTIKANLNENGELDEQTKCDIAHAFQQAVVDTILIKCKRALEQTGYKRLVMAGGVSANKQLRADLAEMMKKLKGEVFYPRPQFCTDNGAMIAYTGFLRLKTMNKPT

SEQ ID NO: 45992 - DNA, 975 bp, Pyrococcus abyssi
  CDS (1)..(975)
atgctagccctgggcattgaggggacggcacacacattgggaataggaatagtttcggaagataaagtattagcaaatgtttttgacacattaacaactgaaaagggaggaattcatcccaaagaagctgcagagcatcatgctaggttaatgaagcccttgttgaggaaagcattatctgaggctggagtttcgttggatgatatagacgttatagcgttctcccagggaccaggattgggacccgcacttagggttgtcgctacggcggcgagggctttggcggttaaatataggaaaccgatagttggggtaaaccactgtatagcccatgtagagataacaaagatgttcggagtgaaagacccagttggcctttatgttagtggcgggaacacccaagttctggcccttgaaggaggaaggtatagggtatttggagagaccctagatataggaatcggaaacgccatagatgtctttgcaagggaactcggattggggttccctggggggccaaaggtagagaagctagcagagaaaggggagaaatacattgagttaccatatgccgttaaaggcatggacttaagcttttctggactcttaacggaagccattaggaagtatagaagtggaaaatacagggtagaggatttagcgtattcatttcaggaaactgcatttgcggcattagttgaggtaacggaaagggcagttgcccacacggaaaaagatgaggtagtcctcgttggaggggttgcagcgaacaataggcttagggaaatgctcagaataatgacagaggatagaggtataaagttcttcgtccctccttatgacttgtgccgggataatggggccatgatagcctatacaggcttaaggatgtataaggcgggaatcagcttcaggcttgaggaaactatagtcaagcagaagttcaggactgatgaggtggagattgtatggtaa

SEQ ID NO: 45993 - protein, 324 aa, Pyrococcus abyssi
MLALGIEGTAHTLGIGIVSEDKVLANVFDTLTTEKGGIHPKEAAEHHARLMKPLLRKALSEAGVSLDDIDVIAFSQGPGLGPALRVVATAARALAVKYRKPIVGVNHCIAHVEITKMFGVKDPVGLYVSGGNTQVLALEGGRYRVFGETLDIGIGNAIDVFARELGLGFPGGPKVEKLAEKGEKYIELPYAVKGMDLSFSGLLTEAIRKYRSGKYRVEDLAYSFQETAFAALVEVTERAVAHTEKDEVVLVGGVAANNRLREMLRIMTEDRGIKFFVPPYDLCRDNGAMIAYTGLRMYKAGISFRLEETIVKQKFRTDEVEIVW

SEQ ID NO: 45994 - DNA, 975 bp, Pyrococcus horikoshii
  CDS (1)..(975)
atgctagcattgggaattgaaggaactgcccatacacttggaattggaatagtgagtgagaaaaaggtacttgctaatgtttttgatactttaactactgaaaaagggggaatacatccaaaagaagctgccgaacaccatgcaaggctaatgaaaccactattaaagaaagccctagaaaaagcagggatttcaatggatgatatagatgtaatagccttctcccagggacctggcctggggccagctttaagggtagttgctaccgcagcaagggctttagcaattcgatacaataagccaatagtcggagttaaccactgtatagctcatgttgagataacgaagatgtttggaataaaggatcctgtgggattgtacgtgagtggaggcaacacacaggttctggcattggaaggggggaggtatagggtatttggggagaccctagacattggaataggaaatgctatagatgtctttgcaagagagctaggcttaggttttcccggaggtcctaagcttgaaaagctagccgaaaaaggtaagaattatatagaccttccatacgccgttaaaggaatggatctaagtttttccggtcttttaactgaagcgataaggaagtacagaagcgggaagtttagggtcgaggatctagcatactcatttcaagaaaccgcgtttgccgcactagttgaagttactgagagagcattagcccatactgagaaaaaggaggtagtcctggtcggaggagttgccgccaataacaggcttagggaaatgctaaaaataatggccgaggataggggggttaagttcttcgttcctccctatgatctatgcagagacaacggtgcaatgatagcgtacacaggattaagaatgtataaggccgggattagcttcccactagagaagacaatagtaaaacagaagttcagaaccgatgaggtggagataacatggtga

SEQ ID NO: 45995 - protein, 324 aa, Pyrococcus horikoshii
MLALGIEGTAHTLGIGIVSEKKVLANVFDTLTTEKGGIHPKEAAEHHARLMKPLLKKALEKAGISMDDIDVIAFSQGPGLGPALRVVATAARALAIRYNKPIVGVNHCIAHVEITKMFGIKDPVGLYVSGGNTQVLALEGGRYRVFGETLDIGIGNAIDVFARELGLGFPGGPKLEKLAEKGKNYIDLPYAVKGMDLSFSGLLTEAIRKYRSGKFRVEDLAYSFQETAFAALVEVTERALAHTEKKEVVLVGGVAANNRLREMLKIMAEDRGVKFFVPPYDLCRDNGAMIAYTGLRMYKAGISFPLEKTIVKQKFRTDEVEITW

SEQ ID NO: 45996 - DNA, 1014 bp, Salmonella typhimurium
  CDS (1)..(1014)
atgcgtgtactgggtattgaaacatcctgcgatgaaaccggcatcgctatttacgacgacaaaaagggtctgttagccaaccaattgtatagtcaggtgaaattacatgctgactacggcggcgtagtgcctgaactggcttcccgcgatcatgtgcgtaaaaccgtgccgctgattcaggcggcattaaaagaagccggtctgacggcgagcgatatcgacgcggtggcctataccgcaggcccgggcctggtcggcgcgctgctggtcggcgcaaccgtcgggcgttcactggcatttgcctggaatgtgccggccattcctgtacaccatatggaaggtcatctgctggcgccaatgctggaagataatcccccggaattcccgtttgtggcgctactggtctccggcggacatacgcagctcattagcgtgaccggaatcggtcagtacgaactgctgggagagtcgattgacgatgccgccggtgaagcgtttgataaaaccgccaaattgttggggctggattatcctggcggcccgatgctgtcgaaaatggcgtcgcaggggacggcggggcgttttgtctttccgcgcccgatgaccgatcgtccggggctggattttagtttttccggtctgaaaacctttgccgctaacaccattcgtagtaatggcggcgacgaacaaactcgcgctgatatcgcgcgcgcttttgaagatgcggtcgtggatacgctgatgatcaagtgcaagcgcgcgctggaaagcaccggttttaagcgtctggtcatggcgggcggcgtcagcgctaaccgcacgctgcgcgcgaagcttgccgaaatgatgcaaaaacgccgcggcgaagtgttctatgcgcgtccggagttttgtaccgacaacggggcgatgatcgcctatgccggaatggtgcggtttaaggcgggcgttacggcggatcttggcgtaacggtacgtccgcgctggccgctggccgagctgccggcggcgtaa

SEQ ID NO: 45997 - protein, 337 aa, Salmonella typhimurium
MRVLGIETSCDETGIAIYDDKKGLLANQLYSQVKLHADYGGVVPELASRDHVRKTVPLIQAALKEAGLTASDIDAVAYTAGPGLVGALLVGATVGRSLAFAWNVPAIPVHHMEGHLLAPMLEDNPPEFPFVALLVSGGHTQLISVTGIGQYELLGESIDDAAGEAFDKTAKLLGLDYPGGPMLSKMASQGTAGRFVFPRPMTDRPGLDFSFSGLKTFAANTIRSNGGDEQTRADIARAFEDAVVDTLMIKCKRALESTGFKRLVMAGGVSANRTLRAKLAEMMQKRRGEVFYARPEFCTDNGAMIAYAGMVRFKAGVTADLGVTVRPRWPLAELPAA

SEQ ID NO: 45998 - DNA, 1047 bp, Synechocystis sp
  CDS (1)..(1047)
atggcaatcattttagcaattgaaacaagttgtgatgaaactgcggtggcaattgtaaataatcgtaacgtttgcagtaatgtggtttcttcccaaatacaaacccatcaaattttcggcggggtagtaccggaagtggcctctcgccagcatttacttttaattaatacctgtctcgaccaagctttgcaagcaagtggtttgggttggccagaaattgaggcgatcgccgtgaccgtggctccggggttggcaggggcgttgatggtgggggtgacggcggctaaaaccctagccatggtgcatcaaaaaccttttttaggggtgcatcatctggaaggtcatatctacgccagctatctgagtcaaccggatttgcaaccaccatttttgtgtttgctagtttccggtggccacaccagtttgatccacgttaaaggttgtggggattaccgacaattgggcaccaccagggacgatgcggccggggaagcctttgataaggtagctcgtttgctggatttaggttacccagggggccctgccattgaccgggcggctaaacagggcgatccagggacgtttaaattaccagaaggaaaaatttccttgccccaaggaggatatcatccctacgattccagctttagtggtttaaaaacggccatgttacgcctcactcaggaacttaaacagagttcagctcccttgcctgtggatgatttagcggccagtttccaagatacggtggcccgttctttgaccaaaaagaccattcagtgtgtcctagaccatggcttaaccaccattaccgtcgggggaggggtggccgccaatagtcgtttacgctatcatctccaaaccgccgcccaagaacatcaattgcaagtcttttttccgcccctaaagttttgcaccgacaatgccgctatgattgcctgtgccgccgctgaccatttccaaaacggcgatcgctcccctttaactttaggtgtccagtctcgcctctcggtggaacaagtcagccagttgtatgagcgcaattaa

SEQ ID NO: 45999 - protein, 348 aa, Synechocystis sp
MAIILAIETSCDETAVAIVNNRNVCSNVVSSQIQTHQIFGGVVPEVASRQHLLLINTCLDQALQASGLGWPEIEAIAVTVAPGLAGALMVGVTAAKTLAMVHQKPFLGVHHLEGHIYASYLSQPDLQPPFLCLLVSGGHTSLIHVKGCGDYRQLGTTRDDAAGEAFDKVARLLDLGYPGGPAIDRAAKQGDPGTFKLPEGKISLPQGGYHPYDSSFSGLKTAMLRLTQELKQSSAPLPVDDLAASFQDTVARSLTKKTIQCVLDHGLTTITVGGGVAANSRLRYHLQTAAQEHQLQVFFPPLKFCTDNAAMIACAAADHFQNGDRSPLTLGVQSRLSVEQVSQLYERN

SEQ ID NO: 46000 - DNA, 1059 bp, Treponema pallidum
  CDS (1)..(1059)
gtgaatgtcctcggaattgagacctcttgtgatgagactgcagttgcaattgtaaaagatggcacgcacgtgtgcagcaatgttgtggctacgcaaattccttttcatgcgccgtatcgtggcattgtcccagaacttgcaagtcgcaagcacattgagtggattttgccaacggtgaaagaggcgcttgcacgcgctcagctgacgcttgctgatatcgatggcatcgccgtaacacatgcacctgggctgaccggatctctcctggtaggcctgacgtttgcgaaaacactcgcatggtcaatgcaccttcctttcattgcggttaatcaccttcatgcacacttttgtgccgcgcacgtggagcacgatctggcatatccctacgtgggcttgctggcgtctggaggacatgcgctcgtatgtgttgtgcacgattttgatcaggtagaagcgcttggcgcaacgatcgacgacgctcccggggaagcctttgataaggttgcagccttttatggctttggatatccgggaggcaaggtaattgaaacgttagcagaacagggtgacgcgcgtgccgcgcgttttccgcttcctcattttcacggaaaagggcatcggtatgatgtatcatattcaggattgaagacagcagttattcatcagctcgatcacttttggaacaaggaatacgagcgcactgcgcagaacattgctgcggcgtttcaagcgtgtgcaatcaacatcttgctccgtccgcttgcgcgcgcattacaggatacagggctgccaacggcagtagtgtgcggaggtgttgcagcaaacagtttgctcagaaaatctgtagcggactggaagcatgcgcggtgtgtgttcccttcgcgtgagtactgtacagacaacgcggtgatggttgctgcgctcgggtaccgctatttgatccgtggtgataggagtttctatggggtaacagagcgttcgcgcattgcgcacttcagtaagcgcgggggagatcgtctcgctgcacagagaagcgctgcttctcagcctcttttttga

SEQ ID NO: 46001 - protein, 352 aa, Treponema pallidum
MNVLGIETSCDETAVAIVKDGTHVCSNVVATQIPFHAPYRGIVPELASRKHIEWILPTVKEALARAQLTLADIDGIAVTHAPGLTGSLLVGLTFAKTLAWSMHLPFIAVNHLHAHFCAAHVEHDLAYPYVGLLASGGHALVCVVHDFDQVEALGATIDDAPGEAFDKVAAFYGFGYPGGKVIETLAEQGDARAARFPLPHFHGKGHRYDVSYSGLKTAVIHQLDHFWNKEYERTAQNIAAAFQACAINILLRPLARALQDTGLPTAVVCGGVAANSLLRKSVADWKHARCVFPSREYCTDNAVMVAALGYRYLIRGDRSFYGVTERSRIAHFSKRGGDRLAAQRSAASQPLF

SEQ ID NO: 46002 - DNA, 1008 bp, Xenopus laevis
  CDS (1)..(1008)
atgaccattgttgttgggttcgaggggagtgccaacaagattggtgtaggaataatccaagatgggaaagtgctgagcaatccacgaagaacctacatcactcctccaggacagggcttcatgccaagtgacactgcacgtcaccatcgttcctgtatcctagatgtgctgcaagaagcgctcgaggaatcaaatataaagccggaagatgtagattgtgtagcttataccaaaggccctggaatgggagcccctctgctgtcagtagctatagtggctcggacagtcgcacagctttggaagaagcccctattgggtgttaatcactgtattgggcatattgaaatgggaaggctgataactggtgcagaaaatcccactgtgctgtatgtgagcgggggcaacacacaggtaattgcatattcagagcgctgctatcgaatatttggggaaacaatagatattgctgtgggaaactgtttggatcgatttgccagagtgctaaagatatccaatgaccccagtcctggttataatattgaacagatggcaaagaaaggcaagaagtttgtggaattgccatatacagttaaaggaatggatgtgtcattctctggaattctgtcttacatcgaggacatgtctcataagatgctgtcatctggagaatgtacccctgaggatctctgcttctctctacaggagaccctcttctctatgctggtggaaattacagagcgggcaatggcacattgtgggtcacaagaagttctgatagtgggaggcgttggctgtaatgtacgtttacaagaaatgatgggagtgatgtgtgaggaacgtggagctaagatttttgcaacagatgaaagattctgcatagataatggagctatgattgcacaggctggatgggagatgttccgcgctggacaagtaaccaatctgcaggattcatggataacccaaaggtaccgcactgatgaggtggaagtgacatggagagattaa

SEQ ID NO: 46003 - protein, 335 aa, Xenopus laevis
MTIVVGFEGSANKIGVGIIQDGKVLSNPRRTYITPPGQGFMPSDTARHHRSCILDVLQEALEESNIKPEDVDCVAYTKGPGMGAPLLSVAIVARTVAQLWKKPLLGVNHCIGHIEMGRLITGAENPTVLYVSGGNTQVIAYSERCYRIFGETIDIAVGNCLDRFARVLKISNDPSPGYNIEQMAKKGKKFVELPYTVKGMDVSFSGILSYIEDMSHKMLSSGECTPEDLCFSLQETLFSMLVEITERAMAHCGSQEVLIVGGVGCNVRLQEMMGVMCEERGAKIFATDERFCIDNGAMIAQAGWEMFRAGQVTNLQDSWITQRYRTDEVEVTWRD

SEQ ID NO: 46004 - DNA, 1224 bp, Saccharomyces cerevisiae
  CDS (1)..(1224)
atgatatcaataaaaggaaccggaagatttctcctcgataactatagaatttggcagaggcgtgcattcaacagaccaatacagttaagaaaaggctataaagttttagccattgagacttcttgcgatgatacatgcgtttcagttttggacaggttctcaaaaagtgcagctcctaatgtgctagccaatttgaaagatactttagatagtattgacgaaggaggtattataccaacaaaggctcatatccatcaccaagctcggataggacccttaaccgaaagagccctgatagaaagcaatgcgagagaaggaattgatctcatatgtgttacaagaggccctggtatgcctggttcattatcaggaggattagattttgcaaaaggtttagctgttgcctggaacaaaccactgattggtgtgcatcacatgctgggacacttgctgataccaagaatgggtacaaatggaaaagtgcctcaatttccctttgttagcctgctggttagtggtggtcatactacgtttgttttgtcacgagcaattgacgatcacgaaatattatgtgatactatcgatattgcagtgggtgactcattagataaatgtggcagagagcttggattcaagggaacaatgatcgctagagaaatggagaaatttattaatcaagatattaacgaccaagattttgctttaaaactagaaatgcccagtccgttaaaaaacagcgctagtaaaagaaacatgctttcgttttcgttttcagcatttatcacagcattaagaactaatttgacaaaactaggtaaaacagaaatccaggaactgccagaacgcgaaatacggtcaattgcatatcaagtacaggaatctgttttcgaccatataataaataaactgaagcacgtgctcaagtcacaaccggaaaagtttaaaaacgtgcgtgaatttgtatgttctggtggagtgagtagtaatcaaaggttgagaacaaaattagaaacggaattggggacgttgaactccacaagcttttttaatttttattatcctcctatggacctttgtagtgacaactctattatgatcggctgggcaggtatcgagatatgggaaagcttacgattagttagtgatttagatatatgtccaattaggcaatggccattgaatgacctattaagtgttgatggttggagaacggaccagctatga

SEQ ID NO: 46005 - protein, 407 aa, Saccharomyces cerevisiae
MISIKGTGRFLLDNYRIWQRRAFNRPIQLRKGYKVLAIETSCDDTCVSVLDRFSKSAAPNVLANLKDTLDSIDEGGIIPTKAHIHHQARIGPLTERALIESNAREGIDLICVTRGPGMPGSLSGGLDFAKGLAVAWNKPLIGVHHMLGHLLIPRMGTNGKVPQFPFVSLLVSGGHTTFVLSRAIDDHEILCDTIDIAVGDSLDKCGRELGFKGTMIAREMEKFINQDINDQDFALKLEMPSPLKNSASKRNMLSFSFSAFITALRTNLTKLGKTEIQELPEREIRSIAYQVQESVFDHIINKLKHVLKSQPEKFKNVREFVCSGGVSSNQRLRTKLETELGTLNSTSFFNFYYPPMDLCSDNSIMIGWAGIEIWESLRLVSDLDICPIRQWPLNDLLSVDGWRTDQL

SEQ ID NO: 46006 - DNA, 23 bp, Primer
atgcgtgtactgggtattgaaac

SEQ ID NO: 46007 - DNA, 21 bp, Primer
ttacgcagccggtaactccgc

SEQ ID NO: 46008 - protein, 510 aa, consensus
  MISC_FEATURE (1)..(510): consensus for the disclosure of xaa see table XV
LXXEXSXXXXXXXXXXXXXXXXXXXXXXXXXXXXXXXXXXXXXXXXXXGXXGXXPXXAXXXHXXXXXXXXXXXXXXXXXXXXXXXXXXXXXXXXXXXXXXXXXXXAXTXXPGLXXXLXXGXXXAXXXXXXXXXPXXXVXHXXXHXXXXXXXXXXXXXXXXXXXXXXXXXXXXXXXXXXXXXXXXXXXXXXXXXXXXXXXXXXXXXXXXXXXXXXXXXXLXXSGGXXXXXXXXXXXXXXXXXXXXGXXXDXAXGXXXDKXAXXXXLXXPXXXXXXXXXGXXXXXXAXXGXXXXXXXXXXXXXXXXXXXXXXXXXXXXXXXXXXXXXXXXXXXSFSGXXXXXXXXXXXXXXXXXXXXXXXXXXXXXXXXXXXXXXXXXXXXXXXXXXXXXXXXXLXXXXXXAXXXXXXXXXXXXXXXXXXXXXXXXXXXXXXXXXXXGGVXXNXXLRXXXXXXXXXXXXXXXXXXXXXXXXXXXXXXXXXXXXXXXXXXXXXXXXXXXXXXXXCXDNXXMIA

SEQ ID NO: 46009 - protein, 43 aa, consensus
  MISC_FEATURE (1)..(43): consensus for the disclosure of xaa see table XV
XXXXXXXXXPGXXXXXXXXXXXXXXXXXXXXXXXXXXXHXXXH

SEQ ID NO: 46010 - protein, 120 aa, consensus
  MISC_FEATURE (1)..(120): consensus for the disclosure of xaa see table XV
XXXXXSGXXXXXXXXXXXXXXXXXXXXXXXXXDXXXGXXXDXXXXXXXXXXXXXXXXXXXXXXXXXXXXXXXXXXXXXXXXXXXXXXXXXXXXXXXXXXXXXXXXXXXXXXXXXXSXXXX

SEQ ID NO: 46011 - protein, 59 aa, consensus
  MISC_FEATURE (1)..(59): consensus for the disclosure of xaa see table XV
XXXXGGXXXNXXXXXXXXXXXXXXXXXXXXXXXXXXXXXXXXXXXXXXXDNXXMXXXXX

SEQ ID NO: 46012 - DNA, 945 bp, Escherichia coli
  CDS (1)..(945)
atgagtcgtcctcgtcgtcgcggtcgcgacattaacggcgttttgttgctggataaaccgcagggtatgtccagcaacgatgcgctgcaaaaagtgaaacgtatatataacgccaatcgtgccgggcataccggtgcgctggacccgctggcgaccggcatgttgccgatttgcctcggggaagcgacgaagttttcccagtatctgctggactccgacaaacgctatcgggtcattgcgcgtcttggacagcgtaccgatacttctgacgccgacggacaaatcgttgaagagcgtccggtaacctttagtgcagaacaactggcggcggcactggatactttccgtggcgatatcgaacagatcccatcgatgtattcagcactgaaataccagggcaaaaaactgtacgaatatgcgcgtcagggcattgaagttccgcgtgaagcgcgtccaattaccgtttatgaattgctgtttattcgccatgaaggcaatgagctggagctggaaattcactgctcaaaaggcacttatatccgcaccatcattgatgacctgggtgaaaaactcggctgtggcgcgcatgtgatttacctgcgtcgtctggcggtaagtaaatatccggttgaacggatggtgaccctggagcacctgcgtgaactggtcgaacaagccgaacagcaggatattccggctgcggagttgcttgatccattactgatgccaatggacagtccagcttcggactacccggtggtgaatcttccgttaacgtcttctgtttacttcaaaaatggtaacccggttcgtacatctggcgcgccgctggaaggactggttcgcgttacggaaggtgagaacggcaagtttatcggtatgggcgaaattgacgatgaaggccgcgttgcgcctcgtcgtctggtggttgaatacccggcgtaa

SEQ ID NO: 46013 - protein, 314 aa, Escherichia coli
MSRPRRRGRDINGVLLLDKPQGMSSNDALQKVKRIYNANRAGHTGALDPLATGMLPICLGEATKFSQYLLDSDKRYRVIARLGQRTDTSDADGQIVEERPVTFSAEQLAAALDTFRGDIEQIPSMYSALKYQGKKLYEYARQGIEVPREARPITVYELLFIRHEGNELELEIHCSKGTYIRTIIDDLGEKLGCGAHVIYLRRLAVSKYPVERMVTLEHLRELVEQAEQQDIPAAELLDPLLMPMDSPASDYPVVNLPLTSSVYFKNGNPVRTSGAPLEGLVRVTEGENGKFIGMGEIDDEGRVAPRRLVVEYPA

SEQ ID NO: 46014 - DNA, 1017 bp, Thermococcus kodakaraensis
  CDS (1)..(1017)
atggcgagggacgaagtgaggaggatccttcccgctgacatcaagagggaagtggttgtgaaggacgagaaggccgagacgaatccgaagtggggctttccgccggagaaacggccaatcgagatgcacatccagttcggcataatcaacctcgacaagccgcccgggccgacgagccacgaggtcgtcgcctgggtcaagaggatactgaaccttaacaaggcaggacacggtggaacgctagatccgaaggtcagtggagtccttccggttgccctggagagagcaacaagggttgtgcaggcccttctgccagctggaaaggagtacgtggctttaatgcacctccacggcgacgttcccgaggacaaaatactcgccgttatgagggagttccagggggagataatccagaggccgcccctgaggagtgccgtcaagagacgccttaggacgaggaaggtctactacatagacgtgctggagatagaaggtagggacgttctcttcagggttggagtcgaggccggaacctacatccgttcgctcatccaccacattggccttgcccttggggtcggcgcccacatggccgaacttagaaggaccagaagtggccccttcaaggaggatgagaccctcgtgaccctccatgaccttgtggactactaccacttctggaaggaggacggggttgaggagtacttcaggaaggcaatccagccgatggagaaggcagtggaacatctgcccaaggtctggataagggactccgcagttgccgctgttactcacggcgctgatttagcagttcccggcgtagtcaagctccacaagggcataaagaagggagacctcgtcgcaataatgaccctcaaggacgagcttgttgcactgggcaaagccatgatgacaaccggggagatgctccagaagagcaagggcatagcggtcgatgtggacaaagtcttcatgccaagggactggtatcccaagctgtggaaggagaaagagtga

SEQ ID NO: 46015 - protein, 338 aa, Thermococcus kodakaraensis
MARDEVRRILPADIKREVVVKDEKAETNPKWGFPPEKRPIEMHIQFGIINLDKPPGPTSHEVVAWVKRILNLNKAGHGGTLDPKVSGVLPVALERATRVVQALLPAGKEYVALMHLHGDVPEDKILAVMREFQGEIIQRPPLRSAVKRRLRTRKVYYIDVLEIEGRDVLFRVGVEAGTYIRSLIHHIGLALGVGAHMAELRRTRSGPFKEDETLVTLHDLVDYYHFWKEDGVEEYFRKAIQPMEKAVEHLPKVWIRDSAVAAVTHGADLAVPGVVKLHKGIKKGDLVAIMTLKDELVALGKAMMTTGEMLQKSKGIAVDVDKVFMPRDWYPKLWKEKE

SEQ ID NO: 46016 - DNA, 918 bp, Staphylococcus aureus subsp. aureus COL
  CDS (1)..(918)
atgtataatgggatattaccagtatataaagagcgcggtttaacaagtcatgacgttgtattcaaattgcgtaaaatattaaaaactaaaaaaataggtcacacgggtacgcttgatcccgaagttgcaggcgtgttaccggtatgtataggtaatgcaacgagagttagtgattatgttatggatatgggcaaagcttatgaagcaactgtatcgataggaagaagtacaacgactgaagatcaaacgggtgatacattggaaacaaaaggtgtacactcagcagattttaataaggacgatattgaccgattgttagaaagttttaaaggtatcattgaacaaattccgccgatgtactcatccgtcaaagtaaatggtaaaaaattatatgaatatgcgcgtaataatgaaacagttgaaagaccaaagcgtaaagttaatattaaagacattgggcgtatatctgaattagattttaaagaaaatgagtgtcattttaaaatacgcgtcatctgtggtaaaggtacatatattagaacgctagcaactgatattggtgtgaaattaggctttccggcacatatgtcgaaattaacacgaatcgagtctggtggatttgtgttgaaagatagccttacattagaacaaataaaagaacttcatgagcaggattcattgcaaaataaattgtttcctttagaatatggattaaagggtttgccaagcattaaaattaaagattcgcacataaaaaaacgtattttaaatgggcagaaatttaataaaaatgaatttgataacaaaattaaagaccaaattgtatttattgatgatgattcagaaaaagtattagcaatttatatggtacaccctacaaaagaatcagaaattaaacctaaaaaagtctttaattaa

SEQ ID NO: 46017 - protein, 305 aa, Staphylococcus aureus subsp. aureus COL
MYNGILPVYKERGLTSHDVVFKLRKILKTKKIGHTGTLDPEVAGVLPVCIGNATRVSDYVMDMGKAYEATVSIGRSTTTEDQTGDTLETKGVHSADFNKDDIDRLLESFKGIIEQIPPMYSSVKVNGKKLYEYARNNETVERPKRKVNIKDIGRISELDFKENECHFKIRVICGKGTYIRTLATDIGVKLGFPAHMSKLTRIESGGFVLKDSLTLEQIKELHEQDSLQNKLFPLEYGLKGLPSIKIKDSHIKKRILNGQKFNKNEFDNKIKDQIVFIDDDSEKVLAIYMVHPTKESEIKPKKVFN

SEQ ID NO: 46018 - DNA, 1002 bp, Gluconobacter oxydans 621H
  CDS (1)..(1002)
atgggcaggaaacgtggacgcgatatcgacgggtggctgattcttgacaagccgctggggccgacctccacggatatggtcaacaagctgcgatgggcttttgatgcgaaaaaagccggtcatggtggaacgctcgatccgctggcgtccggtgtgctgccgattgcgttcggcaaggccacccggaccattccctacatcatggacgcgacaaagcgttaccgcttcaccctgactttcggtgaaagccggacgacggatgatcttgaaggcgaggttctggcgacatctccgaaccgtccgaccgatgaccagatccgtgctgttctgccggcactcaccggtaatgtcatgcaggtgcctccagttttttcggcactccgggtcgggggagagcgggcctatgacatggcgcgggccggccggccgcctgaacttccgccgcgtccggcgcggatcgattcgataacgctggtggaacgtccggacgccaatacggccgtcttcgacgtccagtcaggcaagggcgtctatatgcgctcgctcgcgcgtgacattgcgctggcctgcggaacggtcgggcatatttcggtgctgcggcggacgaagtgcgggccgttcgatctgagccacgcactgacgatcgatcagatatcactggacaaatcgactcaaactgtggacaacgccgatgctcttccggctcctctgctggatgcggcgaccgcgctggtcgacatcccggcgctggccgtcaccgatgcggagggaaggatgcttgtctgggggcagtcgatagaccccgcggacctcgtgcatcctctgccggcatcgtcgcagggggaagaccacctgtggcgcgcgatgatcggagagcacgtgctgggtctgtgtcatgtccgtcatgggcggctcagggcagcgcgtatgctggaaaaccacgagttttttggagaacacgatgtcgattaccgcagaacgccgcacggcactgatttctga

SEQ ID NO: 46019 - protein, 333 aa, Gluconobacter oxydans 621H
MGRKRGRDIDGWLILDKPLGPTSTDMVNKLRWAFDAKKAGHGGTLDPLASGVLPIAFGKATRTIPYIMDATKRYRFTLTFGESRTTDDLEGEVLATSPNRPTDDQIRAVLPALTGNVMQVPPVFSALRVGGERAYDMARAGRPPELPPRPARIDSITLVERPDANTAVFDVQSGKGVYMRSLARDIALACGTVGHISVLRRTKCGPFDLSHALTIDQISLDKSTQTVDNADALPAPLLDAATALVDIPALAVTDAEGRMLVWGQSIDPADLVHPLPASSQGEDHLWRAMIGEHVLGLCHVRHGRLRAARMLENHEFFGEHDVDYRRTPHGTDF

SEQ ID NO: 46020 - DNA, 1017 bp, Mus musculus
  CDS (1)..(1017)
atggcagctgcagaggcagaggtggtttcacctctgattgtggacacagctcctgacacttcaggaacagccgaggcctctgtagcagcatcggtggcggaagcggccaggactgaatcgcaagccccggcctccaaggccgccctggctgctaagctcatgtcgctgagcggcgtgttcgccgtgcacaagcccaaagggcccacttcagccgagctgctgaaccggctgaaggagaagctgctggcagaagctggaatgccttctccagaatggaacaagaggcaaaagcagacattgaaagtcggacacggagggacgctggacagtgcagcgcaaggtgttctggtggttgggattggaagaggaacaaaaatgttgaccagtatgttgtcggggtccaagaggtatatcaccatcggagaactggggaaagccacggacaccctggattctactgggaaggtaacggaagagaagccgtatgataaaataacacgagaagatatcgaaggcattctgcagaagtttactgggaatataatgcaagtacccccgctctattctgcgctgaagaaggatgggcagagactctcaacgctaatgaagaaaggcaaggtggtggaggccagaccggcccggcccgtgactgtccacagtatctccctcctgaagttccagcctccgttcttcacgctggatgttgaatgcggaggaggcttttacatccggagcctggtcagtgacatcggcaaagagctctcttcctgtgccagcgtgctggagctgacccgcaccaaacaggggcccttcacacttgcacagcacgccctccccgaagacaggtggaccatcgatgacatcgaacagtccctcgagcgctgcacgtctcttctgccggaggagctgacatttaaaaaactaaaatctgacaactccagtgaccaggttataagctgtggatatataactctcagggacacaaagagagaagatgacgcagttaagacactgtga

SEQ ID NO: 46021 - protein, 338 aa, Mus musculus
MAAAEAEVVSPLIVDTAPDTSGTAEASVAASVAEAARTESQAPASKAALAAKLMSLSGVFAVHKPKGPTSAELLNRLKEKLLAEAGMPSPEWNKRQKQTLKVGHGGTLDSAAQGVLVVGIGRGTKMLTSMLSGSKRYITIGELGKATDTLDSTGKVTEEKPYDKITREDIEGILQKFTGNIMQVPPLYSALKKDGQRLSTLMKKGKVVEARPARPVTVHSISLLKFQPPFFTLDVECGGGFYIRSLVSDIGKELSSCASVLELTRTKQGPFTLAQHALPEDRWTIDDIEQSLERCTSLLPEELTFKKLKSDNSSDQVISCGYITLRDTKREDDAVKTL

SEQ ID NO: 46022 - DNA, 1623 bp, Arabidopsis thaliana
  CDS (1)..(1623)
atggcgaaatctctacacttcacaagactaatgtcttcttcagcaagaatgtcaatgacttctcctctcttcttctcctcagtcaaaccatggagaaacatccataaaccctacttggcttctctcttcctctccacaacatctactcgatacccacttcaatacgacatgatcatcaatcgtcccacacaatcatctctctctcaaaaccgtcgtcgtccccctaaagccatcgaatccggtgcacctgactcagcagagccggaattcgattcatgggtcgacaataaactggctatggagcgtgaacagggtcgacccggttctggagatccggaaatggataaagccaagaggaaatactacagtaagagaaggaagagactatacgggtctgattctgaagatgagaccagtagcagaaaatcagatgaaggattcgttgaattgaaacctgaagttgttgaatttgataggttacatcagagagaagaggaattgtatttttatgatacttttgcttatccatgggagaaagataagcattataagatggtgtatcagttagagaagaagtattatcctgaccagtgtttagataaggcgtttctgcaacctggagaagttttgaagaagagtgatgattctgggaaagttagagggaagaagaaagtagtagcagcacttggtgggaagagaagtgaggttaaacgaattggtatggagaattgtgatgaggatgatgataagttggtgttttttgatgaagtgaaggagaaggaggagaagaagaagtcagaggatgatgttgttgttgttactgagaagaaagtggaacagttctttaagggtttaacgaaatctcccaatgagaaaggtatggctagtggtggtggtgatggagaaccttttcttgttacgagaaacggtgaacttcctcctagatgggatggtcctaacggtacagtgcttttggtgaacaaacctaaaggatggacttctttcactgtctgtggtaagctacgacgattagtcaaagtgaaaaaggtgggtcatgctggaacacttgatcccatggctactggtctattaatcgtctgcgtcggtaaagccactaaggttgttgacagataccaaggtatgatcaaaggttatagcggagtttttcgtcttggtgaagccacttcaactctagacgctgactctcctgtgattcagcgagagtcttgggagcatataaaagatgatgacattaagaaagctttgacatcatttcttggagaaatatggcaagttccaccgatgttctctgcgataaaagttggaggtgagaagatgtacgagaaggcaagaagaggagaaaccgtagagctttctccaagaagaatttcaattttccagtttgacattgaacgcagtttagatgacagacaaaatctgatattccgggttatatgctctaagggtacatacataagatctctctgtgcagatcttgcgaaagctcttggaagttgtgctcacctcactgctctccggcgagattcaattggtgaatattctgctaatgatgcttgggaattcaatgagttagaagcagcaatcactaaaaactacttctag

SEQ ID NO: 46023 - protein, 540 aa, Arabidopsis thaliana
MAKSLHFTRLMSSSARMSMTSPLFFSSVKPWRNIHKPYLASLFLSTTSTRYPLQYDMIINRPTQSSLSQNRRRPPKAIESGAPDSAEPEFDSWVDNKLAMEREQGRPGSGDPEMDKAKRKYYSKRRKRLYGSDSEDETSSRKSDEGFVELKPEVVEFDRLHQREEELYFYDTFAYPWEKDKHYKMVYQLEKKYYPDQCLDKAFLQPGEVLKKSDDSGKVRGKKKVVAALGGKRSEVKRIGMENCDEDDDKLVFFDEVKEKEEKKKSEDDVVVVTEKKVEQFFKGLTKSPNEKGMASGGGDGEPFLVTRNGELPPRWDGPNGTVLLVNKPKGWTSFTVCGKLRRLVKVKKVGHAGTLDPMATGLLIVCVGKATKVVDRYQGMIKGYSGVFRLGEATSTLDADSPVIQRESWEHIKDDDIKKALTSFLGEIWQVPPMFSAIKVGGEKMYEKARRGETVELSPRRISIFQFDIERSLDDRQNLIFRVICSKGTYIRSLCADLAKALGSCAHLTALRRDSIGEYSANDAWEFNELEAAITKNYF

SEQ ID NO: 46024 - DNA, 1068 bp, Thermoplasma acidophilum DSM 1728
  CDS (1)..(1068)
gtgcttgacaagcctcagggcccaaccagccaccaggttgatcactgggttagggagatcctaggcatagagaaggtggcgcacatcggtacgcttgacccaaacgtgaccggagtcctgactatggccataggcaaggccgtccgccttgtggatgttgtgcacgagagtccaaaggaatatgttggtgttatgcggttttacgaagacataaccgaagaagaggtcaggtactatttcaaaaaattcacaggaaggatatatcagctgccacccgtgagaagcgcagtggctagaagcctcaggatcaagacggtgtattcgcttgatctcctggagaagaaagacaggctagtgctgtttcacgtcaaatgcgaatctggaacttatatacgcacgctttgcacggatatcggatacgtatccggaaagggtgggcagatggtggatctgaggaggacttcaaccggtccattctccgaggataggtgcataacactgcaggatttcgcggctatggtagaactggccaggaagggcgaggataagctgctcagggaccacatactcgatatgacctacgccttcaaggactatccgaagatcgtggtcaagaggagcgccatgaggaatatagcacatggatcggatctgtatgccgggggaatcaagataattgacggaaagttcaggaagggtgaacgcgtagccgtcatctccgaggacaacgatctggtgggaactggcatagccatgtgcagctctgataacatctttatgaaggtagtggatttcgatcatatattcctggaggctgatgatggaaaggataatgtggtacggatcgggaaagaggctgttcaaaaatctggatcaggattacataaggatattcaaagatctgagggaaggaaggataccagaactggatggtatgggagagataccggacctgagaaaactgctgatagagtatggaaaggaaagaataagggaagagtttacccccgatcaggcgctgataaaggtggcggcggtaaggaacgccatggacgagatcatcaataa

SEQ ID NO: 46025 - protein, 355 aa, Thermoplasma acidophilum DSM 1728
MLDKPQGPTSHQVDHWVREILGIEKVAHIGTLDPNVTGVLTMAIGKAVRLVDVVHESPKEYVGVMRFYEDITEEEVRYYFKKFTGRIYQLPPVRSAVARSLRIKTVYSLDLLEKKDRLVLFHVKCESGTYIRTLCTDIGYVSGKGGQMVDLRRTSTGPFSEDRCITLQDFAAMVELARKGEDKLLRDHILDMTYAFKDYPKIVVKRSAMRNIAHGSDLYAGGIKIIDGKFRKGERVAVISEDNDLVGTGIAMCSSDNIFMKVVDFDHIFLEADDGKDNVVRIGKEAVQKSGSGLHKDIQRSEGRKDTRTGWYGRDTGPEKTADRVWKGKNKGRVYPRSGADKGGGGKERHGRDHQ

SEQ ID NO: 46026 - DNA, 846 bp, Streptococcus pyogenes MGAS315
  CDS (1)..(846)
atgacctctcatgacgcagtttttaaattacggaagttattacaagaaaaaaagattggacatggggggaccttagatcctgatgtggtcggtgttctaccaattgcagttggtaaggctactcgtgtgatcgaatacatgacagaagctggtaaagtttatgaaggacaagtgactctcggttactcaacaacgactgaggatgctagtggagaggtagttgcgagatcctctttgccagctgtgctaacagaagaactcgttgatcaaacgatgacgactttccttgggaaaatcacacagaccccacctatgtattcagccgtaaaggttaatggccgtaaattgtacgagtatgcgcgtgctggtgaaagtgtggaacgtcctagaagagaagtgactatttctctgtttgaacgcaccagccctttgaattttactgaagacggtctttgccgattctcttttaaagttgcttgtggcaaggggacttatgtgcggaccttagcagttgatttaggtcgagctctaggggtagagagtcatatgtccttcttgcagcgatcagcttcagcaggattaaccctcgagactgcctatactttgggagaaattgctgatatggtttctaaacaagagatgtcttttttgttaccgatcgagtatggcgttgctgatcttcctaaaatggttattgatgatactgaattgactgaaatttcatttggtcgccgtcttagtctccctagtcaagagccactgttagctgcttttcatggcgaaaaagtaattgctattttagaaaaaagagatcaagaatacaaacccaaaaaagttcttatttaa

SEQ ID NO: 46027 - protein, 281 aa, Streptococcus pyogenes MGAS315
MTSHDAVFKLRKLLQEKKIGHGGTLDPDVVGVLPIAVGKATRVIEYMTEAGKVYEGQVTLGYSTTTEDASGEVVARSSLPAVLTEELVDQTMTTFLGKITQTPPMYSAVKVNGRKLYEYARAGESVERPRREVTISLFERTSPLNFTEDGLCRFSFKVACGKGTYVRTLAVDLGRALGVESHMSFLQRSASAGLTLETAYTLGEIADMVSKQEMSFLLPIEYGVADLPKMVIDDTELTEISFGRRLSLPSQEPLLAAFHGEKVIAILEKRDQEYKPKKVLI

SEQ ID NO: 46028 - DNA, 984 bp, Corynebacterium efficiens YS-314
  CDS (1)..(984)
gtgaccaccgaaccctcaaggtccgccggaacttcctttaaaccgcgccaaatatccacggctacaggttacggcatagacttctcaggcatgaatgatcccgtccagaactcaggtctcgtcgtggtggacaaacccgccggaatgacatcacacgatgtggtatcaaaactgcgccgtgccttctccacccgcaaggtggggcacgccggcacccttgatcccatggccaccggtgtgctggtggtcggcatcgagcgtggtacacgtttcctcgcgcacctggtggccaccaccaaggcctacgatgccaccatccggctcggcgcctccaccaccaccgatgaccgggagggggacgttgtattctcggctgacgcctcgacgcttgacgacgaacagatcaccaccgccgtcacctcgctgaccggggagatcatgcagaaacccgcgagtgtgtccgccatcaagatcgacgggaagcgggcccatgaacgggtccgcgacggtgaggtggtggatattccggcgcgcccggtaaccgtgagcgtgttcgacgtgctggagcagcgacgcgagggtggcttcgtggatctggatgtgcgggtgcactgttcctccggcacctatatccgttccctggcgcgtgacctgggggccgccctgggggtgggtggacacctgaccgcgctgcgtcgcaccgaggtggggcccttcaccctggaggatgcgatccccctggctgacctccaggacaacgcccggttatccctgagcctggatgaggcactggcccgttcctatcctgtcctggagatcaccgaggccgagggtgaggcactgtcgatgggcaagtggctggaaccgcgtggactgaagggtgtgcacgcggcggtcaccccgtcgggccggtcgatcgccctggtcgaggagaaggggaaacgcctggccaccgtgttcgtagcgcgtcccaacaccctgtga

SEQ ID NO: 46029 - protein, 327 aa, Corynebacterium efficiens YS-314
MTTEPSRSAGTSFKPRQISTATGYGIDFSGMNDPVQNSGLVVVDKPAGMTSHDVVSKLRRAFSTRKVGHAGTLDPMATGVLVVGIERGTRFLAHLVATTKAYDATIRLGASTTTDDREGDVVFSADASTLDDEQITTAVTSLTGEIMQKPASVSAIKIDGKRAHERVRDGEVVDIPARPVTVSVFDVLEQRREGGFVDLDVRVHCSSGTYIRSLARDLGAALGVGGHLTALRRTEVGPFTLEDAIPLADLQDNARLSLSLDEALARSYPVLEITEAEGEALSMGKWLEPRGLKGVHAAVTPSGRSIALVEEKGKRLATVFVARPNTL

SEQ ID NO: 46030 - DNA, 849 bp, Bacillus cereus ATCC 14579
  CDS (1)..(849)
ttgcgagaaaagagaattggtcatacgggaacattagatccagatgtaacaggagtattaccaatttgcgttggaagagcaacgaaaattgcacaatttttaacaagtgaaacgaaaacatatgaaggtgaagtaacattagggttttcaacgacaactgaagacgcttctggtgaggttgttgaaacgaaaaatgtagatcgtactattactcgtatggaagtagagaaagtccttgcggaattaacaggcacgattgaacaaatgccaccaatgttctcggctgtaaaagtaaacgggaaaaaattatatgaatatgcaagagcaggacaagaggtggaacgtccagttcgtacaattacaattcatgaattcgtattacttgatgatcgtgaagtttttgaaggagaaaatatttcattccgtttccgtgtaacgtgtagtaaaggaacatatgtaagaacgttagctgtaatgatcggggagaaacttggtttcccatcacatatgtctcaccttgtaagaacggcatctggtgaatttttattagaagattgcatatcatttgaagaaattgaagaaaacgtgcaaaatggaacagtagagtctatcttcatttcaattgatgaagcattaagtaagtttccaaaaatggttgtagatgaaaagcaagcagagaaaataaagaatggtatgttcttaaagaatgaattagaaataacagcaccatttattacagtgtttgataaaaatgatcgttgcttagcaatttatgaacatcatccgaaacatcctggcatgttaaagccgatgaaagtacttgtgaataatcaagaactaaagctataa

SEQ ID NO: 46031 - protein, 282 aa, Bacillus cereus ATCC 14579
MREKRIGHTGTLDPDVTGVLPICVGRATKIAQFLTSETKTYEGEVTLGFSTTTEDASGEVVETKNVDRTITRMEVEKVLAELTGTIEQMPPMFSAVKVNGKKLYEYARAGQEVERPVRTITIHEFVLLDDREVFEGENISFRFRVTCSKGTYVRTLAVMIGEKLGFPSHMSHLVRTASGEFLLEDCISFEEIEENVQNGTVESIFISIDEALSKFPKMVVDEKQAEKIKNGMFLKNELEITAPFITVFDKNDRCLAIYEHHPKHPGMLKPMKVLVNNQELKL

SEQ ID NO: 46032 - DNA, 930 bp, Anopheles gambiae str. PEST
  CDS (1)..(930)
atgtctcgtagacgtcgtttcaagggccgtgacgtgcacggtatcctgctgctggacaagccgaccgggctgacctccaacgatgtgttgcagaaggtcaagcggatctacaacgccgccaaggccggccacaccggcgccctggacccgctggcaaccggcatgctgccgatctgcctcggcgaagccaccaagttctcccagtatctgctggaagcggacaagcgctacgaggtgaccgccaagctgggcgagcgcaccaataccagcgactccgatggcgaggtggtctccacccggccggtgaacgtggccgtgggtaccctgatcgagtcgctggaccagttccgcggccccatcatgcaggtgccgtccatgtactcagccctcaagcacaacggtcgcccgctctacgagtacgcccgtgaaggcatcgagatcgagcgggaagcccgccctatcacggtgttcgagctcaagctcatcagctttgaaggggatgaggtcaagctggaggtgcactgcagcaagggcacctacatccgctccctggtggacgatctgggggaggtgctgggctgcggcgcgcacgtcacccagttgcgccgtacccaggtggccagctatccctatgagcggatgctgaccctggaacagctcgagtgcatcttcgagcaggccaaggccgaaagcattccgccgcgcgagcagctggatccgctgctgctgccgatggacaccgccgtggcaagcctgcccgaggtgaacatgctggccgccgtggccgcctatgtaaatcagggccaggccgtgcaggtcgccggagcgccgcagagcggtcaggtccgcatgacggtcggtccggagcgcgagttcatcggcgtgggcgagatcgacgacgaggggcgcgtggcgcccaagcgtctgtag

SEQ ID NO: 46033 - protein, 309 aa, Anopheles gambiae str. PEST
MSRRRRFKGRDVHGILLLDKPTGLTSNDVLQKVKRIYNAAKAGHTGALDPLATGMLPICLGEATKFSQYLLEADKRYEVTAKLGERTNTSDSDGEVVSTRPVNVAVGTLIESLDQFRGPIMQVPSMYSALKHNGRPLYEYAREGIEIEREARPITVFELKLISFEGDEVKLEVHCSKGTYIRSLVDDLGEVLGCGAHVTQLRRTQVASYPYERMLTLEQLECIFEQAKAESIPPREQLDPLLLPMDTAVASLPEVNMLAAVAAYVNQGQAVQVAGAPQSGQVRMTVGPEREFIGVGEIDDEGRVAPKRL

SEQ ID NO: 46034 - DNA, 1239 bp, Debaryomyces hansenii CBS767
  CDS (1)..(1239)
atgaatggtgtatttgcaattgaaaagccgtctgggattacatcgtctaaattcataggtgatattcaggctctcttcacgcaatcagaaatttttaaaaacgatctaaacgaagcgaagaccaaagcagcccaagctttaggaactgataaaaaatggtccaaagaaagaataaacaaacgagtaaagtcgttgaaggtcaagattggacatgggggtaccttagatccaatggcaagtggtgtattggttgttggtgttggattagggactaaaaaattacaatattatcttagcgaatgcaataaaacttacgagacgaaggcattattgggtatttcgacaactactggagatgcagaaggtgagatcattaccaaaaatcaagtaagtcacataactcaagaaatgataaaggaaactgctccaaaatttattggtgatcttaaacagacaccgcctatattttcagcattgaaaatgaatggtaagccattatatgactatgcgagggaaggaatcccattgccaatgcctataaaggtaaggcaagtcaaggtcttcgatgtaaaagtacatgatgaagattcattacgcaccgaccatgagtttcagacattgaaaagtgaattggatgaacaaggtaatccaaaagagcatgagttgtcaaacaatcctactttgaatgattcacctttgtatttctcggagcaatacttgtcaaaggcggagactgagggtttgcctaaggaagttggtaaaccaaggtcgttggctgatgattcgcttcctgaaaaattaccattaattcatttgactgctgatgtctcctctggtacatacatcagaagtttagtaagtgattatggtagggctttagagtcttcggcatatatggtcgaattgatacgagtaagacaatccgaatggcagttaggaaaaaatgtatttaaaatatcagattttgaaaatagagatgaaagaatttggggacctgttttaaaaaaggtcttggatagcgatcatgatatcgatgttctgaaagaattgaatgatttttctgaaaaaattgctcccttgcttgagcgtgaacaagaagttatagaaaagtttggtgatgctaacaagcaagacaaagaagcgcatgttgcagatactacaagtatagcaaacacaaacacgactgagagagacgcagaaattccaaagaaaagaacaattgacgaaatagaaaaataa

SEQ ID NO: 46035 - protein, 412 aa, Debaryomyces hansenii CBS767
MNGVFAIEKPSGITSSKFIGDIQALFTQSEIFKNDLNEAKTKAAQALGTDKKWSKERINKRVKSLKVKIGHGGTLDPMASGVLVVGVGLGTKKLQYYLSECNKTYETKALLGISTTTGDAEGEIITKNQVSHITQEMIKETAPKFIGDLKQTPPIFSALKMNGKPLYDYAREGIPLPMPIKVRQVKVFDVKVHDEDSLRTDHEFQTLKSELDEQGNPKEHELSNNPTLNDSPLYFSEQYLSKAETEGLPKEVGKPRSLADDSLPEKLPLIHLTADVSSGTYIRSLVSDYGRALESSAYMVELIRVRQSEWQLGKNVFKISDFENRDERIWGPVLKKVLDSDHDIDVLKELNDFSEKIAPLLEREQEVIEKFGDANKQDKEAHVADTTSIANTNTTERDAEIPKKRTIDEIEK

SEQ ID NO: 46036 - DNA, 852 bp, Leptospira interrogans serovar Copenhageni str. Fiocruz L1-130
  CDS (1)..(852)
atgacttcttcggatttagtggttaccgttcgtaaaaaactaggatttaagaaagtaggtcatactggaaccttggaccgagccgcaagtggcttaatgattcttcctattggaagttgtactagtttttccagcgtatttttagaaaaagaaaaatcctatgaagcatgggtaaggccaggagaatctactgattccggagataaagaaggtgagattttagaatctctttccaaagaacaaactgaaacttggttccaagagcaccaagaaaaattaagggatttatttgaacaagtgcctacttgggaaacccaagaagctcctgaagtttctgctctcaaggtaaacggtaggcgaagatcggatctatttcgagaaggtgtagctcttgttccagcggttcgaaagatcaaaatatatcggtatgaacttggagaattttctcccgaatctatttcttttcaaattcgagtttctgcaggaacttatattcgtaaaattgtaatggatatttccgatcgaatcggttttccacttcgtttggagaaattggttcgtacaagtattggtaagttaaacttaaatcaggccgattcatacgaaagtctattagatggaaagattaaaattcatcctccagaaacgattttggattttccgacggtagaagttccagacacggaagttaggaatgtactgaatggtagaaaaattaagttggaatggattccagtgaatgagtttcttttggtttctcccgaagaggagattcttgcttggtgtaaaaaagaagaacatggaatccatgaattagattataaatatttaagggtctttcctaaaaattag

SEQ ID NO: 46037 - protein, 283 aa, Leptospira interrogans serovar Copenhageni str. Fiocruz L1-130
MTSSDLVVTVRKKLGFKKVGHTGTLDRAASGLMILPIGSCTSFSSVFLEKEKSYEAWVRPGESTDSGDKEGEILESLSKEQTETWFQEHQEKLRDLFEQVPTWETQEAPEVSALKVNGRRRSDLFREGVALVPAVRKIKIYRYELGEFSPESISFQIRVSAGTYIRKIVMDISDRIGFPLRLEKLVRTSIGKLNLNQADSYESLLDGKIKIHPPETILDFPTVEVPDTEVRNVLNGRKIKLEWIPVNEFLLVSPEEEILAWCKKEEHGIHELDYKYLRVFPKN

SEQ ID NO: 46038 - DNA, 864 bp, Mycoplasma mobile 163K
  CDS (1)..(864)
ttgaaaatgatattacttttaagaaaaacaaaaaacattagtagttttaattttattaataactttaaaaagacaaaaggttttaaaaaaattggacattgtggtactttagatccactagcaactggccttttaatcgttgcaacagatgaagatacaaaattaattgattatttagatcaaaaagataagacatatgtagcaagagcaaaactaggtttcgaaacaactacttatgattctgaaggtgaaattattaatcaaagttcaaatgtaaaatttacaaaagaaaaattgattgaagttctaaattcttttattggtttaacaaaacaaatgcctcctaaatatagtgcaaaaaaactaaatggaataagagcttatgatttagcaaggcaaaatattgattttgaattaaatgaggttgaaatcaatataactaaaataaagttattgtcttataatgaagatgaaaattactttgattttgaagttgttgtttcaagagggacttacattagaagtcttatttatgacattggaattaaattaaattctttagcttatatggaatctttagaaagaacaaaaataggaaatctttttttagaaaaaaatcaagatgataaaattttaaatgcaaaagaaataattcaactggaaataattcaattagaaaaaaatcaaatagaaaatctttctaaaggtctcttaattgatttaaaaaatgaggataatttttatgctcttttttgaaaagatgaaatgattggatttggacaaattttgaataatgtattaaaatctaaaaaacttattgggaaaaaaatacaaaaaattttaggagataaacaaagtgaataa

SEQ ID NO: 46039 - protein, 287 aa, Mycoplasma mobile 163K
MKMILLLRKTKNISSFNFINNFKKTKGFKKIGHCGTLDPLATGLLIVATDEDTKLIDYLDQKDKTYVARAKLGFETTTYDSEGEIINQSSNVKFTKEKLIEVLNSFIGLTKQMPPKYSAKKLNGIRAYDLARQNIDFELNEVEINITKIKLLSYNEDENYFDFEVVVSRGTYIRSLIYDIGIKLNSLAYMESLERTKIGNLFLEKNQDDKILNAKEIIQLEIIQLEKNQIENLSKGLLIDLKNEDNFYALFWKDEMIGFGQILNNVLKSKKLIGKKIQKILGDKQSE

SEQ ID NO: 46040 - DNA, 1050 bp, Picrophilus torridus DSM 9790
  CDS (1)..(1050)
atgagtaatttaaatggtttcattgttgtagacaagccgaaggggcccacgagccatcagatagattcatggattagagatatcaccggtgagcctagggtaggtcatataggcacactggatcctggagtttccggagtgcttgtcatggccctgggcaaggccacaaagttaatagacatagttcacagggaatcaaaggaatacgtctcagttttaagaacatacgataaatatgaccatgattccataaaaagtgtttttaaggaattcaccggtaaaatataccagataccccctgtaagatccgcggtttccagggaactccgcataagggaaatttacaatcttgaactgcttgaaatggatgagaaattcgtcctttttaaggtttgctgcgaatccggaacatatataagaacactgtgcacagatataggttatgttcttggttccggaggccagatggcggagctcaggagaacaagaaccggcccattcgatgaatccatgtgccatacactgcaggaggtaagtgatgcatttaaattaaaaagcatgggaaacgaaaaattatttaaaaatatatttataccaatggatttcatatttattaaatacccaaaggtcattgtaaaggaaacggcattaaaaaacatagcacatggttctgatatataccctgcaggcatacatgcaattaccggcagtccaaaaaagggggacgtggttgcagtttacaccgagaagaatgagcttgttgccactggtacaatgatggtaaatgccgatgaaatatatgatcttaaggtaattgatattgataatgtcttgatagaaaccggtgataatgatggaaaagattctttggtacggaaagataatagatggaaagatatacctgttcaaaaacctgagagaaaactacatggcaatcttcagggatctcaggaatggaaggataccggaaacagaggaaatcccaagcggggaggtaccggatctaagggattttcttctggatttcgaaagagaaaggctaaaagatga

SEQ ID NO: 46041 - protein, 349 aa, Picrophilus torridus DSM 9790
MSNLNGFIVVDKPKGPTSHQIDSWIRDITGEPRVGHIGTLDPGVSGVLVMALGKATKLIDIVHRESKEYVSVLRTYDKYDHDSIKSVFKEFTGKIYQIPPVRSAVSRELRIREIYNLELLEMDEKFVLFKVCCESGTYIRTLCTDIGYVLGSGGQMAELRRTRTGPFDESMCHTLQEVSDAFKLKSMGNEKLFKNIFIPMDFIFIKYPKVIVKETALKNIAHGSDIYPAGIHAITGSPKKGDVVAVYTEKNELVATGTMMVNADEIYDLKVIDIDNVLIETGDNDGKDSLVRKDNRWKDIPVQKPERKLHGNLQGSQEWKDTGNRGNPKRGGTGSKGFSSGFRKRKAKR

SEQ ID NO: 46042 - DNA, 879 bp, Rickettsia typhi str. Wilmington
  CDS (1)..(879)
atgagtaattattggttaaatttttataaaccaaaaggtataagttctgctaaacttgttaatatagtaaaaaaaataatcggtaaaactaagataggacatgccggtactttagatgtagaagcggaaggaatattacctcttgcagtaggtgaagctacaaaactaatacagttgctcattgatgctaagaaaacctatatttttagtgtaaaatttggtgcacaaacagataacggagattatactggtaaagtaatagcatcaaaaaattatataccttctcaagaagaggcatatgcagtatgttctaaatttataggtaacataaaacaaataccaccgatgttttctgctattaaagttaatggtataagagcgtataaattagctagagaagggaaagtagtagaattaaagccacgcaatgtaactatatatgatctaaaatgtttaaatttcgacaaagaaaaagctattgctacatactatacggaatgctcaaaaggtacttatataaggactttaacagaagatttggcattatccttgcaaagtttaggatttgtgatagaattacgccgtactcaggttggaatatttaaagaagagaatgctattcacattaaagcatctgacgcaattactaaaaattttatagacaaaaaaagtataaagatagaagcaatactggacgacatcctggttcttgatgcaaccgatgatcaagcacagaaaattaaatatggacaaaaatgcgtatttgattatgaagaagacgttaattttttatgggttcggtataatggtactctgcttgcaataggtagcttaaacaagagttgttttaattctttacgagtatttaatttattataa

SEQ ID NO: 46043 - protein, 292 aa, Rickettsia typhi str. Wilmington
MSNYWLNFYKPKGISSAKLVNIVKKIIGKTKIGHAGTLDVEAEGILPLAVGEATKLIQLLIDAKKTYIFSVKFGAQTDNGDYTGKVIASKNYIPSQEEAYAVCSKFIGNIKQIPPMFSAIKVNGIRAYKLAREGKVVELKPRNVTIYDLKCLNFDKEKAIATYYTECSKGTYIRTLTEDLALSLQSLGFVIELRRTQVGIFKEENAIHIKASDAITKNFIDKKSIKIEAILDDILVLDATDDQAQKIKYGQKCVFDYEEDVNFLWVRYNGTLLAIGSLNKSCFNSLRVFNLL

SEQ ID NO: 46044 - DNA, 849 bp, Borrelia garinii PBi
  CDS (1)..(849)
ttggaaaatggattccttttaattaacaaagaacaaggcaaaacttcttttgaaactctttttcctataaaaaaatattttaatacaaatcatgttgggcatgctggtacacttgataaatttgcgagtggaattttaattgctcttgtagggaaatatacgaagcttgcaggctattttatttctttggataaagagtatgtagcagaatttagatttggattagaaacagatactcttgattcaaatggaagaatagttaataaagcggattatatccctagtgtagaggatatagatttaaagcttaaagactttgtgggtgagatttatcaaagccctcctagattttcttctattcatattgatggtatcagggcttataaacttgctttaaatggaaagttttttgaaattaaaaaacgaagagtaaatgtctatgatatccaaagattaagctacgattttagttcttcttcgcttagtttgaaaattacttgttcaaaaggtacttatattaggagtattgcaagagatttggcttattctttaaattcttgcgcatatgttagtaatttaaaaagaaccaaaataggtatgtttagattaaaagattctacattgtgtaaaaatttgagtaaatcttccttaattagtttagaatctttaagcagttttaaaaaggtttatattgattctagtaaagtaaatcttgttaaaaatggggcttacgttgaagttcaaatcaatattaatgaatttaagattttaaaatccagagaaggggaaatattagcggtcattgaaggaataggttttaataaatataaatatgttattatattttaa

SEQ ID NO: 46045 - protein, 282 aa, Borrelia garinii PBi
MENGFLLINKEQGKTSFETLFPIKKYFNTNHVGHAGTLDKFASGILIALVGKYTKLAGYFISLDKEYVAEFRFGLETDTLDSNGRIVNKADYIPSVEDIDLKLKDFVGEIYQSPPRFSSIHIDGIRAYKLALNGKFFEIKKRRVNVYDIQRLSYDFSSSSLSLKITCSKGTYIRSIARDLAYSLNSCAYVSNLKRTKIGMFRLKDSTLCKNLSKSSLISLESLSSFKKVYIDSSKVNLVKNGAYVEVQININEFKILKSREGEILAVIEGIGFNKYKYVIIF

SEQ ID NO: 46046 - DNA, 930 bp, Bacillus licheniformis ATCC 14580
  CDS (1)..(930)
atgtataacggagtccttctattacataaaccggtcggcatgacctcgcacgactgcgtcatgaagatccgcaaactgctgaaaacaaaaaaggtcggccataccggtacactggatcccgaggtgtcgggcgttctcccgatctgcgtcgggagggcaaccaaaatcgtcgagtatttgaccgaaaagtccaaaacatatgatgcagaggtcacgcttggctgttccacggagacagaggatcagacgggggaagtcacagaaaagaaacccgtcttagcgccgcctgatgaacagaccgtgcagagcgtcctgagatctcttgaaggaacgattgagcaggttccgccgatgtattcagctgtcaaggtaggcggcaaaaagctgtatgaatacgcgcgggctggaatcgaggttgaacggccgaagcggaccatcaccatccatcatatcgaactgacatccgagatccgccatgagggggataaagcccgcttccggtttgttgtgacatgttcaaaaggcacatatgtcaggaccttggcggtaaccatcggggagaagctcggatatcccgcgcatatgtccaatctggtcaggaccgcgtcaggccctttcacccttgacgaatgcttgacctttgaagacgtcgaaggcttgatcgctgacggaacattgtctgaaaagctcgtccccatcgaacgtgcgcttgatcatttgccgaaatggataattagtgatacattagctaagaaagtggaaaatggagcggtgcttgaaacgcccggcagcttttctcatttgacgagcgaagaccgcattgcggtctttacggaagcaggccggtgcacagccgtctattatccgcatccgaccaaaaccggtttgttgaagccggcaaaagtacacgtgcaaaaaagcgaacaatag

SEQ ID NO: 46047 - protein, 309 aa, Bacillus licheniformis ATCC 14580
MYNGVLLLHKPVGMTSHDCVMKIRKLLKTKKVGHTGTLDPEVSGVLPICVGRATKIVEYLTEKSKTYDAEVTLGCSTETEDQTGEVTEKKPVLAPPDEQTVQSVLRSLEGTIEQVPPMYSAVKVGGKKLYEYARAGIEVERPKRTITIHHIELTSEIRHEGDKARFRFVVTCSKGTYVRTLAVTIGEKLGYPAHMSNLVRTASGPFTLDECLTFEDVEGLIADGTLSEKLVPIERALDHLPKWIISDTLAKKVENGAVLETPGSFSHLTSEDRIAVFTEAGRCTAVYYPHPTKTGLLKPAKVHVQKSEQ

SEQ ID NO: 46048 - DNA, 918 bp, Mannheimia succiniciproducens MBEL55E
  CDS (1)..(918)
atgtcgagaccccgtaaacgcggtcgtgatattcacggcgtatttttacttgataaaccgcagggaatgtcgtctaacgatattttgcagaaggtaaaacgtatttatcaggcaaataaagcagggcatacgggcgcattggatccattggcaacaggaatgttgccgatttgtttaggtgaggcgacaaaattttctcagtttttattggatgcggataaacgttatcaggtgattgcgaaattaggcgaacgtacggatacttccgatgcggaagggcaagttgtagaaacccgctccgtgaatgtaacggaacaaaaaatccttgattctttaccgcactttcgcggtgatattatgcaggttcccactatgttttccgccttgaaacataagggtaaacctctttacgaatatgccagagcggggattgttgtagagcgtgaagcccgcccgattagcattttcgagcttaattttattagctatgaagcaccttatttaacacttgaagtgcattgttcaaaaggtacgtatattcgtacgttagtggacgatttaggcgaatatctaggttgcggcgctcatgtaagtatgcttagacgtaccgcagtatccgattatccggcggataaaatgctgacttgggaacaattgcagcaatttgcgcaagacgaagatctagccgcattagatgcccgtttattaccggtggacagcgccgtatcaaaattacctgttttaagtttgagcgaagagcaaacaaaagccgtgggtttcggtcagcgggtaaagtttgataatcttcagcaactgcaagggcaagttcgtttgttttcgccgcaaaatgtgtttttaggggtagcggaaataggtaaggataatgtaattcgccccagccgaatggtgaatttataa

SEQ ID NO: 46049 - protein, 305 aa, Mannheimia succiniciproducens MBEL55E
MSRPRKRGRDIHGVFLLDKPQGMSSNDILQKVKRIYQANKAGHTGALDPLATGMLPICLGEATKFSQFLLDADKRYQVIAKLGERTDTSDAEGQVVETRSVNVTEQKILDSLPHFRGDIMQVPTMFSALKHKGKPLYEYARAGIVVEREARPISIFELNFISYEAPYLTLEVHCSKGTYIRTLVDDLGEYLGCGAHVSMLRRTAVSDYPADKMLTWEQLQQFAQDEDLAALDARLLPVDSAVSKLPVLSLSEEQTKAVGFGQRVKFDNLQQLQGQVRLFSPQNVFLGVAEIGKDNVIRPSRMVNL

SEQ ID NO: 46050 - DNA, 921 bp, Nocardia farcinica IFM 10152
  CDS (1)..(921)
atgggcgagcgcagcgcaccgacgcgccgcgtcgacccgctcggcgggctgctcgtcgtcgacaaggacggcggcatgaccagccacgacgtcgtcgcgcgctgccggaagatcctgggcaccaggaagatcgggcacgcgggcaccctcgacccgatggccaccggcgtgctggtgctcggcgtggagcgggccaccaagctgctcgggttgctcaccctcaccaccaaggcctacaccgcgaccatccgcctcggcagtgccaccaccaccgacgacgccgagggcgaggtgctcaccaccgtcccggcgggccacctcggcgacgccgaggtcgccgcgggggtggcggcgctgaccggcgacatccagcaggtgcccgccaccgtcagcgcgatcaagatcggcggcgagcgcgcgtacgcccgccatcgcgcgggggagcaggtcgagttggccgcgcggccggtgacggtgtcgcgcttcgaggtcctggctcgccgcgacgtcgccggattcgtcgacctcgacgtggtggtggagtgctcctcgggtacctacgtgcgggcgctggcccgagatctgggtgcggcgctcggtgtcggcggccacttgacggcgctgcgccgcacccgggtgggcccgttcaccctcgaccacgcccgcacgctcgacgcgctcgccgacgagcctcggctgaacctcgacatggacgaggccgtgcgaatcgccttcccgcaccgggcgatcgacgcccgcgaggcggagtcgctgcgcgatggccgctggctcgacccggtcggcatccccggcgtgtacgccgccctgaccgccgacggcaccgccatcgcgctgctcgaggagaagggcaagcgcgcctcgccggtattcgtggtgcgcccacgcggtctggtggactga

SEQ ID NO: 46051 - protein, 306 aa, Nocardia farcinica IFM 10152
MGERSAPTRRVDPLGGLLVVDKDGGMTSHDVVARCRKILGTRKIGHAGTLDPMATGVLVLGVERATKLLGLLTLTTKAYTATIRLGSATTTDDAEGEVLTTVPAGHLGDAEVAAGVAALTGDIQQVPATVSAIKIGGERAYARHRAGEQVELAARPVTVSRFEVLARRDVAGFVDLDVVVECSSGTYVRALARDLGAALGVGGHLTALRRTRVGPFTLDHARTLDALADEPRLNLDMDEAVRIAFPHRAIDAREAESLRDGRWLDPVGIPGVYAALTADGTAIALLEEKGKRASPVFVVRPRGLVD

SEQ ID NO: 46052 - DNA, 912 bp, Legionella pneumophila str. Paris
  CDS (1)..(912)
atgacaacaattgaatcgcagtgttccatagatggaatcctgctattaaataaaccacaaggaatgacctctaacgccgctcttcagaaagccaaacatttgtttggtgctaaaaaagctgggcacacaggcagcttggatcctttagcaaccggcatgctacctctatgcttcggagaagcgactaaaatatgtcagtatctccttaatgcggataaaagctatgaaacaattgggaggctaggcagtaagacaaatactgctgattgtactggcgaagtgatattttgcattgaaaactatactgttagccatgaggaaatgattgcaacgcttgaaaaatataagggtaaaatcaagcaaatcccatccatgttttctgctttaaagcacaagggaacccctttgtatcgacttgccagagaagggatagagatagaacgtaaggccagggatatagtaatcagccaattgaagttggaacaatttgatggtgaatgttttacattaacggtatcatgcagcaaaggaacctatatacgtaatttagtggaagatattggtgatacgttgaaggcaggagctcatatgacaaaattgcataggctctacactgcagggtttgaaaataatcgaatgtacactcttgatgaattacaggatatgcctttatcacaaaggcttgcttgcttaatccctattgatcaggccattcagcatttaacaccagtaattctttcagattctgaggtaacagcaattcgccagggcaaggtgatttcaaataaaactggtgctgttgaaggagaagatttgcgtctttatggcgagcaatcccaatttattggcattggccaagctttaattcatggtgatattaaagcaaaaaggttagtttcttttgcgttgtaa

SEQ ID NO: 46053 - protein, 303 aa, Legionella pneumophila str. Paris
MTTIESQCSIDGILLLNKPQGMTSNAALQKAKHLFGAKKAGHTGSLDPLATGMLPLCFGEATKICQYLLNADKSYETIGRLGSKTNTADCTGEVIFCIENYTVSHEEMIATLEKYKGKIKQIPSMFSALKHKGTPLYRLAREGIEIERKARDIVISQLKLEQFDGECFTLTVSCSKGTYIRNLVEDIGDTLKAGAHMTKLHRLYTAGFENNRMYTLDELQDMPLSQRLACLIPIDQAIQHLTPVILSDSEVTAIRQGKVISNKTGAVEGEDLRLYGEQSQFIGIGQALIHGDIKAKRLVSFAL

SEQ ID NO: 46054 - DNA, 945 bp, Haloarcula marismortui ATCC 43049
  CDS (1)..(945)
atggcgacgaggggaaggcaccggtcgagaacatccggtacgagttctgagccgatgacactccgtgccccgcccgacgaacgggacctcgattcgcttcgctcgttcggcgtcgtcaacctcgataagccaccgggcccgtcagcccatcaggtcgcggcctggattcgcgacgccactggccaggaccgggtcgcccacggcggaacgctcgacccaaaggtgaccggctgtctgcccgtgttgctcggcgacgccgctcggatggcgcaagtgttcgacaacgccgtcaaggagtacgtgacggtgctcgaactccacgaccaagcgccggccgatattgcggatatcgtcgccgagttcgagacagacatctatcagaaacctcctcgaaagagcgcagtgaagcgccagttgcgttcccgccggattcactcactggatatcctcgaacagggggaccggagactgctgttgcgggtccggtgtgcgtcggggacctatatccggaagctgtgtcacgatatcgggctggcggcggggaccggcgcacacatgggcgacctccgccggacggcgaccggcacctttgacgacggatcgctgtcgacgatgcacgacctcgtggacgcgctggcctttgctgcagacggggacgaagcgcaactgcgcgagattatccagcccgcagagcgtgcgctgtcccacctgccacgggtcacaattgcgcccagcgccgcccgcgaagtcgccgaaggcgcgccggtgtatgcgccgggcgtcatcgagaccggcccggcagaagtgggcgacgcgacgcctgagatagattcacaggtcgtctctgtcacgcccgacggggctgcggtctgcctagggacgctcgtcagcgacccagacgccgacagcggcctcgttgtcgaactcgaccgtatgttagtgtaa

SEQ ID NO: 46055 - protein, 314 aa, Haloarcula marismortui ATCC 43049
MATRGRHRSRTSGTSSEPMTLRAPPDERDLDSLRSFGVVNLDKPPGPSAHQVAAWIRDATGQDRVAHGGTLDPKVTGCLPVLLGDAARMAQVFDNAVKEYVTVLELHDQAPADIADIVAEFETDIYQKPPRKSAVKRQLRSRRIHSLDILEQGDRRLLLRVRCASGTYIRKLCHDIGLAAGTGAHMGDLRRTATGTFDDGSLSTMHDLVDALAFAADGDEAQLREIIQPAERALSHLPRVTIAPSAAREVAEGAPVYAPGVIETGPAEVGDATPEIDSQVVSVTPDGAAVCLGTLVSDPDADSGLVVELDRMLV

SEQ ID NO: 46056 - DNA, 882 bp, Streptococcus thermophilus CNRZ1066
  CDS (1)..(882)
atgatttcaggaattattaatctaaaaaaagaggctggaatgaccagtcatgatgctgtttttaaactacgcaaaatattacatgagaaaaaaattgggcacggcggaactcttgatccagatgttactggtgttctacctatagcagttggaaaagctactcgtgttattgaatacatgactgaagcgggtaaagtctatgaaggcgaaatcaccattggattttcgacaactaccgaagatgctagtggagaagtcgtccaaacaactccaataacagagctagatggagcaactgtcgatcaggcgatggctagttttgagggagaaatcacacaaattcctcctatgtattcagcggttaagatcaacggaaagaaactttatgagtacgcccgagctggagaagaagttgaacgtcctcaacgtcaggtgaaaattaccgagtttgtccgaacctcacctattgagctagaaaacggtactgcaagattcaccttccgtgttgcttgtagtaaaggaacttatgtccgcaccttatctgttgatttgggtgtaaaactaggctttgctagtcatatgtctgctctgcgtcgaacagcttctgcaggtttaacattagattcatccctaagcttgtcacaaatttctgaaatggtagaagcaggagaccagtccttcctactccctatcgaatttggcgttcaggacctgccagccgtacaagtcactgaagatgatgccaaagaaatctcatttggtcgctttatttcaattaatagccaagagcctttggttgctgcctttttgggcaacaaagttctagctattatggaaaagcgaggtcaagtctataaacctagaaaagtattaagtcaatga

SEQ ID NO: 46057 - protein, 293 aa, Streptococcus thermophilus CNRZ1066
MISGIINLKKEAGMTSHDAVFKLRKILHEKKIGHGGTLDPDVTGVLPIAVGKATRVIEYMTEAGKVYEGEITIGFSTTTEDASGEVVQTTPITELDGATVDQAMASFEGEITQIPPMYSAVKINGKKLYEYARAGEEVERPQRQVKITEFVRTSPIELENGTARFTFRVACSKGTYVRTLSVDLGVKLGFASHMSALRRTASAGLTLDSSLSLSQISEMVEAGDQSFLLPIEFGVQDLPAVQVTEDDAKEISFGRFISINSQEPLVAAFLGNKVLAIMEKRGQVYKPRKVLSQ

SEQ ID NO: 46058 - DNA, 858 bp, Geobacillus kaustophilus HTA426
  CDS (1)..(858)
atggacggggtattgctgctgaataaaccgaaagggatgacgtctcacgactgcgtagccaaagtgcgccgtctgcttggcgtaaaaaaagcgggacacaccggcacgcttgacccaaacgtgtccggtgtgctgcccatttgccttggcaaggcgacgcgcatcgccgagtttttgaccgggacgacgaaaacgtatgaaggaaaagtgacgcttggcgccgcgacgacaaccgaagatgcggacggcgacatcatcgccgcccgtccggttgaccggccgattgcgcgcgcggaaatcgaggcggtgtttgacagcttgaccggagaaattgagcaaacgccgccgatgtactccgcggtgaaagtgggcggcaaaaaactgtatgaatacgcgcgcgccggcatcgaagtcgaacgtccgacgcggcgcgtgaccatttatgagctcgaactgcttgatgaacgtgaacaattctttggggaaacggtgtcatttcgctttcgcgtcacgtgcagcaaaggcacgtacgtgcgtacgctggcggtgatgatcggcgagcggctcggctatccggcgcatatgtccgacctcatccgtacggcgtccgggccgtttcggcttgaagattgcgtaacgtttgaagacgttgagcgccgggcggccgacgggacggctgatgccttgctcatcccgatcgagcgggcgctttttcatttgccgaaatatgaaatcaatgataaagtagcagagaaggtaaaaaacggggcgctgctccggcttcccgcttttttagagaagctgacgggccggtcgtgcttgtttcgcccgagcgggaagcgctggccctgtacgtga

SEQ ID NO: 46059 - protein, 285 aa, Geobacillus kaustophilus HTA426
MDGVLLLNKPKGMTSHDCVAKVRRLLGVKKAGHTGTLDPNVSGVLPICLGKATRIAEFLTGTTKTYEGKVTLGAATTTEDADGDIIAARPVDRPIARAEIEAVFDSLTGEIEQTPPMYSAVKVGGKKLYEYARAGIEVERPTRRVTIYELELLDEREQFFGETVSFRFRVTCSKGTYVRTLAVMIGERLGYPAHMSDLIRTASGPFRLEDCVTFEDVERRAADGTADALLIPIERALFHLPKYEINDKVAEKVKNGALLRLPAFLEKLTGRSCLFRPSGKRWPCT

SEQ ID NO: 46060 - DNA, 921 bp, Anaplasma marginale str. St. Maries
  CDS (1)..(921)
ttgcaaagtgctagagtaaaatatggatggctaaacgtagataagcctctccacatgagttccggcagtgtggttggtagggtaaagaagatttttaactgcaaagttggccatgcgggcacgttagaccctctagcaaccggggtgctgcctgttgctgtaggtgaggcgacgaaaaccataccgtatgcggttgatgggttgaagtcgtatgcagttacggtacaatgggggtctcaacgctctactgacgacgctgaaggtgagattatcaagacgagcagcttgaggccgagcgcggatagtataagagaggcattaggccagtttgtggggaatatacggcaagtacctccggcattttctgcggttagagtgcggggagtaagggcgtatcgtcttgcgagaaggggggaagccgtttcactgccacccaaggaggtgtgcattgtcagcatagacttgctgtctgcggacgaagaaagcaacactgcagatttccttattgtatgcaaaaagggggtgtatattcgctcatttgcgcgcgacttgggcgcatcccttgggtgttttgggtatgtttcctttttacgcaggaaaagtgtagggcctttctcggaagaaaattccgtaacattagacagactagaggcattggcggatgctgatgttctgaatgaggcgctactcccgatatcatacgttatgggggatgctcttttaaggttgcacgtagatgcggaggtggcggagatcgtgaaaaagggacaaagtgtgagtttacagcgcacaagcttaaatggcttgtatgccgctgagaattatgatatgtgttacctaagccgggtgggtggcgttcctgtcgctgtctgcaaggttgtaaatggcaccgctaggccggtgcgcgtttttgatgtctaa

SEQ ID NO: 46061 - protein, 306 aa, Anaplasma marginale str. St. Maries
MQSARVKYGWLNVDKPLHMSSGSVVGRVKKIFNCKVGHAGTLDPLATGVLPVAVGEATKTIPYAVDGLKSYAVTVQWGSQRSTDDAEGEIIKTSSLRPSADSIREALGQFVGNIRQVPPAFSAVRVRGVRAYRLARRGEAVSLPPKEVCIVSIDLLSADEESNTADFLIVCKKGVYIRSFARDLGASLGCFGYVSFLRRKSVGPFSEENSVTLDRLEALADADVLNEALLPISYVMGDALLRLHVDAEVAEIVKKGQSVSLQRTSLNGLYAAENYDMCYLSRVGGVPVAVCKVVNGTARPVRVFDV

SEQ ID NO: 46062 - DNA, 933 bp, Idiomarina loihiensis L2TR
  CDS (1)..(933)
atgtctaaagctcgtctacgcaaaggccgtgctctcacgggcgtagtattattgaataaaccgcagggcatgagttcaaaccatgccctgcagcgtgttaagcgcctgtataatgcacaaaaagcgggtcatactggtgcgctggatcctctggcaaccggtattctgccagtttgtctgggagaggcgacgaagttttcgcaatatctgctggatgccgataaagcctaccgggttgaagctacgctgggggtaagaacaaccaccagtgacgccgaaggtgaagtggtagaggaaaagcctgttgcagttgataccgctaaggttgccgatgcaataaagcagtttattggtgaacaggatcagtctccctctatttattcggcactgaagcacgaaggccgtccattatattattatgcgcgccaaggcattgaagtaccgaaaaaaacgcggacaatcaccgtccactctatcgaactgctgaatattcaggacaataaagtgaccctgcaagtgagttgcagcaaaggtacttatattcgtactttagttgatgacctgggtcagttactaggctgtggtgctcacgtatccatgctacatcgtaatgcagtagccgacatagctgaagcggctatggtgaccctggaacaactggaaacgttagcagaagagggctatgaaggtctcgatgcgttattgcatccggctgatttgctactgggacaattgccagaggtaacagtgactcaagcgcaaactcgcgactttttgcatggacagcccattcctttacctgagcaaaatggaaatgacgcagaagaatggcgcgttgccacagaaaactcgctatttcttggtgttgcacgggtgaaaaatgcggaattatggccgcgtcgggttattgcgcgggagcatgtggatttatag

SEQ ID NO: 46063 - protein, 310 aa, Idiomarina loihiensis L2TR
MSKARLRKGRALTGVVLLNKPQGMSSNHALQRVKRLYNAQKAGHTGALDPLATGILPVCLGEATKFSQYLLDADKAYRVEATLGVRTTTSDAEGEVVEEKPVAVDTAKVADAIKQFIGEQDQSPSIYSALKHEGRPLYYYARQGIEVPKKTRTITVHSIELLNIQDNKVTLQVSCSKGTYIRTLVDDLGQLLGCGAHVSMLHRNAVADIAEAAMVTLEQLETLAEEGYEGLDALLHPADLLLGQLPEVTVTQAQTRDFLHGQPIPLPEQNGNDAEEWRVATENSLFLGVARVKNAELWPRRVIAREHVDL

SEQ ID NO: 46064 - DNA, 927 bp, Azoarcus sp. EbN1
  CDS (1)..(927)
ttgaaagcatcgaaacaattccggcatcaacgccggatcgtcgacggcgtcctgctgctcgacaagccccgcggcctgacatcgaacgccgcactgcagacggcgcgccgtctcctgaatgcggcgaaggcggggcacaccggaacgctggacccgatggcgaccggattgctgccgctgacgctgggcgaggccaccaagttctcgcagatgctgctcgatgccgacaaggcctacgaggccaccgtgcggctcggcatcgaaacggacaccggagacgcggaaggagcggcgatcgcaacggctcccgtgcacgtaacggacgattcgatccgccaggcactggcggcgctgacgggtgaaatcgagcaggttccgccgatgtattcggcgctcaagcgcgacggcaagcccctgtacgaatacgctcgcgcgggaatcgaggtcgagcgcgccgcgcgccccgtgacgatccattcgctcgaactgctcggcgtggaaggggattcgttgcggatccgcgtcgattgcagcaagggaacgtatgtccgcacgctggccatcgacctggggcgcttgctcggttgcggcggccatctgaccgaattgcgccggacgaggatcggacctttcaacgtggacgaggccgttacgctcacggcgttggaggcgctgcctgcggagtcgcgcgtcgggctattggcgccggtcgatgcgctggtgggtcatctgccgcgcatcgaactcgatgccttccaggctggcctgcttctgcagggacgtgtgcttgcagctccctgcggcgcagcggggctggtgcgtatttacggcgaaggccgttacctcggactgggggaatgcgacggaaacggcacattgtcaccgaaacgtctcgtttcgacggttgccacagcgcaacaatcttga

SEQ ID NO: 46065 - protein, 308 aa, Azoarcus sp. EbN1
MKASKQFRHQRRIVDGVLLLDKPRGLTSNAALQTARRLLNAAKAGHTGTLDPMATGLLPLTLGEATKFSQMLLDADKAYEATVRLGIETDTGDAEGAAIATAPVHVTDDSIRQALAALTGEIEQVPPMYSALKRDGKPLYEYARAGIEVERAARPVTIHSLELLGVEGDSLRIRVDCSKGTYVRTLAIDLGRLLGCGGHLTELRRTRIGPFNVDEAVTLTALEALPAESRVGLLAPVDALVGHLPRIELDAFQAGLLLQGRVLAAPCGAAGLVRIYGEGRYLGLGECDGNGTLSPKRLVSTVATAQQS

SEQ ID NO: 46066 - DNA, 912 bp, Zymomonas mobilis subsp. mobilis ZM4
  CDS (1)..(912)
atgacccttacgccctccccgaccgatgcgctccatggctggatcattctcgacaagcaagaaggcttaggctcaacccaagccgtctctgctgtcaaacgcgctatccgtatcgccggattaccgaaagtaaaagtcggtcatggcgggacgttagatccccttgcctctggcgttttacctgttgccttaggcgaggcgacgaaattggcgggctatgcgcttaattccgacaaagtctatgcctttaccctcgcttttggagcggaaacggatagcttggatagagaggggagcatcaccgctcaatcagataaacgtcccacaagggaagaagtggaatctgttctatcttgcttccgaggtgaaatacaccaaatcccccccgtttattctgccttgaaaatcaatgggaaacgcgcctgcgaccgcgtccgcgccggagaaacggtgaccgtcaaaggacgcgatattactatccatgaattgaccttagacgattttagccccgatcaggctacttttatcgctaaggtttctaaaggcacctatattagaagccttgcccgcgacattgcccataaactgaattgttatggtcatgtcagctatttgcgtcgattgaaatcggggccatttacgagtgaacaggcaatttcactggacaaattaatggaaatggcgcaagctggaaagctgtatcaaatgcttttgcctttaacagcagggctggacgacatcccggctttagcagtttcctccgatcaggcaaaagcactccgtcaggggcagaaattgatcggaattaacgcagaatccggcttgaatatggcaatggaatcacaaattccggttgctcttattgaagtcactgggcaagaagctcgggttttgcgcggtttcaatttttaa

SEQ ID NO: 46067 - protein, 303 aa, Zymomonas mobilis subsp. mobilis ZM4
MTLTPSPTDALHGWIILDKQEGLGSTQAVSAVKRAIRIAGLPKVKVGHGGTLDPLASGVLPVALGEATKLAGYALNSDKVYAFTLAFGAETDSLDREGSITAQSDKRPTREEVESVLSCFRGEIHQIPPVYSALKINGKRACDRVRAGETVTVKGRDITIHELTLDDFSPDQATFIAKVSKGTYIRSLARDIAHKLNCYGHVSYLRRLKSGPFTSEQAISLDKLMEMAQAGKLYQMLLPLTAGLDDIPALAVSSDQAKALRQGQKLIGINAESGLNMAMESQIPVALIEVTGQEARVLRGFNF

SEQ ID NO: 46068 - DNA, 912 bp, Silicibacter pomeroyi DSS-3
  CDS (1)..(912)
atggcacgcaaacgcaagggacgcgatatttcgggatggctggtggtggacaagcccgccggcatgacctcgaccgccgtcgtcaacaaggttcgctgggcgctgggcgccaacaaggccggtcatgccggaaccctcgaccccgaggccaccggcgttctggccatcgccctgggcgaggcgaccaagaccgttccctatatcaccgacgcgctcaaggcctatgtctttaccgtgcgcctgggccaggcaaccaataccgacgatgccgagggcgaggtgatcgcctccagcgacctgcgccccaccgatgaacagatcaaggatgctctggcaccgttcctgggtgacatcatgcaggtcccccccaaattctcggccgtcaagatcgacggccagcgcgcctataaactggctcgcgacggcgaggatgtagagttggccgcccgcccgctctgggtcgaggagctgctgatgctggaccggcccgacccggatcacgtgctgctcgaaatgacctgcggaaagggcggctatgtccgctcgatcgcccgcgatctgggtgcagcgctgggctgttacggccatgtgcgcgagctgcgccgcatctggtcgggccctttcgaggccgaggatggcatcaccctcgagcaggtcgaggcgctggccaagacacccgaactcgacagctatctgcgccccctcgaagagggcctcgccgatctgcccgagttgaaatgcagccccgagggcgcccagcgcctgcgcaacggcaatccgggcatggtctatcccggcgaggccgaatatggcgacgaggcctgggcctcgttcgaggggcgcgctgttgcggtgggcatctacaagtccggcgagctgcatcccgcccgcgtctttgcccggcccgagtaa

SEQ ID NO: 46069 - protein, 303 aa, Silicibacter pomeroyi DSS-3
MARKRKGRDISGWLVVDKPAGMTSTAVVNKVRWALGANKAGHAGTLDPEATGVLAIALGEATKTVPYITDALKAYVFTVRLGQATNTDDAEGEVIASSDLRPTDEQIKDALAPFLGDIMQVPPKFSAVKIDGQRAYKLARDGEDVELAARPLWVEELLMLDRPDPDHVLLEMTCGKGGYVRSIARDLGAALGCYGHVRELRRIWSGPFEAEDGITLEQVEALAKTPELDSYLRPLEEGLADLPELKCSPEGAQRLRNGNPGMVYPGEAEYGDEAWASFEGRAVAVGIYKSGELHPARVFARPE

SEQ ID NO: 46070 - DNA, 909 bp, Francisella tularensis subsp. tularensis Schu 4
  CDS (1)..(909)
atgaaaaaaaatagactaaacttaaatggtgtggttgttattaataaggttaaagatattagttcaaataaagttttacagcaattaaagtatttatttaatgcacaaaaagcaggtcatacaggtactttggatcctatggcgactggagttctaccgatatgttttggtagggctacaaaaatagcacaatacttacttgatgctgataaagagtatatagctacaattagactcggtattgaaactgatagtggtgatgctgagggtgaaataatagcaaaaagcattaacattcctgagttatctgctgagtatctagaaacagttttagcaaagtttcgcggagatgtagtccaaatccctccaatgtactcagctcttaaatataatggacaacctctttataagttagcaagggaaggtaaaactgttgaggtgaagtcacgcaatatcaaaatatatgagttagaactactagagtttaatatagattcattaaaaataagagttaaatgttcaaaaggaacatatatccgtagtttagctatagatattggaaagactctaggttgtggagggcacttaatagctttacaaagaactcaaagtggaccttttaaattatctgaggcttttaggctagaacaactaaaagatttaagttttgagcaaaaaattgctagtataactaatatagagagtgtatttatcgacaaaccaatatattctttattagaagaagaaaaagatgatttatataaaagagggctctttgctgacaaacctcatcttgatggaacggtcaggatatatgatgttgagaagtttgttgctatagcagagtttgataaaggtaagttgattaataaaaaattttttgatcaggatatattgataagtgagtaa

SEQ ID NO: 46071 - protein, 302 aa, Francisella tularensis subsp. tularensis Schu 4
MKKNRLNLNGVVVINKVKDISSNKVLQQLKYLFNAQKAGHTGTLDPMATGVLPICFGRATKIAQYLLDADKEYIATIRLGIETDSGDAEGEIIAKSINIPELSAEYLETVLAKFRGDVVQIPPMYSALKYNGQPLYKLAREGKTVEVKSRNIKIYELELLEFNIDSLKIRVKCSKGTYIRSLAIDIGKTLGCGGHLIALQRTQSGPFKLSEAFRLEQLKDLSFEQKIASITNIESVFIDKPIYSLLEEEKDDLYKRGLFADKPHLDGTVRIYDVEKFVAIAEFDKGKLINKKFFDQDILISE

SEQ ID NO: 46072 - DNA, 885 bp, Synechococcus elongatus PCC 6301
  CDS (1)..(885)
atgtcatcggaagggtttgtcaacctcgataagccagcgggctggacttcccatgactgtgtcgccaagttacggcgtctgttacgggagcggcgtatcggccatggtggcacgcttgatccggcagtcacaggtgttctgccgatcgcggtgggacgagccacgcggctcctaccctatcttcccagtggcaaaacctacgtcggcaccattcgcttcgggttgcagaccagtacggacgatctgacgggcgatcgcctggcagaagccgataccagccacttgtcgcgagaggcaatcgaggcggcgctaccccaattcctcggccacattcagcagcaaccgccccaggttagtgccgtacaagtgcaagggcagcgactctatcagcttgctcggcgcggggaagcccccacggagctcccttggcgcaccgtagaaattcagtcaattcgaattctccagtggcgatcgggcagtcaagccgaattatctgtcgaaatccactgtggtgctggcacttacatccgttctctagcgcgagacctcggagccgtgctgggggtcggtggcaccctagcagagttgcgtcgtactgcgagtagtggctttgatctgaaccagagcacgccgctgactgaactgctcgatggagcagcggtgccgctcttggctttggatttgccattgcagcatttagccaaagttcaactgagtgccgaaaccagcgatcgctggcgacaaggacaagcgatgcccgtgcctgacagtgttcttcccgatgcagctccagtccgtgtctatgatctcaacggccagttcttaggaatcggcgcgatcgcggcaggactgtgcaagcccaaagtcgtactcgcggctctttga

SEQ ID NO: 46073 - protein, 294 aa, Synechococcus elongatus PCC 6301
MSSEGFVNLDKPAGWTSHDCVAKLRRLLRERRIGHGGTLDPAVTGVLPIAVGRATRLLPYLPSGKTYVGTIRFGLQTSTDDLTGDRLAEADTSHLSREAIEAALPQFLGHIQQQPPQVSAVQVQGQRLYQLARRGEAPTELPWRTVEIQSIRILQWRSGSQAELSVEIHCGAGTYIRSLARDLGAVLGVGGTLAELRRTASSGFDLNQSTPLTELLDGAAVPLLALDLPLQHLAKVQLSAETSDRWRQGQAMPVPDSVLPDAAPVRVYDLNGQFLGIGAIAAGLCKPKVVLAAL

SEQ ID NO: 46074 - DNA, 909 bp, Bacillus clausii KSM-K16
  CDS (1)..(909)
atggagccaacagggattgtggtgctggacaaaccgaaaggatggacatcccacgattgtgtccaccaaatgcggaaatggtttcaaacacggaaagtcggccatacagggacgctcgatcccgaagtggatggcgttttgccgatctgcatcggcaaagcgaccaaagtggtcaaatacatgtccgattacgataaaacgtatataggggaagtcacattcggcgtggcgacgacaacggaagacgcacacggtgaagtcgtagaagagaaacgcgtcaataaaccgtttacgcgtacggaaattgaagcgttgctgcaagcctttatcggcaaaattgagcagacacccccttattattcggctgtaaaagtaaacggcaaacgcttgtatgaatacgctcgagctggcatcgaagtcgagcggccaacgcgcacagtggaaataaaagcgttgacattgacggaaataacaactgcgaagccaggttgtttttcgtttgccttttctgtcacatgtacaaaaggtacttacatccgtacgcttgccgttgatataggcaaaaaagctggctaccctgcccatatgtcaaagctgacacggacagcatctggcccgtttacacaagcagatgccattcctttatctgcatttgcggaaatgagtttggatgagcgcctgaataagttgcgcccccttgatacggctcttcagcattttccacgggtcactgccgataaggaactggaaaaacgaatacgcaatggtgctgtcctggagaaaagcgcttcttttggagatgggcgttttttgttttataatgaacaaggagattgcttggcattgtatcaagcacatccaacaaaggctggacttattaaaccagaaacgttattttgtcatgtttaa

SEQ ID NO: 46075 - protein, 302 aa, Bacillus clausii KSM-K16
MEPTGIVVLDKPKGWTSHDCVHQMRKWFQTRKVGHTGTLDPEVDGVLPICIGKATKVVKYMSDYDKTYIGEVTFGVATTTEDAHGEVVEEKRVNKPFTRTEIEALLQAFIGKIEQTPPYYSAVKVNGKRLYEYARAGIEVERPTRTVEIKALTLTEITTAKPGCFSFAFSVTCTKGTYIRTLAVDIGKKAGYPAHMSKLTRTASGPFTQADAIPLSAFAEMSLDERLNKLRPLDTALQHFPRVTADKELEKRIRNGAVLEKSASFGDGRFLFYNEQGDCLALYQAHPTKAGLIKPETLFCHV

SEQ ID NO: 46076 - DNA, 891 bp, Ehrlichia ruminantium str. Welgevonden
  CDS (1)..(891)
atgtatggttggataaatatagataaaccatgcggtataagttcagcttctgttgtgagtcgtgttaagaagattttgaatgttaaaaaagttggttatgcaggtacattagatcctttagcgtctggaatattacctattgctattggtgaagctacaaagcttatgccatatgctgttgatgtgcagaaatcttacatatttactgtgcagtggggtgaacaaaggactactgatgatgcaagtggagaaattataaaaaaaagtaatatagttccacactttgaagagataaataaaattattccaaattttattgggatgatagagcaggtgccacctaatttttctgcaatacatgtagatggagttagggcatttaaattagctagaaatggtcaggaatttgaattaagttcaagatatgttaatgtagtacgtttaaaactattatcatttagccgagaaaataatactgcagatttttacttgctatgtaagaaaggtgtatatgttcgttctatagcaagagatcttggaatacgtttaggttgttttggatatgtagcaaaattgcgtagagtacgggtaggttattttaaacaaaaaaatgctattacattagacaagttaaagatattacataataatggtgatactcataaatatttactaccattatggtatgtattacaggatatcaagcatcttgatgatgtattctgtagtgttgaaatatcaaaaatcaaaaatggccaaaatattcagttaaataacttgtatatggttaagaattgtgatatgtgttatgtcagcacacatagtgtgccagtggcaatttgtagtatagctaataatgttataaagccagtacgtgtttttaatgtttag

SEQ ID NO: 46077 - protein, 296 aa, Ehrlichia ruminantium str. Welgevonden
MYGWINIDKPCGISSASVVSRVKKILNVKKVGYAGTLDPLASGILPIAIGEATKLMPYAVDVQKSYIFTVQWGEQRTTDDASGEIIKKSNIVPHFEEINKIIPNFIGMIEQVPPNFSAIHVDGVRAFKLARNGQEFELSSRYVNVVRLKLLSFSRENNTADFYLLCKKGVYVRSIARDLGIRLGCFGYVAKLRRVRVGYFKQKNAITLDKLKILHNNGDTHKYLLPLWYVLQDIKHLDDVFCSVEISKIKNGQNIQLNNLYMVKNCDMCYVSTHSVPVAICSIANNVIKPVRVFNV

SEQ ID NO: 46078 - DNA, 903 bp, Dehalococcoides ethenogenes 195
  CDS (1)..(903)
atgaatggcatcttgaatatcaacaaacctccaggtttgacctctttcggggtggtctcaaaagtaaggcatatttactcccagaaaaaggtagggcatggcggtatgcttgacccgagtgccaccggggttatacctgtttttctgggaagcgcaacccgcctgatagagtacctttcttcagtccgcaaaacctatctggctgaaatagagctgggtacggagacagatagctacgatagcgaaggggagattacttcccgaaagagctgtgaacatattactgctgatatggtgcgtaatgctttgccggattttctgggtgagataacccagattccccccatgtacagtgcggtaaaacaccgcggggttcgcctgtataacctggccaggcaggggatagaggttgaaagaaacccgcgtaaagctgcgatttacggcattgaattcctcggttttgcttcacctgtgctgcgtttgcggatagagtgcggacacggtacgtatatacgttctatagcctttgatttaggcaggaaactgggctgcggggcatatttgaaaaccctggtcagggaatcttacggcccattccaccttacaacttcacttgatttggctgaccttgaagcggctgaaaataaaggaaggctggcagatattctgctgccgccggaagccgccgtagggcatttgccgcgtataacccttgatgatgaaagtataacccggctggtaaacgggttggaaataaggctggaaatgaccgggcagccggaagctatggcggtgtatagcgctgaaaaccgctttgcggctgtaatccgccctgaaactgacggcagctggcaccctgccaaagtcttcctgagcccatgccctaaaaagaatgcggattag

SEQ ID NO: 46079 - protein, 300 aa, Dehalococcoides ethenogenes 195
MNGILNINKPPGLTSFGVVSKVRHIYSQKKVGHGGMLDPSATGVIPVFLGSATRLIEYLSSVRKTYLAEIELGTETDSYDSEGEITSRKSCEHITADMVRNALPDFLGEITQIPPMYSAVKHRGVRLYNLARQGIEVERNPRKAAIYGIEFLGFASPVLRLRIECGHGTYIRSIAFDLGRKLGCGAYLKTLVRESYGPFHLTTSLDLADLEAAENKGRLADILLPPEAAVGHLPRITLDDESITRLVNGLEIRLEMTGQPEAMAVYSAENRFAAVIRPETDGSWHPAKVFLSPCPKKNAD

SEQ ID NO: 46080 - DNA, 906 bp, Rhodobacter sphaeroides 2.4.1
  CDS (1)..(906)
atgggacggacgcgcaagggccgggcgatctcgggctggctggtggtggacaagcctgcgggcatgacctcgaccgcggtcgtgaacaaggtgcgctgggcgctcgaggcgcagaaggcgggccatgcgggcacgctcgaccccgatgcgacgggcgttctggccgtagccctgggcgaggccacgaagaccgtgccctacatcaccgatgcgctgaaatgctaccgcttcatggtgcggctgggcctgtccacccgcaccgacgacgcgagcggcgaggtgatcgccacctccgaggcgcgcccgacggatgcggagatcgaggcagcgctggcggccttccggggcgagatccagcaggtgccgccgcagttctcggcggtgaaggtcgagggcgagcgcgcctatgatctcgcccgggacggcgagcggctggatctggcggcccgtccgctctgggtcgaaagcctcgaaatcctttcgcggcccgacgcggaccatgtcgagctggagatggtctgcggcaagggcggctatgtccgctccatcgcgcgcgatctcggcgaggcgctcggctgccacggccatgtcgcctggctgcgccgcacctggtcggggccgttcgaggccgaggacgggatctcggtcgcgaccatcgacgagctcgcgcggagcgaggcgctgctttcccatgtgctgccgctggcgaagggcctcgcggatctgcccgaactgccggccacgcccgagggggccgcgcggctccggtgcggcaatcccggcatggtcatcgcctcggatgtcgagttcggcgaggaagcctgggcgagtttccagggccagcccgtcgcggtgggcatctacaagtcgggcgagctgcatccgagccgggtgttcaacctctga

SEQ ID NO: 46081 - protein, 301 aa, Rhodobacter sphaeroides 2.4.1
MGRTRKGRAISGWLVVDKPAGMTSTAVVNKVRWALEAQKAGHAGTLDPDATGVLAVALGEATKTVPYITDALKCYRFMVRLGLSTRTDDASGEVIATSEARPTDAEIEAALAAFRGEIQQVPPQFSAVKVEGERAYDLARDGERLDLAARPLWVESLEILSRPDADHVELEMVCGKGGYVRSIARDLGEALGCHGHVAWLRRTWSGPFEAEDGISVATIDELARSEALLSHVLPLAKGLADLPELPATPEGAARLRCGNPGMVIASDVEFGEEAWASFQGQPVAVGIYKSGELHPSRVFNL

SEQ ID NO: 46082 - DNA, 903 bp, Xylella fastidiosa Ann-1
  CDS (1)..(903)
atgtctcgcatttcctatcgtcgtttggatggtattttgctgcttgataagccagctggcataagttctaacagtgcgttacaggtcgcgcgtcggttattgcgtgctaaaaagggggggcatactggtagcttggatccactcgctactggattgttgccgctgtgttttggagaagccaccaaaatcgctggtttgctactggattctaccaaggcatacgacgctgacgtgctactcggcaccacgacgacgacggatgatgctgaaggggctgtattacttacgcgccctgtgccgacgttagatgccgaaatggttgatgctcttatacctcaattgattggtcggattaggcaacgtgccccaatctattctgctctcaaacagggcggtgaacctttatatgctaaagctcggcgtggtgaagtggtcaatgccccggtacgtgaggttgaggtgcatgcgatcgaattgcttgttttggctacgccgcgattacaattacgtgtgacttgcggttcgggtacatatattcgtagcctagttcgcgatttgggcgaaatcttgggctgcggcgcacatatcactgcattgcgccgtcgttgggtcgctccatttcagataccgaagatgttgacgttggatgcattggagcaggcattgagtgcagggagagatcctgattctctgttattgccattggttgaaggattagccggtttcccagcgctggacctcgatgcccagcgtctagcttgcttcaggctagggcagcgcttgcgcgatcatagtttccagactgggcgggttgcggtgttcagtcgagatggtatccctgcggggctgggggaggtggatagtgaaggcttgttggtgccgcagcgtcttttcaatctttga

SEQ ID NO: 46083 - protein, 300 aa, Xylella fastidiosa Ann-1
MSRISYRRLDGILLLDKPAGISSNSALQVARRLLRAKKGGHTGSLDPLATGLLPLCFGEATKIAGLLLDSTKAYDADVLLGTTTTTDDAEGAVLLTRPVPTLDAEMVDALIPQLIGRIRQRAPIYSALKQGGEPLYAKARRGEVVNAPVREVEVHAIELLVLATPRLQLRVTCGSGTYIRSLVRDLGEILGCGAHITALRRRWVAPFQIPKMLTLDALEQALSAGRDPDSLLLPLVEGLAGFPALDLDAQRLACFRLGQRLRDHSFQTGRVAVFSRDGIPAGLGEVDSEGLLVPQRLFNL

SEQ ID NO: 46084 - DNA, 894 bp, Lactobacillus gasseri
  CDS (1)..(894)
atgctaaatggaattgtagtagtaaataagccacgtggagtaacaagcagtgattgtgtttataaattaagaaagatacttcaaattagaaaaatcggacatgctgggacgcttgatcctgaagttaatggcgtattaccaattgctattggtcaagcgacgaaattgattgaattaatgcatgaaaaacctaaatcctatattggaagcggaatgtttgggcgagctactgatagttatgatttagatggtaaaactattgctgaagaaaaaataaatactccgtttacaagtaatgaaattattgctggcatggaaaagttgacaggaaagcttgagcaagtaccgccaatttattcagctgtaagagtaaatggtaaaaggctttatgaatatgctcgggaaaatattccagttgaacgtcccaagcgaaaagtcaatgtttatagctatgaattaacacaagatccagaatatgatccattggaaaaaacagaaagctttaattttgcaattcgctgttctaaaggaacctatgtcaggtcattagtaaatgatttaggtgaagaattaggtgtacctgctgtaatgactagtcttacgcgaactagtagttcaggctatgacttaaatcaagctgtagatttagaaacaattgaagcagaaatagatactccaggaaaatggcttcagccaattgatagcttttttgctgaattacctcaacttcaactttcgccagatcaatttaaacgggtttcaaacggtgcaagcattagtttaaataccagttatgctaaggtcgctttggtttataatggtcatataaaagctatttatcggcgacaaggaaaaatctatcgccctgagatgatgcttttaaaaaatgaatag

SEQ ID NO: 46085 - protein, 297 aa, Lactobacillus gasseri
MLNGIVVVNKPRGVTSSDCVYKLRKILQIRKIGHAGTLDPEVNGVLPIAIGQATKLIELMHEKPKSYIGSGMFGRATDSYDLDGKTIAEEKINTPFTSNEIIAGMEKLTGKLEQVPPIYSAVRVNGKRLYEYARENIPVERPKRKVNVYSYELTQDPEYDPLEKTESFNFAIRCSKGTYVRSLVNDLGEELGVPAVMTSLTRTSSSGYDLNQAVDLETIEAEIDTPGKWLQPIDSFFAELPQLQLSPDQFKRVSNGASISLNTSYAKVALVYNGHIKAIYRRQGKIYRPEMMLLKNE

SEQ ID NO: 46086 - DNA, 1026 bp, Magnetospirillum magnetotacticum MS-1
  CDS (1)..(1026)
atgcaggacgagatttcttccgaacgcgccgtcgaggtgccgcaggggccgcgcggtgatgtccgccgggatgggccgccgcgcggcggacgccggccccaacgcggtcggccgcgccaggatcgcccgaagaagaatgacgtgagcggctgggtggtgctcgacaagggcgtcggcatgacctcgacccaggccgtggcggtggtgaagcgcctgttcaacgccaagaaggccggccatgccggcaccctggatccgttggcctccggtatcctgccgatcgccctcggtgaggcgaccaagacggttcccttcgtcatggacggacgcaaggcctaccgtttcgaggtgacctggggcatcgagaccgataccgacgacgccgaggggcgcccgatcgccacgagcgacgtccgtccgacccgcgaggcggtcgaggcggctctgccgtccttcgtcggcgagatcgagcaggtgccgccgcgcttctcggccatcaagatccagggcgagcgcgcctacgatctcgcccgcgacggcgaggtggtggaactcgtggctcgcgcggtgcgcatcgatcacctctcggtgatcgagcatgagggtgaccgcacggtgctggccgccgaatgcggcaagggaacctatgtccgggcgctggcccgcgacctcgggcggatgctcggctgctacggccacgtttccgccctgcggcgcacccgcgtcggccccttcgaggaggcgagcgcctgcagcgtcgcagccttggaggagagcacggagatgcacctccactcggtcgagacggccctggacgagattccctcggtggcagtgagccgcgacatggggcttcgcctgatgcgcgggcagccggtgatcctgcgcgggcaggacgctccgatggagggcaaggccttcgccacctgcggcggcgtcctcgtcgcggtcggcgatgtggcgcgtggcgagctggtgccgcaccgggtgtttcacctcggcggaacagcaccgcagcggaactga

SEQ ID NO: 46087 - protein, 341 aa, Magnetospirillum magnetotacticum MS-1
MQDEISSERAVEVPQGPRGDVRRDGPPRGGRRPQRGRPRQDRPKKNDVSGWVVLDKGVGMTSTQAVAVVKRLFNAKKAGHAGTLDPLASGILPIALGEATKTVPFVMDGRKAYRFEVTWGIETDTDDAEGRPIATSDVRPTREAVEAALPSFVGEIEQVPPRFSAIKIQGERAYDLARDGEVVELVARAVRIDHLSVIEHEGDRTVLAAECGKGTYVRALARDLGRMLGCYGHVSALRRTRVGPFEEASACSVAALEESTEMHLHSVETALDEIPSVAVSRDMGLRLMRGQPVILRGQDAPMEGKAFATCGGVLVAVGDVARGELVPHRVFHLGGTAPQRN

SEQ ID NO: 46088 - DNA, 936 bp, Magnetospirillum magnetotacticum MS-1
  CDS (1)..(936)
atggcccgcaagcgcaagggcgatcccgtcgatggctggctggccatcgacaagcccttaggaatcggctccacccaggtggtagccaaggtcaagcgcatcctcaacgccgccaaggtcggccatggcggcaccctggaccccttggcgtcgggcatcctgcccatcgcgctgggcgaggccaccaagacggtgcaatacgtcatggatggggccaagacctaccgcttccagctgcgctggggcgaggccacggccagttgcgacaaagaaagcgaggtgatcgagacgtcgccggttcgccccagtgccgaggccattcaggcggctctgcccggctttgtgggcgagatcgaccagatcccgcccgccttttccgccatcaagatcgacggccagcgtgcctatgatctggcccgcgccgggcaagaggtggagatcaagccccgccgggtcgccatccactccttcaccctgctgggccagcccgattccgatcatgccgatttccaggtccattgcggcaagggcacctatgtgcgttcgctcgcccgcgatctggccctggcgctcggcactgtcgggcatgtctcggttctgcggcgtaccgcctgcggcccgtttacggagcaaaacgcgatttcccttgaatccctggaggagttgagtcaagttcccgccccttggacctttctgcttcccatcgagaccgcgctggacgacatcccggcgctggccctgacggaaagcgaggcccgccgcctccgaagcggtaatcccgtgtcaatctcgcacgtggtttcccggcacccgcaggctgaactcgtcgaaggcacagtgtgccgggcgatgcaggcagagcggctggtggcgttggttcgcatcgaatgcggagaaatccgtccggtgcgggtcatgaatctcaccgaagaatag

SEQ ID NO: 46089 - protein, 311 aa, Magnetospirillum magnetotacticum MS-1
MARKRKGDPVDGWLAIDKPLGIGSTQVVAKVKRILNAAKVGHGGTLDPLASGILPIALGEATKTVQYVMDGAKTYRFQLRWGEATASCDKESEVIETSPVRPSAEAIQAALPGFVGEIDQIPPAFSAIKIDGQRAYDLARAGQEVEIKPRRVAIHSFTLLGQPDSDHADFQVHCGKGTYVRSLARDLALALGTVGHVSVLRRTACGPFTEQNAISLESLEELSQVPAPWTFLLPIETALDDIPALALTESEARRLRSGNPVSISHVVSRHPQAELVEGTVCRAMQAERLVALVRIECGEIRPVRVMNLTEE

SEQ ID NO: 46090 - DNA, 909 bp, Leuconostoc mesenteroides subsp. mesenteroides ATCC 8293
  CDS (1)..(909)
atgacaaagaatcagatagttgatggtttgttagttatcaataagtctcgtggcatgacatcttttgatgttgttagtagagtacgccgtattattggtcaaaaaaaagttggccatgctggcactttagatccgaatgttgatggtgtcctagtagttgctttaggtaaagcgacaaagttgattgatgaattgcaaacacggccaaaaagttatattggtgaaattacattagggttttcaacagaaacagaggaccttgatggtgaaatcgttgatcagctggatatcgtaacgcctttttctgaccagaaaattgatcaagcgatacagcaattaaatggcgaaatcacacaaaggccacctatgtactctgctgtaaaagttaatggtaagcggctctatgagtatgctcgaaatggtgagactgttgaacgtccagttcgtaaagcggtaattcatgactttaaacgtacatccggtattaaatttatagaaggtaagcaggtattcaagtttgaagccacagtttccaagggcacgtatattcgcactttagccgtagatgcaggcaaaataattgggatcccggcaacaatgacacaattaactcgaacgatggggagcggattcaaaatttctgaagcacgtgacctggattttttgtccacactatcgtatgaagaagtattaaaacaagtaatacctattagagaagtattgaagtggccaactaaaaatttgagtgaaaatgaatggtttgctgtaaaaaatggtcagaaaatttctagttggcctgcaaatgacagctatttgcaactatattatcaaaacaaactgaaagcagtatatcaatatgacgagattgagcaattatggcgctctcgttatgtatttgataaccaatga

SEQ ID NO: 46091 - protein, 302 aa, Leuconostoc mesenteroides subsp. mesenteroides ATCC 8293
MTKNQIVDGLLVINKSRGMTSFDVVSRVRRIIGQKKVGHAGTLDPNVDGVLVVALGKATKLIDELQTRPKSYIGEITLGFSTETEDLDGEIVDQLDIVTPFSDQKIDQAIQQLNGEITQRPPMYSAVKVNGKRLYEYARNGETVERPVRKAVIHDFKRTSGIKFIEGKQVFKFEATVSKGTYIRTLAVDAGKIIGIPATMTQLTRTMGSGFKISEARDLDFLSTLSYEEVLKQVIPIREVLKWPTKNLSENEWFAVKNGQKISSWPANDSYLQLYYQNKLKAVYQYDEIEQLWRSRYVFDNQ

SEQ ID NO: 46092 - DNA, 918 bp, Azotobacter vinelandii
  CDS (1)..(918)
atgacccagggtaaacgtatccgccgcaaggtcgacggcatcctggtcctcgacaagccgcatggactgacctccaacgccgcgttgcagaaggtgcgctggcttctgaacgccgagaaggccgggcataccggtagcctcgacccgttggccaccggtgtgctgccgctgtgtttcggcgaggcgaccaagttttcccagtacctgctggatgccgacaagggttacgagaccctgatgcatctcggcgtgaccacgactaccggcgacgccgagggtgaggtgctcgagcgacgtgccgtgcagctcgggcgcgatgcgctggagtcggtactggcggatttccgcggcgagatcagccaggtcccgcccatgtattcggcactcaaacgtgacgggcagccgctctacaagctggccagggccggcgaggtggtggagcgcgaggcgcgttctgttactattgcgcgcctggaactgctggccttcgagccgccgttcgcacggctggcggtggcttgcagcaagggcacctatgtgcgttccctggtcgaggacatcggccgggcgctcggattcggagcgcacgtcgcggagttgcgcaggacccaggccggacctttcgggctggcccggacggtcagcctcgcggcccttgagcaggcccatgccgaaggtggcagcgaggcgctcgaccctttcctgctgccggcggacagcggtctggagcattggccgttgctgcagctctccgagcacagcagctactactggctgcacgggcagccggtgcgtgcgccgcagtcgccgaagttcggcatggtgcgggtgcaggatcatacgggccgcttcatcggtatcggtgaagtgggcgacgacgggcgcatcgcgccgcgtcgactgattcggtcggaatga

SEQ ID NO: 46093 - protein, 305 aa, Azotobacter vinelandii
MTQGKRIRRKVDGILVLDKPHGLTSNAALQKVRWLLNAEKAGHTGSLDPLATGVLPLCFGEATKFSQYLLDADKGYETLMHLGVTTTTGDAEGEVLERRAVQLGRDALESVLADFRGEISQVPPMYSALKRDGQPLYKLARAGEVVEREARSVTIARLELLAFEPPFARLAVACSKGTYVRSLVEDIGRALGFGAHVAELRRTQAGPFGLARTVSLAALEQAHAEGGSEALDPFLLPADSGLEHWPLLQLSEHSSYYWLHGQPVRAPQSPKFGMVRVQDHTGRFIGIGEVGDDGRIAPRRLIRSE

SEQ ID NO: 46094 - DNA, 885 bp, Nostoc punctiforme PCC 73102
  CDS (1)..(885)
atgttatttcaaggttttctcaacttaaacaaaccatttgactggacttcccacgactgcgtagcgcgggtgcgaaaattgttgcgcctcaaacgtgtcggacatgcgggaaccttagatccagccgccacaggagttttaccaattgcccttggtaaagccacaagattattgcaatatctgccagaaaataaagcttacaaagccactattcgcctgggtgtgcgtaccacaaccgatgatttacaaggtgaaatcatcacttctcaaccttgtactggattgagtttggcagaggtaaaaactgcattagcacaatttgaaggcaaaattgagcaaataccacctatttatagtgcaatccaagtggatggtaaacgtctctacgatttagcacgccaagggaaaacagtagaagttccagtgcgaacagtggaagtttttcggatagatattttggactggagagaaggagattttcctgaattggatgtggcgatcgcttgcggttctggtacatatattagagcgatcgctcgtgacttaggtgcaagcttagaaactggtggtactcttgcggctttaatccgtaccgaaagtagtggtttcaatttaaccgatagcctcaccttgactgatttagaagcacaactagaagccggaacatttcaactcgttttcccagatgcggctttacaacatttatcatctgttactttaccagcaacatctgctcaaaagtggtgtcaaggtcagcgaatttctctaacttttgatgttcctagaatagtgcgagtttatgatgaagaaactcgttttttaggtattggacaattacaagacgaagtgttgatccctcaaatggtttttgaaccaatttcttaa

SEQ ID NO: 46095 - protein, 294 aa, Nostoc punctiforme PCC 73102
MLFQGFLNLNKPFDWTSHDCVARVRKLLRLKRVGHAGTLDPAATGVLPIALGKATRLLQYLPENKAYKATIRLGVRTTTDDLQGEIITSQPCTGLSLAEVKTALAQFEGKIEQIPPIYSAIQVDGKRLYDLARQGKTVEVPVRTVEVFRIDILDWREGDFPELDVAIACGSGTYIRAIARDLGASLETGGTLAALIRTESSGFNLTDSLTLTDLEAQLEAGTFQLVFPDAALQHLSSVTLPATSAQKWCQGQRISLTFDVPRIVRVYDEETRFLGIGQLQDEVLIPQMVFEPIS

SEQ ID NO: 46096 - DNA, 930 bp, Desulfovibrio desulfuricans G20
  CDS (1)..(930)
atggctgattcgaaacttgcacagcagcacggggtactggtacttaacaaacctaaaggccccacatcggctcactgcatcgccagaatcaaacggctggggcagaaaaaaataggccacgccggcacgctggaccccatggctcagggcgtgctgctggtgctgctgggccagtgcaccaagatttccggctatctgatggaaggcggagaaaaaatatactccggcacgctggaactgggacgcaccacagacacgtgggacgacgaaggcgaaacactttccacagcagactggacgcacgtaaccgaagaggacgtggtccgcgctgtcgacttgtggacaggttcgtcggaacagcaggttccggcatattccgcggccaagcacaaggggcagcccctgtacaagctggcacgcgaaggtaaggaaacgcctgtcaaaacaaggcgtatagaaatttcacaggcggaaacgctcgctgttgagctgccgtttgtgcgcttccgggttcattgcagttcgggcacctatatacgatccctggcccacagcttggggaaccgtctagggtgcggcgctgtgctgaccgaactcatccgggagtacagccacccgttctcgctggacgaagcccatgatctggacgacgttctggcagaaccggcggaacttgccggcagggtcataccgctggacaaggcattgccgcactggcccaagctgcgcctgagcgcagctgacgaagcccgtgtgaaaaacggcatgccccatccgtatgatccggcagaaatggccagcatgccttttaccgaaggtatcagagccgtactgctcgacccggccggtgacccgctggctctggcggaaacagcctacagaaatcaggtgcccgtctggacggttctgcgggggctgtggaatacataa

SEQ ID NO: 46097 - protein, 309 aa, Desulfovibrio desulfuricans G20
MADSKLAQQHGVLVLNKPKGPTSAHCIARIKRLGQKKIGHAGTLDPMAQGVLLVLLGQCTKISGYLMEGGEKIYSGTLELGRTTDTWDDEGETLSTADWTHVTEEDVVRAVDLWTGSSEQQVPAYSAAKHKGQPLYKLAREGKETPVKTRRIEISQAETLAVELPFVRFRVHCSSGTYIRSLAHSLGNRLGCGAVLTELIREYSHPFSLDEAHDLDDVLAEPAELAGRVIPLDKALPHWPKLRLSAADEARVKNGMPHPYDPAEMASMPFTEGIRAVLLDPAGDPLALAETAYRNQVPVWTVLRGLWNT

SEQ ID NO: 46098 - DNA, 918 bp, Actinobacillus pleuropneumoniae serovar 1 str. 4074
  CDS (1)..(918)
atgtccagacctcgtaaaaaagggcgtgatgttcacggcgtatttttattagataaaccgcaaggaatgtcgtcaaacgatattttgcaaaaggttaaacgcctgtttcaagcgaataaagcggggcataccggcgcattagatccgcttgcgaccggaatgcttccgatttgtttaggcgaagcgaccaagttttcacaatttttgcttgattcggacaaacgttatcaagttactgcaaaattaggcaaacgcaccgatacgtccgatgcggaaggtcaagtggtggaaacccgtgcggtgaacgtaggtgaagcggaaattattacggcattggagcaatttcgcggcgatattttacaagtgccgactatgttttccgcattaaaacataacggtaaaccgctctatgaatatgctcgccaaggcattacggtagaaagagaagctcgcccgattacgattttcgaattgcgttttatcgaatatgccgcaccttatcttacgttagaggtacattgctcgaaaggcacttatattcgtactttagtcgatgatttaggcgaagtattgggctgtggtgcgcacgtgacggttctacgccgtttagcggtggcaaattatccgattgaagcgatgatgagctatgcggatttgcaaaatttaagtgaaaatcaaccgcttgaagaattagataaatatcttttacctttagataccgcagtagaaagcctaccaaaactaaacttaaccgcagagcagactaaagcggtcggtttcggtcaaagagtgaaatttgaaaataacgatcaaatttacggacaagttcgtttattttcgcataatatgcaattcctcggtgtcgcggaaattacgaccgataatgtcattcgcccaagcagaatggtaaatatttaa

SEQ ID NO: 46099 - protein, 305 aa, Actinobacillus pleuropneumoniae serovar 1 str. 4074
MSRPRKKGRDVHGVFLLDKPQGMSSNDILQKVKRLFQANKAGHTGALDPLATGMLPICLGEATKFSQFLLDSDKRYQVTAKLGKRTDTSDAEGQVVETRAVNVGEAEIITALEQFRGDILQVPTMFSALKHNGKPLYEYARQGITVEREARPITIFELRFIEYAAPYLTLEVHCSKGTYIRTLVDDLGEVLGCGAHVTVLRRLAVANYPIEAMMSYADLQNLSENQPLEELDKYLLPLDTAVESLPKLNLTAEQTKAVGFGQRVKFENNDQIYGQVRLFSHNMQFLGVAEITTDNVIRPSRMVNI

SEQ ID NO: 46100 - DNA, 864 bp, Fusobacterium nucleatum subsp. vincentii ATCC 49256
  CDS (1)..(864)
ttggaaggaataatagttgtaaacaaaccaaaaggaataacttcctttgatgttataagaaaacttaaaaaaattttaaaaactaaaaaaataggacatactggaactcttgatccacttgcaacaggagttatgcttgtatgtgttggaaaagctactaaacttgcatctgatttagaagctaaaaataaaatatatatagcagattttgatataggctatgcaacagatacctatgatgttgaaggaaaaaaaatagctgaaaatattattgaagtttcaaaagaaaatttagaacaatctataaaaaaatttataggaaatataaaacaagttcctcctatgtattctgctatcaaaattgatggaaataaactttatcatttagcaagaaaagggattgaagttgaaagacctaaaagagatgttactattgaatacattaatcttttagactttaaaaacaataaagctaaaatagaaacagaggtttcaaaaggttgctatataagaagtttaatctatgatataggacaagatttaggaacttatgcaactatgacagcacttcaaagaaaacaggttggagaatattccctagaaaattcatataacttagaacagattgaagaaatgactttaaataatgattttaagtttttaaaaactattgaagaaattttttcttatgacaaatataatttagaaactgaaaaagaatttattttatataaaaacggtaatactgtaaaaacaaaagaaaatttagaaaataaaaagtatagaatttattttcaagatgaatttattggattagcaaatatagaaaataataatttattaaagggatataaatattattaa

SEQ ID NO: 46101 - protein, 287 aa, Fusobacterium nucleatum subsp. vincentii ATCC 49256
MEGIIVVNKPKGITSFDVIRKLKKILKTKKIGHTGTLDPLATGVMLVCVGKATKLASDLEAKNKIYIADFDIGYATDTYDVEGKKIAENIIEVSKENLEQSIKKFIGNIKQVPPMYSAIKIDGNKLYHLARKGIEVERPKRDVTIEYINLLDFKNNKAKIETEVSKGCYIRSLIYDIGQDLGTYATMTALQRKQVGEYSLENSYNLEQIEEMTLNNDFKFLKTIEEIFSYDKYNLETEKEFILYKNGNTVKTKENLENKKYRIYFQDEFIGLANIENNNLLKGYKYY

SEQ ID NO: 46102 - DNA, 1143 bp, Psychrobacter sp. 273-4
  CDS (1)..(1143)
atgtctatcgcatctacgcaagcggataaaaagtctagtaatcaccctgacaagattaaaatttcgggtgttattttagtcgataagcctcaaggtatgacttcacagcaagtggtgtcaaaggtaaaatatttattcaaatcgcctaaccatgacagcaaaaaagcaggtcataccggaacacttgatccgatggcaacggggttgttgcctatctgtttgggtgaagcgactaagttcagtcactatcagcttgatgcggataaatcttatcaagcgactattttacttggtagtcaaactgataccggtgatgctgatggacaagtcactgctgaggcaacgatttcagcgtttgatgatacaatgttagacaaaattgcccagcagtttctaggtgcccagcagcaaattccaccgatgtattctgccttaaaaaaagatggcaaaaaactctatgaatatgctcgtgctggtattgaagtagaccgccctccaagagatattatcctcaaagccattgagttgaaagcaatcgatgagcagcaaatacaattgacagtcacctgttcaaaaggcacttatgtgcgtgtgttggcagaagatattgccaaagccataggtacacttgggcatttgacggcactgagccgtttacaagtgggtgattttaaaatcgatgagacaattacgcttgcaaatttagaggcgttggcattagaacaacgtcagacatatctattgccagtagatgcctgcatcgatattaatgctgagcttacattatcatcagagcagtgtgagcgtgtgcaaatgggtcaacgtttgaatgttatcgatcagttgactaatgatttgcaaagttatattacatcagctatcgaacagcacttatctactagcaataaaaacgctgctgttaatcaaaatgttgaagatgataacgatgataacgatgataacgatgataacgatgataacgatgataacgatgataacgatgataacgatgataacgcgcagcaattgctacatgagataccggtagatattcgtcttatcgatgagcatggaacgtttatcggtctaggggcagtgagcttaaatggtcgattgcaacctaaaaaattgattcagttataa

SEQ ID NO: 46103 - protein, 380 aa, Psychrobacter sp. 273-4
MSIASTQADKKSSNHPDKIKISGVILVDKPQGMTSQQVVSKVKYLFKSPNHDSKKAGHTGTLDPMATGLLPICLGEATKFSHYQLDADKSYQATILLGSQTDTGDADGQVTAEATISAFDDTMLDKIAQQFLGAQQQIPPMYSALKKDGKKLYEYARAGIEVDRPPRDIILKAIELKAIDEQQIQLTVTCSKGTYVRVLAEDIAKAIGTLGHLTALSRLQVGDFKIDETITLANLEALALEQRQTYLLPVDACIDINAELTLSSEQCERVQMGQRLNVIDQLTNDLQSYITSAIEQHLSTSNKNAAVNQNVEDDNDDNDDNDDNDDNDDNDDNDDNDDNAQQLLHEIPVDIRLIDEHGTFIGLGAVSLNGRLQPKKLIQL

SEQ ID NO: 46104 - DNA, 837 bp, Dechloromonas aromatica RCB
  CDS (1)..(837)
atgacctccaacgatgctctgcaaaaggcacgtcgcctcttttcggcggcaaagggcggccatacagggacactggaccccctggctactggcctgctcccattgtgtttcggcgaggcgaccaagttttcggccgatttgcttgatgccgacaagacctatgaggccgttctcaagcttggtgttacgactgattcaggggatgcagaggggcaggtgacgtcgactgcgatggtcgatatccaaaaggagcaggtttctgaagtcttgcccagattcgttggcgacatccagcagattccgcccatgcattcggccttgaaacgcaatggtcggccactctatgaattggctcgccaggggatcgaagtcgaacgcgagccgagggcggttactatttttgccatcgattgcctcgatttttccggtgatttgctgacgttgcgcgttgcttgcagcaagggaacctatattcgtgtgctggccgctgatatcggcaaggcattgggttgcggtgcgcatctggcagcgctccgccgaatcgtggtgggcgatatacgcctgggcaactccgtcacactggctgagttggaaaccttggacgaggcaggccgtatggagaggctcctgccggttgatgccttgctgcagtctttgcccatcgtcggcgtcgaggggccggaagcggaacgcttccgccatggcaatccggtgagcttgccggccgggttggccggtaaagctcgggtctatgccgaggggcgattgattggtgtcggtgagccgggtcatggtggtttgctttggccgaaaaggctggttcaactggctgattaa

SEQ ID NO: 46105 - protein, 278 aa, Dechloromonas aromatica RCB
MTSNDALQKARRLFSAAKGGHTGTLDPLATGLLPLCFGEATKFSADLLDADKTYEAVLKLGVTTDSGDAEGQVTSTAMVDIQKEQVSEVLPRFVGDIQQIPPMHSALKRNGRPLYELARQGIEVEREPRAVTIFAIDCLDFSGDLLTLRVACSKGTYIRVLAADIGKALGCGAHLAALRRIVVGDIRLGNSVTLAELETLDEAGRMERLLPVDALLQSLPIVGVEGPEAERFRHGNPVSLPAGLAGKARVYAEGRLIGVGEPGHGGLLWPKRLVQLAD

SEQ ID NO: 46106 - DNA, 921 bp, Haemophilus influenzae R2866
  CDS (1)..(921)
atgtctagacctcgtaaacgctggcgtgatgttgatggtgtgtttttgttggataagccacaaggcatgtcatcaaatgacatcatgcaaaaggtgaagcgtttatttcaagcgaacaaagcggggcatactggcgcgctcgatccgttggcaacgggaatgttgcctatttgcttgggtgaagcaactaagttttcacaatttttgcttgatgccgataagcgttatcttgttacggcaaaattaggcgaacgtaccgatacttccgatgcggaagggcaagtcgtggaaactcgtgaagttaatcttgaaactccgcaaattttgaccgcacttgaacaatttcgtggtgatattttacaagtgccgacaatgttttcagcactaaaacataacggcaaaccgctttatgaatatgcgcgccaaggtattacggttgagcgtgaggcacgtccaattacgatttttgaacttaattttattgaatatcacgcaccttatttaaccttagaagtgcattgttcaaaaggcacttatattcgcactttagtagatgatttgggtgaagtgctaggttgtggcgcgcatgtgacaatgttacgccgtacagccgtagcggattaccccgtagcagaaatgatgccaatcaatgagttacaactgctcgctgaaagttttccattaagtgaattggatcatctattactaccaaccgataccgcagtaagtaaattgcctgctttgcatttggatgcagagcagagtaaagctattggttttggtcagcgagtgaaatttgctaacgaacagcaattaagtggacaagtgcggttattttcagcggagaatttattcttaggcgtagccttaatcgatgggaatattattcgcccacaacggttaattacacaatccgcataa

SEQ ID NO: 46107 - protein, 306 aa, Haemophilus influenzae R2866
MSRPRKRWRDVDGVFLLDKPQGMSSNDIMQKVKRLFQANKAGHTGALDPLATGMLPICLGEATKFSQFLLDADKRYLVTAKLGERTDTSDAEGQVVETREVNLETPQILTALEQFRGDILQVPTMFSALKHNGKPLYEYARQGITVEREARPITIFELNFIEYHAPYLTLEVHCSKGTYIRTLVDDLGEVLGCGAHVTMLRRTAVADYPVAEMMPINELQLLAESFPLSELDHLLLPTDTAVSKLPALHLDAEQSKAIGFGQRVKFANEQQLSGQVRLFSAENLFLGVALIDGNIIRPQRLITQSA

SEQ ID NO: 46108 - DNA, 948 bp, Ralstonia eutropha JMP134
  CDS (1)..(948)
atgactgactccgcaaacaaccgtccgccccggctcccgcgccgcgaggtgcacggcgtgctgttgctcgacaagccgctagggctgtcttccaacgacgcgctcgtgcgcgccaaacgcctgctgcgggccctcaaggccggccacaccggcacgttggaccctctcgccacagggctgctgccgctttgctttggcgaggcgacgaagttctcgcaggacttgctcgatgcggacaagacttacgaggcggtcgtcaggctcggtcagaaaaccactaccggcgatgccgaaggcgaagttgtggttgagcggccggtgagctgcgaccgtgccgggctggacgccgcaatcgcacgtttcctcggtgagatcgaccaggttccgccgatgcattctgcgctgaagaaggatggccggccgctgtatgagtacgcgcgagcgggacagaccgtggagcgacccgcccggcgcgtcacgattcacgcgatcgacgtgctcgattgtgccttgccgctggcgccttccttcacgatgcgggtgaagtgcagcaagggtacgtatattcgcacgctggccgaggatattggcgaggcgctcggctgtggcgcacacctgaccgggttgcgccgcatcgctgtcggcgacctgacgctcgatggcgctgtgacgctcgatcagatcgacgcgcaggcggacgaggcccgcccggccatgctggcgccggtcgatgcgctgttgcgacgctgcccgccggtgacgctgtccgccgaagcgatgtcgcgcttcctgcaaggtcaacgcctcgcataccgggatctggaccccgacagtgcgccgcaggaaggcgtgcttgcgcgtgtctatggcggcgagccgccgaagctgctcggcgtggcccgcatgcgtgaaggcgccctgcggccggaacgactggtccggctgtaa

SEQ ID NO: 46109 - protein, 315 aa, Ralstonia eutropha JMP134
MTDSANNRPPRLPRREVHGVLLLDKPLGLSSNDALVRAKRLLRALKAGHTGTLDPLATGLLPLCFGEATKFSQDLLDADKTYEAVVRLGQKTTTGDAEGEVVVERPVSCDRAGLDAAIARFLGEIDQVPPMHSALKKDGRPLYEYARAGQTVERPARRVTIHAIDVLDCALPLAPSFTMRVKCSKGTYIRTLAEDIGEALGCGAHLTGLRRIAVGDLTLDGAVTLDQIDAQADEARPAMLAPVDALLRRCPPVTLSAEAMSRFLQGQRLAYRDLDPDSAPQEGVLARVYGGEPPKLLGVARMREGALRPERLVRL

SEQ ID NO: 46110 - DNA, 909 bp, Methylobacillus flagellatus KT
  CDS (1)..(909)
atgcaattcaaacgagtcaagcgcaatatagatggtgtgctgttgctggacaagccgctcggcatttcctccaatcaggcattgcaaatggtcaagcggctttaccaggcagccaaggctggacatacaggcagccttgacccactggccagtggcctgttgcccatttgcctgggtgaagccaccaaattttcccattttctgcttgatgcagacaaaagttaccgggcattggtgacattgggcagtacgacaaccactggcgacgttgaaggcgagatcatgacgcaagcaccggtaacggtgacgcagtccgaattggaagccatactacaggacatggtgggcgatatattgcaagttcctcccatgtattctgcattgaagcatgaaggaaaagcgttatatgcatatgcgcgcgagggggtagaaattccccggaagccaaggccggtgaccatacatgccattgcactcgagcggtttgacggcaagcagttcgagatggtggtgtcgtgcagtaaagggacttatatcaggacgctggcagaggatataggcagtcgcctgggttgtggcgctcacctcggtggcttgcggcgcctgacgacggcgcacttcaatctaaagaatgctgtgaccatcgaacagctcgatcaaatgtcgcaagcagagcgggatgcagtcttgttgcaagtggatgctgctattgaagactttccaattgttaccctggatgctgacagcgctttttatttattgcaaggccaagaagtgtggaagtccgggttgagcatttccgggttgttcaggttatattccgaacaaggtgcttttctgggtctcggtgaacaaacttcccgaggatccattgctcccaggcgtttgcttcgccaggctggcgagtaa

SEQ ID NO: 46111 - protein, 302 aa, Methylobacillus flagellatus KT
MQFKRVKRNIDGVLLLDKPLGISSNQALQMVKRLYQAAKAGHTGSLDPLASGLLPICLGEATKFSHFLLDADKSYRALVTLGSTTTTGDVEGEIMTQAPVTVTQSELEAILQDMVGDILQVPPMYSALKHEGKALYAYAREGVEIPRKPRPVTIHAIALERFDGKQFEMVVSCSKGTYIRTLAEDIGSRLGCGAHLGGLRRLTTAHFNLKNAVTIEQLDQMSQAERDAVLLQVDAAIEDFPIVTLDADSAFYLLQGQEVWKSGLSISGLFRLYSEQGAFLGLGEQTSRGSIAPRRLLRQAGE

SEQ ID NO: 46112 - DNA, 894 bp, Crocosphaera watsonii WH 8501
  CDS (1)..(894)
atgcttggatttatccctttaaataaaccatcagggtttacgtctcatgattgtgttgccaaggttagacgactcttaaacatcaaaaaggtaggacacggaggaaccctagatccagcagcaacaggggttttacccatagcagttggtaaagcaactcgtctcttaccttttttaccagaaaataaggcttatcgggcgactattcgcttcgggatgcaaaccacaaccgatgatctccaaggagaggttattcaacgtcaatctgcctctcatttgactatagaagagattaaacccttattcaacgattttttaggtgaaattgagcaaataccccctatatatagtgctattcaaagagatggtaaacgattgtatgagttagcaaggaaaggagaaatcgtggatattcctgtgagaagagttaaggttgacaaaatagaagttttagactggtatgtagaagaattttgtgaattggtggttaatattgaatgtggtccagggacttatattcgggcgatcgccagggatataggggacaagctaggggttgggggaaccttagcagcattaaccagaactaaaagttgtggcatgattctatcagaaagcattagtttagaagagttagaaaaacaaattgaagaaggaacattttctttaaatgaaccaggattacttctaaaacatttacccaatattactctttctttagaagaaggtaaacgttggggtcaaggacaaaaaatagcaatttcttctattaattttgttactgctgatgacattattcaggtaaataatgaagcaggggagtttttaggaatcagtcaaattatctctaaagatactcatcaaattctcaagccaaaagttgttattaaatag

SEQ ID NO: 46113 - protein, 297 aa, Crocosphaera watsonii WH 8501
MLGFIPLNKPSGFTSHDCVAKVRRLLNIKKVGHGGTLDPAATGVLPIAVGKATRLLPFLPENKAYRATIRFGMQTTTDDLQGEVIQRQSASHLTIEEIKPLFNDFLGEIEQIPPIYSAIQRDGKRLYELARKGEIVDIPVRRVKVDKIEVLDWYVEEFCELVVNIECGPGTYIRAIARDIGDKLGVGGTLAALTRTKSCGMILSESISLEELEKQIEEGTFSLNEPGLLLKHLPNITLSLEEGKRWGQGQKIAISSINFVTADDIIQVNNEAGEFLGISQIISKDTHQILKPKVVIK

SEQ ID NO: 46114 - DNA, 909 bp, Exiguobacterium sp. 255-15
  CDS (1)..(909)
atggaacccataggagtattaccgctggacaaaccggcaggcatgacgagtcacgactgtgtctttcgactgcgccggctctttcagacaaaaaaagtcgggcataccggaacacttgacccggaagtgacaggtgtcttaccgatctgtctcggacgtgctacaaaacttgcacgtttcattacagacgaaggaaagagatatgtggcagaagtgacgatcggatatgcgacgacgaccgaagacgcccacggtgaaaccgtccgcgaaacaccggtcacgcccgcgtcaattacggagcaacaagtagatgaaattctacagcaactgaccggacagattgaacagaccccaccgtattattcggcggtcaaagtaaacgggaaaaaattgtatgaatatgcccgtaaaggcattgaagtggaacgtccgacccgaacggttcaaattgatacgttggaacggacatccgggctgacttttgcagacggactctgccggtttcaaatcgagattgcttgcggaaaaggaacttatatccggacgcttgccgttgaaatcggtgaacagttgggttatgcggcccacatgagtgaattgcgccgaacgagttcaggaatgatgtctgaaacagaagcagtgacgctggctacgcttgaagcctgtgagactgtcgaagagcggatgcaatacgtcttaccgattgaacaagtcattcaaaagtggccgcggttgactgtaaatgccgagacggcggctcgtgtattgaatggggcaaaattaccaggcattccggtcgaatttgaacgatttactgtctataatgaagagggcatccctttagcgatctaccggcttgattccgagatcaatatgggacgcgttgaagtcatgttacaaatcgattag

SEQ ID NO: 46115 - protein, 302 aa, Exiguobacterium sp. 255-15
MEPIGVLPLDKPAGMTSHDCVFRLRRLFQTKKVGHTGTLDPEVTGVLPICLGRATKLARFITDEGKRYVAEVTIGYATTTEDAHGETVRETPVTPASITEQQVDEILQQLTGQIEQTPPYYSAVKVNGKKLYEYARKGIEVERPTRTVQIDTLERTSGLTFADGLCRFQIEIACGKGTYIRTLAVEIGEQLGYAAHMSELRRTSSGMMSETEAVTLATLEACETVEERMQYVLPIEQVIQKWPRLTVNAETAARVLNGAKLPGIPVEFERFTVYNEEGIPLAIYRLDSEINMGRVEVMLQID

SEQ ID NO: 46116 - DNA, 939 bp, Mesorhizobium sp. BNC1
  CDS (1)..(939)
atggcgcgtcgcggaaagaaaaagggccgagccgtctcgggctggctggtgctggacaagccggccgggcttggttccacggaggctgtctccaaggtgaaatggctgttcggcgcacagaaggctggacatgccggcacattggacccgctcgcctccggcatgttgcccatcgctcttggcgaggccacgaagaccgttccctatgtcatggaaggggcgaaggtctaccggttcacggtcgcttggggtgaggaacgctcgacggacgatcttgagggaccggtgacaaagtcctgtgacaaggtgcctgtggaagaggacatacgagcgctcctgccgcggtacacggggctgatcatgcaaacgccgccccaattctccgccgtgaagatcggtggggaacgcgcctatgatctggcgcgagaaggcgaggtggtggaaattgcagcgcgcgaggtggagatcgggcggctcgatctcatttcgattcccgaaccgaaaaaggccgtgttcgaagtggaatgcggcaaggggacctatgtccgctcgctcgcccgcgatatgggccgcgatctaggctgtttcgggcatgtcgccgatctccggcgcacagaagtctacccattcgagacgcaacaattggtgccgctgaaggatttggaaggcgccgcagccgatgcggaaacggaaagcgatcgattttctgccctggactcctatcttctcgatacggaagcggccctcgacggattacccgaaatcgtcctgggcgatgatgcggcaggccgtatccggcttgggaatccggtgatcgtgcgcggccgggacgctccggtacaggcgccggaagcttgggccagcctgcgcggccgtttgatcgcgatcggcatggtggaggccggcatgttcaagccgaaaagggtttttgggctctaa

SEQ ID NO: 46117 - protein, 312 aa, Mesorhizobium sp. BNC1
MARRGKKKGRAVSGWLVLDKPAGLGSTEAVSKVKWLFGAQKAGHAGTLDPLASGMLPIALGEATKTVPYVMEGAKVYRFTVAWGEERSTDDLEGPVTKSCDKVPVEEDIRALLPRYTGLIMQTPPQFSAVKIGGERAYDLAREGEVVEIAAREVEIGRLDLISIPEPKKAVFEVECGKGTYVRSLARDMGRDLGCFGHVADLRRTEVYPFETQQLVPLKDLEGAAADAETESDRFSALDSYLLDTEAALDGLPEIVLGDDAAGRIRLGNPVIVRGRDAPVQAPEAWASLRGRLIAIGMVEAGMFKPKRVFGL

SEQ ID NO: 46118 - DNA, 798 bp, Rubrobacter xylanophilus DSM 9941
  CDS (1)..(798)
atgaagcgcctgctcccccggcggacgaaggtggggcacaccgggaccctggacccgctggcctcggggctgctcgtgctcctcgtgggccgggcgacccggctctcgcgctacgttaccgggctggacaagacctacgtcgccacggcccgcttcggggccgcctcggacaccctggacgccgacggcgagatcctggagaacgccggcccggtgccagacgaggcggagctgcggcgggcgctgccccgctttgtcggcgagatccggcagctcccccccatggcctcggccgtgagggtcgggggccggcgcctctacgagctgcaccgccgcggggtcgaggtggagcgcgagccgcgcctcgtcagggtccactccctcgagctcctctccttcgacccccccgccgccaccttcgccgtctcctgcagcagcggcacctacgtccgtaccctgatctccgacctcgccgcctccctcggcaccgccgcctacctcaccgccctgcgcaggacccgcgtcggtcacctgcgcgtcgaagacgccctgcccccccaagacctcgacccctccaccatccatcaccgcataatacccccttcgggggtgctggcccacctccccgcggtggaggccgacgaggggcgggcgcgggcggtcgcctccgggaggggactgcgggttgcgggcgggcttgaggggagcttccgggtcgagcggggcggggagctgcttgcggtctaccgggccgagggcgggcgggcccggccggaggtggtgctgtgcggggggtag

SEQ ID NO: 46119 - protein, 265 aa, Rubrobacter xylanophilus DSM 9941
MKRLLPRRTKVGHTGTLDPLASGLLVLLVGRATRLSRYVTGLDKTYVATARFGAASDTLDADGEILENAGPVPDEAELRRALPRFVGEIRQLPPMASAVRVGGRRLYELHRRGVEVEREPRLVRVHSLELLSFDPPAATFAVSCSSGTYVRTLISDLAASLGTAAYLTALRRTRVGHLRVEDALPPQDLDPSTIHHRIIPPSGVLAHLPAVEADEGRARAVASGRGLRVAGGLEGSFRVERGGELLAVYRAEGGRARPEVVLCGG

SEQ ID NO: 46120 - DNA, 903 bp, Burkholderia cepacia R1808
  CDS (1)..(903)
atgccgcggcgcgcgctcgacggcgtgcttctgctcgacaagccggtcggcctgtcgagcaacgacgcactgatacgcgcgaagcgcctgttgctcgcgaagaaggccggtcataccggcacgctggatccgctcgcctcggggctgttgccgctgtgcttcggtgaggcgacgaagttttcgcaggacctgctggaagcggacaagacctacgaagcgacgatgcgcctcggcgtgcgcacgaccaccggcgacgcggaaggcgacgtgctcgagacgcgcgcggtcgcatgcgatcgcgcggcagtggcggcggcgctcgcgcgcttcaccggcgacatcgtgcaggtgccgccgatgtactcggcgctcaagcgcgacggcaagccgctgtatgaatatgcgcgggccgggcagaccgtcgagcgcgaaggccgcaacgtgacgatccatgcgctcgacctgctcgattgcgcgctgccggacgtgacgttccgcgtgacctgcagcaagggcacctacgtgcgtacgctcgccgaagacatcggcgaagcgctcggttgcggcgcgcatctgacgatgctgcgccgcaccggggtcggcgcgttgacgctcgagcacgcggtgacgctcgacgcactgtcggacgctgccgaagcggcgcgcgacgcgtggcttcagccggtcgacgcgctgctgtcgacgttcccgccggtgcgtctcgacgacgccagcgcgaagcggttcctgcacgggcagcgcctgccgctgtcggcgctcgatccgatcgacgcggccgaaggcgcgcgcgtgcgcgtgtacgacgcgcagcggctgctgggcgtcgcacgcaaggcgagcggcgtgctcgcacccgagcgtctcgtcgtgacggccgcctga

SEQ ID NO: 46121 - protein, 300 aa, Burkholderia cepacia R1808
MPRRALDGVLLLDKPVGLSSNDALIRAKRLLLAKKAGHTGTLDPLASGLLPLCFGEATKFSQDLLEADKTYEATMRLGVRTTTGDAEGDVLETRAVACDRAAVAAALARFTGDIVQVPPMYSALKRDGKPLYEYARAGQTVEREGRNVTIHALDLLDCALPDVTFRVTCSKGTYVRTLAEDIGEALGCGAHLTMLRRTGVGALTLEHAVTLDALSDAAEAARDAWLQPVDALLSTFPPVRLDDASAKRFLHGQRLPLSALDPIDAAEGARVRVYDAQRLLGVARKASGVLAPERLVVTAA

SEQ ID NO: 46122 - DNA, 876 bp, Kineococcus radiotolerans SRS30216
  CDS (1)..(876)
atgggcgacggcatcctcgtcgtcgacaagcccagcggctggaccagccacgacgtcgtcggccgctgccggcggctgctgggcacccgccgcgtcgggcacgccggcaccctcgaccccgcggcgaccggggtcctcgtgctcggggccaaccgggggacgaagttcctcacccacctcgtcgcccacgacaaggcctacgccgccacgatccggctggggctggccacggtcaccgacgacgccgagggcgaaccgctcggcgcccccgccgacgcctcggccctcgcccccgacgccgtcgccgccgcggtctcggcgctgaccggggacctccagcaggtgcccagctcggtcagcgccatcaaggtcgacggccagcgcagctacgcgcgggtccgcggcggccaggaggtcgacctgcccgcccgaccggtgacggtctcccgcttcgacgtgctccagcgccgcgcggagggcgggttcctcgacctcgacgtcgtcgtcgaggtgtccagcggcacctacgtgcgggcgctggcccgcgacctcggcgccgccctgggggtgggcgggcacctcacggcgctgcggcgcacccgctcgggcccgttcggcatcgaggaggcgcgcaccctggaacaggtcgagcaggacccggtcgtgcagccgctggccctggtggcccgccggctgttcccggcccgcgagctcaccgtggcggaagtcgccaccgtctcccacggcggcttcctccgggcgggggagcacccgggcccggtcggcgccttcgcccccgacggcaccctggtcgccctgctcggcgacaccgcccgcggggccaagccgctgctcgtcctcgccgccgccggctga

SEQ ID NO: 46123 - protein, 291 aa, Kineococcus radiotolerans SRS30216
MGDGILVVDKPSGWTSHDVVGRCRRLLGTRRVGHAGTLDPAATGVLVLGANRGTKFLTHLVAHDKAYAATIRLGLATVTDDAEGEPLGAPADASALAPDAVAAAVSALTGDLQQVPSSVSAIKVDGQRSYARVRGGQEVDLPARPVTVSRFDVLQRRAEGGFLDLDVVVEVSSGTYVRALARDLGAALGVGGHLTALRRTRSGPFGIEEARTLEQVEQDPVVQPLALVARRLFPARELTVAEVATVSHGGFLRAGEHPGPVGAFAPDGTLVALLGDTARGAKPLLVLAAAG

SEQ ID NO: 46124 - DNA, 915 bp, Listeria monocytogenes str. 1/2a F6854
  CDS (1)..(915)
atgaacggcattatcccactgtggaaagaacgcgggatgacaagtcatgattgcgtttttaaattaagaaaaattttacatacgaaaaaagttggtcatacaggtacacttgatcctgaagtagaaggcgtgctaccaatttgtattggccgtgcgacaaaattggctgaatatgtcaccgatgaaggcaaagtctatgtagcagaaataacattaggcaaatcgactacgacagaagatgcaactggtgaaacggttaatactaaagaactagccgaaatttcggcggcagaacttcaagccgcgcttactaaactaacaggtaagattacccagattccaccaatgttttccgctgtaaaagtcaacggtaagaaattgtatgaatatgcaagagctggaatagaggtagaacgcccatccagacaagtggatatttattcgttaatccgtttagatggcgacacagcgctaaatcaatccaacccaaccttccaattagaaattgcgtgcggaaaaggaacctatatccgtactcttgcagttatgattggcgaattattaggttatccagctcatatgtctaaactagaacgtactcgtagcggctttttcaaaaaagaagattgtttgacgctcacagaaattgacgaaatgatgcaagcaagtgatagcagctttttatatccacttgaaaaaggaattgaatctatggccaaactagtaattgaggaagaagtatatgcaaaagttttgaatggcggccttttaccaacatcgttatttgcagaggtagaaaatgaacctcgtgctgcgcttatttttaaagataaattaacagctatttataaaccacatccagagaaaaaagacctttggaaaccagaaaaggtcatcgagttaaatcaagcatag

SEQ ID NO: 46125 - protein, 304 aa, Listeria monocytogenes str. 1/2a F6854
MNGIIPLWKERGMTSHDCVFKLRKILHTKKVGHTGTLDPEVEGVLPICIGRATKLAEYVTDEGKVYVAEITLGKSTTTEDATGETVNTKELAEISAAELQAALTKLTGKITQIPPMFSAVKVNGKKLYEYARAGIEVERPSRQVDIYSLIRLDGDTALNQSNPTFQLEIACGKGTYIRTLAVMIGELLGYPAHMSKLERTRSGFFKKEDCLTLTEIDEMMQASDSSFLYPLEKGIESMAKLVIEEEVYAKVLNGGLLPTSLFAEVENEPRAALIFKDKLTAIYKPHPEKKDLWKPEKVIELNQA

SEQ ID NO: 46126 - DNA, 1038 bp, Rubrivivax gelatinosus PM1
  CDS (1)..(1038)
atgaacccggttgcgctgaaccgtccgccccgccgcgtgccgcaagccgtgcgcgagccgcgtgcaccgcgccgtgcactgcacggcgtgctgctgctcgacaagccgctgggctggtcgagcaacgatgcgctgcagaaggtcaagggcatgctgcgcgccgagaagggggggcacaccggcaccctcgatccgctggcgacgggcctgctgccgctgtgcttcggcgcggccaccaagttttcgcaggccagcctggatgccgacaagacctaccgtgcgacgctgaagctcggcgtcacgcgcatcggtggcgacggcgagggcgaggtgatcgagacgcgcccggtgtccttcgacgatgcggcgctgcgcgccgcctgcgccgccctgaccggcgagacgatgcagctgccaccgatgcattcggcgctcaagcgcgagggcaaggcgctctacgaatacgcgcgcgccggcgtcgaggtcgaacgcaccccgcggcgagtcgtgattcatcggctggacatcctgcgctggcacgctgacgagctcgacatcgaggtctgcgtcagcaagggcacctacatccgtacactcgccgaagacctgggccgtgcgctcggctgcggcgcccacctgagcgcgctgcgccgggtggccagcggaccggtgcaactggacggcgcgatcaccatcgacgcgctgcaggcgctcgatcccgtgctgcgcgagcagcgcctgttgccgcccgacgtgctggtggccgactggcctgccgtgcggttgacggctgacgacgccggccgcttcctgtccggcctgcgtcgccgcgtcgaggctgtggattgcgccgcggtgcgggtgtacggccccgagccgcgtgccttcctcggcagcgcccacgtgaaggccggagaactgatccccgaccggctgctgagcccgcctgaagtgcaggcgctgatcgacgccagccctgccgccgacaccgcgaccgctgcgccccttaccgaatccaagcaagtgagcatgacatga

SEQ ID NO: 46127 - protein, 345 aa, Rubrivivax gelatinosus PM1
MNPVALNRPPRRVPQAVREPRAPRRALHGVLLLDKPLGWSSNDALQKVKGMLRAEKGGHTGTLDPLATGLLPLCFGAATKFSQASLDADKTYRATLKLGVTRIGGDGEGEVIETRPVSFDDAALRAACAALTGETMQLPPMHSALKREGKALYEYARAGVEVERTPRRVVIHRLDILRWHADELDIEVCVSKGTYIRTLAEDLGRALGCGAHLSALRRVASGPVQLDGAITIDALQALDPVLREQRLLPPDVLVADWPAVRLTADDAGRFLSGLRRRVEAVDCAAVRVYGPEPRAFLGSAHVKAGELIPDRLLSPPEVQALIDASPAADTATAAPLTESKQVSMT

SEQ ID NO: 46128 - DNA, 918 bp, Pseudomonas fluorescens PfO-1
  CDS (1)..(918)
atggctcaggtcaaacgtatccgtcgtaacgtcagcggcatcatcctgctcgacaagccgctggggttcacctccaacgcagccttgcagaaggttcgctggttgctcaacgccgaaaaggccggtcacaccggcagtctcgaccctctggccaccggcgtgctgccgttgtgctttggcgaggcgaccaagttctcgcagtacctgctcgattccgacaagggttacgaaaccctggcgcaactgggcaagaccaccaccacggcagacgccgaaggtgaggttttgcaggaacgtccggtgaccgttggtcaggccgacattgaagcggttctgccgaaatttcgtgggcaaatcagtcagataccgccgatgtactcggctctcaagcgtgatggccagcccctgtacaagttggcccgtgctggcgaagtagtggagcgcgaaccgcgttctgttactattgcgcgcttggaattgctggccttcgaaggcgatactgcgcgtcttgcggtggattgcagcaagggcacctatattcgcaccctggtggaggatatcggtgagcaactcggttgtggtgcgtacgtcgctgaactgcgtcgtacccaggccgggcctttcaccctggcgcagaccgtgaccctcgaagagctggaagcggtacatgccgaaggcggcaacgaagcggtcgaccgcttcctgatgccatcggacagcggcctgcaggattggccgttgctgcagttctcggaagcgagcgcgttctactggctcaacggccagccggtacgtgccccggatgctccgaagttcggcatggtgcgggtacaggatcacaacggtcgcttcatcggtatcggtgaagtgagcgaagacgggcgcatcgcgccgcgtcgactgattcggtcagaatga

SEQ ID NO: 46129 - protein, 305 aa, Pseudomonas fluorescens PfO-1
MAQVKRIRRNVSGIILLDKPLGFTSNAALQKVRWLLNAEKAGHTGSLDPLATGVLPLCFGEATKFSQYLLDSDKGYETLAQLGKTTTTADAEGEVLQERPVTVGQADIEAVLPKFRGQISQIPPMYSALKRDGQPLYKLARAGEVVEREPRSVTIARLELLAFEGDTARLAVDCSKGTYIRTLVEDIGEQLGCGAYVAELRRTQAGPFTLAQTVTLEELEAVHAEGGNEAVDRFLMPSDSGLQDWPLLQFSEASAFYWLNGQPVRAPDAPKFGMVRVQDHNGRFIGIGEVSEDGRIAPRRLIRSE

SEQ ID NO: 46130 - DNA, 927 bp, Rhodospirillum rubrum
  CDS (1)..(927)
atgagccggcgccggcgcggtcaggcgatccacggctggcttgccatcgacaagcccgtcggcatcaccagcaccgatgtggtcaaccggctgcggcggacgatggacgcggccaaggtcggccatggcggcacccttgatccgttggccagcggcgttctgcccatcgcctttggcgaggcgaccaagaccgtgtcctatgtgatggacggcaccaaggtctatcacatggtcgtcggctggggtgaagcccgcgataccgacgatcgcgaaggcaaggtcatcgacaccagcgatgtccgtcccgatgcccaggcgatcaccgccatgctggcgcgcttcaccggcgagatcgaacaggtgccgccgatctattcggccgtcaaggtcgaggggcggcgctcctatgatctggcgcgcgccgatcaggccgtggaattgaagtcgcgcaagatcctgatcaaggatctgacgcttctcgagacctcgaccccggattttggccatttccgcatcgtttcgggcaagggcgcctatatgcgctcgctggcccgcgacctggccttggccctgggaacggtcggccatgtcgtcgccctgcgtcgtctcgcatgcggtccgttcaccgccgaaacggcgatttctctggatatggtagacgccctcgggcatgatgcgccccattctgaaagcctgcttcccatcgaggccgcgctggccgacatcccggccgtgcctttgacggaagcggaggcccgtcgcctgtcccaaggacagcccgtgtccctcttgcatctggcaagccggacccccctgaacggactcgcccaaggcgaaaccgttcaggcgctgctcaatggaaaactggtggctttggcaaaaatcgtagagggcgaaatccgccccttgcgcgtcgtcaacctctag

SEQ ID NO: 46131 - protein, 308 aa, Rhodospirillum rubrum
MSRRRRGQAIHGWLAIDKPVGITSTDVVNRLRRTMDAAKVGHGGTLDPLASGVLPIAFGEATKTVSYVMDGTKVYHMVVGWGEARDTDDREGKVIDTSDVRPDAQAITAMLARFTGEIEQVPPIYSAVKVEGRRSYDLARADQAVELKSRKILIKDLTLLETSTPDFGHFRIVSGKGAYMRSLARDLALALGTVGHVVALRRLACGPFTAETAISLDMVDALGHDAPHSESLLPIEAALADIPAVPLTEAEARRLSQGQPVSLLHLASRTPLNGLAQGETVQALLNGKLVALAKIVEGEIRPLRVVNL

SEQ ID NO: 46132 - DNA, 1002 bp, Enterococcus faecium
  CDS (1)..(1002)
atgatgtcaaattcgtcagtaattgatgcaatgtgttataataattcagttaaatcaaaaatgaaatggagaaaagacatggacgggttattacctttatggaaagaacgcggaatgacaagtcatgattgcgtattcaaattaagaaaaatcttacatacgaaaaaaatcggacatgggggtacgcttgacccagacgtagacggtgtgttgcccatttgtattggaaaagccacaaaagttatcgaatatttgacagattctgggaaaatctatgtaggcgagataactctaggtttcagtacaacgacggaagatcgatccggagaacgggtagaaacaaaaccagtagatatgtctttatctgaaaaaaaaatagatgaagtgatggcttcatttattggtgagatcacccagataccaccaatgtactcagcggtaaaagtcaacggtaagcggttatatgaatatgcccgcaataatgaaacagtggagcgtcctgttagaaaggctcagatttaccgttttatccggacaagtgaattgacaagagacgaagtgacaggaaccatttcttggcgcttcgaagtagaatgcgggaaaggaacctatgtccgcacattagctgtagatacaggcaagaaacttggttaccctgcgcacatgtctgatctgacccgaacagcaagtgccggtatgtcccagaaggatgctctgacattagaagaagtagctcaagctgtgaaaaatgggacaatcgatgattgtttgctgccaatagaaaaaggagtggaacggttcaaacgagtagatattactgatgaagtatggcagaaagtaaaaaacggtatgagacttgattatactgtatttgcgctcccagaaatgccgtcagaagaaattgctttgttttataaaggaaaagttgtcagtatttatcagccaaacccgaaagaaaaaaacaaattaaaacctagtaaagtattgagaaatgaggaataa

SEQ ID NO: 46133 - protein, 333 aa, Enterococcus faecium
MMSNSSVIDAMCYNNSVKSKMKWRKDMDGLLPLWKERGMTSHDCVFKLRKILHTKKIGHGGTLDPDVDGVLPICIGKATKVIEYLTDSGKIYVGEITLGFSTTTEDRSGERVETKPVDMSLSEKKIDEVMASFIGEITQIPPMYSAVKVNGKRLYEYARNNETVERPVRKAQIYRFIRTSELTRDEVTGTISWRFEVECGKGTYVRTLAVDTGKKLGYPAHMSDLTRTASAGMSQKDALTLEEVAQAVKNGTIDDCLLPIEKGVERFKRVDITDEVWQKVKNGMRLDYTVFALPEMPSEEIALFYKGKVVSIYQPNPKEKNKLKPSKVLRNEE

SEQ ID NO: 46134 - DNA, 960 bp, Magnetococcus sp. MC-1
  CDS (1)..(960)
atggggcgcagacgtcgtaaaggggtggtgattcacggttggttggcgatccacaaggagcctggtttaagttccagtcaggttgtggagcgggtgatccgcaccaccaaggccaataaggccggtcatgggggtactttggatcccttttctgagggggttttgcccattgctttgggggaggccaccaagaccagcggtatggtgctgaatggggataaaagctaccgttgctggttaaagtttggccaggagaccgacagcggcgatctaaccggcgtgctgttggaagagcaagggcgggtgcctagcgaggcagagttgcgggctgtgctcccgcaatttatgggtgaaattgaacaggttcccccggttttttcggcgcttagggtagacggtgagcgggcttataaacgggccagacgcggagaagaggtgcaattggcctcgcgacgtgttagaattgaccgccttgaactggttggatttgaagcagataccgccgttttggatgtagcgtgtgggaaaggcacctatattcgctcgctgggggtggacattgcccgggcgctgcatagccgggcgcatctggtgcgtctactgcgtaccggtaccatgggttttggcctaaatgatgctgttacattggaacaattgcgtgaagcctgtagtgagggtaggctacaggagattttataccctgttgaccgggtgctggacgacatcccggctctacggatgacagggaacgcttggtaccgcctgcgccaagggcaggaggttgaggtggaggatgcagcaaccccggcggggatggtgcgtttgcaggatcccgacggccagtttggcctgctgggggagatctcagcgcaagctgatctgcaaggtttgcggcggattaaaccgacgcggctctttcatctggacgagacaccaggcagtgacccaacggcccaatga

SEQ ID NO: 46135 - protein, 319 aa, Magnetococcus sp. MC-1
MGRRRRKGVVIHGWLAIHKEPGLSSSQVVERVIRTTKANKAGHGGTLDPFSEGVLPIALGEATKTSGMVLNGDKSYRCWLKFGQETDSGDLTGVLLEEQGRVPSEAELRAVLPQFMGEIEQVPPVFSALRVDGERAYKRARRGEEVQLASRRVRIDRLELVGFEADTAVLDVACGKGTYIRSLGVDIARALHSRAHLVRLLRTGTMGFGLNDAVTLEQLREACSEGRLQEILYPVDRVLDDIPALRMTGNAWYRLRQGQEVEVEDAATPAGMVRLQDPDGQFGLLGEISAQADLQGLRRIKPTRLFHLDETPGSDPTAQ

SEQ ID NO: 46136 - DNA, 882 bp, Thermobifida fusca
  CDS (1)..(882)
atggccgacggcgttgtcatcgtcgacaagcccgcaggctggacttcccacgacgtggtggcccgggtgcggcgccttgccggcactcgtcgggtcggccacgccggcacccttgacccgatggcgacgggggtgctggtcgtcggagtcggcaaagcgacccggctgctggggtatctcgcgttgacggagaaggtctacgaggcgacaatccgcctcggccagtccaccaccaccgacgacgcggagggagagctgctggagcgccgccccgccgaccacatcgacgaggccgcggtccacgcggggacccgcgcgctcaccggcgtgatccaccaggttccgccgcaggtcagtgcggtcaaagtgcgggggcagcgcgcctaccgccgtgcccgggcaggcgagacggtggaactgaaagcgcgcgaggtgaccgtgcacgagttcaccgtcaccgggttccgccgcgtcgacagcccggacggcgccttcgtcgacgttgacgcccgcgtgacctgctccagcggcacctacatccgttccctggcacgcgacctgggggcggacctcggcgtgggcgggcacctgaccgcgctgcgccgcacccgggtagggccctacaccgtggagcaggccgccaccctggacgagctggccgccgagttcaccgtgatgccgctggcggaagcggtggctgcggcgttcccggtccgtcggctcagcgcgggcgaagcccgccgtgtggtccacggccaccggatctccccgagcgggcattccggtccggtggggttgttcgcccccgacggccgggtgctggccctggcggagaaccggtcgggcagcagccagcccgtggtggtcttcgcgggaagctga

SEQ ID NO: 46137 - protein, 293 aa, Thermobifida fusca
MADGVVIVDKPAGWTSHDVVARVRRLAGTRRVGHAGTLDPMATGVLVVGVGKATRLLGYLALTEKVYEATIRLGQSTTTDDAEGELLERRPADHIDEAAVHAGTRALTGVIHQVPPQVSAVKVRGQRAYRRARAGETVELKAREVTVHEFTVTGFRRVDSPDGAFVDVDARVTCSSGTYIRSLARDLGADLGVGGHLTALRRTRVGPYTVEQAATLDELAAEFTVMPLAEAVAAAFPVRRLSAGEARRVVHGHRISPSGHSGPVGLFAPDGRVLALAENRSGSSQPVVVFAGS

SEQ ID NO: 46138 - DNA, 1017 bp, Methanosarcina barkeri str. fusaro
  CDS (1)..(1017)
atgtcacctgctggcaaattgccgtccgaagctgaaagaattctggtccggaaatccggtgcctggacaaacccctcttacggttcttacccggaaaagcgtcctattcttgaatatattgagaaaggggttgtaaatattgataaaccaaaggggccgacaagtcacgaggttgcagcctgggtaaaagctattctgggcgtgagtacggcagggcatgcaggctcacttgatcccaaggttacagggcttttgcccactttactcggaaaggctacaaaggcagtccctgctctgcgcctttctggaaaggaatatgtctgccttctgaagcttcataaggaaatgcctcaaaaactggtcaggaaggtctgtgaggaatttacaggccctatctaccagatgcctcctatcaaatcagctgtcaaacgcgttatcaggataaggacgatctattaccttgaagtgcttgaaattgaagggagttttgtgctctttcgcgtgggatgcgaagccgggacttacatcagaaaactctgtcacgatattggacttgctcttggttgcggcggacatatgcaggaactcaggaggacaaaagcaggcccgtttaccgaggaaacacttgtcaccctccaggatctcaaagatgcatatgtactctggaaggaagacggggatgagtctgaaatccggcgtgtaatcatgccaatggaaacggctgtatctcaccttcccaagattatcctgcgggacagtgcagtagatgcaatctgttcaggggctgctctggcagttccgggcataacaagcctggatgcgaaccttaagaaaggagagcttatagcgttgtttacccttaaaggtgagctcgttgcccttgcaaaagctgaaatgagtacagaagagctcctcaaagcttcaaccggacttgcagctacctcagtccgaattatgatggagataggaacctatccaaagggttggactaaaaaagagtatggtgttgaatcctaa

SEQ ID NO: 46139 - protein, 338 aa, Methanosarcina barkeri str. fusaro
MSPAGKLPSEAERILVRKSGAWTNPSYGSYPEKRPILEYIEKGVVNIDKPKGPTSHEVAAWVKAILGVSTAGHAGSLDPKVTGLLPTLLGKATKAVPALRLSGKEYVCLLKLHKEMPQKLVRKVCEEFTGPIYQMPPIKSAVKRVIRIRTIYYLEVLEIEGSFVLFRVGCEAGTYIRKLCHDIGLALGCGGHMQELRRTKAGPFTEETLVTLQDLKDAYVLWKEDGDESEIRRVIMPMETAVSHLPKIILRDSAVDAICSGAALAVPGITSLDANLKKGELIALFTLKGELVALAKAEMSTEELLKASTGLAATSVRIMMEIGTYPKGWTKKEYGVES

SEQ ID NO: 46140 - DNA, 915 bp, Geobacter metallireducens GS-15
  CDS (1)..(915)
atggacggtttcattgttatcgacaagccggccggcttgacttcccacgacatcattgcgcgcgtcagacggattctcggccagaagaaggcgggccatacgggaacccttgatccctttgccaccggagttttgccggttgcaatgggagaggggaccaaggcgataccgtttcttgatgaggctgtgaaagagtaccgtgcaaccatggtgctcggtgctgccaccgatacccaggactgtaccggcagggtcgagaaagaaggggactggactcgattgtccgttgaggcggtcagggaagttttcggtgcatatatcggaaagtgcaagcagatccctcccatgtactctgcggtcaagcaagggggggttcccctctaccgactagcgcgaaaagggcatgaggtggaacgagaaccccgggatatcgagatccattccctcataatcgatcgtatggagctgccgcgaattgagtttacggtttcctgctcccggggcacctatgtgagaacgctggcacacgacatgggggagcgcctcggttgcggcgcccatctttctgcgctgcgcagaacgcggagcggcccgtttgacctttcccgggccgtgacccttgacgaactggcaagcatcaaggaacaaggcgctgttgattcgcttctgctggctcccaacgaggtgcttggtcattttcccgagatcgagctctcagacgaggaagtccgcaaggtttactgcggagtccctccccgttgccatggcagatgcgaagaatcttcagcgtcgcaaaatgacggtaagaaggtgcgtctcgttcagaatggcaagcttctcgctgtggctgaaatcggtcaggctgaatcgggtaacgggaacaaaagcctaaggcttataagggtttttaactag

SEQ ID NO: 46141 - protein, 304 aa, Geobacter metallireducens GS-15
MDGFIVIDKPAGLTSHDIIARVRRILGQKKAGHTGTLDPFATGVLPVAMGEGTKAIPFLDEAVKEYRATMVLGAATDTQDCTGRVEKEGDWTRLSVEAVREVFGAYIGKCKQIPPMYSAVKQGGVPLYRLARKGHEVEREPRDIEIHSLIIDRMELPRIEFTVSCSRGTYVRTLAHDMGERLGCGAHLSALRRTRSGPFDLSRAVTLDELASIKEQGAVDSLLLAPNEVLGHFPEIELSDEEVRKVYCGVPPRCHGRCEESSASQNDGKKVRLVQNGKLLAVAEIGQAESGNGNKSLRLIRVFN

SEQ ID NO: 46142 - DNA, 915 bp, Novosphingobium aromaticivorans DSM 12444
  CDS (1)..(915)
atggtcgacggctggatcatcctcgacaagcctctggaactcgggtcgactcaaggggttgcggcggtaaagcgcaatctgcggcaggccggctacggcaagtgcaaggtcggacacggcgggacgctcgaccccctggctaccggggtgcttccgatcgcggtgggcgaggcgacgaaactgtgcggacggatgctcgatgcgagcaaggtctatgctttcacggtggccttcggaacggagaccgacagcctcgatctggagggcggaatcgtcgccaccagcgacgtccggccgcctcttgcggacgttcatgtcactttaggtgcgtttcgggattccatcgatcaggttcccccggcgtactcggccctgatggtcgagggcaggcgcgcctatgatctcgcaagggcgggcgaaacagtcgaactgccctcgcgccgggtcacgatccatgcactcacgctcgattcgtggacaggaagcgagggcgcggtggaaacggcgacgctgaccgcgcacgtttcgaaaggcacatacatccgcagcctggcccgcgatatcgcgcgcgcgctgggcacggtgggccatgtgacgatgctgcgacggctcaaggcggggccgttcgccatcgagcaggcgatttcgctggacaaattgaacgcattgggtcaaggcgcgccccttgaacacgtactcttgccgctggaggcagggctggtcgacatcccggctcttgaccttgatcccgagcaggcgagggcggtccgtcagggccgcgttctgacgggattgcccttcgaggacgggctctactgggcgaggcttggcactgtgccggtcgcgctggtcgagctttccgacggaaacctgaaggtttcgcggggcttcaacttacaggatgtcgcggagtag

SEQ ID NO: 46143 - protein, 304 aa, Novosphingobium aromaticivorans DSM 12444
MVDGWIILDKPLELGSTQGVAAVKRNLRQAGYGKCKVGHGGTLDPLATGVLPIAVGEATKLCGRMLDASKVYAFTVAFGTETDSLDLEGGIVATSDVRPPLADVHVTLGAFRDSIDQVPPAYSALMVEGRRAYDLARAGETVELPSRRVTIHALTLDSWTGSEGAVETATLTAHVSKGTYIRSLARDIARALGTVGHVTMLRRLKAGPFAIEQAISLDKLNALGQGAPLEHVLLPLEAGLVDIPALDLDPEQARAVRQGRVLTGLPFEDGLYWARLGTVPVALVELSDGNLKVSRGFNLQDVAE

SEQ ID NO: 46144 - DNA, 1056 bp, Ferroplasma acidarmanus
  CDS (1)..(1056)
atgtatgcttcaaattcaaccccggaagaaataaacggttttatcgtgatagacaagccgaagggcccgaccagccaccagatcgatgcatgggtcagggaaatcacaggtgaaaaaagagtgggccatataggtacactggacccgaatgtatccggtgtccttgtaatggcacttggaaaggccacaaaactgatagatatagtacacgaaaggccaaaagaatatatatctgttatgaggctttactccactgctgatacagataatataatgaaggtgtttaaagaattcaccgggaagatttaccagttgccccctgtgaggtcagcagtttcaaggcaagtcagggaaaggacaatatataatatggatgtactggaaattcaggaaaaattaatacttttcagggttaaatgtgagtcagggacatatatacggacattatgtacggatatgggctatgtaattggtacaggggcccagatggcggatttgagaaggctttcaacagggcagtttaatgaatcgcatatacacaccctgcaggaactcagcgattcagtagttttaaaaaaacagggagacacatcattgtttgacaatatggtaatccctatggatttcgttttcgccgattctccaaaggttgtcgtgaaaaatacggcaataaaaaatattatgcacggttcggatatatacccttccggaataaaagccctgataggggatatacacaagggaagccgtgttgctatatactctggtgataatgagctgcttgcctttggcacaatgctcgtggacagtttaaatgaccttaaggcagtggaccttgatggaatattgagtgataaatatggagaaaataatgtggtacggaaaaataatagacaaaaaaatatacctgtacagaaacctgcaaaaagattacatgaacatattagaaagcctgaggcaagggataatcccggaaacggaagagacatgttcagaaaaaatcccggatttaagggaaatccttctaaaattcgaaaaagaaagaataaattctga

SEQ ID NO: 46145 - protein, 351 aa, Ferroplasma acidarmanus
MYASNSTPEEINGFIVIDKPKGPTSHQIDAWVREITGEKRVGHIGTLDPNVSGVLVMALGKATKLIDIVHERPKEYISVMRLYSTADTDNIMKVFKEFTGKIYQLPPVRSAVSRQVRERTIYNMDVLEIQEKLILFRVKCESGTYIRTLCTDMGYVIGTGAQMADLRRLSTGQFNESHIHTLQELSDSVVLKKQGDTSLFDNMVIPMDFVFADSPKVVVKNTAIKNIMHGSDIYPSGIKALIGDIHKGSRVAIYSGDNELLAFGTMLVDSLNDLKAVDLDGILSDKYGENNVVRKNNRQKNIPVQKPAKRLHEHIRKPEARDNPGNGRDMFRKNPGFKGNPSKIRKRKNKF

SEQ ID NO: 46146 - DNA, 678 bp, Cytophaga hutchinsonii
  CDS (1)..(678)
atgcctacgaatgaatccccccagcacgatttagtattgtgcttagataagccttatcactggacctcctttgatgtggtaaaaaaagtacgtagagttttaaaaatgaaaaaggttggtcatgcgggcacgcttgatccactggctaccggcttgctgattgtttgtaccggaaaaaaaacaaaaacaattgaatcgctgatggccgatgaaaaagaatattcaggtgctattggtttaggtgcaactactgcatcatacgatctggaattgcctttagaaaaccataccgatatttcagggttgaccgagacacagatccggaaaacggtgaaacaatttttaggtaccattacacagatcccgcctattcattctgcggttaaagtagatggaaaaagagcgtacgacgaagcacgcaaaggcaatgaagtgatcattaaatcgaggcaggttttcattaaagaattcaaaattacaaaagtagaattacccttagtgtatttcaatattgtttgcagcaaaggcacatacatacgtaccattgcaaacgattttggaaaagcattaggctgcggcggccacctgaatgccttacgcagagagcgcatcggaaccctttctgtaaaacaggcattaactccggaacaacttgaagaaaaatttttgtcgatatga

SEQ ID NO: 46147 - protein, 225 aa, Cytophaga hutchinsonii
MPTNESPQHDLVLCLDKPYHWTSFDVVKKVRRVLKMKKVGHAGTLDPLATGLLIVCTGKKTKTIESLMADEKEYSGAIGLGATTASYDLELPLENHTDISGLTETQIRKTVKQFLGTITQIPPIHSAVKVDGKRAYDEARKGNEVIIKSRQVFIKEFKITKVELPLVYFNIVCSKGTYIRTIANDFGKALGCGGHLNALRRERIGTLSVKQALTPEQLEEKFLSI

SEQ ID NO: 46148 - DNA, 894 bp, Clostridium thermocellum ATCC 27405
  CDS (1)..(894)
atgaacggaatattgaatgttttaaaaccaccgggtatgacttcctttgatgtggtggcataccttaggggaatcctgaaaataaaaaaaatcggacacacaggcacgcttgaccccggtgcggcaggagtgcttcctgtttgtacaggcaaggctacaaaagcaattgaatatctttcggataaagacaaagtttacagagcggagcttttgctgggtgtatccactgatacccaggattcttatggagaagttataagagagcaggaagtaaaggcttccgttgaagatattgaaaaggtaattaagtcttttgaaggggactacagtcagcttcctcccatgtattcggcagtcaagatgaacgggaagaagctgtatgagcttgccagaagcggcattgaagtggaacggactccaagaaaggttaaaatacattttattaatattttaagtatccgaggcaacagagttgtttttgacgtgggatgttccaaaggcacttatataagaactttatgttccgatgtcggagacaaattaggctgcggaggacatatgggttttctggtaaggctgaaatcgggaagttttgacattaaaaatgctttgactctggaagagataaaagaaacagccgagaaaggaaaccctgaagagattctgacaagtattgataaagtttttagcgattatgataaaatttatcttaatgaaaaggataaaaagagatttttgaacgggggatttgtaactctcggaaaatacggtaagtttgctttgacccaaaaagtcagagtatatgataaggacggtgcttttctggctttgggggaagcggttttgaacaaaagtgaagagttgagtcttaaaattgacaagctttttgtataa

SEQ ID NO: 46149 - protein, 297 aa, Clostridium thermocellum ATCC 27405
MNGILNVLKPPGMTSFDVVAYLRGILKIKKIGHTGTLDPGAAGVLPVCTGKATKAIEYLSDKDKVYRAELLLGVSTDTQDSYGEVIREQEVKASVEDIEKVIKSFEGDYSQLPPMYSAVKMNGKKLYELARSGIEVERTPRKVKIHFINILSIRGNRVVFDVGCSKGTYIRTLCSDVGDKLGCGGHMGFLVRLKSGSFDIKNALTLEEIKETAEKGNPEEILTSIDKVFSDYDKIYLNEKDKKRFLNGGFVTLGKYGKFALTQKVRVYDKDGAFLALGEAVLNKSEELSLKIDKLFV

SEQ ID NO: 46150 - DNA, 942 bp, Microbulbifer degradans 2-40
  CDS (1)..(942)
atgggtaatcgtaaaagacctggtcgcccaatatcgggcgtaatagttatagataaaccggctggagattcctccaacggcgtattgcaaagggttaaacgcctttttttcgcaaataaagcaggccacacaggcagtttagacccgctcgcaacaggggttttaccggtttgttttggcgatgccaccaaattctcgcagtttttgctcgattccgataaagaatatgtaagcacatttcgctttggcgaggttaccgataccgccgattcagacggcgaagtgttggaaagcattgatgcctctaagcttactaaggctgacgtgctcaaagctattaaggcttatattggcgatatcgatcaggttccccctatgtattctgcgcttaagcgcaacggccagcctttatacaagttggcgcgtcagggtatagaggtggagcgagagccacgtccagtaactgtttacgaattcgaattactggcatttagaccgggggcagtagctgaggccgatgtacgggtcttttgcagtaaaggtacatacattcgaagcttggcatcggatataggcgcagatttagagcttggcggtcacgtagctaaattacgccgtacccaagccggcccttttactatcgaccagtcgataactattgaagaactagagcaagagcgcggcgaaaggcttgctgaagtgctcgatcatcacttattgccaactgatatagcggttgcggatttcccaagtttggaattagacgacaatagtgcgttctacttctctagagggcaggcggttatggactctcgggtctatcgcttaggggatgaaggtgataaagtgcgcgtctttgactccagcggaaagttctatggagtggcggaaatcaccgatgaaggcaccgtggcgcccaagcgcttagtgagtcaatcgtag

SEQ ID NO: 46151 - protein, 313 aa, Microbulbifer degradans 2-40
MGNRKRPGRPISGVIVIDKPAGDSSNGVLQRVKRLFFANKAGHTGSLDPLATGVLPVCFGDATKFSQFLLDSDKEYVSTFRFGEVTDTADSDGEVLESIDASKLTKADVLKAIKAYIGDIDQVPPMYSALKRNGQPLYKLARQGIEVEREPRPVTVYEFELLAFRPGAVAEADVRVFCSKGTYIRSLASDIGADLELGGHVAKLRRTQAGPFTIDQSITIEELEQERGERLAEVLDHHLLPTDIAVADFPSLELDDNSAFYFSRGQAVMDSRVYRLGDEGDKVRVFDSSGKFYGVAEITDEGTVAPKRLVSQS

SEQ ID NO: 46152 - DNA, 897 bp, Oenococcus oeni PSU-1
  CDS (1)..(897)
atgtataacggaattgttttggttgataagccagcaggtttgaccagttttgatgtggttgctaaattaagaaaaatattccaacaaaagcaagttggacacaccgggacacttgacccttctgttaccggattgcttgtgattgtactgggcaaagcaacgaaattaattgattatcttcaagaaaatcaaaagcaatatcgcggtactttgattctcggattaaaaaccgacacccaggatatggatggtcaggtaactgagatgcagtttttaaaagaagcaatcgccgattttaaaaaaaaagccgctttcgatagtttccttggaagttccgaccagcttccaccgatgtattcggctgttaaagttggtggaaaacatttatacgaattagctcgaaagggcgaaactatcgaacgaaaatccagaaaaataaaagtgatggaatttcaacaggttggcggttcaaaattcgatgctagcaagggccaggaatatattaattttgttgcaactgtatcaaaaggaacttacatacgaactctaatcgaagattttggcgcaaaattaggtttaccggccacaatgatgagactgaggcgtatcgaggcggatggatacgatgttaaaaattcgattaatttagaagaaatattagccagcaaaacacctaggaaatttattattccaatggaaaagctcttaccaacgctaccgaagtattcggttggcagcgatgactggcagcttattaaaaatggcggttggctaaaagaattaccgatttctgtttcaccagttaaaattttttacaataatagttttcaggctatttatgaaaaacaggatggattttataagccaaaaaagatgctgattcatgaagatcattaa

SEQ ID NO: 46153 - protein, 298 aa, Oenococcus oeni PSU-1
MYNGIVLVDKPAGLTSFDVVAKLRKIFQQKQVGHTGTLDPSVTGLLVIVLGKATKLIDYLQENQKQYRGTLILGLKTDTQDMDGQVTEMQFLKEAIADFKKKAAFDSFLGSSDQLPPMYSAVKVGGKHLYELARKGETIERKSRKIKVMEFQQVGGSKFDASKGQEYINFVATVSKGTYIRTLIEDFGAKLGLPATMMRLRRIEADGYDVKNSINLEEILASKTPRKFIIPMEKLLPTLPKYSVGSDDWQLIKNGGWLKELPISVSPVKIFYNNSFQAIYEKQDGFYKPKKMLIHEDH

SEQ ID NO: 46154 - DNA, 900 bp, Pediococcus pentosaceus ATCC 25745
  CDS (1)..(900)
atggatggaataattccaattaataaagaacgaggaatgacaagtcacgatgttgttgccaaggttcgtggtattttaagaactaaaaaagttggtcatagtggaacccttgatcctagtgttgacggggttttaccaatttgtgttggcagagctacgaaagttgtggactatttaatgggatttggaaaagtttatcaaggttcaattacgttaggtttctcgactactacggaagatctagatggtgaagtagttgaaactaaaaaacttgatgaaccattaacggacgaacaaattaatcaaactttgactgcaatgacaggaactttaattcaaattccacccatgtattccgcagtaaaggttaagggccgcaagttatatgaatacgcccgcgctggtgagacggtagaacgtcctcagcgtcaaattaaggtttatgattttgttcaaactcgcccatcaatttttgatgcagaaaagggacaacaaactatttatttcaaggttagttgtggcaaggggacgtatgtgagaactttagcagttgattttggtcgtcattttggattaccagcggtgatgtctgatttaagtcgcttggctagtgggggattcaaaattgaggaatgcctgacgttatccgacttagaacaagcacgagatgaagatcgtttatcgacggttattcaacctttagatcgggccttggataactttaatacaattacaatttcagatgttgaatgggaaattgttaaaaatggaggatttttgaatcgtccgcaaactgatgaaatcatagctttaaaatataatgggaatattcaggcgttatatcagtatgatacaaatcgtcaaaactatattcctaaaaaaatgttgttggtgagatag

SEQ ID NO: 46155 - protein, 299 aa, Pediococcus pentosaceus ATCC 25745
MDGIIPINKERGMTSHDVVAKVRGILRTKKVGHSGTLDPSVDGVLPICVGRATKVVDYLMGFGKVYQGSITLGFSTTTEDLDGEVVETKKLDEPLTDEQINQTLTAMTGTLIQIPPMYSAVKVKGRKLYEYARAGETVERPQRQIKVYDFVQTRPSIFDAEKGQQTIYFKVSCGKGTYVRTLAVDFGRHFGLPAVMSDLSRLASGGFKIEECLTLSDLEQARDEDRLSTVIQPLDRALDNFNTITISDVEWEIVKNGGFLNRPQTDEIIALKYNGNIQALYQYDTNRQNYIPKKMLLVR

SEQ ID NO: 46156 - DNA, 906 bp, Trichodesmium erythraeum IMS101
  CDS (1)..(906)
atgcaaggatttctcaatcttaacaaaccatcgggcatgacttcccatgactgtgtagcaaaagtacgaaagctactacgtctcaagcgtgttggacatggaggaactcttgaccctgctgctactggtgttttacctattgcagtgggaaaagcaaccaggttattacagtttctaccttcagaaaaagcttattttggtacagttaaatttggtataattactactactgatgacttagagggagaaattgttcaatctgcaccagtaccagaattaatgttgtctgatattgaaaaagtattaccaaatttcctaggtaaaatagagcaagtgccacctagttatagtgcaatacaggtagaaggaaagcgactttatgatttagcgcgtcagggaaaaacagttgaggttcctacccgtattgttgaagtgtttaatataaaaattcttgactggcgaagtggagattttccagaagtagacttggcgatcgcttgtggtacaggaacttatattcgagcgatcgctcgcgatctaggtagaactttaagtattggcggaactttagctgctttaaccagaatagaaagtagtggtttttctgaggaaaatagtctcacttttgcagaagtggaaaatcaactacaggaaaataagtttagtcttttatctatagaaatagcattggcacatttaccagtgatagtcttaattactgaagatgcaaaaagatggtgtcaaggtcaacgtttaccctatcaagtaaaatggcagatagaaactaaaaaagctgagcactatttccgagtatacaattataaaggtgactttctaggtattgggcagttaatcaaatctgaagaaaatttattattagcacctcaagttgtaattagtaattag

SEQ ID NO: 46157 - protein, 301 aa, Trichodesmium erythraeum IMS101
MQGFLNLNKPSGMTSHDCVAKVRKLLRLKRVGHGGTLDPAATGVLPIAVGKATRLLQFLPSEKAYFGTVKFGIITTTDDLEGEIVQSAPVPELMLSDIEKVLPNFLGKIEQVPPSYSAIQVEGKRLYDLARQGKTVEVPTRIVEVFNIKILDWRSGDFPEVDLAIACGTGTYIRAIARDLGRTLSIGGTLAALTRIESSGFSEENSLTFAEVENQLQENKFSLLSIEIALAHLPVIVLITEDAKRWCQGQRLPYQVKWQIETKKAEHYFRVYNYKGDFLGIGQLIKSEENLLLAPQVVISN

SEQ ID NO: 46158 - DNA, 918 bp, Moorella thermoacetica ATCC 39073
  CDS (1)..(918)
atggttatgggttttgttaatgtcttaaaaccgccgggacttacctcccatgacgtggtgcagaatctgcgccggcttctcaaagtcaagaggatcggccatggtggcaccctggaccctctggcggctggcgtcctgccggttgccgttggtacggctacccgtttgctggaatacctgcagggcggcgataaagcctaccgggccgagtttatcctgggcctgaagaccgacacccaggacttgggcggccgggtcctggccaggaaaccctgcccgcctttcacagaaaaggatttacaggccgccaccaggccctttacggggactatcaggcaggtaccacccatggtatcggctgtgcactaccagggccgccggctttatgaactggcaagggagggcctggaggttgaacgaccggcccgccaggtgaccatccatgaatttcggctgattagggcctggcctgatggaccttactaccgggcgttaatagatatcacctgctcccggggtacctatatccgtaccctgggggctgactggggtgattacctgggggtaggtgccaccctggcctttttacttcgtacccgagccgggagtttccgattgacagatgcctggaccctggaggaaatagccggggctatagataggggcgagaggaccttccttctcccgcccgccgccggcctggcccacctgccagtgataatagttccaggcgagtttatccgccatgtaagtaacggggtagccatcaagggtgatgtatgccggccgctaccgtccctcagagaaggggatatagtgcgcctggagaccggcgaaggccaactcctggccctggccagggtggagccagataccagggggtccttcttactaaaaccccataaggttttgaagtga

SEQ ID NO: 46159 - protein, 305 aa, Moorella thermoacetica ATCC 39073
MVMGFVNVLKPPGLTSHDVVQNLRRLLKVKRIGHGGTLDPLAAGVLPVAVGTATRLLEYLQGGDKAYRAEFILGLKTDTQDLGGRVLARKPCPPFTEKDLQAATRPFTGTIRQVPPMVSAVHYQGRRLYELAREGLEVERPARQVTIHEFRLIRAWPDGPYYRALIDITCSRGTYIRTLGADWGDYLGVGATLAFLLRTRAGSFRLTDAWTLEEIAGAIDRGERTFLLPPAAGLAHLPVIIVPGEFIRHVSNGVAIKGDVCRPLPSLREGDIVRLETGEGQLLALARVEPDTRGSFLLKPHKVLK

SEQ ID NO: 46160 - DNA, 879 bp, Streptococcus suis 89/1591
  CDS (1)..(879)
atgatttcaggaattattaacgtaaaaaaagaggcaggtatgacctcgcatgatgttgtttttaagctccgcaagattttgcaggagaagaagattggacatggtgggaccttggatcccgatgtgacaggcgttctgcccatcgcagtcggtaaggccacgcgtatgattgagtacatgcaggaagagggaaagatttacgagggggagattaccctcggcttctcaaccacgaccgaagattcgtcgggcgacctcgtcgagcggacaccggttttggacatagcagagcaggcagttgatgaggctatgaccagtttcgtcggtactattacccagattccgcctatgtactctgctgtcaaagtaaacggtcgcaaactatacgaatacgcacggacgggtgaagaagttgagcgtcctcaacgccaaattgagatttacagttttgaacggactagcccgattgaactagtagatgactgtgcacgttttaccttccgagttcgctgtggtaagggcacctatgtccgtaccctgtctgttgacctaggggctaagttgggctatgccagccatatgtccaagttggaacgaacaggatcagctggaatggacctagcggatgccttgactttagaagaaatttcttcgctggtagctgaaaatgatttttcattcctccaacctattgaacgtggcatcggggatttacctgttgtagaattgaaagaagagcaggtgcaagatgctacatttggtcgatttgtagaattgaatgcagaagcagagcgcttagcaggctttcatgatggtcagttgattgctatttttgaaaaacgcgaccagctgtataaaccgagcaaggttttggtctaa

SEQ ID NO: 46161 - protein, 292 aa, Streptococcus suis 89/1591
MISGIINVKKEAGMTSHDVVFKLRKILQEKKIGHGGTLDPDVTGVLPIAVGKATRMIEYMQEEGKIYEGEITLGFSTTTEDSSGDLVERTPVLDIAEQAVDEAMTSFVGTITQIPPMYSAVKVNGRKLYEYARTGEEVERPQRQIEIYSFERTSPIELVDDCARFTFRVRCGKGTYVRTLSVDLGAKLGYASHMSKLERTGSAGMDLADALTLEEISSLVAENDFSFLQPIERGIGDLPVVELKEEQVQDATFGRFVELNAEAERLAGFHDGQLIAIFEKRDQLYKPSKVLV

SEQ ID NO: 46162 - DNA, 897 bp, Thiobacillus denitrificans ATCC 25259
  CDS (1)..(897)
atgaagcccgcccgccaagctgtcgatggcgtgctgctgctgaacaagccggtcgggatcacctccaacgccgcgctgcagaaggccaagtggctgctgaacgcgaagaaggccggccacaccggtacgctcgaccccttcgccgacggcctcctgccgctctgcttcggcgaggcgaccaagttctcggcctatctgctcgacgccgacaagcgctatcgcgcgatcctgcaactcggcgtcacgacgcgcaccggcgaccccgagggcgaggtgctcgcgacccgcgaagttcgcgcgacctgcgccgacatccgcgcggcgcttcccgctttcgtcggtgaaatcgaacagatcccgccgatgcattcggcactcaagcatcaggggcgtccgctctacgagtacgcgcgtgccggcgtcgagatcgcgcgtgcgccgcgccgggtgcatatccgcgccctcgacctcttcaaatgcgccccgccccgcgcggtcgtcgacgtgcaatgcagcgcgggcacctacgtccgcacgctggccgaagacctcggcaacgcgctcggctgcggcgcccacctcacggccctcacccgcaccgcgtcgggcggattcctgctcgaacaggcacacacgctcgccgaactcgaggcgaccaacgcgggggccaggcaggccctgctgctacccgcggactgcctcgtcgcgcatctgccgagcgtgcacctcggcgagaccgccgccgcgtccttgcgccagggccggagcgtgcccgacgctgcggatcgccgtggactcgtgcgcgtgtacgacggccacggggtatttgtcggtctcgccgaagcggaagccggaaagctggtcccgcgacgcctgatcgccaccgtgcaggcttga

SEQ ID NO: 46163 - protein, 298 aa, Thiobacillus denitrificans ATCC 25259
MKPARQAVDGVLLLNKPVGITSNAALQKAKWLLNAKKAGHTGTLDPFADGLLPLCFGEATKFSAYLLDADKRYRAILQLGVTTRTGDPEGEVLATREVRATCADIRAALPAFVGEIEQIPPMHSALKHQGRPLYEYARAGVEIARAPRRVHIRALDLFKCAPPRAVVDVQCSAGTYVRTLAEDLGNALGCGAHLTALTRTASGGFLLEQAHTLAELEATNAGARQALLLPADCLVAHLPSVHLGETAAASLRQGRSVPDAADRRGLVRVYDGHGVFVGLAEAEAGKLVPRRLIATVQA

SEQ ID NO: 46164 - DNA, 909 bp, Silicibacter sp. TM1040
  CDS (1)..(909)
atgggacgcaaacgcaagggacgcgacatttccggctggttggtggtggacaaacccgcaggcctcacctcgacggcggtggtcaacaaggtccgttgggcgttcgacgccaaaaaagcaggccatgccggtacgctcgaccccgaggcaaccggtgtgcttgcggtggcacttggcgaggcgacaaagaccgtgccgtttatcaccgacgccatgaaagcctatacgtttaccgtgacccttggggcggcgaccaatacggatgacgccgaaggcgaagtgattgcgacctccgcagagcgccccacggatgatgacatcaaagaagcactgcttggctttattggcgaaatccagcaggtgccgccgaagttctccgctgtaaaaatcgacggtcagcgcgcctacaagctggcgcgggacggcgaagaagtggagctttccgcccgtccgctctgggtcgaagagctggtgatgctggatcgtcccgacgccgatcatgttgttctggaaatgacgtgcggcaagggcggctacgtacgttccatcgcgcgcgatttgggcgaaaaactcggctgccttggccatgttcgagagctgcgccggatctggtccggcccgtttgatgcagaagatggcgtgacccttgaacagattgacgcgcttgcaaaatcacccgagatcgaccagttcctgcggccgcttgaggaggggcttgcggatctgcccgagctgaaatgcacaccgcaaggcgcgacccgactgcgcaacggcaacccgggcatggtgatcgcctctgacgtggaatatggcgaggaagcctgggcttctcttgaaggcaaagccgtggccgtgggcaccttcaaggccggagagctgcacccttcgcgcgttttcaatcaggactga

SEQ ID NO: 46165 - protein, 302 aa, Silicibacter sp. TM1040
MGRKRKGRDISGWLVVDKPAGLTSTAVVNKVRWAFDAKKAGHAGTLDPEATGVLAVALGEATKTVPFITDAMKAYTFTVTLGAATNTDDAEGEVIATSAERPTDDDIKEALLGFIGEIQQVPPKFSAVKIDGQRAYKLARDGEEVELSARPLWVEELVMLDRPDADHVVLEMTCGKGGYVRSIARDLGEKLGCLGHVRELRRIWSGPFDAEDGVTLEQIDALAKSPEIDQFLRPLEEGLADLPELKCTPQGATRLRNGNPGMVIASDVEYGEEAWASLEGKAVAVGTFKAGELHPSRVFNQD

SEQ ID NO: 46166 - DNA, 873 bp, Chloroflexus aurantiacus
  CDS (1)..(873)
atgacagcattaacaggatttctggttgtcgataaaccggctggtctgacatcgcacgatgtggtggcccgcgtgcgccgactggcagggcgggcggtaaaggttggccacgccggtaccctcgatccggcagcaacgggtgtattacccgttgccctgggcagtgcgacgcgactgatcgatcagttggtcgatgcccggaagggctaccgtggcgtcgtgcgcctcggtgtgcagacaacgaccgatgatgccgagggtgaaccggtagcgaccctgccggtaccagtattcacgatcacggaaatcgccgctgtcctggcccagtttcggggtgacattctccaacaacctcccgccttttcggccttgcatgtcgccggtcagcgcgcctacgccctggcccgcgctggtgatcaggtgacgctagcgccgcgcctcgtgcggattgatcgtctggagctgcttgattgggcctcacccgatctcaccatcgaggtcgaatgcggcaaaggggtctacattcgcgcactggcccgcgacattggcgctgcccttggctgcggtgggcatctggtctcattacagcgtaccttcgtcggcccctttcgtctcgcacaggcggtaccgctggcaaacttgaccgatcagtcgtgcttactcaaccatctcctgccgccggaaacggttctgcaagactggcccctcgtccaggttgatgccgacgatgccaaccgactacgtcatggaatggccattacggcaaccgaacccgacgcaccgcatgcacgggcacacgatccagccggtaagctcatcgcactcctcaaacgtgatggtgacaactggcgaccggtaaaggtgttggggtga

SEQ ID NO: 46167 - protein, 290 aa, Chloroflexus aurantiacus
MTALTGFLVVDKPAGLTSHDVVARVRRLAGRAVKVGHAGTLDPAATGVLPVALGSATRLIDQLVDARKGYRGVVRLGVQTTTDDAEGEPVATLPVPVFTITEIAAVLAQFRGDILQQPPAFSALHVAGQRAYALARAGDQVTLAPRLVRIDRLELLDWASPDLTIEVECGKGVYIRALARDIGAALGCGGHLVSLQRTFVGPFRLAQAVPLANLTDQSCLLNHLLPPETVLQDWPLVQVDADDANRLRHGMAITATEPDAPHARAHDPAGKLIALLKRDGDNWRPVKVLG

SEQ ID NO: 46168 - DNA, 969 bp, Polaromonas sp. JS666
  CDS (1)..(969)
atgcacggcgtgctgctgctcgacaagccgctgggcctgtcgagcaaccaggcgctgcaaaaagccaaatggctgttgcgcgccgacaaggccgggcataccggtacgctggatccgctggccactggcgtgctgccgctgtgctttggggcggcgaccaaattcagccagatccagttggacgccgacaagacgtatgaagccgtgctcctgctgggccggaaaaccacgacggctgatgccgagggcgacgtcatcgagacgcgccccgttcccgagatcacccccgaactgctggcaaccctgacccggcgttttaccggcccgctggcgcagattccgcccatgtattccgcgctcaagaaagacggcaaggcactgtacgaatacgcgcgcaaaggcgaagacgtggagcgggaagcgcgccacatcacgatttacaagctggatatggctctgacccatgacgagcgggcgccggcagctatcaaaatcaccgtgacctgcagcaagggcacctacattcgcacgcttggtgaagacatcggcgaggcgatcggttgcggcgctcacctcgggtccctgaggcggctggagaccggcggctatgtcgcttcgcagtgcgtgggcctgccggcgctggaagccatgagcgagcagcagcgcgaagcctgcctgctgccagttcaatcactcgtcgccaactatccggttgtcacactcgatgccgataatgcagggcgctttttgagcggcctgcgccgtcgcggcagccccggccaatggggtccggacgcggtgctggtgcaggtgtacggtagcgacccggcggcttttctcggctcggcccatgtcatggctgacgagttgattccggggcgcctgctcagcccgattgaaatccaggacatgctggccccgcgtccgcctgttatttccaaccctgcggcaagcgccgcaacggcttag

SEQ ID NO: 46169 - protein, 322 aa, Polaromonas sp. JS666
MHGVLLLDKPLGLSSNQALQKAKWLLRADKAGHTGTLDPLATGVLPLCFGAATKFSQIQLDADKTYEAVLLLGRKTTTADAEGDVIETRPVPEITPELLATLTRRFTGPLAQIPPMYSALKKDGKALYEYARKGEDVEREARHITIYKLDMALTHDERAPAAIKITVTCSKGTYIRTLGEDIGEAIGCGAHLGSLRRLETGGYVASQCVGLPALEAMSEQQREACLLPVQSLVANYPVVTLDADNAGRFLSGLRRRGSPGQWGPDAVLVQVYGSDPAAFLGSAHVMADELIPGRLLSPIEIQDMLAPRPPVISNPAASAATA

SEQ ID NO: 46170 - DNA, 957 bp, Acinetobacter sp
  CDS (1)..(957)
atgaatgaattttttaacattatatttaatttatttgatgtagagcacattatgactgcaaaatccagcaagatatcgagacgccctgtgagtggtgtatttcttttgaataaacctttgggactcagctcaaatggtgtacttcaaaaagtccgctggttgtttcgtgcgcaaaaggctggtcatacaggtgcacttgatccactggcgactggtttattgccgatttgtttaggggaggcgaccaagttttcacattatttgcttgactcgaccaagcgttatcaaaccgtggtcaaactgggacaagtgacgactacaggtgatgttgaagggaaagttgtacagtcgcgttcagtcccaccactcacccgtgacatgctcgaattggtattggatgggtttcgcggcgatatccagcaagttccgccaatgtattctgctttaaagcgtgatggccgcccattatatgaattggcacgtcaaggaattgagattgagcgtgaagcacgcccagtcacaattcatgctctcaaacttgtcgattttgatacagaaagcctaacgttagatgtgacatgttctaaaggcacttatattcgcgtattgggtgaagatattggtgaggcattaggctgtggtgggcatttaactgccttgcatcgtgtacagactggacattttgaacttgtacctgaatatacccttgaatatttagaacaactgaatgaaacagagcgggatatgctattattggcgccctacgcaccagtcgattatttaccacaggttcaaattccagaaggtcgtcttaaatatttctgcaatggacaagaaagcaatattgaccacgatgcagtaccagaagttctggtatttgagggtgaacgttgtttaggacttgctgaaatcacagataaaaaaagattggtgccgaaacgtcttttaaatttatag

SEQ ID NO: 46171 - protein, 318 aa, Acinetobacter sp
MNEFFNIIFNLFDVEHIMTAKSSKISRRPVSGVFLLNKPLGLSSNGVLQKVRWLFRAQKAGHTGALDPLATGLLPICLGEATKFSHYLLDSTKRYQTVVKLGQVTTTGDVEGKVVQSRSVPPLTRDMLELVLDGFRGDIQQVPPMYSALKRDGRPLYELARQGIEIEREARPVTIHALKLVDFDTESLTLDVTCSKGTYIRVLGEDIGEALGCGGHLTALHRVQTGHFELVPEYTLEYLEQLNETERDMLLLAPYAPVDYLPQVQIPEGRLKYFCNGQESNIDHDAVPEVLVFEGERCLGLAEITDKKRLVPKRLLNL

SEQ ID NO: 46172 - DNA, 948 bp, Agrobacterium tumefaciens
  CDS (1)..(948)
atgtccaaaccacgtaaacagcaacaccgcaaacccaaaggccgtccgatttcgggctggctcatcctcgacaagccgctcgatttcggctccacagaggccgtttccaagatcaaatggctgttcaacgcccagaaggcgggccacgccggtacgcttgatccgctcgcttccggcatgctgccgatcgcgctcggtgacgccaccaagaccgtgccctacgtcatggacggccggaagatctacgaatttaccgtgacctggggcgaacagcgcgcgacggacgatctcgagggtgaggtggtcgaatcctctgaccagcgcccggaagagcaggcgatccgcgatattctgcccaattataccggcgtgatcatgcagaccccgccgcagttttccgccatcaaaatcgctggcgagcgcgcctatgatctggcgcgtgatggtgagacggtggaaattcctgcacgcgaagtagaaatccatcgcctgacgctgctggcctgcccggacgccgataccgcgcatttcgaagtggaatgtggcaagggcacctacgtgcgggcgctggcccgcgacatgggccgcgatctcgggtgtttcggccatatctcggaactgcgccgcaccatggtcgcccccttcggcgaagacatgatggtgccccttgaaaccttgacggcgctggaagcgatagaagatcgtgacgaacggctggaagcactggatgccttcctgatcgatacggccgaggcgttgtcctcacttccccgcctcatcatcaacgatgatcaggcgcacaggctgaagatgggcaaccccatcctgctgcgtgggcgcgatgcgccagccaatcacccggaagcctatgccaccgcgcaaggcaaactggtcgccatcggcgagatcggcgaaggcgagttcaggccgaagcgggtttttggctaa

SEQ ID NO: 46173 - protein, 315 aa, Agrobacterium tumefaciens
MSKPRKQQHRKPKGRPISGWLILDKPLDFGSTEAVSKIKWLFNAQKAGHAGTLDPLASGMLPIALGDATKTVPYVMDGRKIYEFTVTWGEQRATDDLEGEVVESSDQRPEEQAIRDILPNYTGVIMQTPPQFSAIKIAGERAYDLARDGETVEIPAREVEIHRLTLLACPDADTAHFEVECGKGTYVRALARDMGRDLGCFGHISELRRTMVAPFGEDMMVPLETLTALEAIEDRDERLEALDAFLIDTAEALSSLPRLIINDDQAHRLKMGNPILLRGRDAPANHPEAYATAQGKLVAIGEIGEGEFRPKRVFG

SEQ ID NO: 46174 - DNA, 882 bp, Anabaena sp
  CDS (1)..(882)
atgcaaggttttattaatttaaacaaacaatttggttggacttcccacgactgtgtagcacgtttaagaaaaatgttacgtctcaaacgtgtgggacacgcgggaacattagatccagcagccactggggtgttacctatcgcagttggcaaagctacacgtttattgcagtatctgcctagtgacaaagcttataaagctactgtccgttttggtgtgcagactacaacagatgatttgcaaggtgaaattattacttcccaaccttgtcggggattgagtttgtctgaggtgaaaactgcactaccccaatttatcggcaagattgaacaaataccacccatttacagtgcgattcaagtagagggaaaacgcttatatgatttggcgcgtaaaggcgaaatcatagaagtgccagcacggactgtagaagtttttagtatagatgttttggattggcgggaaggagattttcccgaattggatgtggcgatcgcctgtggtagtggtacatatattagagcgatcgctcgtgatttaggtgcagttttccacacaggtggaactctcgccgctttgatccgcactcacagcagtggctttaatctaacagatagtctcaccttgacagacttagaaacccaactgcaagcagggacttttgaaccaactcccgccgatgcagctttgcaatgtttaccgtcagttaccttacctagcatatctgcacaaaaatggtgtcagggacagcgaattgaattaaatttagaaactattggtaaagtgcgagtttatcaagcagaaacaaatattttcttgggtataggagaattgcaagcaggtgtgttaattccccaaatggtgtttgaaccgatttcttaa

SEQ ID NO: 46175 - protein, 293 aa, Anabaena sp
MQGFINLNKQFGWTSHDCVARLRKMLRLKRVGHAGTLDPAATGVLPIAVGKATRLLQYLPSDKAYKATVRFGVQTTTDDLQGEIITSQPCRGLSLSEVKTALPQFIGKIEQIPPIYSAIQVEGKRLYDLARKGEIIEVPARTVEVFSIDVLDWREGDFPELDVAIACGSGTYIRAIARDLGAVFHTGGTLAALIRTHSSGFNLTDSLTLTDLETQLQAGTFEPTPADAALQCLPSVTLPSISAQKWCQGQRIELNLETIGKVRVYQAETNIFLGIGELQAGVLIPQMVFEPIS

SEQ ID NO: 46176 - DNA, 864 bp, Aquifex aeolicus
  CDS (1)..(864)
atggacggagcacttctgatagacaagccaaagggaataacctccacggaagtagtggaaagggtaaaggaaaaactgaaggcaagaaaggcggggcacacgggaaccctcgatcctattgccacgggactcctcataatcctcataaacaaggctacgaggttttcgcagttctttatagggatgcctaaaacttacaggtttacggttaagttcggtgcagagacggacacctacgacgctcaggggaaagtcgtagaaacttacgaaggagaactcaattgcgataagttaaaagaagttctgaacgagttcaggggcgaaatactccagacacctccgcccttctccgcaaaaaagataaaaggtaggagggcttatgaactcgcgagaaagggcaaaaaggtagaactaaagcccgtgaagataaccgtctactccttggaactcctttcctgcaatccccgagaaaaggaggcggaattcttggccgaaatatcttccgggggttacgtgaggagtctcgcctacgatataggaaagaagctcgggatagggggctacatgaaggaactcagaaggttgaagatagacgaaataagcgttgaggaagcggtaagtctggaagagtttctctcttcggaaaatccggaggagtacgtcctgcccgtggatacactcttcagggtaatccccgaagttaggctaaacacctttgaagccggaaaaatactccagggaaagaggattttaataaagaattacgattacgagggccttgttaagatatatgaagactctaaatttataggtatcggagagttaaagggaggtgttctttcccctaaacgtttattagtttag

SEQ ID NO: 46177 - protein, 287 aa, Aquifex aeolicus
MDGALLIDKPKGITSTEVVERVKEKLKARKAGHTGTLDPIATGLLIILINKATRFSQFFIGMPKTYRFTVKFGAETDTYDAQGKVVETYEGELNCDKLKEVLNEFRGEILQTPPPFSAKKIKGRRAYELARKGKKVELKPVKITVYSLELLSCNPREKEAEFLAEISSGGYVRSLAYDIGKKLGIGGYMKELRRLKIDEISVEEAVSLEEFLSSENPEEYVLPVDTLFRVIPEVRLNTFEAGKILQGKRILIKNYDYEGLVKIYEDSKFIGIGELKGGVLSPKRLLV

SEQ ID NO: 46178 - DNA, 978 bp, Archaeoglobus fulgidus
  CDS (1)..(978)
gtgaaactggaaaacttctacgtcaaggatgacgcaagcacggatgagagctacggatgctacccaaccaagaggccgatggaggagtacatcaggaaggggttagtgtgcatcgacaagcccatggggccaagcagccacgaggtggttgtttgggtgaggaggattctcaatgtcagcaaaacgggccacgcaggcactctcgacccaagagttacaggcgttctgccaattttcattgaaaatgcaacaaagatggtcaagttccttcaggagtcgagcaaggagtacgtctgcctcatgaggcttcacggtgatgcgaagagggaggatgttgagaaggtgatgaagctcttcgtcggcagaatctaccagcgccccccgcttaagtccgcggttaaaaaagtgctgagaatcagggagatttacgaaatggagcttctggagatggagggcagggacgtgcttttcagagttgttactgaatctggaacatacatcagaaagctctgcagggacatcggagaggtgcttggcactggggcgcacatgcaggagctaagaagaactcggacggggaaatttggagaggacatgtgctacacactgcaggacctgcttgatgcttacgttttctggaaggaggagggagaagagaagtatttaagggagataatcaagccgatggaggttgctgctgcagagctgcccaaaatcgtcatcaaagattccgctgttgatgccatctgccatggggcgaatctttcagtgaggggagtggcttacgtggagaagaatgttaagaaggacagcactgtggcgatcttcacgctgaaaaacgagctggtggcaattggcagagctttaatggatgcagaagacatctacaggcttaaaaaaggaattgctgcggacattcagagagtgatgatggagaggggagtgtatcccaaagtctggaagtcctcttctgattag

SEQ ID NO: 46179 - protein, 325 aa, Archaeoglobus fulgidus
MKLENFYVKDDASTDESYGCYPTKRPMEEYIRKGLVCIDKPMGPSSHEVVVWVRRILNVSKTGHAGTLDPRVTGVLPIFIENATKMVKFLQESSKEYVCLMRLHGDAKREDVEKVMKLFVGRIYQRPPLKSAVKKVLRIREIYEMELLEMEGRDVLFRVVTESGTYIRKLCRDIGEVLGTGAHMQELRRTRTGKFGEDMCYTLQDLLDAYVFWKEEGEEKYLREIIKPMEVAAAELPKIVIKDSAVDAICHGANLSVRGVAYVEKNVKKDSTVAIFTLKNELVAIGRALMDAEDIYRLKKGIAADIQRVMMERGVYPKVWKSSSD

SEQ ID NO: 46180 - DNA, 930 bp, Bacillus subtilis
  CDS (1)..(930)
atggttaacggagttctccttttacataaacctgttggcatgacatcgcacgactgtgtcatgaagatccgaaagctgttaaaaacaaaaaaagtaggacatacaggaacgctcgatccggaagtatcaggcgtgcttccgatttgtgtaggaagagcgacaaaaatagtcgaatacttaactgaaaaatctaaaacgtatgatgcagaaataacattgggcttttcaaccacaacagaggatcaaaccggagaaacggtggaaacaaagcctgtcaatcacgacattgataaagcggatgtagaaaaggttttaaacagtttaaaggggaaacaagaacaaattccgcccatgtattccgctgtaaaagtaaacggcaaaaaattatacgaatacgcaagagcagggattgaagtagaacgtccgaaacgtatgataaccattgaagacattgccctgacaacagagattaaacatcatggagaaaccgcaagcttccggtttacagtgacttgctccaaagggacctatgtaaggacgctggcggtcatgatcggagaaaagctcggatatccggcccatatgtctcatttaatccgtacggcatccggagatttttctctcgacgaatgctttacttttgatgaactcgaagcacaggcccaatccggaaccgtggaagagcatacagttcctattgaacgtgcgctcaatcatttgccgaaatggatcataagtgatacattagctaagaaagtagaaaatggggctttgcttgagacgcccgagcagttttctgaaatgacaagtggagaccgtattgccgtctttactgaatccggaacctgcttggcgatctatttccctcatcctgcaaaaaaagggctgttaaagccggcaaaagtattgatgcaaaaaagcgaacaatag

SEQ ID NO: 46181 - protein, 309 aa, Bacillus subtilis
MVNGVLLLHKPVGMTSHDCVMKIRKLLKTKKVGHTGTLDPEVSGVLPICVGRATKIVEYLTEKSKTYDAEITLGFSTTTEDQTGETVETKPVNHDIDKADVEKVLNSLKGKQEQIPPMYSAVKVNGKKLYEYARAGIEVERPKRMITIEDIALTTEIKHHGETASFRFTVTCSKGTYVRTLAVMIGEKLGYPAHMSHLIRTASGDFSLDECFTFDELEAQAQSGTVEEHTVPIERALNHLPKWIISDTLAKKVENGALLETPEQFSEMTSGDRIAVFTESGTCLAIYFPHPAKKGLLKPAKVLMQKSEQ

SEQ ID NO: 46182 - DNA, 960 bp, Bartonella henselae
  CDS (1)..(960)
atggcacggcaaagcaaaaaaaaaggccgtcctgtttctggttggattatacttgataaaccaaaaggtatgagatcaacagaagctgtctcacaaattaaatacctctttcatgcgcaaaaagtaggacacgccggcacgcttgatccccttgcttctggtctcctgccaattgcattgggggaagcaaccaaaaccgttccctacgtgatgcaaggtacaaaaacctaccgttttcacatcgcttggggagaagagcgttcaacagatgatttagagggtgaaataacgcacacatcttctaaacgtccaacacgagaagagatacttgctcttcttcctcaatatacaggtgttattttgcaaacacccccacaattttcggcaattaaaattgccggtaatcgagcctatgatctagcacgtgaaggtgaagtcgttgaaatcccaccacgtcaagtggaaatagaaactttcaaattaatagaaatgataaccaaagatcattctatctttgaaatcacctgtggaaaaggaacctatgtgcgctccttagcacgcgatatgggacgtgatcttggttgttatgcgcatattgctgatttaagacgtattgcagtcgcacctttttgtgaaaatgatctcatcacatgggatgaactcaaagcagttgaactagataaaagtgcaaaaaatgaaaaggatgctccttttgaaagaaatttcataaaacttgacgaactcttaattgaaacgatttctgcactagaatgtctctctcattatacccttagccaaactcaagcacagcaagttatgaaaggcaatacagtgctcctatatcatcacgatgtacctcttgatgaagatgaggtttgtgtcctgtatcaagaccaacttcttgctataggcgctcttgaaaaaaaccaattcaagccaaagcgtcttttcacaatttaa

SEQ ID NO: 46183 - protein, 319 aa, Bartonella henselae
MARQSKKKGRPVSGWIILDKPKGMRSTEAVSQIKYLFHAQKVGHAGTLDPLASGLLPIALGEATKTVPYVMQGTKTYRFHIAWGEERSTDDLEGEITHTSSKRPTREEILALLPQYTGVILQTPPQFSAIKIAGNRAYDLAREGEVVEIPPRQVEIETFKLIEMITKDHSIFEITCGKGTYVRSLARDMGRDLGCYAHIADLRRIAVAPFCENDLITWDELKAVELDKSAKNEKDAPFERNFIKLDELLIETISALECLSHYTLSQTQAQQVMKGNTVLLYHHDVPLDEDEVCVLYQDQLLAIGALEKNQFKPKRLFTI

SEQ ID NO: 46184 - DNA, 927 bp, Bdellovibrio bacteriovorus
  CDS (1)..(927)
atgacgaataaaaatcaattcaatggtctgctgctggtggataaaccttcagggatctccagccatgacgttgtggcgcgtttgcgccgcattctttccacgcgcgctgtggggcattccggcactctggatcccatggcttcgggtctgatggcctgtctggtgaacgagggcacaaaacttagccaatacattctggaaggcgacaagggctaccgcctgcgtgcgcagttcgggattcgcaccgacaccctcgacacgaccggcgaaactttggaaacccgtcccacggatcatttgacccgggaactgatcctgtccgaggccctcaagcttcagggcgagatggaagttgaagtgcctatttactcggcaatcaaggttcagggtaaaaagctttatgaatacgcccggggcgagcaggaagtgaccattcccaagaaggtcatgaagttctgggatattgaacctgtggaaatcggctctgattgggcagaatttgatatcaaatgcagtaagggcagctatatccgcacctggatcgacctgctgggtaaggccttggggtgtggggcggcgatgagcggcctgcgccggacgtggtcttcaccgtataaaattgaccaggctcagactctggagcagatcgaggcttcggtcaaaggcggctctttaggccctgcttttgttcccatggagctggcgctgcctcaggtgaaacgtattcgaatcaaggggcaagacaaggtccttttggggaatggccagatcagccatgacctcagatcccagcttatttcggccttcaatcccgatgtggaccagtacattcaggttctggcccaagaggggggcgagcttttggccgttattggcctggagcccggccgggggttcgttctacgcagggtatttaaatactcttga

SEQ ID NO: 46185 - protein, 308 aa, Bdellovibrio bacteriovorus
MTNKNQFNGLLLVDKPSGISSHDVVARLRRILSTRAVGHSGTLDPMASGLMACLVNEGTKLSQYILEGDKGYRLRAQFGIRTDTLDTTGETLETRPTDHLTRELILSEALKLQGEMEVEVPIYSAIKVQGKKLYEYARGEQEVTIPKKVMKFWDIEPVEIGSDWAEFDIKCSKGSYIRTWIDLLGKALGCGAAMSGLRRTWSSPYKIDQAQTLEQIEASVKGGSLGPAFVPMELALPQVKRIRIKGQDKVLLGNGQISHDLRSQLISAFNPDVDQYIQVLAQEGGELLAVIGLEPGRGFVLRRVFKYS

SEQ ID NO: 46186 - DNA, 1038 bp, Bradyrhizobium japonicum
  CDS (1)..(1038)
atgggcggcaattcccagccgcaccaggagccgcgccgcgtcaacaacgatccccgcgccaagcagcagaagggcaaccaggttcgccgcgaccgccgcgacgtccatggctgggtcgtgctcgacaagccgatcggcatgacctcgacgcaggccgtcgccgtgctcaagcgcctgttcaacgccaagcgcgccggccacgccggcacgctcgatccgctcgcttccggcggcctgccgattgcgctcggcgaagccaccaagacggttcccttcgtcatggacggccgcaagcgctaccagttcaccgtgtgctggggcgaggagcgcgacaccgacgacatcgagggccgggtgaccgcgacctccgagctgcgcccgacccgggaggccatcctggcgctgttgccccgcttcaccggggtgatcgagcagatcccgccgcgctattctgcgatcaagatccagggcgagcgcgcctatgacctcgcccgcgacggcgaggtcgtggagctggctccccgcccggtcgagattcaccgattaacccttgtggatcaaccggataacgaccgggccgtgttcgaggccgaatgcggcaagggcacctatgtccgcgcgctggcccgcgatatgggccggattctcggcacttatggccatatctgcgcgctgcggcggaccctggtcggcccatttggcgaaaacgacatgattccgctggatcagttggaggctttgtgcgatagagccgcgtccggcgagggcagcctcgccgacgcgcttttgcccgttgagaccgcgctggacgacatcccggcactggccgtcactcgggctgatgcggcaaggctccatcggggccaggccgttttgttgcgcggacgggatgcgcccacttgtagcggcacagtctatgtcacggtggcaggccgccttttggcgcttgccgaagtcggcaatggcgaaatcatccccaagcgtgtgttcaacctgaccggcctgactgccagccccggtcgcaacgagagaaattga

SEQ ID NO: 46187 - protein, 345 aa, Bradyrhizobium japonicum
MGGNSQPHQEPRRVNNDPRAKQQKGNQVRRDRRDVHGWVVLDKPIGMTSTQAVAVLKRLFNAKRAGHAGTLDPLASGGLPIALGEATKTVPFVMDGRKRYQFTVCWGEERDTDDIEGRVTATSELRPTREAILALLPRFTGVIEQIPPRYSAIKIQGERAYDLARDGEVVELAPRPVEIHRLTLVDQPDNDRAVFEAECGKGTYVRALARDMGRILGTYGHICALRRTLVGPFGENDMIPLDQLEALCDRAASGEGSLADALLPVETALDDIPALAVTRADAARLHRGQAVLLRGRDAPTCSGTVYVTVAGRLLALAEVGNGEIIPKRVFNLTGLTASPGRNERN

SEQ ID NO: 46188 - DNA, 975 bp, Brucella suis
  CDS (1)..(975)
atggcaagacggggcaagaaaaaaggtcgcccgatatccggctgggtcatttttgacaagccgaagggaatgggatcgaccgaggcggtctcgaagatcaagtggcttttcagtgctgaaaaggctggccatgcgggcacgctcgatccgcttgcttcgggcatgttgcccatcgcgcttggcgaagccacgaagacggtgccttatgtcatggacggaaccaaggtctatcgttttacggtgacatggggcgaggagcgttccacggacgatctggaaggccagcccaccaaaacttccgacaagcgtccgtcgcgtgaggaagtggaagcactcctgccggattataccggcgtgatctcgcaggttccgccgcagttttccgcaatcaagatcgatggcgagcgcgcttatgatctggcccgcgagggtgaaaccgtggaaattcccgcccgtgaggtcgagatcgaccgccttgagatcgtaggctttcccgatgccgaccgtaccgaatttgaggtggaatgctccaagggtacctatgtgcgctcgcttgcgcgcgacatggggcgcgatctcggctgctatggtcatatttccgatctgcgccgtgtggaagttgcgcccttcaccgatgaagatatggtgacgctcgcaaagcttgaggctgtctggccgccgcttccgccgaaggatgaggacggcaatgtgatcgagcctgcaccgcggcgcgatttctccgcgcttgatgcgctggtgatcgatacgggtgcggcacttgattgtctgccgcaagtgccgctctccgacgatcaggcccagcgggtgcgccttggcaatccggtcatcctgcgcgggcgcgatgcgccgctggaagccgacgaggcctgcgttaccacgcgcggcaagcttctcgccatcggctatatcgagcacgggcagttcaagccgaaacgggttttcaccgccggctga

SEQ ID NO: 46189 - protein, 324 aa, Brucella suis
MARRGKKKGRPISGWVIFDKPKGMGSTEAVSKIKWLFSAEKAGHAGTLDPLASGMLPIALGEATKTVPYVMDGTKVYRFTVTWGEERSTDDLEGQPTKTSDKRPSREEVEALLPDYTGVISQVPPQFSAIKIDGERAYDLAREGETVEIPAREVEIDRLEIVGFPDADRTEFEVECSKGTYVRSLARDMGRDLGCYGHISDLRRVEVAPFTDEDMVTLAKLEAVWPPLPPKDEDGNVIEPAPRRDFSALDALVIDTGAALDCLPQVPLSDDQAQRVRLGNPVILRGRDAPLEADEACVTTRGKLLAIGYIEHGQFKPKRVFTAG

SEQ ID NO: 46190 - DNA, 939 bp, Buchnera aphidicola
  CDS (1)..(939)
atgttttttcataaaaaacgtaatgttaatggatttttattgttggacaagcctaagggaatgacttctaacaatgttttacagaaagtaaaaattatttttaaggctaaaaaagcaggctatattggtaccttagatcccttagctactggaattttaccgatttgttttggtgaagctacaaaattttctaattatttgaatgcatcagacaaacactataatgtaattgctaggttgggagaaaaaacatctacttcggattctgatggaataattgtaagaaaaagacccattttatttacgcctattcaacttagtttagctttaaaagcactgacaggttcagttaatcaaataccttcaatgtactcagctgttaaatataaaggtattcctttgtataaatatgcacgacagggaataaatgttaaacgtaatattagatgcgtttttatatataagattgatcttgttgatcaaaaagataattggattgaattaaatgtgcattgttcaaaaggtacttatattcgaacacttattgaagatttaggtgaaaaattattttgtggagctcacgtaattagattacgtcgtttaaaaataggattactttcttattctaaattagtcaagctatcttttttagaaaatttattaaatgaaaaaaatgttgtaaaaataaatttttttaaaaaaatagatgatttgctaatgccagttgatactccagtttattttttgcctaagatatatatttctattgaaaaattatctgtttttagattaggacaaaaagttaatttttcatcttctatcacaaatggtttagtccgtgtttttgaaaaagataataatacatttatcggattaggaaagattaattctgaaaaaacgttaattccgtatcgattagtttctatgttaactaattaa

SEQ ID NO: 46191 - protein, 312 aa, Buchnera aphidicola
MFFHKKRNVNGFLLLDKPKGMTSNNVLQKVKIIFKAKKAGYIGTLDPLATGILPICFGEATKFSNYLNASDKHYNVIARLGEKTSTSDSDGIIVRKRPILFTPIQLSLALKALTGSVNQIPSMYSAVKYKGIPLYKYARQGINVKRNIRCVFIYKIDLVDQKDNWIELNVHCSKGTYIRTLIEDLGEKLFCGAHVIRLRRLKIGLLSYSKLVKLSFLENLLNEKNVVKINFFKKIDDLLMPVDTPVYFLPKIYISIEKLSVFRLGQKVNFSSSITNGLVRVFEKDNNTFIGLGKINSEKTLIPYRLVSMLTN

SEQ ID NO: 46192 - DNA, 933 bp, Caulobacter crescentus
  CDS (1)..(933)
atggcccgccgcaagaagggcgacgccgtctcgggctggctgtgcctggacaagccctatgacctgacctcgaccacggccgtctcccgcgtgcgccgcgcgttcaacgcccagaagggcggccacgccggcacgcttgatccactggccacgggcatcctgccgatcgcgctgggcgaagcgaccaaaaccgttccgttcctgatggacgccgacaaggcctatcgcttcaccatcgcctggggccgcgacacaacgacgctggaccgcgagggcgagaccacggggacctctgacgtgcgccccacccgagagcaagtcgaggcggcgctgcccgccttcatcggcgaggtggatcagattccgccgaacttctcggccatcaaggtcgacggcgagcgggcctatgacctggcgcgcgacggcgtggagttcgagctgccgacccgcaaggtcagcattttcgacctcaaggtggtcgaccagccggacgccgaccatgtgacgctcacgatggaatgcggcaagggcacctatgtccgcgccgtggtccgggacctggccaaggcgctgggaacctgcggtcacgtggccgacctgcgccgcacccgggtgggcggcttctccgaggcctcggcgatagcgctggaaactctggagaatttgagctatgaggcccggctgtcggaggcattgcttccggtcgagaccgcgctggacgacatcccggcgttggccgtgaccgatgaagacgccttccggcttgcacagggacgcgccatcgtcctgcttccgcgtcaggtggaaacgttgaaagccgagcttccgcccggcgatcgcaccgtttcagccatgtccggcgacaggttggtggccctgtgcgagatgcgcgctgggaagctcaatcccgtgcgggtcttccaactcacctga

SEQ ID NO: 46193 - protein, 310 aa, Caulobacter crescentus
MARRKKGDAVSGWLCLDKPYDLTSTTAVSRVRRAFNAQKGGHAGTLDPLATGILPIALGEATKTVPFLMDADKAYRFTIAWGRDTTTLDREGETTGTSDVRPTREQVEAALPAFIGEVDQIPPNFSAIKVDGERAYDLARDGVEFELPTRKVSIFDLKVVDQPDADHVTLTMECGKGTYVRAVVRDLAKALGTCGHVADLRRTRVGGFSEASAIALETLENLSYEARLSEALLPVETALDDIPALAVTDEDAFRLAQGRAIVLLPRQVETLKAELPPGDRTVSAMSGDRLVALCEMRAGKLNPVRVFQLT

SEQ ID NO: 46194 - DNA, 870 bp, Clostridium acetobutylicum
  CDS (1)..(870)
atggatggaattttaaacatatttaagccaataggactaacatcctttgatgtagtaagacaagtaaaaaaaatctccaaagaaaaaaaagtagggcatacagggacacttgatccattggcatcaggtgttttgcctatttgcattggaaaagctactaaaattgtggattttgtaatggaaggtaagaaaatatacgacgcagaaatgaagctcggtgaaataagtgatacttatgatagagaaggtaagattttaaaagtaaatcaagttacttcaagtgaaaataatatagttgaagctattatgagttttcaaggtgaaattcttcaagtccctccaatgtactcagcactaaaggttaatggtatcaaattatatgatttagccaggcagggaattgaaatagaaagagcttctagaaaaatacacatatatgcaattaagattttaagtatagatattccttttgttaaattccgtgttgagtgctctaaaggaacgtacataagaagtttatgttatgatataggtaacaaactaggatgtggagcattaatgtacaatttaacgcgagtgtcatccggaaatttcaattcttcattcagcattccattggaagatcttaatgagcaaaatattacggaaaatataattaatgttgataaatgcctggaaaattacgatgaaatagcagtagatgaaaaattcgaaaaattattggtaaatggcgtaaaagtatcagacagaagattaattgaaaaaattcctgataacaaaacttatagagtctataatatggaaagaaagtttttaggtcttggaaatttaagtgaagaaggatttaaaataattaaattattaacctag

SEQ ID NO: 46195 - protein, 289 aa, Clostridium acetobutylicum
MDGILNIFKPIGLTSFDVVRQVKKISKEKKVGHTGTLDPLASGVLPICIGKATKIVDFVMEGKKIYDAEMKLGEISDTYDREGKILKVNQVTSSENNIVEAIMSFQGEILQVPPMYSALKVNGIKLYDLARQGIEIERASRKIHIYAIKILSIDIPFVKFRVECSKGTYIRSLCYDIGNKLGCGALMYNLTRVSSGNFNSSFSIPLEDLNEQNITENIINVDKCLENYDEIAVDEKFEKLLVNGVKVSDRRLIEKIPDNKTYRVYNMERKFLGLGNLSEEGFKIIKLLT

SEQ ID NO: 46196 - DNA, 885 bp, Clostridium perfringens
  CDS (1)..(885)
atgaatggagtaattaacatatataaaaatacgggaatgacttcatttgatgttgtggccatggtaagaagagttgcaaaaatgaaaaaggtaggacatacaggaactttagatccagcggcttctggagttttacctgtatgccttggaaaagctacaaaaattatagattatataatggaaaataaaaaagtttatagagtgaatttaaagcttggtatggttactgacacatatgatttagaaggagaagttttaagagaagaggatgcatcacatataacaaaggatgaaatattaaattgtataaattcctttgtaggaacaatagatcaagttccaccaatgtattctgctttaaaacaaaatggagtaagattatatgaattagcacgtcaaggaatagaagttcacagagaagctagaaaaattactatttattctattgaaaatataaaaatagaatcaaatgataatatacaaatggatgtttgttgttctaagggaacatatataagaagcctttgctatgatattggtgaaaaattaaatgttggagcaacaatgactgccttagagagaatacaaaatggtacatttactaaagaagaagcaataaatatagaagatttaacagaagaacttttagaaaaacatattatttccattgaaaaggctttagattcttttgaaaaaatcacagtaaatgagaagtttggtaagcttttaagaaatggtgttaaagtatttgataatagaatgtatagtgaagaagttgaatttaataaactatatagagtatatgaagacaatggagtctttttgggattaggaaaaagggatgaaaaaggatttaaattggagaaattactgatagaggagtag

SEQ ID NO: 46197 - protein, 294 aa, Clostridium perfringens
MNGVINIYKNTGMTSFDVVAMVRRVAKMKKVGHTGTLDPAASGVLPVCLGKATKIIDYIMENKKVYRVNLKLGMVTDTYDLEGEVLREEDASHITKDEILNCINSFVGTIDQVPPMYSALKQNGVRLYELARQGIEVHREARKITIYSIENIKIESNDNIQMDVCCSKGTYIRSLCYDIGEKLNVGATMTALERIQNGTFTKEEAINIEDLTEELLEKHIISIEKALDSFEKITVNEKFGKLLRNGVKVFDNRMYSEEVEFNKLYRVYEDNGVFLGLGKRDEKGFKLEKLLIEE

SEQ ID NO: 46198 - DNA, 870 bp, Clostridium tetani
  CDS (1)..(870)
atgaatggtgtaataaatgtatataagcctcaaaatattacctcttttgatgtggtaagaattattaaaaaaataagtagaataaaaaaagtagggcatacaggtacattagatccaatggctacaggggttttacctatatgcttaggtggttctaccaaaattgttgattttattatgaatgaacacaaagagtatagagctaaactaaaattaggattaatcacagatacttatgatagagaaggaaaagtactgaaagaagaagatgcatccaaaattttagaggaggaagttgtaaactgtataaattcttttaaaggggaaattatacaaattcctcctatgtactctgctataaaaattaaaggggaaagattatacaatcttgcaagaaaaggaatagaggttgaaagagaaggtagaaaaataaatatctataatatagaagtgctaaaggtgaatcttccctatgtagaatttaaagtaaattgttctaagggaacttacataagaagtctttgctatgatattggtaacaaattaggaatgggggcaactatgtgggaattggagagaactaaaacaggaaatttctctattgaaaactctataaacttagaagatataaatgaagaaaatatacaagaatttataattcctgcagaaaaagctctaagtaaatatgaaagaatagaaatagatgaatacttttcaagacttctaaaaaatggagtaaaagtaaaagataaaaggcttttagataaaataaaagcaaatgatattttaagagtttaccaagaagataaattcatagggttaggacaaaaaactaaagaggggtttaagatcgttaaattacttgtatag

SEQ ID NO: 46199 - protein, 289 aa, Clostridium tetani
MNGVINVYKPQNITSFDVVRIIKKISRIKKVGHTGTLDPMATGVLPICLGGSTKIVDFIMNEHKEYRAKLKLGLITDTYDREGKVLKEEDASKILEEEVVNCINSFKGEIIQIPPMYSAIKIKGERLYNLARKGIEVEREGRKINIYNIEVLKVNLPYVEFKVNCSKGTYIRSLCYDIGNKLGMGATMWELERTKTGNFSIENSINLEDINEENIQEFIIPAEKALSKYERIEIDEYFSRLLKNGVKVKDKRLLDKIKANDILRVYQEDKFIGLGQKTKEGFKIVKLLV

SEQ ID NO: 46200 - DNA, 903 bp, Corynebacterium diphtheriae
  CDS (1)..(903)
atgaatgatgccctcgcagactcaggccttgtgattgtcgacaaaccccaaggaatgacctcccacgacgttgtttctaaaatccgtcggaccttttccaccaaaaaggtgggtcatgccggaaccctcgaccctatggctacaggagtgctcgtattaggactagagcgcgggaccaaattcctagcacatatggttgcgtctacaaagtcctatacggccactattcgtctcggtgctgctactactaccgacgaccgtgaaggcgaaacgatcacttcagcttcaccagatcaactggcaggaatcaccgaaaccaagatctccgatgccgttaagcagtttcggggatctatcatgcaacgtcctgccgcagtgagcgctatcaagatagatgggaaaagagcgcatcaacgcgtacgagaaggtgaaaaagtagaaattccagcacggccggtcaccatttctcggtatgacattttagagattcgtcgagacgcagctttcatcgacatcgacgtagaagttgattgttcttccggaacctacattcggtcactagcccgtgatctcggcgaagaactcggagtaggtgggcacttaaccgcgttacgacgaacacaggtaggaccgtttacgctcgataatgctgtaacactcgaaaaattggaagaaaacccacacgtatctttgacccttgaccaggcattagcagcgagctacccagttctttctgtttcagaaaaagaggcgagtgatctcgccatgggcaaatggctcactccacgcggtctgaaaggaatccatgcagcggtcgatcctcatggacgtgctatcgccttggtaaaagaacaaggcaaacggctagccaccatatttgtggcacgtccatcgaccctttaa

SEQ ID NO: 46201 - protein, 300 aa, Corynebacterium diphtheriae
MNDALADSGLVIVDKPQGMTSHDVVSKIRRTFSTKKVGHAGTLDPMATGVLVLGLERGTKFLAHMVASTKSYTATIRLGAATTTDDREGETITSASPDQLAGITETKISDAVKQFRGSIMQRPAAVSAIKIDGKRAHQRVREGEKVEIPARPVTISRYDILEIRRDAAFIDIDVEVDCSSGTYIRSLARDLGEELGVGGHLTALRRTQVGPFTLDNAVTLEKLEENPHVSLTLDQALAASYPVLSVSEKEASDLAMGKWLTPRGLKGIHAAVDPHGRAIALVKEQGKRLATIFVARPSTL

SEQ ID NO: 46202 - DNA, 894 bp, Corynebacterium efficiens
  CDS (1)..(894)
atgaatgatcccgtccagaactcaggtctcgtcgtggtggacaaacccgccggaatgacatcacacgatgtggtatcaaaactgcgccgtgccttctccacccgcaaggtggggcacgccggcacccttgatcccatggccaccggtgtgctggtggtcggcatcgagcgtggtacacgtttcctcgcgcacctggtggccaccaccaaggcctacgatgccaccatccggctcggcgcctccaccaccaccgatgaccgggagggggacgttgtattctcggctgacgcctcgacgcttgacgacgaacagatcaccaccgccgtcacctcgctgaccggggagatcatgcagaaacccgcgagtgtgtccgccatcaagatcgacgggaagcgggcccatgaacgggtccgcgacggtgaggtggtggatattccggcgcgcccggtaaccgtgagcgtgttcgacgtgctggagcagcgacgcgagggtggcttcgtggatctggatgtgcgggtgcactgttcctccggcacctatatccgttccctggcgcgtgacctgggggccgccctgggggtgggtggacacctgaccgcgctgcgtcgcaccgaggtggggcccttcaccctggaggatgcgatccccctggctgacctccaggacaacgcccggttatccctgagcctggatgaggcactggcccgttcctatcctgtcctggagatcaccgaggccgagggtgaggcactgtcgatgggcaagtggctggaaccgcgtggactgaagggtgtgcacgcggcggtcaccccgtcgggccggtcgatcgccctggtcgaggagaaggggaaacgcctggccaccgtgttcgtagcgcgtcccaacaccctgtga

SEQ ID NO: 46203 - protein, 297 aa, Corynebacterium efficiens
MNDPVQNSGLVVVDKPAGMTSHDVVSKLRRAFSTRKVGHAGTLDPMATGVLVVGIERGTRFLAHLVATTKAYDATIRLGASTTTDDREGDVVFSADASTLDDEQITTAVTSLTGEIMQKPASVSAIKIDGKRAHERVRDGEVVDIPARPVTVSVFDVLEQRREGGFVDLDVRVHCSSGTYIRSLARDLGAALGVGGHLTALRRTEVGPFTLEDAIPLADLQDNARLSLSLDEALARSYPVLEITEAEGEALSMGKWLEPRGLKGVHAAVTPSGRSIALVEEKGKRLATVFVARPNTL

SEQ ID NO: 46204 - DNA, 894 bp, Corynebacterium glutamicum
  CDS (1)..(894)
atgaatgctcctgcccctaaacctggactcgtgatcgtcgacaagcccgccggaatgacatcccatgacgtggtgtccaaattgcgccgcgcattttccacccgcaaagtaggccacgcaggcaccctcgaccccatggcaaccggcgtgttagtcgtcggaattgagcgcggaacccgcttcctggcacacatggtggcctccaccaaagcctacgacgccaccattcgactcggcgccgccaccagcaccgatgatgcagaaggcgaggttatctccacaacagacgcatccggcctcgaccacagcaccatccttgctgaaatcgtcaacctcaccggcgacatcatgcaaaaacccaccaaagtctccgccatcaaaatcgacggcaaacgcgcccacgaacgcgtccgcgacggcgaagaagtagacattcccgcacgtcccgtcaccgtcagcgtctttgacgtgctcgactaccacgtcgacggtgaattttatgacttagatgtgcgcgtccactgctcctccggcacctacatccgcgcgctcgcccgcgacctcggcaacgctttgcaggtcggcggccacctgaccgcgcttaggcgcacagaggtcggcccttttacgcttaacgacgcgacccccctctccaaactccaagagaatccagaactctccctcaacctcgaccaggcactcacccgcagttacccagtccttgacatcaccgaagacgaaggcgttgacctgtccatgggcaaatggttggaacctcgcggactgaaaggcgtccacgctgcagtaacaccatcaggaaaagccgtggcgctcatcgaagaaaagggcaaacgcctggccaccgtgtttgttgctcaccccaacactctttag

SEQ ID NO: 46205 - protein, 297 aa, Corynebacterium glutamicum
MNAPAPKPGLVIVDKPAGMTSHDVVSKLRRAFSTRKVGHAGTLDPMATGVLVVGIERGTRFLAHMVASTKAYDATIRLGAATSTDDAEGEVISTTDASGLDHSTILAEIVNLTGDIMQKPTKVSAIKIDGKRAHERVRDGEEVDIPARPVTVSVFDVLDYHVDGEFYDLDVRVHCSSGTYIRALARDLGNALQVGGHLTALRRTEVGPFTLNDATPLSKLQENPELSLNLDQALTRSYPVLDITEDEGVDLSMGKWLEPRGLKGVHAAVTPSGKAVALIEEKGKRLATVFVAHPNTL

SEQ ID NO: 46206 - DNA, 927 bp, Deinococcus radiodurans
  CDS (1)..(927)
atgcccgtcattgccgccgacaagcccctgcatctcacctcgcacgacgtggtgaaccgggcgcggcgggcgctgggcaccaagcgggtgggccacaccggcacgctggacccgctggcgaccggcgtggtcgtgctgtgcgtggacgactccaccaaactggtgcagttcatggagcatgacaccaaggagtacctcgcctgggtgagcctgggcgcgggcaccccgacgcttgacgccgaggggcctatcgagcagcaggccgaggtgccgccgctggatgaggaccacctccgcgaagtgctgaagggcttcctggggccgcaacaacaaattcccccgcagtacagcgccattcaaattggcggtcagcgggcctacgcggtggcgcgggccggggggcaactcgaccttcccgcccgcgacgtggagattcacgagctggaattgatcggcatgtttccgagcgtgcaggcggcgccgcgcaccttcgacccgcagagttggactccggctgcggcaggactgaccttcaccctccccgaaccgctcggcgagtttcccacgctgctgctgcgggcgcacgtcggcagcggcacttacctgcgctcgctggcacgtgacctgggggcggcgctcggcgtgcccgcgcacctcggcgggctggtccgcacccgcgcggggcgctacagcctgcgggacgcggtgagcctggagaacctgactgaagcccccaccattcccgacctggacgcgctggactttccgcgcatcgaggccgacgagcgcctcgcccgcgagctgcggcaaggcaaacggcccgcgcacccgcagcggggccgcgctgtggtcaccctcggcggcgagctggtcgcggtggtggacggcgacggcgagcacctgaaggtcgtgcgcgcctgggcgtga

SEQ ID NO: 46207 - protein, 308 aa, Deinococcus radiodurans
MPVIAADKPLHLTSHDVVNRARRALGTKRVGHTGTLDPLATGVVVLCVDDSTKLVQFMEHDTKEYLAWVSLGAGTPTLDAEGPIEQQAEVPPLDEDHLREVLKGFLGPQQQIPPQYSAIQIGGQRAYAVARAGGQLDLPARDVEIHELELIGMFPSVQAAPRTFDPQSWTPAAAGLTFTLPEPLGEFPTLLLRAHVGSGTYLRSLARDLGAALGVPAHLGGLVRTRAGRYSLRDAVSLENLTEAPTIPDLDALDFPRIEADERLARELRQGKRPAHPQRGRAVVTLGGELVAVVDGDGEHLKVVRAWA

SEQ ID NO: 46208 - DNA, 915 bp, Desulfovibrio vulgaris
  CDS (1)..(915)
atgcccgtacagcagcatggtctgctggtgctggacaagcccagtggcccctcgtcggcccagtgcatctcgaaggtgaagcggctgggtcagaagaagataggtcatgcggggactctcgaccccatggctggtggtgtgttgctcgtcctgctgggacatgcgacgaaaatttcaggtcacctcatggccgatggcgagaaggtgtatgcaggcaccctgcgccttggcgagacgaccgacacttgggacgccgaaggtacggtgacagccaccgcgccctggcaccatgtgacagaagccgacgtgcgcgccatcgtcgactcgtggctgggttcctccgagcaggaggtgcccccctattctgccgcaaagcatcagggccagcccctgtacaagctttcgcgtgcaggccgcgagaccccggtgaagacgaagaccgtcgagatttcccttgcggaggtcgtatggtgcgacctgccgcatgtacgtttccgggtaagatgcagttccggcacctacatacggtccctggcccacagcttggggatacgtctagggtgcggcgccgtgcttacggaactgacccgggagtacagtcatccgttcggactggacatggcgcatacccttgatgccgtgctcgcagaacccggacgcctcgcagagcgggtcatccccatcacgcacgcgttgccgcactggccaaaggtcggcatcagcctccagcaggaggcgagcgtacgcaacgggataccactgccctatcaacccgagatggtggcggacatgccattcatggaaggtgtgaaggcgatactgctcgacacgcgcgaggtgcccgtggctcttgtcgaaacggccatcgtaggtggcagacaggtctgggccgtactccggggactgtggagttaa

SEQ ID NO: 46209 - protein, 304 aa, Desulfovibrio vulgaris
MPVQQHGLLVLDKPSGPSSAQCISKVKRLGQKKIGHAGTLDPMAGGVLLVLLGHATKISGHLMADGEKVYAGTLRLGETTDTWDAEGTVTATAPWHHVTEADVRAIVDSWLGSSEQEVPPYSAAKHQGQPLYKLSRAGRETPVKTKTVEISLAEVVWCDLPHVRFRVRCSSGTYIRSLAHSLGIRLGCGAVLTELTREYSHPFGLDMAHTLDAVLAEPGRLAERVIPITHALPHWPKVGISLQQEASVRNGIPLPYQPEMVADMPFMEGVKAILLDTREVPVALVETAIVGGRQVWAVLRGLWS

SEQ ID NO: 46210 - DNA, 945 bp, Erwinia carotovora
  CDS (1)..(945)
atgagtcgtcctcgtcgccgtggccgtgatgtacacggcgtattgttattagataagccgcagggcgtgtcgtctaatgatgttttgcagaaagtaaaacggatttttaacgctaacagagcgggccatacgggtgcgttggatccattagcaaccggtatgctgcctatttgccttggggaagcgacgaagttttctcaatatttgctggattctgataaacgctaccgtgtcattgctcggcttgggcaacgaaccgacacctctgatgccgacggtaacgtgatcgaagaacgtgctattggtttttctgctacggatctggaactcgcactggagagctttcgcggcaccacgcagcaagtgccatccatgtactcggcgctgaaatatcaggggcgtaagctgtatgagtatgcacgtcaggggctgacggttccgcgtgaagcgcgtgaaatcaccgtgtatgaacttcagttcattcgctgggaaggtgatgagctggaactggaaattcactgctcgaaagggacgtacatccgtaccattattgacgatctgggtgaacagttgggctgtggcgcgcatgtgatttacctgcgccgcttgcaggttgctatttatcctaccgaaagaatggtgacgctagagcagctagcggcattggccgagcaggctcagacgcaagagcattcactttcgctgagccttgattcgttgctcatgccgatggaaagcccagttattgatttccctgaagtgaatttgccgccagttgttgcaggctatttgaagctgggacaagccgttcaggcagcgaatgcgccgttgaacggcatggtgaggatcaccgagggtgatgcgcacaaatttatcggaatgggcgaaattgacggcgatggccgcgttgcaccacggcgtttggttgttgagtttccggtgtaa

SEQ ID NO: 46211 - protein, 314 aa, Erwinia carotovora
MSRPRRRGRDVHGVLLLDKPQGVSSNDVLQKVKRIFNANRAGHTGALDPLATGMLPICLGEATKFSQYLLDSDKRYRVIARLGQRTDTSDADGNVIEERAIGFSATDLELALESFRGTTQQVPSMYSALKYQGRKLYEYARQGLTVPREAREITVYELQFIRWEGDELELEIHCSKGTYIRTIIDDLGEQLGCGAHVIYLRRLQVAIYPTERMVTLEQLAALAEQAQTQEHSLSLSLDSLLMPMESPVIDFPEVNLPPVVAGYLKLGQAVQAANAPLNGMVRITEGDAHKFIGMGEIDGDGRVAPRRLVVEFPV

SEQ ID NO: 46212 - DNA, 864 bp, Fusobacterium nucleatum
  CDS (1)..(864)
ttggaaggaataatagttataaacaaaccaaaagggataacttcctttgatgttataagaaaacttaaaaaatttttaaaaactaaaaaaataggacatactggaactcttgacccattagcaataggagttatgcttgtgtgtgttgggaaagctactaaactcgcttcggacttagaagctaaggataaagtatatatagcagactttgatataggctatgcaacagatacctatgatattgaaggaaaaaagatagctgaaaatattattgaagtttcaaaagaaaatttagaacaatctttaaaaaaatttataggaaatataaaacaagttcctccaatgtattctgctatcaaaattgatggaaataaactttatcatttagcaagaaaaggaattgaagttgaaagacctgaaagagatattactattgaatatattaatcttttagattttaaagataataaagctaaaatagaaacaaaagtttcaaaaggttgctatataagaagtttaatctatgatataggacaagatttaggaacttatgcaaccatgacagcacttcaaagaaaacaggttggagaatattccttagaaaattcatacagcttagaacagattgaagaaatgactttaaataataattttaaattcttaaaaactattgaagaaattttttcttatgacaaatataatttacaaactgaaaaagaatttattttatataaaaatggtaatactgtaaaaataaaagaaaatttagaaaataaaaaatatagaatttattttcaagatgagtttataggattagcaaatatagaaaataataatttgttaaaaggatataaatattattaa

SEQ ID NO: 46213 - protein, 287 aa, Fusobacterium nucleatum
MEGIIVINKPKGITSFDVIRKLKKFLKTKKIGHTGTLDPLAIGVMLVCVGKATKLASDLEAKDKVYIADFDIGYATDTYDIEGKKIAENIIEVSKENLEQSLKKFIGNIKQVPPMYSAIKIDGNKLYHLARKGIEVERPERDITIEYINLLDFKDNKAKIETKVSKGCYIRSLIYDIGQDLGTYATMTALQRKQVGEYSLENSYSLEQIEEMTLNNNFKFLKTIEEIFSYDKYNLQTEKEFILYKNGNTVKIKENLENKKYRIYFQDEFIGLANIENNNLLKGYKYY

SEQ ID NO: 46214 - DNA, 915 bp, Geobacter sulfurreducens
  CDS (1)..(915)
atggacggctttatcgtcatcgacaaaccgatcggtctcacctcccatgatgtggttgcgagagtcaggcaaacccttcggcagaagaaggccggtcacaccggcacgcttgatccattcgccaccggcgttctaccggttgctgtcggcgaggggacaaaagcgattccctatctggatgaatcaaccaaagtataccgtgccacgctgatccttggcgctgccactgatacccaggaccacaccggtcaggttgttcatgccggcgactggcggcacctggagcctcagtcagttcgtgatgtcgtttcctcgttcacgggcaaactcagccagctgccccccatgttttcggccctcaagcgtgatggcgtccccctttacaaactcgcccgcactggcagggaagtcgagcgcgaacgccgtgagatagaggttttctcattggttgtcgactcgattgatctgccgttggtgacgtttaccctgtcctgctcgcgcgggacctatgtccggacactggcccacgacatgggtgagcgtcttggctgcggtgctcacctgacggagttgcgccggttgagcagcggccccttcaatctggaccgggctatatcccttgaacggcttaaagagctggcagaagccggcaaccttgccgatgtccttgtgtcgccatccgacgccctgggtcatcttcatgcattgccgctcaccgcccagggagctgaacgtgtcaggcgcggcatgcccccttgccgtgaggatgttgagcatggggcgggtacgggaataccggcggggacacgtctgcgtttgctgagagacggaattgttgttgctgtggcggattctcttgccggtctttggtccagtgataccaaaaacctaagacttttaagggtgtttaactag

SEQ ID NO: 46215 - protein, 304 aa, Geobacter sulfurreducens
MDGFIVIDKPIGLTSHDVVARVRQTLRQKKAGHTGTLDPFATGVLPVAVGEGTKAIPYLDESTKVYRATLILGAATDTQDHTGQVVHAGDWRHLEPQSVRDVVSSFTGKLSQLPPMFSALKRDGVPLYKLARTGREVERERREIEVFSLVVDSIDLPLVTFTLSCSRGTYVRTLAHDMGERLGCGAHLTELRRLSSGPFNLDRAISLERLKELAEAGNLADVLVSPSDALGHLHALPLTAQGAERVRRGMPPCREDVEHGAGTGIPAGTRLRLLRDGIVVAVADSLAGLWSSDTKNLRLLRVFN

SEQ ID NO: 46216 - DNA, 906 bp, Halobacterium sp
  CDS (1)..(906)
atggggattcgaccgccacccggcgagcgcagcccggcggcagtgctgtcgtttggcgtcgtgaacctggacaagccaccggggccgtcggcccaccaggtgtcggcgtggattcgagacctcgtgggcgtggagaaggccgcacacgccggcacgctcgatccgaaggtcacgggctgtctgcccgtgttgaccgggaccgcgacccggatcgcacccgcgctcctggaggggttcaaggagtacgtcgccgtcctggagctgcacgacgacccgccgcgcatcctcccggacgtgatcgaggcgttcaccggcgagatctaccagaagccgccgaagaaatccgcggtcgcgcgccgcctgcgcacccgcacggtctacgacctcgacgtgctcgacgtggacggccgccaggtcctgctccggatccggtgtgagtcgggcacgtacatccggaagctctgccacgacatcggccgcgcgctcggcacgaacgcccacatggggcatctgcgccgcagcgccaccacgccgttcgacgacaccgacctcgtcacgctgcacgacctcgcggacgcggtggcgtggctgcgcgacaccgacgacaccgagccgccggacgcacccgcggacgcgctgcgcgcagcggtccagcccgccgagcgcgcgctcacgcacctgccgcggctcaccatcgccgactcggcagcccacgaggtcgccacgggtgcgccggtgtacgcgccgggcgtcatcgacaccacggccctgccgacaccgccggcggatggggcgctggtggcgtgttacaccgcaggcgggacggcggtctgcctcggtcggctggtcggcgatccggacgcggacgccggcgtggtcgttgccctcgaacgcgtgctcgtgtag

SEQ ID NO: 46217 - protein, 301 aa, Halobacterium sp
MGIRPPPGERSPAAVLSFGVVNLDKPPGPSAHQVSAWIRDLVGVEKAAHAGTLDPKVTGCLPVLTGTATRIAPALLEGFKEYVAVLELHDDPPRILPDVIEAFTGEIYQKPPKKSAVARRLRTRTVYDLDVLDVDGRQVLLRIRCESGTYIRKLCHDIGRALGTNAHMGHLRRSATTPFDDTDLVTLHDLADAVAWLRDTDDTEPPDAPADALRAAVQPAERALTHLPRLTIADSAAHEVATGAPVYAPGVIDTTALPTPPADGALVACYTAGGTAVCLGRLVGDPDADAGVVVALERVLV

SEQ ID NO: 46218 - DNA, 894 bp, Lactobacillus johnsonii
  CDS (1)..(894)
atgctaaatggaattgtagtagtaaataagccacgcggagtaaccagtagtgactgtgtttataaattacgaaaaattttacaaattagaaaaattggacatgcaggtacactggatccagaagtaaatggggtattaccgattgcaattggccaagccacaaagctaattgaattgatgcatgaaaaaccaaagtcatatattggaagtggaatgtttggtaaagcaaccgatagctatgatttagatggaacaaccactgcagaagaaaagatagttactccatttacaagtgatgaaattattagtggaatgaaaaaacttactggaaagattgatcaagttcctccaatatattctgcggtccgtgttaatggtaaaagactttatgaatatgctcgagaaaatatcccagtagaacgtccgaaaagaaaagtaaacatttatagttatgaattaactcaagatccagaatatgatccactagaaaaaactgaaagttttaattttgctattcgctgttctaaaggaacctatgtacgatccctagtaaatgatttgggagaggaattgggagttccagctgtaatgaccagtcttactagaactagcagttcaggttttgatttaagtcaagcggtagatctagaaactattgaaaaagaaatagattatcctgaaaaatggcttcaaccaattgatagctttttcgtagatttaccccaacttcaaatatcaccagatcaatttaaaagagtttcaaatggagcaagcattaaattgaataccacttatgccaaggtagctttggtttataatggacatataaaagctatttatcaacgacaaggtaaaatttatcgtcctgaaatgatgcttttaaaaaatgaatag

SEQ ID NO: 46219 - protein, 297 aa, Lactobacillus johnsonii
MLNGIVVVNKPRGVTSSDCVYKLRKILQIRKIGHAGTLDPEVNGVLPIAIGQATKLIELMHEKPKSYIGSGMFGKATDSYDLDGTTTAEEKIVTPFTSDEIISGMKKLTGKIDQVPPIYSAVRVNGKRLYEYARENIPVERPKRKVNIYSYELTQDPEYDPLEKTESFNFAIRCSKGTYVRSLVNDLGEELGVPAVMTSLTRTSSSGFDLSQAVDLETIEKEIDYPEKWLQPIDSFFVDLPQLQISPDQFKRVSNGASIKLNTTYAKVALVYNGHIKAIYQRQGKIYRPEMMLLKNE

SEQ ID NO: 46220 - DNA, 990 bp, Lactococcus lactis
  CDS (1)..(990)
atgaatgaaaatttaaatggcattttaaatgtctataaagaagcgggctggacatcttttgatgttgtagccaaacttcgtggtattttaaaaacaaaaaaaattggacatggtggaactttggacccttctgtgacaggcgttttgccagtggccgttggaaaatcgacgcggttattagaatacatggaagcggcaggtaaaatttacgaaggtgaagttactattggtttttcaacggaaaccgaagatgctgacggggaaattgttagtaaaacgccagtagaacgggagctgacagagtctgaaattgactcagtaatgaaaaattttattggaaaaataaagcaaattcctccaatgtattcagccgtaaaaattaacggaaaaaaattgtatgaatatgccagagctggtcagacagttgaccgtccgacaagagagattacaatcaaatcatttgtcagaacaagtcccatgatgactgatgaagcggcaggtttggtaagcttttctttcaaagttgagtgcagtaaaggaacctatgtccgaacattagcagtagatttagcagagcaacttggttatgcaggacatatgtcaaaattgcaaagaacagcaagtaatggactgatgattaaagatgctgtcaaactctcagagattgaagtagcaatggaggcaggagagctttctagcttaatgtacccagcagaatatgctgtcagtgatttgccaagagtaaatttgactgctgatcagtttgaaatggcacgagttggaaaaaaatttgctgaggatgattgggttacagatgaaactactgacagccctgtcattaagtctaataaaagtaaatttttactgacagacttgtcagaactgacaagagataaatttgcagccttttatgatgataaattaattgctgtttacatgaaacatccagaaaaagcaggaatttggaaaccaaataaagtattggtttaa

SEQ ID NO: 46221 - protein, 329 aa, Lactococcus lactis
MNENLNGILNVYKEAGWTSFDVVAKLRGILKTKKIGHGGTLDPSVTGVLPVAVGKSTRLLEYMEAAGKIYEGEVTIGFSTETEDADGEIVSKTPVERELTESEIDSVMKNFIGKIKQIPPMYSAVKINGKKLYEYARAGQTVDRPTREITIKSFVRTSPMMTDEAAGLVSFSFKVECSKGTYVRTLAVDLAEQLGYAGHMSKLQRTASNGLMIKDAVKLSEIEVAMEAGELSSLMYPAEYAVSDLPRVNLTADQFEMARVGKKFAEDDWVTDETTDSPVIKSNKSKFLLTDLSELTRDKFAAFYDDKLIAVYMKHPEKAGIWKPNKVLV

SEQ ID NO: 46222 - DNA, 924 bp, Lactobacillus plantarum
  CDS (1)..(924)
atgttgaacgggattctaccattatataaacctcgtgggatgacgagctttgactgtgtcgctaaaatccgacgactctatcagacccgcaaagtaggtcattcagggacactggacccaaatgtggatggcgttttaccgatttgtattgggaatgcgactaaagttgtgcaatttttagtggcttctggcaaagaataccaagggagcattaccctcggatttgcaacgactactgaagatttagatggtgaggagattgcgcgccaagcggtcacagagccgttcacaagtgaccaagttgatgctgcgctggcacagatgacgggggccattacgcaaattccaccgatgttttcagcagtaaaagtaaatgggcggcgtttatatgactatgcgcgcagtggtgaaactgtcgagcgcccagaacggcatatcacaattagcagcttcaagcaacggcaggcatctacctatgactcggcaacccagactcagacgatctattttacggtcgcttgtagtaaagggacttatgttcgcacgctagcggtggatgtcggcaaagtgctcggggtacccgctgtgatgagtgatttgacccgattaaagagtggcggctttactttagatgaaaccgtgacctttgaggaaatcgcggcccacgtcgatgctggaacggccggagcattattggcgccaattgataaagctttaagtcagtacccgcgagtcacgttaacggatgagcagtggcaacgggtcaaaaatggggcctttattacggcggcagaagggcaacaaactgatccagatgcgaacacgatggttgcgttagtttaccaaaacagcctaaaatgtctatatagttatcgaccggacgaacagcggtacaagccgttcaaaatgtttgcggtcaattaa

SEQ ID NO: 46223 - protein, 307 aa, Lactobacillus plantarum
MLNGILPLYKPRGMTSFDCVAKIRRLYQTRKVGHSGTLDPNVDGVLPICIGNATKVVQFLVASGKEYQGSITLGFATTTEDLDGEEIARQAVTEPFTSDQVDAALAQMTGAITQIPPMFSAVKVNGRRLYDYARSGETVERPERHITISSFKQRQASTYDSATQTQTIYFTVACSKGTYVRTLAVDVGKVLGVPAVMSDLTRLKSGGFTLDETVTFEEIAAHVDAGTAGALLAPIDKALSQYPRVTLTDEQWQRVKNGAFITAAEGQQTDPDANTMVALVYQNSLKCLYSYRPDEQRYKPFKMFAVN

SEQ ID NO: 46224 - DNA, 915 bp, Listeria monocytogenes
  CDS (1)..(915)
atgaacggcattatcccactgtggaaagaacgcgggatgacaagtcatgattgcgtttataaattaagaaaaattttacatacgaaaaaagttggtcatacaggtacacttgatcctgaagtagaaggcgtgctaccaatttgtattggccgtgcgacaaaattggctgaatatgtcaccgatgaaggcaaagtctatgtagcagaaataacattaggcaaatcgactacgacagaagatgcaactggtgaaacggttaatactaaagaactagccgaaatttcggcggcagaacttcaagccgcgcttactaaactaacaggtaagattacccagattccaccaatgttttccgctgtaaaagtcaatggtaagaaattgtatgaatatgcaagagctggtatagaggtagaacgaccatccagacaagtggatatttattcgttaatccgtttagatggcgacacagcgctaaatcaatccaacccaaccttccaattagaaattgcgtgcggaaaaggaacctatatccgtactcttgcagttatgattggcgaattattaggttatccagctcatatgtctaaactagaacgtactcgtagcggctttttcaaaaaagaagattgtttgacgctcacagaaattgacgaaatgatgcaagcaagtgatagcagctttttatatccacttgaaaaaggaattgaatctatggccaaactagtaattgaggaagaagtatacgcaaaagttttgaatggcggccttttaccaacatcgttatttgcagaggtagaaaatgaacctcgtgctgcgcttatttttaaagataaattaacagctatttataaaccacatccagagaaaaaagacctttggaaaccagaaaaggtcatcgagttaaatcaagcatag

SEQ ID NO: 46225 - protein, 304 aa, Listeria monocytogenes
MNGIIPLWKERGMTSHDCVYKLRKILHTKKVGHTGTLDPEVEGVLPICIGRATKLAEYVTDEGKVYVAEITLGKSTTTEDATGETVNTKELAEISAAELQAALTKLTGKITQIPPMFSAVKVNGKKLYEYARAGIEVERPSRQVDIYSLIRLDGDTALNQSNPTFQLEIACGKGTYIRTLAVMIGELLGYPAHMSKLERTRSGFFKKEDCLTLTEIDEMMQASDSSFLYPLEKGIESMAKLVIEEEVYAKVLNGGLLPTSLFAEVENEPRAALIFKDKLTAIYKPHPEKKDLWKPEKVIELNQA

SEQ ID NO: 46226 - DNA, 861 bp, Mesoplasma florum
  CDS (1)..(861)
atgaataaatcaggaataataattttaaataaaccaaaaggtttaacaacaaatcatttaattcaaaaacttaaaagaaaattaaatgtaaaaaaaatagggcatgcaggtactttggatcctttagctactggtgtggttatatgtttaataaataatggaacaaaattaagtgattattttttaaatgaaaataaagcatatgaagtcactatgaaattatttcaagctacagatacatatgatagtgatggaagcataatagaagagcaggaacctttcaaaatagaacaagaacaagttgaaaaagttatagcaaagtttaatggacttgcttatgaacaagaaccgccaatgtattcagcaattaaaattgatggaaaaaaactttatgaatatgctcgtgaaaatcaagttgtaaaagtgaataaaagactaataaaaattaattcactatctttagataaatatgaaaataatgaaatatcaatgactgtttattgttcaaaaggaacttatataagaagccttattgtagatatagcaaaagaactaaatacaattgctcatgtaactagtctaaatagaatagaatcaggaaattttataattaaaaattctgttaacattgaaaattgtgaagaatcaaatttgattaaaatgtttgatgcaattaaaatggctgactatgaaatagttgaattagatgacacattaaatgttgagcatggtaaaaaaatagaagtgatagctgagaaaaatattgtttttatttcaaataaatcaaaagaacttatagcttgttatgagagagaaaatggaaatgtctttaaatgcaagcgtggaggtttaaatatttaa

SEQ ID NO: 46227 - protein, 286 aa, Mesoplasma florum
MNKSGIIILNKPKGLTTNHLIQKLKRKLNVKKIGHAGTLDPLATGVVICLINNGTKLSDYFLNENKAYEVTMKLFQATDTYDSDGSIIEEQEPFKIEQEQVEKVIAKFNGLAYEQEPPMYSAIKIDGKKLYEYARENQVVKVNKRLIKINSLSLDKYENNEISMTVYCSKGTYIRSLIVDIAKELNTIAHVTSLNRIESGNFIIKNSVNIENCEESNLIKMFDAIKMADYEIVELDDTLNVEHGKKIEVIAEKNIVFISNKSKELIACYERENGNVFKCKRGGLNI

SEQ ID NO: 46228 - DNA, 1017 bp, Methanosarcina acetivorans
  CDS (1)..(1017)
atgtcatccgccggcaaactgccatctgagattgaaagaacccttgtccggaagtccggcgcctggacaaatccggtctacggctgtgctccggaaaagcgccctatcctcgaatatatcgaaaaaggagtggtgaacatcgacaagcccagtggacccacaagccacgaagttgcagcctgggtaaaagccatccttggcgttaatactgcagggcatgcaggctctcttgacccgaaggttacagggcttttacctaccctgctcgggaaagccacaaaagccgtgcctgccctgagactttcgggaaaagagtatgtctgccacctgaagcttcacagggctatgcctccgaagcttgtccgcaaggtctgcgaggaatttacagggcccatttaccagatgcccccgatcaagtccgctgttaaacgggtcataagggtaaggacaatctattatatcgaggtgctcgaaatcgagggcatgtccgtactcttccgcgttggctgtgaggcaggaacctatatccggaaactctgccacgatatcgggcttgctctgggctgtggcggacatatgcaggccctccgcaggactaaagcagggccgtttacggaaaaaacccttgtcactctccatgagctgaaagatgcctatgtgttctggaaggaggacggggatgagtccgaactgagaagggtgattcggccaatggaatctgccgtatcccacctccccaaaattatcctgcgggacagtgcagtggatgcggtctgttcaggcgcttccctggcagtcccgggcattacgagcctggactccagtctggctgaaggggaacttgcagcgctctttaccttaaaaggggaactcgttgcgcttgcaaaagctgaaatgaacactgaagagattctcaaagcatctgccgggattgcagcttctcctatccgcgtgcttatggaagcaggaacttacccgaagggctggactaaaaaagaggagagtgtccggctctga

SEQ ID NO: 46229 - protein, 338 aa, Methanosarcina acetivorans
MSSAGKLPSEIERTLVRKSGAWTNPVYGCAPEKRPILEYIEKGVVNIDKPSGPTSHEVAAWVKAILGVNTAGHAGSLDPKVTGLLPTLLGKATKAVPALRLSGKEYVCHLKLHRAMPPKLVRKVCEEFTGPIYQMPPIKSAVKRVIRVRTIYYIEVLEIEGMSVLFRVGCEAGTYIRKLCHDIGLALGCGGHMQALRRTKAGPFTEKTLVTLHELKDAYVFWKEDGDESELRRVIRPMESAVSHLPKIILRDSAVDAVCSGASLAVPGITSLDSSLAEGELAALFTLKGELVALAKAEMNTEEILKASAGIAASPIRVLMEAGTYPKGWTKKEESVRL

SEQ ID NO: 46230 - DNA, 1017 bp, Methanopyrus kandleri
  CDS (1)..(1017)
atgagcggcgacaaggaccggcggctgccgttcgaccgggatcgggagatgatcacgaaggccgaggtggagacggacccacggtacggttgtcctcccgaggagcgccctatcgaggaatacatcatgaagggtgtcatcaacctggacaagccggccggacccacatcgcacgaggttgtggcttgggtgaaggagatcttcgggctgtccaaggcgggtcacggtggtaccctggaccctaaggtcacgggagtccttccgatcgccctcgagaaagccacgaagataatccagacgctgctaccggcgggtaaggagtacgtgacgattatgcatctccacggcgatgtggacgaggaggagctcgagcgcgttgtgaaggagttcgaggggacgatacttcagcggccaccgttacgctcggcagtcaagaggagggtacgtcctaagaagatctactacatcgatattctcgagatcgacggtcgcgacgtgctgatgagggtcgggtgtcaggctggtacctacattcggaagctgtgtcacgacatcggtgaggccttgggtgtcggtgcgcacatggcggagctccggaggacgaggacagggccgttctcggaggagaacgcggtcacgctccacgacgtcaaggacgcgtacgagttctggaaggaggagggatgggaagagcccttacgacacgttgtacgaccgatggaggaaggtctcgagcacctaccgagaatagagatcagggatacggccgtcgacgccatctgccacggagccaacctggctgcgccgggaatcgttagggtggagaaggggatccagcccggcgatctagtcgccatcttcacgctgaaaggggaggcggtagcgctgggagtggccaaggccacttggaaggagatgctacacgcggatcggggtattatggtggacaccaagagggtcctgatggagccgggcacgtacccgaaggcttgggggttaaagacccctggagagtag

SEQ ID NO: 46231 - protein, 338 aa, Methanopyrus kandleri
MSGDKDRRLPFDRDREMITKAEVETDPRYGCPPEERPIEEYIMKGVINLDKPAGPTSHEVVAWVKEIFGLSKAGHGGTLDPKVTGVLPIALEKATKIIQTLLPAGKEYVTIMHLHGDVDEEELERVVKEFEGTILQRPPLRSAVKRRVRPKKIYYIDILEIDGRDVLMRVGCQAGTYIRKLCHDIGEALGVGAHMAELRRTRTGPFSEENAVTLHDVKDAYEFWKEEGWEEPLRHVVRPMEEGLEHLPRIEIRDTAVDAICHGANLAAPGIVRVEKGIQPGDLVAIFTLKGEAVALGVAKATWKEMLHADRGIMVDTKRVLMEPGTYPKAWGLKTPGE

SEQ ID NO: 46232 - DNA, 1017 bp, Methanosarcina mazei
  CDS (1)..(1017)
atgtcatccgccggcaaactgccatcagaagttgaaagaacccttgtccggaagtccggcgcctggacaaatccagcctacggctgtcctccggaaaagcgccccatccatgaatatattgagaagggagttgtgaatattgacaagcccagaggacctacaagccatgaagttgcagcctgggtaaaagccatccttggcgtacacacggcaggacacgcaggctctcttgaccctaaggttacaggtcttctgccaacactgctcggaaaagctacccttgccgtgccagccctgcgcctctcgggaaaagagtacatctgccatttgaagcttcacagggctatgccccagaagctggtccgccaggtatgtgaggagtttactggccctatttaccagatgccccctatcaagtctgctgttaagcgcgttataagggtaaggacaatctaccatctggaagtgcttgagatcgagggtacgtctgtgctcttccgtgttgggtgtgaagcagggacttatatccggaaactctgccacgatatagggctcgctctgggctgcggcggacatatgcaggggctccgcaggaccaaagcaggcccgtttacggaaaagacgcttattaccctccacgaactgaaggatgcttatgttttctggaaggaagacggggacgagtctgaattgagaagggttataaggccgatggaatccgccgtatcccacctccccaaaattatcctgcgggacagtgcagtggatgctatctgttcaggagcttccctggcagtccctggtattacaggtctcgactctaatctggctgaaggagaactcacagggctatttactttaaaaggggaacttgttgctcttgcaaaggctaaaatgaccactgaggagatcctcaaagcctctgcgggtattgcagcttctcccatccgtgtacttatggaagcaggaacttatccaagaggctggactaaaaaagaagaaaaggtacagctctga

SEQ ID NO: 46233 - protein, 338 aa, Methanosarcina mazei
MSSAGKLPSEVERTLVRKSGAWTNPAYGCPPEKRPIHEYIEKGVVNIDKPRGPTSHEVAAWVKAILGVHTAGHAGSLDPKVTGLLPTLLGKATLAVPALRLSGKEYICHLKLHRAMPQKLVRQVCEEFTGPIYQMPPIKSAVKRVIRVRTIYHLEVLEIEGTSVLFRVGCEAGTYIRKLCHDIGLALGCGGHMQGLRRTKAGPFTEKTLITLHELKDAYVFWKEDGDESELRRVIRPMESAVSHLPKIILRDSAVDAICSGASLAVPGITGLDSNLAEGELTGLFTLKGELVALAKAKMTTEEILKASAGIAASPIRVLMEAGTYPRGWTKKEEKVQL

SEQ ID NO: 46234 - DNA, 897 bp, Mycobacterium bovis
  CDS (1)..(897)
atgagcgcaaccggccccggaatcgtggttatcgacaagcccgcgggaatgaccagccatgacgtggtggggcggtgccgccgcatcttcgccacccggcgggtcggccacgcgggcaccctggacccgatggccaccggggtgttggtgatcggcatcgaacgcgccaccaagatcctcggtctgctgacggcggcccccaagtcgtatgccgccaccatccgcttgggtcagaccacttccaccgaggacgccgaaggtcaagtgctgcagtcggttccggctaagcacctgaccatcgaggcgatcgacgccgcgatggagcggctgcgcggtgagatccggcaggtgccgtcgtcggtcagcgcgatcaaggtcggtggccgacgcgcctatcggttggcccgccaggggcgctccgtgcaattggaagcccggccgatccgcatcgaccggttcgagctgctggccgcacgccggcgcgaccagctcatcgatatcgatgtggagatcgactgctcctcgggaacctacatccgcgcgttggcacgcgacctcggcgacgcgcttggggtgggaggccatgtgacggcgttgcggcgcacccgcgtcggccgcttcgagctggaccaggcgagatcgctcgacgatctcgcggagcgccccgcgctgagcctgagcctcgatgaggcctgcctgctgatgtttgcgcgccgcgacctgaccgccgcggaggccagcgcggccgccaacggccggtccctgccggcggtcggtatcgacggcgtgtacgcggcctgtgacgccgacggccgggttatcgcgctgctgcgtgacgagggttcgcggaccaggtcggtggcggtgctccgcccggcgacgatgcaccccgggtag

SEQ ID NO: 46235 - protein, 298 aa, Mycobacterium bovis
MSATGPGIVVIDKPAGMTSHDVVGRCRRIFATRRVGHAGTLDPMATGVLVIGIERATKILGLLTAAPKSYAATIRLGQTTSTEDAEGQVLQSVPAKHLTIEAIDAAMERLRGEIRQVPSSVSAIKVGGRRAYRLARQGRSVQLEARPIRIDRFELLAARRRDQLIDIDVEIDCSSGTYIRALARDLGDALGVGGHVTALRRTRVGRFELDQARSLDDLAERPALSLSLDEACLLMFARRDLTAAEASAAANGRSLPAVGIDGVYAACDADGRVIALLRDEGSRTRSVAVLRPATMHPG

SEQ ID NO: 46236 - DNA, 963 bp, Mycobacterium leprae
  CDS (1)..(963)
atgagcgaaagctccacaggtgcaggactcggtccgggaatagtggtcattgacaagccgtccgggatgaccagtcacgatgtggtggcgcgctgtcgccgaatattttgcactcgcagggtggggcacgcgggaacgctggatccgatggccaccggtgtgctggtgctcggggtcgatcgagccaccaagatcttgggtctgctggccggggcctcgaaagagtacgtcgcgaccatccgcctaggtcagaccacatctactgaagacgccgaaggtgaactgctgcagtgtgtctcggctcggcacgtgacagacgaggcgatcgccaccgcgatcggtaggctgcgcggtgatatcaagcaggtgccgtcggcggtcagtgctatcaaggtcgacggccgtcgtgcttatcgactggtccgcgagggtcatgttgttgagctgcaagcccggccggtacgcattgaccggtttgaggtgctggctgttcgacccgggcccgaagtcggattagccgatgtcatcgatcttgatgtggaagtcgaatgctcatcgggaacctatattcgtgcgctggctcgcgacctcggcgatgcgttcggggtaggtgggcatctgacgtcgttgcggcgcacccgggtcggccgtttcgagctggaccaggcgtggtcactcgaggatctggcggagctaccgcggttgagtcggacgctagacgagacctgtttgctgatgtttcctcgccgtgaccttacggtaagcgaggtcgaggcaaccagcaacgggcgaccaatttcgtcggccggtatcgacggcatctatgccgccagcgacgccgacggccgagtcattgcattgctgcgcgacgagggcccgcggaccaagtcggtggtggtgctgcacccggtctttgtgcgagtcagcatcggacggggcattgttggggtgattgaggcctaa

SEQ ID NO: 46237 - protein, 320 aa, Mycobacterium leprae
MSESSTGAGLGPGIVVIDKPSGMTSHDVVARCRRIFCTRRVGHAGTLDPMATGVLVLGVDRATKILGLLAGASKEYVATIRLGQTTSTEDAEGELLQCVSARHVTDEAIATAIGRLRGDIKQVPSAVSAIKVDGRRAYRLVREGHVVELQARPVRIDRFEVLAVRPGPEVGLADVIDLDVEVECSSGTYIRALARDLGDAFGVGGHLTSLRRTRVGRFELDQAWSLEDLAELPRLSRTLDETCLLMFPRRDLTVSEVEATSNGRPISSAGIDGIYAASDADGRVIALLRDEGPRTKSVVVLHPVFVRVSIGRGIVGVIEA

SEQ ID NO: 46238 - DNA, 924 bp, Neisseria meningitidis
  CDS (1)..(924)
atgaatacaggcaaaccccaaaaacgtgccgtcaacggtgttttgctcttggacaaacccgaaggcctttccagcaacaccgcgctgcaaaaagcgcggcgtttgtttcatgccgaaaaagccggacataccggcgtgctcgaccctttggcaaccggacttttgcccgtctgcttcggtgaagcgaccaagttcgcccaatacctgctggatgccgacaaagcctacaccgccacgctgaaactcggcgaagccagcagcacgggtgatgccgaaggcgaaatcattgccaccgcccgcgccgatatttccttagccgaatttcagacggcctgccaagcactgacaggcaacatccgccaagtgccgccaatgttttccgcgctcaagcacgaaggcaaaccgctgtacgaatacgcccgcaaaggcatcgtcatcgaacgcaaagcgcgctacattaccgtttacgccatcgatattgccgaatttgacgcgcccaaagccgtcatcgacgtacgttgcagcaaaggcacctacatccgcaccctcagcgaagacatcgccaaacacatcggcacgttcgcccacctgaccgccctgcgccgcactgaaaccgccggctttaccatcgcccaaagccacacgcttgaggccttggcaaatttgaacgaaacagaacgcgacagcttgctgctaccctgcgacgtattggtttcacactttccccaaaccgttttaaacgattatgccgtccatatgctccactgcggacaacgtccgcgtttcgaagaagacctgccttccgacacgccggtacgcgtttacacggaaaacggccgctttgtcggtctggcggaatatcaaaaagaaatatgccgtctgaaagccttgcgcctgatgaacacggcggcatccgccgcctga

SEQ ID NO: 46239 - protein, 307 aa, Neisseria meningitidis
MNTGKPQKRAVNGVLLLDKPEGLSSNTALQKARRLFHAEKAGHTGVLDPLATGLLPVCFGEATKFAQYLLDADKAYTATLKLGEASSTGDAEGEIIATARADISLAEFQTACQALTGNIRQVPPMFSALKHEGKPLYEYARKGIVIERKARYITVYAIDIAEFDAPKAVIDVRCSKGTYIRTLSEDIAKHIGTFAHLTALRRTETAGFTIAQSHTLEALANLNETERDSLLLPCDVLVSHFPQTVLNDYAVHMLHCGQRPRFEEDLPSDTPVRVYTENGRFVGLAEYQKEICRLKALRLMNTAASAA

SEQ ID NO: 46240 - DNA, 927 bp, Nitrosomonas europaea
  CDS (1)..(927)
ttgcttaacaagccttccggtatttcatccaatcgagcacttcagatcagtaagcgtttattgtcggccgccaaggcagggcataccggaacattggatccaatggcacaggggctgctgccgatctgcctcggtgaggctaccaaattttcctctactttgctaggtgtggataaaacctatattgcgtccctcagacttggttatatcagcaacacgggagatgccgaaggtgaaatcagacaggtggtcggttctgatgtaaacccacctgatttcgggcaagtgaccgggattctgcaaacatttctcggtcgatccagtcagattccacctatgttcagcgcattgaaacaacatggcaaaccgctttaccggtatgcacgtgagggaattacggttgagcgcaaagcacgggaaatcgtaattcatgctgcgtcactcgatactttgtcaggttttgagatgacgattacggttcgatgcagttcaggtacatatgtccgaacactggctgaggacatcggaaaggcacttggttatggcggtgcctatctcacagcgctttcccgtatcagtgtcggtcattttgaattatcccaggcctgtgatctggatcagctcgaatccgagactcctgtcaatcgtcagaaacttttgtgtccgatcgacagtcttctaaacgatattccttccatagtacttgatgatgatgaggcattacgtttgcgacagggacagaaaatcaggaaaaacatgtctcgatatggattaccggtcaacacacaattgaagttgtacgatgatcgcaatgtttttcttggcctcggtgaacggatcgatcctgaagtcatcgtgcctagaagaatgatttcattacatgaagttgttacgggtgcgatagccggttcggtggatttacagtaa

SEQ ID NO: 46241 - protein, 308 aa, Nitrosomonas europaea
MLNKPSGISSNRALQISKRLLSAAKAGHTGTLDPMAQGLLPICLGEATKFSSTLLGVDKTYIASLRLGYISNTGDAEGEIRQVVGSDVNPPDFGQVTGILQTFLGRSSQIPPMFSALKQHGKPLYRYAREGITVERKAREIVIHAASLDTLSGFEMTITVRCSSGTYVRTLAEDIGKALGYGGAYLTALSRISVGHFELSQACDLDQLESETPVNRQKLLCPIDSLLNDIPSIVLDDDEALRLRQGQKIRKNMSRYGLPVNTQLKLYDDRNVFLGLGERIDPEVIVPRRMISLHEVVTGAIAGSVDLQ

SEQ ID NO: 46242 - DNA, 912 bp, Oceanobacillus iheyensis
  CDS (1)..(912)
atgcatggtattcttccgttatggaaaccaaaaggattaacttcacatgactgtgtgatgcgttgtcgtcgatattttaagacgaaaaaggttgggcatactggaactttggatccagaagttgagggtgtgttacctatatgtattggacaagcaacaaaaattgttccgttcttgacagatacaaaaaaagtatatgaagctacggttcaactaggatattcaaccgagacagaggatgcaacgggaaaaatagtagaaacaaaggaagtttctgattttccaacgaacaagaatttggaagaagtacttcagacttttataggaagaacaaagcaaattccaccaatgtactctgctgtaaaggtaaacggaaaaaagttatatgaatatgctagagcaaatgaatcagtggaaagacctgtacgtgaaattgagatatttgaattaacgcttaccagtgtcgatgagaaaaatcattcctttgacattcgcatcgtttgttcaaaaggcacttatatacgtactctttgtgttgatataggaaaagcactgggatatccagcacatatgtctttacttactcgtacaaagacaggggcattttctgagaaaaatacggtaacttttgatatgatagaagaagccgtttccaatcaatcagaagaacggttacttgaaccaattataaacggtttacagcatttggaacaaatagaagtaaatgaagatatggaaaaaagaattttaaatggtcagaaactttcattacaaagaaatcaacccaagcaaacagatccgtttgtatttgtcagggaaggaaatgtactggctatctatcaatctcacccaactaatgaagatcagataaaaccagtacgtgtatttgcaattgaagataaaaaagtgtag

SEQ ID NO: 46243 - protein, 303 aa, Oceanobacillus iheyensis
MHGILPLWKPKGLTSHDCVMRCRRYFKTKKVGHTGTLDPEVEGVLPICIGQATKIVPFLTDTKKVYEATVQLGYSTETEDATGKIVETKEVSDFPTNKNLEEVLQTFIGRTKQIPPMYSAVKVNGKKLYEYARANESVERPVREIEIFELTLTSVDEKNHSFDIRIVCSKGTYIRTLCVDIGKALGYPAHMSLLTRTKTGAFSEKNTVTFDMIEEAVSNQSEERLLEPIINGLQHLEQIEVNEDMEKRILNGQKLSLQRNQPKQTDPFVFVREGNVLAIYQSHPTNEDQIKPVRVFAIEDKKV

SEQ ID NO: 46244 - DNA, 924 bp, Pasteurella multocida
  CDS (1)..(924)
atggcaaagccgcgcaaacgtggacgtgatattgacggcgtttttttgctagataagcctcaagggatgagctccaatgatattatgcaaaaggtcaaacgtgtgtttcaagctaacaaagcaggacacacaggtgcattagatcctttggcaacggggatgttgccaatttgcttaggtgaagccacgaagttttcacaatttttgttggatgcggataaacgttatcaagtgaccgcgaaacttggggaaagaaccgatacgtccgatgcggaagggcaagtcgttgaaacacgagatgtgcaggtagatgtgcaggacattttggctgcactaccacattttcgtggcaatttaatgcaagttcccacgatgttttctgcgttaaaacatcaaggtaagcctttatatgagtatgcacgtgctggcataacagtggaacgagaagctcgcccgatcacgatttttgacttgcaatttattgcgtacgatgccccttatttaacgctggaagtacattgttcaaaaggcacttatatacgcactttagtggatgatttaggcgaatatttgggctgtggtgcacatgtaacggtgttacgtcgaaccgctgttgccaattatcctgtggaggcgatgatgaactgggacactttacaagttttagctgcacaacaagacctcgcattattagatcagcacttattaccgacagacagtgcggtctccgcattacctgcattgcatttaaatcaagaacaaagtaaagccattagttttggtcaacgtgtcaagtttgacaatccaactcagcttactggacaagttcgtttattttctgacacgcaacaatttttaggtgttgccttagtcgatgagcataatgtcattcgtccgcaacgtttgatgacacaaaatacgtaa

SEQ ID NO: 46245 - protein, 307 aa, Pasteurella multocida
MAKPRKRGRDIDGVFLLDKPQGMSSNDIMQKVKRVFQANKAGHTGALDPLATGMLPICLGEATKFSQFLLDADKRYQVTAKLGERTDTSDAEGQVVETRDVQVDVQDILAALPHFRGNLMQVPTMFSALKHQGKPLYEYARAGITVEREARPITIFDLQFIAYDAPYLTLEVHCSKGTYIRTLVDDLGEYLGCGAHVTVLRRTAVANYPVEAMMNWDTLQVLAAQQDLALLDQHLLPTDSAVSALPALHLNQEQSKAISFGQRVKFDNPTQLTGQVRLFSDTQQFLGVALVDEHNVIRPQRLMTQNT

SEQ ID NO: 46246 - DNA, 948 bp, Photorhabdus luminescens
  CDS (1)..(948)
atggggcgtcatcgtcgcggtcgtgatatacatggtgtgttgttactggataagccgcaggatatttcttctaatgatgcgttacaaaaagtaaaacgtattttcaacgctagcaaagctggtcacactggcgcgttggatccactggcaaccggtatgctaccggtttgccttggtgaagcgacgaagttttcccagttcttacttgattctgacaagcgttatcgagtgatagctcgtcttggtcagcgaactgacacatcagattcacacgggcaaatcatcagtgaaagggcaatccagctaagtcaggttcaacttgatgcagctttggataaattccgtggtgataccatgcaaattccttccatgtattctgcactgaaatatcagggaaaaccattgtatgagtatgctcgtcagggtattgaggtagaacgcgaagcacgaccaattacagtctatgaattacagtttatccgttgggaaaatgatgaactggaattggaaatacactgttcgaaaggcacttatattcgcactattattgatgacttaggtgaattattaggctgtggtgctcacgttatttatttaagacgtttacaggtagcgaattatccaaatgatcgcatggtgacacttgagcaattatatgaattacaaaagcaggccaaagatcaagaaatacctgtgggcgaattaattgattcattactattaccaatggatagtgcaattgctcatttcccagaggttaatttgattccagtagttgcggcttattttaaacaaggtcaggcggtgcgcagtgccaaatccccagctttagttgaaagtatggtacgtgtgactgaaggtgatgaacggaaattcattggcattgctgttatcaatgatgatgggcttgttgctccccgccgtttagttgtcgaaagccgggattag

SEQ ID NO: 46247 - protein, 315 aa, Photorhabdus luminescens
MGRHRRGRDIHGVLLLDKPQDISSNDALQKVKRIFNASKAGHTGALDPLATGMLPVCLGEATKFSQFLLDSDKRYRVIARLGQRTDTSDSHGQIISERAIQLSQVQLDAALDKFRGDTMQIPSMYSALKYQGKPLYEYARQGIEVEREARPITVYELQFIRWENDELELEIHCSKGTYIRTIIDDLGELLGCGAHVIYLRRLQVANYPNDRMVTLEQLYELQKQAKDQEIPVGELIDSLLLPMDSAIAHFPEVNLIPVVAAYFKQGQAVRSAKSPALVESMVRVTEGDERKFIGIAVINDDGLVAPRRLVVESRD

SEQ ID NO: 46248 - DNA, 951 bp, Photobacterium profundum
  CDS (1)..(951)
atggcacgtcgtcgtaagggtcgtccaatcgatggagttattcttctcgataaaccaaccggaattacttcgaatgatacgctgcaaaaagtaaagcgtatcttctttgctcaaaaagcgggtcatactggagcgctagatccattagcaacaggtatgctgccgatttgttttggtgaagcgacgaagttttctcaatttttgttggattcagataagcgctaccgtgtaattgcaaaattaggtgagcgtacaaatacatctgactctgatggtgaagttgttgaaacgcgtgaagtgaaagttgaccgtggtcagcttgagcgttgtatcgctaagttccgtggcacgactgaccagatcccttcaatgttttcagcattgaagtatcaaggtcgccctctttatgaatatgcccgtgaaggtatcgaaattcctcgtgaatctcgtaaaatcaccgttcactctattgagcttcttcgttttgaaggtcatgaagttgaaatggaagtgcattgttcaaaagggacttacattcgtactattaccgatgaccttggtgaaatgctgggttgtggcgcacacgttgtatatttacgtcgtaccggtgtgtctgactacccgatggaaaacgttgttaccttagaacaacttcaagcattgcgtgatcaagcaatagagcaaggtattgaacctggcgaattacttgatccactattgttaccgacagattctgcagtacaagatttgccagaggcgaatgttactgttgaaggtggcgatgctattttgcacggccagccagtaaaagcgagccaattaccagaacaaggtacattagttcgcattaccgttggggaacaacgtgacttcattggtattggtgaaatagaccaaaacaatatggttgcacctaaacgtgttatggctaacaagcaagacgaagcataa

SEQ ID NO: 46249 - protein, 316 aa, Photobacterium profundum
MARRRKGRPIDGVILLDKPTGITSNDTLQKVKRIFFAQKAGHTGALDPLATGMLPICFGEATKFSQFLLDSDKRYRVIAKLGERTNTSDSDGEVVETREVKVDRGQLERCIAKFRGTTDQIPSMFSALKYQGRPLYEYAREGIEIPRESRKITVHSIELLRFEGHEVEMEVHCSKGTYIRTITDDLGEMLGCGAHVVYLRRTGVSDYPMENVVTLEQLQALRDQAIEQGIEPGELLDPLLLPTDSAVQDLPEANVTVEGGDAILHGQPVKASQLPEQGTLVRITVGEQRDFIGIGEIDQNNMVAPKRVMANKQDEA

SEQ ID NO: 46250 - DNA, 963 bp, Prochlorococcus marinus
  CDS (1)..(963)
gtgactgtgcccttcggctttgtggtgatcgacaagcctgctggcatcacctcccacgactgtgtgagccgaatgcggcgcgtgtttggcatcaagcgcgtgggccacggcggcacgcttgatcctgccgtaacaggagttttgcccatcgccctagggcatgccaccaggctgctgccctatctacccggcgccaagagctatcgcggcagcatccaactgggccaacgcaccagtagcgacgatcaacaaggggatctgatctccaagcaagcctggcccgaattgaacacagcagagatcgaggcctatctcgagccgtttcgcggcaggattcagcaacggccaccgcaagtttcagccgtgcatgtgcaaggggaacgcgcccatgcacgtgcccgcaggggagaaacgatggagattccagcgcgaacgatcacgattgatcgcttgcagctactcaactggaaccaacaactgggccaaatcgacttcaacgtgcattgctcatcaggcacatacattcgctctctcgcacgagatctaggcgaattaattggctgcggcgcttgtctggggtggttaaagcgaacccaggcactggggtttcacgagcaacaagccgtaccactacccgatcgagacaatccagccctaacgactccgcctgctgtgttaccgccactcacggcccttgcacacctaccaagactgcaactcaacgaagaggaacaggagagctggagctgcgggcgccgcattaccgcccatcaagatcaatgccaaccagcacccaaacctctggcctctgatcagcaagaatctgctccaaaccaaactgatccaagcgcaaacaagtccatgctcgtggtgatcgactgcagaggcgaagtcgccggaatggcctactgggaagacaacgcaacagtgaagccaaaagttgtgttcaacgcacagggatga

SEQ ID NO: 46251 - protein, 320 aa, Prochlorococcus marinus
MTVPFGFVVIDKPAGITSHDCVSRMRRVFGIKRVGHGGTLDPAVTGVLPIALGHATRLLPYLPGAKSYRGSIQLGQRTSSDDQQGDLISKQAWPELNTAEIEAYLEPFRGRIQQRPPQVSAVHVQGERAHARARRGETMEIPARTITIDRLQLLNWNQQLGQIDFNVHCSSGTYIRSLARDLGELIGCGACLGWLKRTQALGFHEQQAVPLPDRDNPALTTPPAVLPPLTALAHLPRLQLNEEEQESWSCGRRITAHQDQCQPAPKPLASDQQESAPNQTDPSANKSMLVVIDCRGEVAGMAYWEDNATVKPKVVFNAQG

SEQ ID NO: 46252 - DNA, 918 bp, Prochlorococcus marinus subsp
  CDS (1)..(918)
atggaaattaaagatggatttatagcaataaataaagagaaaggatttacctctcatgattgcgttaaacaaataaggaaattattaggtatcaaaaaagttggtcacacaggtactttagatcccgatgtaacaggtactttaccaattgcgataggcagtgctacaagatttattcaatatttacctcaaggcaaaacctatattggccaaatccaattaggcataagaacaaaaactgatgatatgcaaggcgaaattcttaacaaaaaagattggcctgttttgagccataagcaattagataaatatttaaataacttcagaggtattatccaacaagtacctcctatagtatctagtgttcacgttaatggagaaagagcatacaaaaaagcttttaaaaatgaggaatttgaattaaaaccaaaagaggtagaaatagaagaattagttctaaacaaatgggatcaaataaatggaatattagaaataaaagtgtcttgttcctcaggaacttatataagatccatcgctagagatttgggcgggagcttagattctgagggttgtcttttgaaacttaaaaggatttcggcttgtggattccatgagaaaaattctataaagatatctgatctaagtgataataatgacaaaaacgcaccttttattattcccacaatttctgctcttgatcatatttcaacactagttttagctaatcaagaagaaattaacttttggcaaacaggaagaataattaaatttgatgctaataattttgttaaaagccgctcttttgattacaaaaaaccaataaaaattattgaccctaacaaaatcctattaggaattggttttattaatgaagaaaaaactatattacatcccaaattagttcttaatgcaaaataa

SEQ ID NO: 46253 - protein, 305 aa, Prochlorococcus marinus subsp
MEIKDGFIAINKEKGFTSHDCVKQIRKLLGIKKVGHTGTLDPDVTGTLPIAIGSATRFIQYLPQGKTYIGQIQLGIRTKTDDMQGEILNKKDWPVLSHKQLDKYLNNFRGIIQQVPPIVSSVHVNGERAYKKAFKNEEFELKPKEVEIEELVLNKWDQINGILEIKVSCSSGTYIRSIARDLGGSLDSEGCLLKLKRISACGFHEKNSIKISDLSDNNDKNAPFIIPTISALDHISTLVLANQEEINFWQTGRIIKFDANNFVKSRSFDYKKPIKIIDPNKILLGIGFINEEKTILHPKLVLNAK

SEQ ID NO: 46254 - DNA, 915 bp, Pseudomonas aeruginosa
  CDS (1)..(915)
gtggcccaggtgaagcgtatccgccgctccatcagcggcatcctggtgctcgacaagccgcgcggcatgagttccaaccaggcactgcagaaagtccgctggctgctcaatgccgagaaggccggccacaccggcagcctcgacccgctggccaccggggtgctgccgctgtgcttcggcgaggcgaccaagttctcccagtatcttctcgatgccgacaagggttacgagacggtgatgcgcatgggcatcaccaccaccaccggcgacgccgagggcgaactgctcgccgagcgggacgtgaccgtcggtcgggacgatctcgaacaggccctgccgcgcttccgtggcgacatagagcaggtgccgccgatgtactcggcgctgaagaaagacggacagccgctgtacaagctcgcccgtgcaggagaggtagtggagcgcgaggcgcgttctgttactattacgcgcctggatttgctctccttcgagccgccctgtgcgaccctggccgtttcctgcagcaaaggcacctacgtgcgtacgctggtggaagatctcggccaggtcctgggctgcggcgcgcacgtcgcggcactgcggcggacccaggccgggccgttcgccctggcccaggcgatcaccctcgagacgctcgaacgcgtgcatgccgaaggtggtccggaagcgctggaccaattcctgatgccggaagacagcggcctgttgcattggccggtgttgcagttgtccgagcacagtgcgtactactggctgcacgggcagccggtgcgggccccggaagcgccgaagttcggctggctgcgggtgcaggatcacacaggtcgtttcatcggtatcggtgaagtgaccgacgacgggcgtatcgccccgcgtcgactgattcggtcataa

SEQ ID NO: 46255 - protein, 304 aa, Pseudomonas aeruginosa
MAQVKRIRRSISGILVLDKPRGMSSNQALQKVRWLLNAEKAGHTGSLDPLATGVLPLCFGEATKFSQYLLDADKGYETVMRMGITTTTGDAEGELLAERDVTVGRDDLEQALPRFRGDIEQVPPMYSALKKDGQPLYKLARAGEVVEREARSVTITRLDLLSFEPPCATLAVSCSKGTYVRTLVEDLGQVLGCGAHVAALRRTQAGPFALAQAITLETLERVHAEGGPEALDQFLMPEDSGLLHWPVLQLSEHSAYYWLHGQPVRAPEAPKFGWLRVQDHTGRFIGIGEVTDDGRIAPRRLIRS

SEQ ID NO: 46256 - DNA, 1005 bp, Pyrococcus abyssi
  CDS (1)..(1005)
atggcgagagatgaggtcaggaggatacttcccgctgatataaagagggaggtaatagttaaggatgataaagctgagacgaatccaaagtggggctttccacccgataagaggccgatagagttgcacatccaatatggggtcataaaccttgacaagcctccaggccctactagccatgaggtcgttgcctggataaagagaatcctcaacttggagaaagccggtcatggtggaaccctcgaccctaaggttagcggtgttctgcctgtggctttggagagagctactagggtcgttcaagctttactcccggctggaaaggagtacgttgcgttgatgcaccttcacggggatgttcctgaagataagatacgcgcagttatgaaggagttcgaaggagagataattcagaggccccccctaagaagtgccgtgaaaagaaggctaaggacgaggaaggtctactacatagaaatcttggagatagatgggagggacgttctcttcagggtaggggttgaggctgggacttacattaggtcattgattcatcacattggactggcccttggagttggagcccacatggccgagcttaggagaactaggagtggtcccttcaaggaagatgaaacccttgtgacgctccacgatttagttgactactatcacttctggaaggaggatgggatagaggaatacatcaggaaggcgatccaaccaatggagaaagctgttgaacatttgcctaagatatggataaaggattcagccgttgccgcagttgcccatggggcaaacttaaccgttcctgggatagttaagttgaacgcaggcattaagaagggcgacctagttgcgataatgacgctcaaagacgagctcgtagctttgggtaaagccatgatgagcacccaggaaatgattgagaggagcaagggaatagcagtggacgttgaaaaagttttcatgcccagggattggtatccgaagctctggtga

SEQ ID NO: 46257 - protein, 334 aa, Pyrococcus abyssi
MARDEVRRILPADIKREVIVKDDKAETNPKWGFPPDKRPIELHIQYGVINLDKPPGPTSHEVVAWIKRILNLEKAGHGGTLDPKVSGVLPVALERATRVVQALLPAGKEYVALMHLHGDVPEDKIRAVMKEFEGEIIQRPPLRSAVKRRLRTRKVYYIEILEIDGRDVLFRVGVEAGTYIRSLIHHIGLALGVGAHMAELRRTRSGPFKEDETLVTLHDLVDYYHFWKEDGIEEYIRKAIQPMEKAVEHLPKIWIKDSAVAAVAHGANLTVPGIVKLNAGIKKGDLVAIMTLKDELVALGKAMMSTQEMIERSKGIAVDVEKVFMPRDWYPKLW

SEQ ID NO: 46258 - DNA, 1005 bp, Pyrococcus horikoshii
  CDS (1)..(1005)
atggcgagagatgaggtaaggaggatgcttcccgctgatattaaaagggaagtgttaataaaagatgaaaatgctgaaacgaaccctaaatggggttttcctccttacgagaggcctattgagttgcacattcaatatggagttataaatttggataaacctcctgggcctaccagtcatgaggtagttgcatggataaagcgaatacttaatctagagaaagctggccatggaggaactttagatcctaaagttagtggagttttaccagttgctttagagaaagcaactagggtagttcaagctttacttccagctggaaaggagtatgtagctttaatgcatcttcacggagatgtcccggagaataaaataattgacgtcatgaaagaatttgagggagagataattcagagaccacccctaagaagtgccgttaagaggagacttagaactaggaaagtttattatatagaaattctggaaatagatggtagggatgttttatttaaagtaggagtcgaggccggaacgtatataaggtctttgatccatcacattggccttgccctcggcgtgggtgctcacatggcggagttgagaaggactaggagcggaccctttaaggaggatgaaactttagttacgcttcatgatctagttgattattatcacttctggaaggaggatggaatagaaaagtatctcagaagggctattcagccaatggagaaggccgtcgagcacttaccgaagatctggattaaggattcagcagtagctgctgtagctcatggtgctaatttaacggttcctgggatagttaagcttaacgttgggattaagagaggtgatctagtggccataatgacgttgaaggatgaactggtagcattgggaaaggctatgatgacctcccaggaaatgatgcagagaagcaaggggatagcggtagacgttgaaaaggtatttatgcccagggattggtatccaaagctttggtag

SEQ ID NO: 46259 - protein, 334 aa, Pyrococcus horikoshii
MARDEVRRMLPADIKREVLIKDENAETNPKWGFPPYERPIELHIQYGVINLDKPPGPTSHEVVAWIKRILNLEKAGHGGTLDPKVSGVLPVALEKATRVVQALLPAGKEYVALMHLHGDVPENKIIDVMKEFEGEIIQRPPLRSAVKRRLRTRKVYYIEILEIDGRDVLFKVGVEAGTYIRSLIHHIGLALGVGAHMAELRRTRSGPFKEDETLVTLHDLVDYYHFWKEDGIEKYLRRAIQPMEKAVEHLPKIWIKDSAVAAVAHGANLTVPGIVKLNVGIKRGDLVAIMTLKDELVALGKAMMTSQEMMQRSKGIAVDVEKVFMPRDWYPKLW

SEQ ID NO: 46260 - DNA, 936 bp, Rhizobium meliloti
  CDS (1)..(936)
atgtccagaccccgcaaaccgaagggccgcccgatttcgggatggctgatcctcgacaaacccctcgatttcggttcgaccgaggccgtatccaagatcaagtggctgttcaaggcgcagaaggcgggccatgcgggcacgctcgatccgctcgcctccggcatgctgccgatcgcgctcggcgacgcgacgaaaaccgttccctacgtcatggacggccgcaagatctacgaattcacggtggcctggggcgaggagcgctccaccgacgatctcgaaggcgaagccgtccgctcttccgccgcgcgtccggaggaagaggcgatccgcgccctgctgccgaaatataccggcgtgatcgcgcaggtgccgccgcagttctccgcgatcaagatcggcggcgagcgcgcctatgatctcgcccgcgacggcgaaaccgtcgagattccggcgcgcgaggtggaggtcttccgtctgtcgctcatcggatcggctccgaatctcgctcatttcgagatcgaatgcggcaagggcacctatgtccgttcgctcgcccgcgacatgggccgcgatctcggctgcttcggccatatcgcgtcgctgcgccgaaccttcgtcgcccccttcggcgaggaggacatggtaccgctcgccgatctcgtcgccctggaggcgatcgaggacgatgcggaacgtctcgccgcgctcgacgcgtatctgatcgacacgggagaggccctgtccgacctgccgcatatcgccgtcaatgacgaccaggcgcaccggctgcggatgggcaacccgatcatcctgcgtggacgcgacgctccgctgcccacgccagaggcctatgccacggcccaaggcaagctcgtggcgatcggcgaaatcgccgagggcgagttccggccgaagcgagttttcgccacccaataa

SEQ ID NO: 46261 - protein, 311 aa, Rhizobium meliloti
MSRPRKPKGRPISGWLILDKPLDFGSTEAVSKIKWLFKAQKAGHAGTLDPLASGMLPIALGDATKTVPYVMDGRKIYEFTVAWGEERSTDDLEGEAVRSSAARPEEEAIRALLPKYTGVIAQVPPQFSAIKIGGERAYDLARDGETVEIPAREVEVFRLSLIGSAPNLAHFEIECGKGTYVRSLARDMGRDLGCFGHIASLRRTFVAPFGEEDMVPLADLVALEAIEDDAERLAALDAYLIDTGEALSDLPHIAVNDDQAHRLRMGNPIILRGRDAPLPTPEAYATAQGKLVAIGEIAEGEFRPKRVFATQ

SEQ ID NO: 46262 - DNA, 1047 bp, Rhodopirellula baltica
  CDS (1)..(1047)
atggaccccaacggcgaacattcaccgctcggttttttgccttgctataaaccgccgggtgcgacttcaagagatttagtcaaccgcgcccagaggcggctgcgcggtgaatttgggcttcgcaaattgaaggtcgggcacaccggaacactcgatccgttggcggaagggttggtgttgctagcgattggttcggcggcgcgtttgaccccttgggtgctgcaacacggcaagcggtatctcgctgattttcgattgggtgtatcgagcgagtcaggcgatttggaatccgaattggtcacgcaaacggacgtcaagttgccgacggcggcggagatcgaacaagtgctcaaggactttcatggcgtggtggaacaaaccccgccggctcattcggcgatcaaggtcgacggggaacgagcccataaaagggcacgtcgtggcgaggattttgaaatgcccaaacgccgaattctgatcgactcggtgaagctgatttcgtacgagccgccgatgatgcgattggacgtccggtgtggttcgggaacttacttgcggacgctggggatggatgttgctgccgcttgcggatgcgcagcggtgatgaccaagttgattcgaaacgaggtcgggcgattcactttggacgacacgctcgattgcgcgttcatgtttgatgatgatgaccgcgaaaaaatgtcatctgaaccgatggtgaaatacctccggcctgcgatcgagggactgacgcatatgccggcgatgaatctggacaggcagcaaatcggcatgcttcaagccggaattcgtatctcaggaacccctgaagcaccgtctgaaccattgccggaagcgtggattggctgcatcgatcaggtcgacacgttcgatcgaaacacggatgttttggattgcatcggggtcgatcgttcggatggttcctccggcccctggggggaattggtcgcgatacttcgcccccatggcaaattgtggcacccgctgagagtgtttccgacgacggaatcaattaccctacgtggctga

SEQ ID NO: 46263 - protein, 348 aa, Rhodopirellula baltica
MDPNGEHSPLGFLPCYKPPGATSRDLVNRAQRRLRGEFGLRKLKVGHTGTLDPLAEGLVLLAIGSAARLTPWVLQHGKRYLADFRLGVSSESGDLESELVTQTDVKLPTAAEIEQVLKDFHGVVEQTPPAHSAIKVDGERAHKRARRGEDFEMPKRRILIDSVKLISYEPPMMRLDVRCGSGTYLRTLGMDVAAACGCAAVMTKLIRNEVGRFTLDDTLDCAFMFDDDDREKMSSEPMVKYLRPAIEGLTHMPAMNLDRQQIGMLQAGIRISGTPEAPSEPLPEAWIGCIDQVDTFDRNTDVLDCIGVDRSDGSSGPWGELVAILRPHGKLWHPLRVFPTTESITLRG

SEQ ID NO: 46264 - DNA, 1101 bp, Rhodopseudomonas palustris
  CDS (1)..(1101)
atgaccgtgaccacccccgacgccctgctcgccccgcacgacgtgcagcacgccggcgccgacgaatccgccgcgcagatccgtaagccgcgcgacaacaacgacccgcgcaatgccaatcgcggcggcggcaatggtaagccgcgccgcgacaagcgcgacgtccacggctgggtggtgctggacaagccgatcggcatgacctcgacccaggcggtcgcggtgctgaagcggctgttctcggccaagcgcgccggccatgccggcaccctcgatccgctggcctccggcggcctgccgatcgcgatgggcgaagccaccaagaccgtgccgttcgtgatggacggccgcaagcgctaccgcttcaccgtggcctggggcgaggaacgggataccgacgacaccgagggccgcgcggtcgcgaccagcccggatcggccgaccgccgaggcgatcagggcgctgctgccgcgctttaccggcgtgatcgagcaggttccgccgcaatactcggccgtgaagatccagggcgagcgcgcctacgacctggcacgcgatggcgaggtcgtgccgctggtcccgcgtccggtcgagattcacgaattaacccttgtggaacatggagatgacggccgctcggtgttcgaggccgagtgcggcaagggaacctatgtgcgggcgctcgcccgcgacatgggccggctgctcggctgctacggtcatatctgcgcgctgcgccgcacggtggtggggccgttcgacgagtcggacatgattccgctggaagaactacaggctttgtgcgatagagcggcgtccggcgagggtagcctcgccgacgcgctactgcccgttgagaccgcgctggacgacatcccggcactggccgtcactcgggctgatgcggcaaggctccatcggggccaggccgttttgttgcgcggacgggatgcgcctcattgtagcggcacagtctatgtcacggtggcaggccggcttctggccctcgccgaagtcggcaatggcgagctcatccccaagcgcgtgttcaacctcaccgggctgactgccagctcggccgttcgcaaggaaagtatctga

SEQ ID NO: 46265 - protein, 366 aa, Rhodopseudomonas palustris
MTVTTPDALLAPHDVQHAGADESAAQIRKPRDNNDPRNANRGGGNGKPRRDKRDVHGWVVLDKPIGMTSTQAVAVLKRLFSAKRAGHAGTLDPLASGGLPIAMGEATKTVPFVMDGRKRYRFTVAWGEERDTDDTEGRAVATSPDRPTAEAIRALLPRFTGVIEQVPPQYSAVKIQGERAYDLARDGEVVPLVPRPVEIHELTLVEHGDDGRSVFEAECGKGTYVRALARDMGRLLGCYGHICALRRTVVGPFDESDMIPLEELQALCDRAASGEGSLADALLPVETALDDIPALAVTRADAARLHRGQAVLLRGRDAPHCSGTVYVTVAGRLLALAEVGNGELIPKRVFNLTGLTASSAVRKESI

SEQ ID NO: 46266 - DNA, 1038 bp, Rickettsia conorii
  CDS (1)..(1038)
atgagtaattattggttaaatatttataaaccaagaggtataagttctgctcaacttgttagcatagtaaaaaaaatactcggtaaaaccaagataggacatgccggtactttagacgtagaagcggaaggaatattaccgtttgctgtaggtgaagctacaaaactgatacatctgctagttgatgctagaaaaacctatatttttaccgtaaaattcggaatgcaaaccaatagcggcgattgtgccggtaaagtaatagcaacgaaagattgtatcccttctcaagaagaagcttatgccgtatgttctaaatttatcggtaacgtaacacaaataccgccggctttttcagctcttaaagttaacggtgtaagagcttataaattggctagagagggaaaaaaagtagaattaaagccacgcaatataactatttatgatctaaaatgtttaaattttgatgagaaaaatgctaccgctacatactatacggaatgctcaaaaggtacttatataaggactttagcagaagatttggcattgtccttgcaaagtttaggatttgtgatagaattacgccgtactcaggttggaatatttaaagaagaaaatgctatccgaattaaatcgcctgacgaaattaccaaaaatgccctagaggaaaacagtataaagatagaagcaatactggacgacatcctggttcttgatgcaactgacagccaagcacagcaaattaaatatggacagaaatgtttatttaattatgaaaaagactttagacatcttgccaaatttgcttatagagaggaatttaaaggaaacacggaacgcaacaccacagcgtacactttagtacgtgaggatgcgagtaccggattgacgtacaaattacctctagaagtagagtttggcaagatgtctgttgatcttttgtgggttcgctataaaggcactttgcttgcaataggtagcttaaacaagagttgctttaattctttacgagtatttaatttaacacaagacttcttttaa

SEQ ID NO: 46267 - protein, 345 aa, Rickettsia conorii
MSNYWLNIYKPRGISSAQLVSIVKKILGKTKIGHAGTLDVEAEGILPFAVGEATKLIHLLVDARKTYIFTVKFGMQTNSGDCAGKVIATKDCIPSQEEAYAVCSKFIGNVTQIPPAFSALKVNGVRAYKLAREGKKVELKPRNITIYDLKCLNFDEKNATATYYTECSKGTYIRTLAEDLALSLQSLGFVIELRRTQVGIFKEENAIRIKSPDEITKNALEENSIKIEAILDDILVLDATDSQAQQIKYGQKCLFNYEKDFRHLAKFAYREEFKGNTERNTTAYTLVREDASTGLTYKLPLEVEFGKMSVDLLWVRYKGTLLAIGSLNKSCFNSLRVFNLTQDFF

SEQ ID NO: 46268 - DNA, 945 bp, Salmonella typhimurium
  CDS (1)..(945)
atgagtcgtcctcgtcgtcgtggccgcgacattcacggcgttctgctgctggataagccgcagggtatgtccagcaatgacgtgctgcagaaagttaagcgcatctacaatgccaaccgcgccgggcataccggcgcgctggacccgctggcgaccggcatgttgccgatttgcctcggcgaagcgacaaaattttcgcagtacctgctggattctgacaaacgctatcgtgttattgcccgtctggggcagcgcacggatacctctgacgccgatggtcaaatcgtgcaggagcgtccggtgactttcagcgctgagcagcttgcgagcgcgctggagactttccgcggcgatattgagcagattccgtcaatgtattcggcgctgaagtatcagggtaagaaactgtacgaatatgcccgccagggtatcgaagtgccgcgcgaagcccgcccgattaccgtctatgagctgctgtttattcgccatgaaggtaacgagctggagctggaagttcattgctccaaaggcacctatattcgtaccattattgatgatttaggtgagaaactgggctgtggcgcgcacgtaacgtacctgcgtcgtctgacggtcagcaagtatccggtggatcgtatggtgacgctggagcatttgcagacgctggtagcacaggcggaacagcagggcgttccggcggcgcagttgctcgatccattattgatgccaatggacagtccagcttcggactatcctgttgttaatctgccgttaacatcttcggtatacttcaaaaatggcaacccggttcgtaccacgggcgcgccgttgaagggactggttcgtgtgacggaaggtgaagacgataaatttatcggtatgggcgaaattgacgacgaaggccgtgtcgcgcctcgtcggctggtagtagagtacccagcgtaa

SEQ ID NO: 46269 - protein, 314 aa, Salmonella typhimurium
MSRPRRRGRDIHGVLLLDKPQGMSSNDVLQKVKRIYNANRAGHTGALDPLATGMLPICLGEATKFSQYLLDSDKRYRVIARLGQRTDTSDADGQIVQERPVTFSAEQLASALETFRGDIEQIPSMYSALKYQGKKLYEYARQGIEVPREARPITVYELLFIRHEGNELELEVHCSKGTYIRTIIDDLGEKLGCGAHVTYLRRLTVSKYPVDRMVTLEHLQTLVAQAEQQGVPAAQLLDPLLMPMDSPASDYPVVNLPLTSSVYFKNGNPVRTTGAPLKGLVRVTEGEDDKFIGMGEIDDEGRVAPRRLVVEYPA

SEQ ID NO: 46270 - DNA, 906 bp, Streptomyces avermitilis
  CDS (1)..(906)
atgaccgagaagcacaggacgcccgacgggcttgtcatcgtggacaagccgtcgggcttcacttcgcacgacgtggtcgccaagatgcgcgggatcgccaggacccgccgcgtcggacacgccggcaccctcgaccccatggcgacgggcgtgctcgtcctcggcgtcgagaaggcgaccaaactcctcggccatctcgcgctcaccgagaaggaatacctgggcacgatccgtctcgggcagaacaccctgacggacgacgccgagggcgagatcatctcctcgacggacgcctcccgggtgacccgggacgcgatcgacgcgggggtcgccaagctcagcggcgccatcatgcaggtgccgtccaaggtcagcgcgatcaagatcgacggcgtgcggtcctacaagcgggcgcgcgagggcgaggacttcgagatcccggcccgcccggtgaccgtctcgtcgttcgcggtgtacgacgtgcgtgacgcggtcgccgaggacggcacaccggtgctcgacctggtggtgtcggtggtgtgctcgtccggcacgtacatccgggcgctggcccgggacctgggcgcggacctgggcgtcggcggacatctgacggcgctgcgccggacgcgcgtcggaccgtacaagctcgatgccgcgcgcaccctcgaccagctccaggaggagctgaccgtgatgcccatcgccgaagcggccgccgccgcgttcccccgctgggacgtggacacgaagcgggccaggctgctgctcaacggcgtacgcctggagatgcccgaggagtacgcgggccgcggcgcggtggcggtcgtcgaccccgcgggccgcttcctggccctggtggaggagcagaagggcaaggcgaagagcctggccgtgttcggctga

SEQ ID NO: 46271 - protein, 301 aa, Streptomyces avermitilis
MTEKHRTPDGLVIVDKPSGFTSHDVVAKMRGIARTRRVGHAGTLDPMATGVLVLGVEKATKLLGHLALTEKEYLGTIRLGQNTLTDDAEGEIISSTDASRVTRDAIDAGVAKLSGAIMQVPSKVSAIKIDGVRSYKRAREGEDFEIPARPVTVSSFAVYDVRDAVAEDGTPVLDLVVSVVCSSGTYIRALARDLGADLGVGGHLTALRRTRVGPYKLDAARTLDQLQEELTVMPIAEAAAAAFPRWDVDTKRARLLLNGVRLEMPEEYAGRGAVAVVDPAGRFLALVEEQKGKAKSLAVFG

SEQ ID NO: 46272 - DNA, 864 bp, Synechococcus elongatus
  CDS (1)..(864)
atgtttggttttttgaatctgaataaacctgctggctgcacgtcccacgactgtattaatgaactgcggcggcggctgcggctcaaacggattggccatgggggcacattggatccgatggccacaggggtactgccgatcgcccttggggcggcaacgcgacttttgccctatctcagcgatcgcaaggcctacattggcacggtgcgctttggcatgagcaccaccaccgatgacatcacaggggaaatttgccaagaacagggggccagtcatctgacgcttgcagccatccaagaacagctcccgcaatttattggtgagattgagcaattgccccctgcctacagtgcgattcaagtggctggccagcggctctatgcccgtgcccgggcgggtgaggtcgtcagcgttccaccgcggatcgtgacggtgtaccgtatcgaggtgttgcattggcaaccgggtcgttatcctgaactcaccctgcacattacctgtggcagtggtacctatattcgcgcccttgcccgcgatttggggactgcactgggggtcggtggcaccctagccgccctgcaacggattgaaagtggtggcctgcggattgaggagagccattccctagaaagcattgccccagaacatttacccctgtgctcgccccaagaggtgctctcccatctgccgtggctggaactcaatgccgcacaactcaacgactggtaccatggccgcgccgtgatttgtgaggggctgccgccggcggacagttgcgtgggcgtgacctttgccactgcctgtgtcggcgttggcatcagtggcggcgatcgcctgcatcccaaggtagtgctcaaggagtag

SEQ ID NO: 46273 - protein, 287 aa, Synechococcus elongatus
MFGFLNLNKPAGCTSHDCINELRRRLRLKRIGHGGTLDPMATGVLPIALGAATRLLPYLSDRKAYIGTVRFGMSTTTDDITGEICQEQGASHLTLAAIQEQLPQFIGEIEQLPPAYSAIQVAGQRLYARARAGEVVSVPPRIVTVYRIEVLHWQPGRYPELTLHITCGSGTYIRALARDLGTALGVGGTLAALQRIESGGLRIEESHSLESIAPEHLPLCSPQEVLSHLPWLELNAAQLNDWYHGRAVICEGLPPADSCVGVTFATACVGVGISGGDRLHPKVVLKE

SEQ ID NO: 46274 - DNA, 885 bp, Synechococcus sp
  CDS (1)..(885)
atgtcatcggaagggtttgtcaacctcgataagccagcgggctggacttcccatgactgtgtcgccaagttacggcgtctgttacgggagcggcgtatcggccatggtggcacgcttgatccggcagtcacaggtgttctgccgatcgcggtgggacgagccacgcggctcctaccctatcttcccagtggcaaaacctacgtcggcaccattcgcttcgggttgcagaccagtacggacgatctgacgggcgatcgcctggcagaagccgataccagccacttgtcgcgagaggcaatcgaggcggcgctaccccaattcctcggccacattcagcagcaaccgccccaggttagtgccgtacaagtgcaagggcagcgactctatcagcttgctcggcgcggggaagcccccacggagctcccttggcgcaccgtagaaattcagtcaattcgaattctccagtggcggatcggccagtcaagccgaattatctgtcgaaatccactgtggtgctggcacttacatccgttctctagcgcgagacctcgaagccgtgtgggggtcggtggcaccctagcagagttgcgtcgtactgcgagtagtggctttgatctgaaccagagcacgccgctgactgaactgctcgatggagcagcggtgccgctcttggctttggatttgccattgcagcatttagccaaagttcaactgagtgccgaaaccagcgatcgctggcgacaaggacaagcgatgcccgtgcctgacagtgttcttcccgatgcagctccagtccgtgtctatgatctcaacggccagttcttaggaatcggcgcgatcgcggcaggactgtgcaagcccaaagtcgtactcgcggctctttga

SEQ ID NO: 46275 - protein, 294 aa, Synechococcus sp
MSSEGFVNLDKPAGWTSHDCVAKLRRLLRERRIGHGGTLDPAVTGVLPIAVGRATRLLPYLPSGKTYVGTIRFGLQTSTDDLTGDRLAEADTSHLSREAIEAALPQFLGHIQQQPPQVSAVQVQGQRLYQLARRGEAPTELPWRTVEIQSIRILQWRIGQSSRIICRNPLWCWHLHPFSSARPRSRVGVGGTLAELRRTASSGFDLNQSTPLTELLDGAAVPLLALDLPLQHLAKVQLSAETSDRWRQGQAMPVPDSVLPDAAPVRVYDLNGQFLGIGAIAAGLCKPKVVLAAL

SEQ ID NO: 46276 - DNA, 891 bp, Synechocystis sp
  CDS (1)..(891)
atgtttggtttcctcaatctccataaacctctgcacctcacttcccatgattgtgtggccaaggtgcgtcgtctattaaggcaaaaacgggtggggcacggaggcaccctagatcctttggcggagggagtattgcccctggcggtggggtcggctacccgtttactgccctacttacctggggcaaagcaatatcaagcccttattcgctttggggtacgtaccgacagcgatgacctagctggggaggtattagagagtaaaaatgttagttatttaacccttgccgccgttgaacagattttaccgacttttttgggggaaattgagcaaattccccctcaatacagcgctattcaggttaatggtaagcgtttgtatgaattggccagggctggcattccccaagcagtgcccagtcgcatggtgactattaatgatttgaaaatactcggttggcgatcggggaatcagccggaattagatttacaagttacctgtggggaaggaacctacattcgagccttagccagggaccttggcgatcgcctgggaacaggggcaacgttggcgggcttggtacggcaacagagtgggggcatggccctggataatagcgttggtttaaccgccctggaaaaaatcgtggcggaggaggagcatattcctctcattcctccccaggaagcgttaagccatttacccacagttcaactgaatagcgaattggaaaaaaggtggttccacggccaaagattgctcttgccagatctacccgtgggagtggtactaatcacatcggagctaggcccagtaaaatgcttgggcgttgccctggtgactccagaagaccatggcacggtgttacggccaaaagttgtgctgaattaa

SEQ ID NO: 46277 - protein, 296 aa, Synechocystis sp
MFGFLNLHKPLHLTSHDCVAKVRRLLRQKRVGHGGTLDPLAEGVLPLAVGSATRLLPYLPGAKQYQALIRFGVRTDSDDLAGEVLESKNVSYLTLAAVEQILPTFLGEIEQIPPQYSAIQVNGKRLYELARAGIPQAVPSRMVTINDLKILGWRSGNQPELDLQVTCGEGTYIRALARDLGDRLGTGATLAGLVRQQSGGMALDNSVGLTALEKIVAEEEHIPLIPPQEALSHLPTVQLNSELEKRWFHGQRLLLPDLPVGVVLITSELGPVKCLGVALVTPEDHGTVLRPKVVLN

SEQ ID NO: 46278 - DNA, 1098 bp, Thermoplasma acidophilum
  CDS (1)..(1098)
atggatttctccaatatcaatggtttcgtagtgcttgacaagcctcagggcccaaccagccaccaggttgatcactgggttagggagatcctaggcatagagaaggtggcgcacatcggtacgcttgacccaaacgtgaccggagtcctgactatggccataggcaaggccgtccgccttgtggatgttgtgcacgagagtccaaaggaatatgttggtgttatgcggttttacgaagacataaccgaagaagaggtcaggtactatttcaaaaaattcacaggaaggatatatcagctgccacccgtgagaagcgcagtggctagaagcctcaggatcaagacggtgtattcgcttgatctcctggagaagaaagacaggctagtgctgtttcacgtcaaatgcgaatctggaacttatatacgcacgctttgcacggatatcggatacgtatccggaaagggtgggcagatggtggatctgaggaggacttcaaccggtccattctccgaggataggtgcataacactgcaggatttcgcggctatggtagaactggccaggaagggcgaggataagctgctcagggaccacatactcgatatgacctacgccttcaaggactatccgaagatcgtggtcaagaggagcgccatgaggaatatagcacatggatcggatctgtatgccgggggaatcaagataattgacggaaagttcaggaagggtgaacgcgtagccgtcatctccgaggacaacgatctggtgggaactggcatagccatgtgcagctctgataacatctttatgaaggtagtggatttcgatcatatattcctggaggctgatgatggaaaggataatgtggtacggatcgggaaagaggctgttcaaaaatctggatcaggattacataaggatattcaaagatctgagggaaggaaggataccagaactggatggtatgggagagataccggacctgagaaaactgctgatagagtatggaaaggaaagaataagggaagagtttacccccgatcaggcgctgataaaggtggcggcggtaaggaacgccatggacgagatcatcaataa

SEQ ID NO: 46279 - protein, 365 aa, Thermoplasma acidophilum
MDFSNINGFVVLDKPQGPTSHQVDHWVREILGIEKVAHIGTLDPNVTGVLTMAIGKAVRLVDVVHESPKEYVGVMRFYEDITEEEVRYYFKKFTGRIYQLPPVRSAVARSLRIKTVYSLDLLEKKDRLVLFHVKCESGTYIRTLCTDIGYVSGKGGQMVDLRRTSTGPFSEDRCITLQDFAAMVELARKGEDKLLRDHILDMTYAFKDYPKIVVKRSAMRNIAHGSDLYAGGIKIIDGKFRKGERVAVISEDNDLVGTGIAMCSSDNIFMKVVDFDHIFLEADDGKDNVVRIGKEAVQKSGSGLHKDIQRSEGRKDTRTGWYGRDTGPEKTADRVWKGKNKGRVYPRSGADKGGGGKERHGRDHQ

SEQ ID NO: 46280 - DNA, 930 bp, Thermotoga maritima
  CDS (1)..(930)
atgaagcacggaatccttgtagcttacaagcctaaaggacccacatcgcacgatgttgtggacgaagttagaaaaaaattgaagacgaggaaagtcggacacggaggaactctcgatccgttcgcctgtggggttctcataatcggtgtcaaccagggcacgagaattctcgagttctacaaggatttgaaaaaggtgtactgggtgaagatgaggcttggtttgataaccgagactttcgatataacaggcgaagttgtcgaagaacgagagtgcaacgtcaccgaagaagaaataagagaagcaatcttttcctttgtgggagaatacgaccaagttccaccagcttattctgctaaaaaatacaaaggcgaacgtctctacaaactggcgagagagggaaagatcataaatcttccaccaaagcgagtgaagatcttcaagatatgggacgtgaatattgagggaagagacgtctctttcagagtggaagtgtctcctggtacctacataagatctctctgtatggatataggttacaagctcggttgcggtgccaccgctgttgagcttgtaagggagagcgtgggacctcatacaatcgaggaaagtttgaacgtattcgaagccgctcctgaagagatcgaaaacaggatcataccactcgaaaaatgccttgagtggctgccgcgtgttgtcgttcatcaggaatcaacgaaaatgattctcaacggttctcaaatacaccttgagatgctcaaagaatgggacggtttcaaaaagggtgaagttgtcagagtattcaacgaagaaggacggttacttgctctggctgaagcggaaagaaattcttcgtttctggaaaccttgagaaagcacgaaagaaacgagcgagttttgaccctcagaaaggtcttcaacacgaggtga

SEQ ID NO: 46281 - protein, 309 aa, Thermotoga maritima
MKHGILVAYKPKGPTSHDVVDEVRKKLKTRKVGHGGTLDPFACGVLIIGVNQGTRILEFYKDLKKVYWVKMRLGLITETFDITGEVVEERECNVTEEEIREAIFSFVGEYDQVPPAYSAKKYKGERLYKLAREGKIINLPPKRVKIFKIWDVNIEGRDVSFRVEVSPGTYIRSLCMDIGYKLGCGATAVELVRESVGPHTIEESLNVFEAAPEEIENRIIPLEKCLEWLPRVVVHQESTKMILNGSQIHLEMLKEWDGFKKGEVVRVFNEEGRLLALAEAERNSSFLETLRKHERNERVLTLRKVFNTR

SEQ ID NO: 46282 - DNA, 858 bp, Thermoanaerobacter tengcongensis
  CDS (1)..(858)
atgagtgtggacggcgttttaaatgtgctaaaacctcctggcatgacttctcacgatgtggtggattttataagaaaaatttacggtataaagaaagtgggccacacaggaactcttgatccagatgcagctggagttttacctgtatgcatgggaagagctactaagttcacttcttacctgatggaacatgacaaaaggtacagatttgaaataacttttggtttttctactgataccctagataaaagtggcaaaatcgttgaaagtggccctgttcccttatttactttggaaaaattacaggaagttttaagccagtttaaaggggaaatacaacagataccacccatttattctgcaaaaaaagtaaaaggaaagaagctctatgaatatgcgagaaaaggcgaagaagtggaaattccacccataaaagtgacagtttatgagttagaattaataaaatacgatgctccgcaccatctgctgttagatgtaaagtgttccaaaggcacttatgtaagagctcttgtgagagatatatgcaagaaacttgaagttccaggccacatgtcttttctcataaggacagaggtcggagactttgacattgaatcttcatatacgctggaggagataaaggagggaaaggcagaagtacagcccgtagataagtttataaaatttccttccgtggaacttgatgaagtttcttccaataaaattttaaatggccaatttatcagaaatacttacaatgttgaaaattctttagtaaagttgtatgataatcatggaatttttataggaattggagtggcagaaggggaaaaaatacgaccaaaaagacttttctaa

SEQ ID NO: 46283 - protein, 285 aa, Thermoanaerobacter tengcongensis
MSVDGVLNVLKPPGMTSHDVVDFIRKIYGIKKVGHTGTLDPDAAGVLPVCMGRATKFTSYLMEHDKRYRFEITFGFSTDTLDKSGKIVESGPVPLFTLEKLQEVLSQFKGEIQQIPPIYSAKKVKGKKLYEYARKGEEVEIPPIKVTVYELELIKYDAPHHLLLDVKCSKGTYVRALVRDICKKLEVPGHMSFLIRTEVGDFDIESSYTLEEIKEGKAEVQPVDKFIKFPSVELDEVSSNKILNGQFIRNTYNVENSLVKLYDNHGIFIGIGVAEGEKIRPKRLF

SEQ ID NO: 46284 - DNA, 1062 bp, Thermoplasma volcanium
  CDS (1)..(1062)
atgattgaagaaatccaaaaattaaacggcttcatagttatagacaagccgcagggtccaacgagccatcaggtagactattgggtaaggcagatcctaggcacagaaaaggtcggtcacattggtaccttggatccaaatgtgactggtgttctagttatggccataggcaaagcagttagattaattgatgttgtacatgagaaaccaaaggaatacgtaggtgtaatgaggtttcatagcgatatatctgaggaagaggtaagagaggtattcaggaaatttaccacaaggatatatcagcttccgcctgttaggagcgcggtatccaggaaggtcagaattaaaacaatatacgaactggatatgattgaaaaaaaggataagatcgtactatttcatgtaaaatgcgagtctgggacctatatacgaactttatgcacagatataggctacgtatcaggaaagggaggccagatggttgatctgagacgaataagcactggcccatttaaggaagatatagcaataacccttcaggatctgcaggcttacgtagatctcgccaaggaagggaaggatgaattattccgatcgcacttcctagacatgacctatgcttttatagattaccctaagatagttgcaaagaaaagtgccgttgaaaacatagcacatggatcggatctttacgtgggcggtgttaagctcatagatggcaatttccaaaaaggcgatagggtttgcgttttatccgaagacaacgaactcctgggaacaggaatagctagatgtgattccagcaatctctttatgaaggttgtagatttcgatcacatatttgtggaggcaaaacatggaaaaggcgatgtggtacgggatagggaaaaggatgtacaaagacctggacagcaggtacatagaaatattcgagatgctgcgcatgggccggactccagaactggacggggaaggaaagaaaccggacctcagatcgctcctaatcgagtacggaaattacagaataaaacaggagttcacagaagaccaggcagccattaa

SEQ ID NO: 46285 - protein, 353 aa, Thermoplasma volcanium
MIEEIQKLNGFIVIDKPQGPTSHQVDYWVRQILGTEKVGHIGTLDPNVTGVLVMAIGKAVRLIDVVHEKPKEYVGVMRFHSDISEEEVREVFRKFTTRIYQLPPVRSAVSRKVRIKTIYELDMIEKKDKIVLFHVKCESGTYIRTLCTDIGYVSGKGGQMVDLRRISTGPFKEDIAITLQDLQAYVDLAKEGKDELFRSHFLDMTYAFIDYPKIVAKKSAVENIAHGSDLYVGGVKLIDGNFQKGDRVCVLSEDNELLGTGIARCDSSNLFMKVVDFDHIFVEAKHGKGDVVRDREKDVQRPGQQVHRNIRDAAHGPDSRTGRGRKETGPQIAPNRVRKLQNKTGVHRRPGSH

SEQ ID NO: 46286 - DNA, 1152 bp, Tropheryma whipplei
  CDS (1)..(1152)
atgttaggtaaagttgaacgttctgagatgtatatactgttcgctatgacgcaggttcttctggtagacaaaataagcggcattacaagtcacacagctgttgcaaaaataaggcacctcacaggagtaaaaaaaatcgggcattgcggaaccctcgatccggcagcgtgtggtcttttgataatgggatgcggaactgcaacaagacttataagatatatgtccaatcttgataagcggtatattgcaacaataacgctgggcacacaaacaacaactgatgattcagaaggtgagattatatacagtgcaccaaagccatcccttgacaaaattacactcgagagcatagggagggctgcggagaaattaagcggaacaatcaaacaaatcccgagcgcatacagcgcaataaaggtctctggaaatagagcgtacaacctagcgcgtcaggggattatcccaaagctcaatgcacgagaggtgcgggtgcattggaaatttctcggagattttgaaaataaccaagttcatgtgcagattacctgttcatctggtacatacgttagggcattggcccgggatatgggaaaattcctgggtgttggcgggcacttatcatacctaaaacgcctcagcatagggccatttcatttgcatgaaatatatcgggaaataaacaaaaaggaagccaccatgtctgagcgaacgcctagtggtaatacgcaaggattaactgacaacatggccatctccgacaacatggccatctccgagagtgataagcacgattgtactgagcctggaattaattgtactgagcttggaattaaagatacatgcacagcgcttcgtgaagtgcactatacacaaggtgatacactgtcattcactcgcctcacagccctccaggcattatcaagaatttacaaaccgatagaagttagtcaaaaacaggcagatgacctaagttgcgggcgatatatatctcttggaatcgactcaaacggcccggtgtgtgcagtttgtaaagaaaatttaattgcggttattcagccggtatcagcaggattatggcgccctgaaacagttctcagtgataacagaaaactcaacagtaatgcggcacaagacgcaagtggaagcacataa

SEQ ID NO: 46287 - protein, 383 aa, Tropheryma whipplei
MLGKVERSEMYILFAMTQVLLVDKISGITSHTAVAKIRHLTGVKKIGHCGTLDPAACGLLIMGCGTATRLIRYMSNLDKRYIATITLGTQTTTDDSEGEIIYSAPKPSLDKITLESIGRAAEKLSGTIKQIPSAYSAIKVSGNRAYNLARQGIIPKLNAREVRVHWKFLGDFENNQVHVQITCSSGTYVRALARDMGKFLGVGGHLSYLKRLSIGPFHLHEIYREINKKEATMSERTPSGNTQGLTDNMAISDNMAISESDKHDCTEPGINCTELGIKDTCTALREVHYTQGDTLSFTRLTALQALSRIYKPIEVSQKQADDLSCGRYISLGIDSNGPVCAVCKENLIAVIQPVSAGLWRPETVLSDNRKLNSNAAQDASGST

SEQ ID NO: 46288 - DNA, 939 bp, Vibrio cholerae
  CDS (1)..(939)
atggctcgtcgacgtaaaggtcgggttatccacggtgtgattctgttggataagccgacaggtatctcttccaacgacgctttgcaaaaggttaaacgcctctatggcgctgaaaaagcgggacatactggcgcgcttgatcctctggcgacgggcatgttgccaatctgcctcggtgaagccactaagttttcccaatttctgctcgattctgataaacgttatcgtgtgatcgccaaattgggtgaacgtaccgacacctcagattctgatggtcaagtggtacaaacgcgtcctgttcacgtggattacgatacgctgctggcctgtatcgccaagtttcgcggtgaaacggatcaagttccatccatgttttcagcgttgaaataccaaggtcgtccactctacgaatacgcccgtcagggtattgaagtgccgcgtgaagcgcgcaagatcactgtgtatgagattgagctgcatcgctttgaaggtgatgaagtggagatggaagtacactgctcgaaaggcacttatattcgtaccatagtcgatgatctgggtgaaatgctgggctgtggagcgcatgtgaccatgctgcgccgtgtgggtgtcgctaactatccgtatgagcgaatggtgacgctagagcaactcaacgctttggttgaacaagcccatcgtgacgaaaaagcggtggcggacgttctcgatccgctattactgccgatggatactgccgtggaagctttacccgaagtcaacgtgatcccagaactgatgacacttattcagcatgggcaagcagtacaggtttcgggggcaccatccgacggtatggtgcgcattactggcggcgagcagaagctattccttggcgttggcgagattgacgataacggtaaggtcgcgccgaaacgcttggtggtgtacggcgaataa

SEQ ID NO: 46289 - protein, 312 aa, Vibrio cholerae
MARRRKGRVIHGVILLDKPTGISSNDALQKVKRLYGAEKAGHTGALDPLATGMLPICLGEATKFSQFLLDSDKRYRVIAKLGERTDTSDSDGQVVQTRPVHVDYDTLLACIAKFRGETDQVPSMFSALKYQGRPLYEYARQGIEVPREARKITVYEIELHRFEGDEVEMEVHCSKGTYIRTIVDDLGEMLGCGAHVTMLRRVGVANYPYERMVTLEQLNALVEQAHRDEKAVADVLDPLLLPMDTAVEALPEVNVIPELMTLIQHGQAVQVSGAPSDGMVRITGGEQKLFLGVGEIDDNGKVAPKRLVVYGE

SEQ ID NO: 46290 - DNA, 984 bp, Wigglesworthia glossinidia brevipalpis
  CDS (1)..(984)
atgatttatttaataataatattgttaaaatttcaaaaaaatctatatgatttattatattctgtgattataaaagaagattacttaagaaatataaatggaatacttttattagacaaaccaataggtttatcttctaacttgattttacaaaaaataaaaaaattatttaaagcaaaaaaagcaggatacattggcacattagatcctatagcatccggaatgcttcctatatttttcggagatgcaacaaaattttctgattatttgttaaacactaataaatggtacaaaataaaagcaaaattaggagaaaaaactaatactttagattcttttggaaaaataatatgtataaggccaattttaaacataaaaaaacttaatatagaaaaaatattatcagaatttcaaggagaaatatatcaaaagcctccaatgttttcttcattaaaacacctaggaaaacctctttataaatatgctagacaaggaatttatataccaagagaaaaaagaaaagtgtacgtacattatataaaattattgagtttttcaaaaaaatatttttctttaacaattaaatgttctaaaggaacttatgttaggagtatagttgatgatataggagaaaaattgttttgtggggctcatatagtaaaattaagaagaacaaaattatttaattataaagaatcacatatgattgattctaataaattatataacataaaaaaaaaatttaatgatttaaaaaaattagatgaatgtttacttccaattgaatctatatttaaaaaattacctattattgttgttaatgatgatataataaatagattaagaaatggtataaaattaaatttttggaaaataaaaaaaaataatttatttaaaattatatcaaaagatacaaaaaagtttgttggaattatagatattaataaatatggacgagctaattctattaaattaattaaataa

SEQ ID NO: 46291 - protein, 327 aa, Wigglesworthia glossinidia brevipalpis
MIYLIIILLKFQKNLYDLLYSVIIKEDYLRNINGILLLDKPIGLSSNLILQKIKKLFKAKKAGYIGTLDPIASGMLPIFFGDATKFSDYLLNTNKWYKIKAKLGEKTNTLDSFGKIICIRPILNIKKLNIEKILSEFQGEIYQKPPMFSSLKHLGKPLYKYARQGIYIPREKRKVYVHYIKLLSFSKKYFSLTIKCSKGTYVRSIVDDIGEKLFCGAHIVKLRRTKLFNYKESHMIDSNKLYNIKKKFNDLKKLDECLLPIESIFKKLPIIVVNDDIINRLRNGIKLNFWKIKKNNLFKIISKDTKKFVGIIDINKYGRANSIKLIK

SEQ ID NO: 46292 - DNA, 876 bp, Wolinella succinogenes
  CDS (1)..(876)
ttggaagcaaataaagggaaattttatcatgaaacaggaggagaatctttgaagcctaacgccctttttgtcggttacaaaccgatgttcatgagctctaaccactatctccagcgcctcaagcggcgctttggggtcaaaaaagcgggatatagcgggacgcttgatccttttgccaaaggggttctagtcgtggcatttgggcactatacgagactatttgatcatctcaatcaagagcctaaggtttatagggcgaccttgtggctggggcttcatagcgattctttggacattgagaatatcttgggggtggaggtgattcctccctattccaaagagagagtggaagagataatgggtgctttggagggggaaatcagctacactcctcccaaatattgcgccaagagaattggcggcaggagggcgtatgatatggcgcgcaacaaagaagaggtggagcttccaatcctcacgatgagggtgggcagactctcgctgctccactacacgcatccttttgtccattttgaggcggaggtgagcaaaggctcttatatccgaagccttggggggatgatcgcctctagacttggatgttatggtgcactctctagtctagagcgtctaagtgaaggggagatgcgctttgagggctacagagagctagagccgctagagattctcccctatccaaaaattgatgccacctctttaaaggaggagtttcttcatgggaagaagcttttagcaagcgatcttggaaatcctaaagagggcaagtatatagcggaatttgaggaatttttctctataattgaaatcaaagagggacaggtcgtctatttgctcaataggatggaaaaatgctga

SEQ ID NO: 46293 - protein, 291 aa, Wolinella succinogenes
MEANKGKFYHETGGESLKPNALFVGYKPMFMSSNHYLQRLKRRFGVKKAGYSGTLDPFAKGVLVVAFGHYTRLFDHLNQEPKVYRATLWLGLHSDSLDIENILGVEVIPPYSKERVEEIMGALEGEISYTPPKYCAKRIGGRRAYDMARNKEEVELPILTMRVGRLSLLHYTHPFVHFEAEVSKGSYIRSLGGMIASRLGCYGALSSLERLSEGEMRFEGYRELEPLEILPYPKIDATSLKEEFLHGKKLLASDLGNPKEGKYIAEFEEFFSIIEIKEGQVVYLLNRMEKC

SEQ ID NO: 46294 - DNA, 927 bp, Xanthomonas campestris
  CDS (1)..(927)
gtgagaccccgcatcaccttccgtccgctgcatggcattttgttgctcgacaagccggccggactcagctcgaacaatgcactgcaggccgcccgccggctgctgcgtgccgagaagggcggccacaccggcagcctggatccgctggccaccggcctgctgccgttgtgctttggcgaggccaccaagattgccggcctgttgctgggctcggccaaggcctacgacgccgagatcgtgctgggcgtcaccaccgataccgacgatgccgatgggcagccgctgcgtgagcgctcggtacctgcgctcagcgaggctgcattgcaggcggcgctggcgccgttcatcggccgcatccagcagcaggcgccgatctattcggcgctcaagcagggcggcgagccgctgtacgccaaggcgcgccgtggcgaggtcatcgaggcgccggtgcgcgaggtcgaggtgcatgccatcacgttgaccagctatgcgtcgccgcggttgcggttgcgcgtgacctgcggctccggcacctatatccgtagcctggcgcgcgaccttggcgaggtgctgggctgtggcgcgcacatcgccgcgctgcgccgcgtgtgggtggagccgttccgcacgccagagatgatcaccctggaagcgctcaccgcgctggtcgaatccggcgccgatgcggcgcaattgctgctgccagtggccgccgggctgagcgattttgcgcagatcacgctcgacgccaccttggcggcgcgctttcgcatggggcagcggttgcgcgatccggcattcccggaagggcaggttgcggtgttcgatgcggacggcagcccagccgggctgggccttgtcgacgcggacggacggctgtcgccgcagcgcctattcaacggtctgaacgccgctgcagcttgttaa

SEQ ID NO: 46295 - protein, 308 aa, Xanthomonas campestris
MRPRITFRPLHGILLLDKPAGLSSNNALQAARRLLRAEKGGHTGSLDPLATGLLPLCFGEATKIAGLLLGSAKAYDAEIVLGVTTDTDDADGQPLRERSVPALSEAALQAALAPFIGRIQQQAPIYSALKQGGEPLYAKARRGEVIEAPVREVEVHAITLTSYASPRLRLRVTCGSGTYIRSLARDLGEVLGCGAHIAALRRVWVEPFRTPEMITLEALTALVESGADAAQLLLPVAAGLSDFAQITLDATLAARFRMGQRLRDPAFPEGQVAVFDADGSPAGLGLVDADGRLSPQRLFNGLNAAAAC

SEQ ID NO: 46296 - DNA, 930 bp, Yersinia enterocolitica
  CDS (1)..(930)
atgggtcgtccacgtcgtcgcggccgtgacattaacggcgttctgttattggataagccgctgggcctctcctctaatgatgttttgcagaaagtaaaacgtctctttagcgcaaaccgcgcaggccataccggtgcactcgatccattggcgaccggtatgttacctatctgtttgggtgaagcgaccaagttttcccaatttttgctcgattcagataagcgctatcgagtggttgcccgtttaggtcaacgcacaaatacctcacatgccgaaggcgcattaatcagcgagcgtgaagatatatgtcatacaggcacagatgatgccgcgttggacagtcaccgtggtagtagccagcaggtgccatccatgtattctgcgctgaagcatcaaggcaaaccgctgtatgaatatgctcgccaagggattgaagttgatcgtgaagcgcgcagtattactgtgtatgaactgctgtttatccgctgggaaggtaatgacctggaactggaaatccactgttccaaaggcacttatattcgtaccattattgatgatttaggtgaattactggggtgcggcgcacatgtgagttatctgcgtcggttgcaagttgcgacttatccaagtgaccgcatggtgacgttggaacagttgacggcaatcgttgaaacagcgcaagcagaagagcggtcgccaaatgctgaactggatgcgttgctattaccgatggatagtgcggtattaaacttccctgaagtcaatctgttacctactgttgcggcctatgtgaaacaagggcaaccagtacatgtagcgggagctcctggtgaaggaatggtccgtatcactgaaggtgaagagcgtaatttcattggtattggcacgattgctgaagatggcgcgttgcaccgaaacgcttggttgtag

SEQ ID NO: 46297 - protein, 309 aa, Yersinia enterocolitica
MGRPRRRGRDINGVLLLDKPLGLSSNDVLQKVKRLFSANRAGHTGALDPLATGMLPICLGEATKFSQFLLDSDKRYRVVARLGQRTNTSHAEGALISEREDICHTGTDDAALDSHRGSSQQVPSMYSALKHQGKPLYEYARQGIEVDREARSITVYELLFIRWEGNDLELEIHCSKGTYIRTIIDDLGELLGCGAHVSYLRRLQVATYPSDRMVTLEQLTAIVETAQAEERSPNAELDALLLPMDSAVLNFPEVNLLPTVAAYVKQGQPVHVAGAPGEGMVRITEGEERNFIGIGTIAEDGALHRNAWL

SEQ ID NO: 46298 - DNA, 975 bp, Yersinia pestis
  CDS (1)..(975)
atggggcgtccacgtcgtcgcggccgtgacattaacggcgttttgctattggataagccgctaggcctctcttctaatgacgttttgcaaaaagtaaaacgtctctttagcgctaatcgcgctggtcacacgggtgctcttgatccattagcaaccggtatgttgcctatttgtctgggcgaagcaactaagttttctcaattcttactcgattcagataaacgttaccgagtggttgctcggctggggcaacgcacggatacctcagatgcggaaggtgcgttaatcagtgagcgtgaggtcaatcttactcaagctcagatcgatactgcactggagagtttccgcggtgaaagccagcagatcccctccatgtattctgcattgaaacatcaaggtaagcctctttacgaatatgcccgtcaggggattgaagtcgaacgtgaagctcgcagcattacggtttacgagttgctcttcatccgttgggaaggcaatgatctggaactggaaattcactgttcgaaaggaacgtacattcgtaccatcatcgatgacttgggtgaattattgggttgcggcgcacatgtcagttatctgcgtcgcttgcaggttgcgacttacccgagcgaacggatggtgaccctagagcagttaacggcgatggttgaggctgcgcaggcagagggacgctcgccaaatccagaactggattcgctgttattgccgatggacagtgccgttcttaattttcctgaagtcaatctgttaccttccgtggccgcttatgtaaaacaggggcaaccggtgcatgtgtcaggtgctcccagtgaaggaatggtccgaatcactgaaggtaaagagcgtaatttcattggtattggtactatcgcagaagatggccgcgttgcccctaaacgtttggttgtggaaagcgtggaagtagaaaatctgccagtagaaaataaaaagtag

SEQ ID NO: 46299 - protein, 324 aa, Yersinia pestis
MGRPRRRGRDINGVLLLDKPLGLSSNDVLQKVKRLFSANRAGHTGALDPLATGMLPICLGEATKFSQFLLDSDKRYRVVARLGQRTDTSDAEGALISEREVNLTQAQIDTALESFRGESQQIPSMYSALKHQGKPLYEYARQGIEVEREARSITVYELLFIRWEGNDLELEIHCSKGTYIRTIIDDLGELLGCGAHVSYLRRLQVATYPSERMVTLEQLTAMVEAAQAEGRSPNPELDSLLLPMDSAVLNFPEVNLLPSVAAYVKQGQPVHVSGAPSEGMVRITEGKERNFIGIGTIAEDGRVAPKRLVVESVEVENLPVENKK

SEQ ID NO: 46300 - DNA, 21 bp, Primer
atgagtcgtcctcgtcgtcgc

SEQ ID NO: 46301 - DNA, 22 bp, Primer
ttacgccgggtattcaaccacc

SEQ ID NO: 46302 - protein, 384 aa, consensus
  MISC_FEATURE (1)..(384): consensus for the disclosure of xaa see table XV
GXXXXXKPXGXXSXXXXXXXXXXXXXXXXXXXXXXXXXXXXXXXXXXXXXXXXXXXXXXXXXXXXXXGHXGTLDPXXXGXLXXXXGXATXXXXXXXXXXXKXYXXXXXXGXXXXXXDXXGXXXXXXXXXXXXXXXXXXXXXXXXXXXXXXGXXXQXPPXXSAXXXXGXXXYXXARXGXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCXXGTYXRXLXXDXGXXLGXXXXXXXXLXRXXXXXXXXXXXXXXXXXXXXXXXXXXXXXXXXXXXXXXXXXXXXXXXXXXXXXXXXXXXXXXXXXXXXXXXXXXG

SEQ ID NO: 46303 - protein, 71 aa, consensus
  MISC_FEATURE (1)..(71): consensus for the disclosure of xaa see table XV
XXXXXXKXXXXXXXXXXXXXXXXXXXXXXXXXXXXXXXGXLDXXXXGXXXXXXXXXXXXXXXXXXXXXKXY

SEQ ID NO: 46304 - protein, 26 aa, consensus
  MISC_FEATURE (1)..(26): consensus for the disclosure of xaa see table XV
GXYXRXXXXXXXXXXXXXXXXXXLXR

SEQ ID NO: 46305 - DNA, 927 bp, Escherichia coli K12; identical to SEQ ID NO: 27377
  CDS (1)..(927)

SEQ ID NO: 46306 - protein, 308 aa, Escherichia coli K12; identical to SEQ ID NO: 27378

SEQ ID NO: 46307 - DNA, 1017 bp, Archaeoglobus fulgidus; identical to SEQ ID NO: 27379
  CDS (1)..(1017)

SEQ ID NO: 46308 - protein, 338 aa, Archaeoglobus fulgidus; identical to SEQ ID NO: 27380

SEQ ID NO: 46309 - DNA, 894 bp, Archaeoglobus fulgidus; identical to SEQ ID NO: 27381
  CDS (1)..(894)

SEQ ID NO: 46310 - protein, 297 aa, Archaeoglobus fulgidus; identical to SEQ ID NO: 27382

SEQ ID NO: 46311 - DNA, 1278 bp, Pseudomonas aeruginosa; identical to SEQ ID NO: 27383
  CDS (1)..(1278)

SEQ ID NO: 46312 - protein, 425 aa, Pseudomonas aeruginosa; identical to SEQ ID NO: 27384

SEQ ID NO: 46313 - DNA, 957 bp, Streptococcus pneumoniae; identical to SEQ ID NO: 27385
  CDS (1)..(957)

SEQ ID NO: 46314 - protein, 318 aa, Streptococcus pneumoniae; identical to SEQ ID NO: 27386

SEQ ID NO: 46315 - DNA, 999 bp, Brucella melitensis; identical to SEQ ID NO: 27387
  CDS (1)..(999)

SEQ ID NO: 46316 - protein, 332 aa, Brucella melitensis; identical to SEQ ID NO: 27388

SEQ ID NO: 46317 - DNA, 942 bp, Agrobacterium tumefaciens; identical to SEQ ID NO: 27389
  CDS (1)..(942)

SEQ ID NO: 46318 - protein, 313 aa, Agrobacterium tumefaciens; identical to SEQ ID NO: 27390

SEQ ID NO: 46319 - DNA, 897 bp, Agrobacterium tumefaciens; identical to SEQ ID NO: 27391
  CDS (1)..(897)

SEQ ID NO: 46320 - protein, 298 aa, Agrobacterium tumefaciens; identical to SEQ ID NO: 27392

SEQ ID NO: 46321 - DNA, 1035 bp, Agrobacterium tumefaciens; identical to SEQ ID NO: 27393
  CDS (1)..(1035)

SEQ ID NO: 46322 - protein, 344 aa, Agrobacterium tumefaciens; identical to SEQ ID NO: 27394

SEQ ID NO: 46323 - DNA, 864 bp, Brucella melitensis; identical to SEQ ID NO: 27395
  CDS (1)..(864)

SEQ ID NO: 46324 - protein, 287 aa, Brucella melitensis; identical to SEQ ID NO: 27396

SEQ ID NO: 46325 - DNA, 924 bp, Brucella melitensis; identical to SEQ ID NO: 27397
  CDS (1)..(924)

SEQ ID NO: 46326 - protein, 307 aa, Brucella melitensis; identical to SEQ ID NO: 27398

SEQ ID NO: 46327 - DNA, 927 bp, Yersinia pestis; identical to SEQ ID NO: 27399
  CDS (1)..(927)

SEQ ID NO: 46328 - protein, 308 aa, Yersinia pestis; identical to SEQ ID NO: 27400

SEQ ID NO: 46329 - DNA, 867 bp, Nostoc sp. PCC 7120; identical to SEQ ID NO: 27401
  CDS (1)..(867)

SEQ ID NO: 46330 - protein, 288 aa, Nostoc sp. PCC 7120; identical to SEQ ID NO: 27402

SEQ ID NO: 46331 - DNA, 951 bp, Nostoc sp. PCC 7120; identical to SEQ ID NO: 27403
  CDS (1)..(951)

SEQ ID NO: 46332 - protein, 316 aa, Nostoc sp. PCC 7120; identical to SEQ ID NO: 27404

SEQ ID NO: 46333 - DNA, 903 bp, Agrobacterium tumefaciens; identical to SEQ ID NO: 27405
  CDS (1)..(903)

SEQ ID NO: 46334 - protein, 300 aa, Agrobacterium tumefaciens; identical to SEQ ID NO: 27406

SEQ ID NO: 46335 - DNA, 924 bp, Pseudomonas aeruginosa; identical to SEQ ID NO: 27407
  CDS (1)..(924)

SEQ ID NO: 46336 - protein, 307 aa, Pseudomonas aeruginosa; identical to SEQ ID NO: 27408

SEQ ID NO: 46337 - DNA, 798 bp, Aeropyrum pernix; identical to SEQ ID NO: 27409
  CDS (1)..(798)

SEQ ID NO: 46338 - protein, 265 aa, Aeropyrum pernix; identical to SEQ ID NO: 27410

SEQ ID NO: 46339 - DNA, 885 bp, Aeropyrum pernix; identical to SEQ ID NO: 27411
  CDS (1)..(885)

SEQ ID NO: 46340 - protein, 294 aa, Aeropyrum pernix; identical to SEQ ID NO: 27412

SEQ ID NO: 46341 - DNA, 1065 bp, Aeropyrum pernix; identical to SEQ ID NO: 27413
  CDS (1)..(1065)

SEQ ID NO: 46342 - protein, 354 aa, Aeropyrum pernix; identical to SEQ ID NO: 27414

SEQ ID NO: 46343 - DNA, 1047 bp, Deinococcus radiodurans; identical to SEQ ID NO: 27415
  CDS (1)..(1047)

SEQ ID NO: 46344 - protein, 348 aa, Deinococcus radiodurans; identical to SEQ ID NO: 27416

SEQ ID NO: 46345 - DNA, 918 bp, Pseudomonas aeruginosa; identical to SEQ ID NO: 27417
  CDS (4)..(918)

SEQ ID NO: 46346 - protein, 304 aa, Pseudomonas aeruginosa; identical to SEQ ID NO: 27418

SEQ ID NO: 46347 - DNA, 954 bp, Pseudomonas aeruginosa; identical to SEQ ID NO: 27419
  CDS (1)..(954)

SEQ ID NO: 46348 - protein, 317 aa, Pseudomonas aeruginosa; identical to SEQ ID NO: 27420

SEQ ID NO: 46349 - DNA, 894 bp, Bacillus halodurans; identical to SEQ ID NO: 27421
  CDS (1)..(894)

SEQ ID NO: 46350 - protein, 297 aa, Bacillus halodurans; identical to SEQ ID NO: 27422

SEQ ID NO: 46351 - DNA, 1254 bp, Pseudomonas aeruginosa; identical to SEQ ID NO: 27423
  CDS (1)..(1254)

SEQ ID NO: 46352 - protein, 417 aa, Pseudomonas aeruginosa; identical to SEQ ID NO: 27424

SEQ ID NO: 46353 - DNA, 936 bp, Agrobacterium tumefaciens; identical to SEQ ID NO: 27425
  CDS (1)..(936)

SEQ ID NO: 46354 - protein, 311 aa, Agrobacterium tumefaciens; identical to SEQ ID NO: 27426

SEQ ID NO: 46355 - DNA, 948 bp, Methanococcus jannaschii; identical to SEQ ID NO: 27427
  CDS (1)..(948)

SEQ ID NO: 46356 - protein, 315 aa, Methanococcus jannaschii; identical to SEQ ID NO: 27428

SEQ ID NO: 46357 - DNA, 900 bp, Thermotoga maritima; identical to SEQ ID NO: 27429
  CDS (1)..(900)

SEQ ID NO: 46358 - protein, 299 aa, Thermotoga maritima; identical to SEQ ID NO: 27430

SEQ ID NO: 46359 - DNA, 1614 bp, Sinorhizobium meliloti; identical to SEQ ID NO: 27431
  CDS (1)..(1614)

SEQ ID NO: 46360 - protein, 537 aa, Sinorhizobium meliloti; identical to SEQ ID NO: 27432

SEQ ID NO: 46361 - DNA, 1080 bp, Thermotoga maritima; identical to SEQ ID NO: 27433
  CDS (1)..(1080)

SEQ ID NO: 46362 - protein, 359 aa, Thermotoga maritima; identical to SEQ ID NO: 27434

SEQ ID NO: 46363 - DNA, 858 bp, Deinococcus radiodurans; identical to SEQ ID NO: 27435
  CDS (1)..(858)

SEQ ID NO: 46364 - protein, 285 aa, Deinococcus radiodurans; identical to SEQ ID NO: 27436

SEQ ID NO: 46365 - DNA, 1053 bp, Campylobacter jejuni; identical to SEQ ID NO: 27437
  CDS (1)..(1053)

SEQ ID NO: 46366 - protein, 350 aa, Campylobacter jejuni; identical to SEQ ID NO: 27438

SEQ ID NO: 46367 - DNA, 918 bp, Sulfolobus solfataricus; identical to SEQ ID NO: 27439
  CDS (1)..(918)

SEQ ID NO: 46368 - protein, 305 aa, Sulfolobus solfataricus; identical to SEQ ID NO: 27440

SEQ ID NO: 46369 - DNA, 1050 bp, Deinococcus radiodurans; identical to SEQ ID NO: 27441
  CDS (1)..(1050)

SEQ ID NO: 46370 - protein, 349 aa, Deinococcus radiodurans; identical to SEQ ID NO: 27442

SEQ ID NO: 46371 - DNA, 903 bp, Deinococcus radiodurans; identical to SEQ ID NO: 27443
  CDS (1)..(903)

SEQ ID NO: 46372 - protein, 300 aa, Deinococcus radiodurans; identical to SEQ ID NO: 27444

SEQ ID NO: 46373 - DNA, 897 bp, Campylobacter jejuni; identical to SEQ ID NO: 27445
  CDS (1)..(897)

SEQ ID NO: 46374 - protein, 298 aa, Campylobacter jejuni; identical to SEQ ID NO: 27446

SEQ ID NO: 46375 - DNA, 939 bp, Archaeoglobus fulgidus; identical to SEQ ID NO: 27447
  CDS (1)..(939)

SEQ ID NO: 46376 - protein, 312 aa, Archaeoglobus fulgidus; identical to SEQ ID NO: 27448

SEQ ID NO: 46377 - DNA, 1071 bp, Deinococcus radiodurans; identical to SEQ ID NO: 27449
  CDS (1)..(1071)

SEQ ID NO: 46378 - protein, 356 aa, Deinococcus radiodurans; identical to SEQ ID NO: 27450

SEQ ID NO: 46379 - DNA, 864 bp, Sinorhizobium meliloti; identical to SEQ ID NO: 27451
  CDS (1)..(864)

SEQ ID NO: 46380 - protein, 287 aa, Sinorhizobium meliloti; identical to SEQ ID NO: 27452

SEQ ID NO: 46381 - DNA, 855 bp, Archaeoglobus fulgidus; identical to SEQ ID NO: 27453
  CDS (1)..(855)

SEQ ID NO: 46382 - protein, 284 aa, Archaeoglobus fulgidus; identical to SEQ ID NO: 27454

SEQ ID NO: 46383 - DNA, 972 bp, Archaeoglobus fulgidus; identical to SEQ ID NO: 27455
  CDS (1)..(972)

SEQ ID NO: 46384 - protein, 323 aa, Archaeoglobus fulgidus; identical to SEQ ID NO: 27456

SEQ ID NO: 46385 - DNA, 870 bp, Streptococcus pneumoniae; identical to SEQ ID NO: 27457
  CDS (1)..(870)

SEQ ID NO: 46386 - protein, 289 aa, Streptococcus pneumoniae; identical to SEQ ID NO: 27458

SEQ ID NO: 46387 - DNA, 888 bp, Agrobacterium tumefaciens; identical to SEQ ID NO: 27459
  CDS (1)..(888)

SEQ ID NO: 46388 - protein, 295 aa, Agrobacterium tumefaciens; identical to SEQ ID NO: 27460

SEQ ID NO: 46389 - DNA, 1278 bp, Escherichia coli; identical to SEQ ID NO: 27461
  CDS (1)..(1278)

SEQ ID NO: 46390 - protein, 425 aa, Escherichia coli; identical to SEQ ID NO: 27462

SEQ ID NO: 46391 - DNA, 861 bp, Synechocystis sp; identical to SEQ ID NO: 27463
  CDS (1)..(861)

SEQ ID NO: 46392 - protein, 286 aa, Synechocystis sp; identical to SEQ ID NO: 27464

SEQ ID NO: 46393 - DNA, 1167 bp, Synechocystis sp; identical to SEQ ID NO: 27465
  CDS (1)..(1167)

SEQ ID NO: 46394 - protein, 388 aa, Synechocystis sp; identical to SEQ ID NO: 27466

SEQ ID NO: 46395 - DNA, 1233 bp, Synechocystis sp; identical to SEQ ID NO: 27467
  CDS (1)..(1233)

SEQ ID NO: 46396 - protein, 410 aa, Synechocystis sp; identical to SEQ ID NO: 27468

SEQ ID NO: 46397 - DNA, 933 bp, Streptomyces coelicolor; identical to SEQ ID NO: 27469
  CDS (1)..(933)

SEQ ID NO: 46398 - protein, 310 aa, Streptomyces coelicolor; identical to SEQ ID NO: 27470

SEQ ID NO: 46399 - DNA, 861 bp, Rhodopseudomonas palustris; identical to SEQ ID NO: 27471
  CDS (1)..(861)

SEQ ID NO: 46400 - protein, 286 aa, Rhodopseudomonas palustris; identical to SEQ ID NO: 27472

SEQ ID NO: 46401 - DNA, 918 bp, Methylophilus methylotrophus; identical to SEQ ID NO: 27473
  CDS (1)..(918)

SEQ ID NO: 46402 - protein, 305 aa, Methylophilus methylotrophus; identical to SEQ ID NO: 27474

SEQ ID NO: 46403 - DNA, 1845 bp, Pseudomonas aeruginosa; identical to SEQ ID NO: 27475
  CDS (1)..(1845)

SEQ ID NO: 46404 - protein, 614 aa, Pseudomonas aeruginosa; identical to SEQ ID NO: 27476

SEQ ID NO: 46405 - DNA, 1860 bp, Symbiobacterium thermophilum; identical to SEQ ID NO: 27477
  CDS (1)..(1860)

SEQ ID NO: 46406 - protein, 619 aa, Symbiobacterium thermophilum; identical to SEQ ID NO: 27478

SEQ ID NO: 46407 - DNA, 1050 bp, Symbiobacterium thermophilum; identical to SEQ ID NO: 27479
  CDS (1)..(1050)

SEQ ID NO: 46408 - protein, 349 aa, Symbiobacterium thermophilum; identical to SEQ ID NO: 27480

SEQ ID NO: 46409 - DNA, 870 bp, Symbiobacterium thermophilum; identical to SEQ ID NO: 27481
  CDS (1)..(870)

SEQ ID NO: 46410 - protein, 289 aa, Symbiobacterium thermophilum; identical to SEQ ID NO: 27482

SEQ ID NO: 46411 - DNA, 1026 bp, Symbiobacterium thermophilum; identical to SEQ ID NO: 27483
  CDS (1)..(1026)

SEQ ID NO: 46412 - protein, 341 aa, Symbiobacterium thermophilum; identical to SEQ ID NO: 27484

SEQ ID NO: 46413 - DNA, 1068 bp, Desulfotalea psychrophila; identical to SEQ ID NO: 27485
  CDS (1)..(1068)

SEQ ID NO: 46414 - protein, 355 aa, Desulfotalea psychrophila; identical to SEQ ID NO: 27486

SEQ ID NO: 46415 - DNA, 891 bp, Desulfotalea psychrophila; identical to SEQ ID NO: 27487
  CDS (1)..(891)

SEQ ID NO: 46416 - protein, 296 aa, Desulfotalea psychrophila; identical to SEQ ID NO: 27488

SEQ ID NO: 46417 - DNA, 882 bp, Acinetobacter sp; identical to SEQ ID NO: 27489
  CDS (1)..(882)

SEQ ID NO: 46418 - protein, 293 aa, Acinetobacter sp; identical to SEQ ID NO: 27490

SEQ ID NO: 46419 - DNA, 1647 bp, Acinetobacter sp; identical to SEQ ID NO: 27491
  CDS (1)..(1647)

SEQ ID NO: 46420 - protein, 548 aa, Acinetobacter sp; identical to SEQ ID NO: 27492

SEQ ID NO: 46421 - DNA, 1059 bp, Bartonella quintana; identical to SEQ ID NO: 27493
  CDS (1)..(1059)

SEQ ID NO: 46422 - protein, 352 aa, Bartonella quintana; identical to SEQ ID NO: 27494

SEQ ID NO: 46423 - DNA, 1065 bp, Bartonella quintana; identical to SEQ ID NO: 27495
  CDS (1)..(1065)

SEQ ID NO: 46424 - protein, 354 aa, Bartonella quintana; identical to SEQ ID NO: 27496

SEQ ID NO: 46425 - DNA, 1065 bp, Bartonella henselae; identical to SEQ ID NO: 27497
  CDS (1)..(1065)

SEQ ID NO: 46426 - protein, 354 aa, Bartonella henselae; identical to SEQ ID NO: 27498

SEQ ID NO: 46427 - DNA, 1059 bp, Bartonella henselae; identical to SEQ ID NO: 27499
  CDS (1)..(1059)

SEQ ID NO: 46428 - protein, 352 aa, Bartonella henselae; identical to SEQ ID NO: 27500

SEQ ID NO: 46429 - DNA, 861 bp, Bacillus thuringiensis; identical to SEQ ID NO: 27501
  CDS (1)..(861)

SEQ ID NO: 46430 - protein, 286 aa, Bacillus thuringiensis; identical to SEQ ID NO: 27502

SEQ ID NO: 46431 - DNA, 972 bp, Bdellovibrio bacteriovorus; identical to SEQ ID NO: 27503
  CDS (1)..(972)

SEQ ID NO: 46432 - protein, 323 aa, Bdellovibrio bacteriovorus; identical to SEQ ID NO: 27504

SEQ ID NO: 46433 - DNA, 903 bp, Bdellovibrio bacteriovorus; identical to SEQ ID NO: 27505
  CDS (1)..(903)

SEQ ID NO: 46434 - protein, 300 aa, Bdellovibrio bacteriovorus; identical to SEQ ID NO: 27506

SEQ ID NO: 46435 - DNA, 1068 bp, Rhodopseudomonas palustris; identical to SEQ ID NO: 27507
  CDS (1)..(1068)

SEQ ID NO: 46436 - protein, 355 aa, Rhodopseudomonas palustris; identical to SEQ ID NO: 27508

SEQ ID NO: 46437 - DNA, 939 bp, Rhodopseudomonas palustris; identical to SEQ ID NO: 27509
  CDS (1)..(939)

SEQ ID NO: 46438 - protein, 312 aa, Rhodopseudomonas palustris; identical to SEQ ID NO: 27510

SEQ ID NO: 46439 - DNA, 948 bp, Rhodopseudomonas palustris; identical to SEQ ID NO: 27511
  CDS (1)..(948)

SEQ ID NO: 46440 - protein, 315 aa, Rhodopseudomonas palustris; identical to SEQ ID NO: 27512

SEQ ID NO: 46441 - DNA, 948 bp, Rhodopseudomonas palustris; identical to SEQ ID NO: 27513
  CDS (1)..(948)

SEQ ID NO: 46442 - protein, 315 aa, Rhodopseudomonas palustris; identical to SEQ ID NO: 27514

SEQ ID NO: 46443 - DNA, 873 bp, Rhodopseudomonas palustris; identical to SEQ ID NO: 27515
  CDS (1)..(873)

SEQ ID NO: 46444 - protein, 290 aa, Rhodopseudomonas palustris; identical to SEQ ID NO: 27516

SEQ ID NO: 46445 - DNA, 918 bp, Rhodopseudomonas palustris; identical to SEQ ID NO: 27517
  CDS (1)..(918)

SEQ ID NO: 46446 - protein, 305 aa, Rhodopseudomonas palustris; identical to SEQ ID NO: 27518

SEQ ID NO: 46447 - DNA, 1614 bp, Rhodopseudomonas palustris; identical to SEQ ID NO: 27519
  CDS (1)..(1614)

SEQ ID NO: 46448 - protein, 537 aa, Rhodopseudomonas palustris; identical to SEQ ID NO: 27520

SEQ ID NO: 46449 - DNA, 1008 bp, Rhodopseudomonas palustris; identical to SEQ ID NO: 27521
  CDS (1)..(1008)

SEQ ID NO: 46450 - protein, 335 aa, Rhodopseudomonas palustris; identical to SEQ ID NO: 27522

SEQ ID NO: 46451 - DNA, 873 bp, Rhodopseudomonas palustris; identical to SEQ ID NO: 27523
  CDS (1)..(873)

SEQ ID NO: 46452 - protein, 290 aa, Rhodopseudomonas palustris; identical to SEQ ID NO: 27524

SEQ ID NO: 46453 - DNA, 876 bp, Rhodopseudomonas palustris; identical to SEQ ID NO: 27525
  CDS (1)..(876)

SEQ ID NO: 46454 - protein, 291 aa, Rhodopseudomonas palustris; identical to SEQ ID NO: 27526

SEQ ID NO: 46455 - DNA, 1041 bp, Rhodopseudomonas palustris; identical to SEQ ID NO: 27527
  CDS (1)..(1041)

SEQ ID NO: 46456 - protein, 346 aa, Rhodopseudomonas palustris; identical to SEQ ID NO: 27528

SEQ ID NO: 46457 - DNA, 1773 bp, Rhodopseudomonas palustris; identical to SEQ ID NO: 27529
  CDS (1)..(1773)

SEQ ID NO: 46458 - protein, 590 aa, Rhodopseudomonas palustris; identical to SEQ ID NO: 27530

SEQ ID NO: 46459 - DNA, 834 bp, Rhodopseudomonas palustris; identical to SEQ ID NO: 27531
  CDS (1)..(834)

SEQ ID NO: 46460 - protein, 277 aa, Rhodopseudomonas palustris; identical to SEQ ID NO: 27532

SEQ ID NO: 46461 - DNA, 876 bp, Rhodopseudomonas palustris; identical to SEQ ID NO: 27533
  CDS (1)..(876)

SEQ ID NO: 46462 - protein, 291 aa, Rhodopseudomonas palustris; identical to SEQ ID NO: 27534

SEQ ID NO: 46463 - DNA, 876 bp, Rhodopseudomonas palustris; identical to SEQ ID NO: 27535
  CDS (1)..(876)

SEQ ID NO: 46464 - protein, 291 aa, Rhodopseudomonas palustris; identical to SEQ ID NO: 27536

SEQ ID NO: 46465 - DNA, 864 bp, Rhodopseudomonas palustris; identical to SEQ ID NO: 27537
  CDS (1)..(864)

SEQ ID NO: 46466 - protein, 287 aa, Rhodopseudomonas palustris; identical to SEQ ID NO: 27538

SEQ ID NO: 46467 - DNA, 927 bp, Rhodopseudomonas palustris; identical to SEQ ID NO: 27539
  CDS (1)..(927)

SEQ ID NO: 46468 - protein, 308 aa, Rhodopseudomonas palustris; identical to SEQ ID NO: 27540

SEQ ID NO: 46469 - DNA, 873 bp, Rhodopseudomonas palustris; identical to SEQ ID NO: 27541
  CDS (1)..(873)

SEQ ID NO: 46470 - protein, 290 aa, Rhodopseudomonas palustris; identical to SEQ ID NO: 27542

SEQ ID NO: 46471 - DNA, 867 bp, Rhodopseudomonas palustris; identical to SEQ ID NO: 27543
  CDS (1)..(867)

SEQ ID NO: 46472 - protein, 288 aa, Rhodopseudomonas palustris; identical to SEQ ID NO: 27544

SEQ ID NO: 46473 - DNA, 870 bp, uncultured bacterium 582; identical to SEQ ID NO: 27545
  CDS (1)..(870)

SEQ ID NO: 46474 - protein, 289 aa, uncultured bacterium 582; identical to SEQ ID NO: 27546

SEQ ID NO: 46475 - DNA, 1254 bp, symbiont bacterium of Paederus fuscipes; identical to SEQ ID NO: 27547
  CDS (1)..(1254)

SEQ ID NO: 46476 - protein, 417 aa, symbiont bacterium of Paederus fuscipes; identical to SEQ ID NO: 27548

SEQ ID NO: 46477 - DNA, 879 bp, Alcaligenes eutrophus; identical to SEQ ID NO: 27549
  CDS (1)..(879)

SEQ ID NO: 46478 - protein, 292 aa, Alcaligenes eutrophus; identical to SEQ ID NO: 27550

SEQ ID NO: 46479 - DNA, 882 bp, Rhizobium sp; identical to SEQ ID NO: 27551
  CDS (1)..(882)

SEQ ID NO: 46480 - protein, 293 aa, Rhizobium sp; identical to SEQ ID NO: 27552

SEQ ID NO: 46481 - DNA, 921 bp, Desulfovibrio vulgaris; identical to SEQ ID NO: 27553
  CDS (1)..(921)

SEQ ID NO: 46482 - protein, 306 aa, Desulfovibrio vulgaris; identical to SEQ ID NO: 27554

SEQ ID NO: 46483 - DNA, 906 bp, Desulfovibrio vulgaris; identical to SEQ ID NO: 27555
  CDS (1)..(906)

SEQ ID NO: 46484 - protein, 301 aa, Desulfovibrio vulgaris; identical to SEQ ID NO: 27556

SEQ ID NO: 46485 - DNA, 1224 bp, Desulfovibrio vulgaris; identical to SEQ ID NO: 27557
  CDS (1)..(1224)

SEQ ID NO: 46486 - protein, 407 aa, Desulfovibrio vulgaris; identical to SEQ ID NO: 27558

SEQ ID NO: 46487 - DNA, 909 bp, Desulfovibrio vulgaris; identical to SEQ ID NO: 27559
  CDS (1)..(909)

SEQ ID NO: 46488 - protein, 302 aa, Desulfovibrio vulgaris; identical to SEQ ID NO: 27560

SEQ ID NO: 46489 - DNA, 969 bp, Thermus thermophilus; identical to SEQ ID NO: 27561
  CDS (1)..(969)

SEQ ID NO: 46490 - protein, 322 aa, Thermus thermophilus; identical to SEQ ID NO: 27562

SEQ ID NO: 46491 - DNA, 978 bp, Thermus thermophilus; identical to SEQ ID NO: 27563
  CDS (1)..(978)

SEQ ID NO: 46492 - protein, 325 aa, Thermus thermophilus; identical to SEQ ID NO: 27564

SEQ ID NO: 46493 - DNA, 858 bp, Thermus thermophilus; identical to SEQ ID NO: 27565
  CDS (1)..(858)

SEQ ID NO: 46494 - protein, 285 aa, Thermus thermophilus; identical to SEQ ID NO: 27566

SEQ ID NO: 46495 - DNA, 876 bp, Thermus thermophilus; identical to SEQ ID NO: 27567
  CDS (1)..(876)

SEQ ID NO: 46496 - protein, 291 aa, Thermus thermophilus; identical to SEQ ID NO: 27568

SEQ ID NO: 46497 - DNA, 1068 bp, Thermus thermophilus; identical to SEQ ID NO: 27569
  CDS (1)..(1068)

SEQ ID NO: 46498 - protein, 355 aa, Thermus thermophilus; identical to SEQ ID NO: 27570

SEQ ID NO: 46499 - DNA, 894 bp, Thermus thermophilus; identical to SEQ ID NO: 27571
  CDS (1)..(894)

SEQ ID NO: 46500 - protein, 297 aa, Thermus thermophilus; identical to SEQ ID NO: 27572

SEQ ID NO: 46501 - DNA, 861 bp, Bacillus cereus; identical to SEQ ID NO: 27573
  CDS (1)..(861)

SEQ ID NO: 46502 - protein, 286 aa, Bacillus cereus; identical to SEQ ID NO: 27574

SEQ ID NO: 46503 - DNA, 900 bp, Treponema denticola; identical to SEQ ID NO: 27575
  CDS (1)..(900)

SEQ ID NO: 46504 - protein, 299 aa, Treponema denticola; identical to SEQ ID NO: 27576

SEQ ID NO: 46505 - DNA, 1020 bp, Treponema denticola; identical to SEQ ID NO: 27577
  CDS (1)..(1020)

SEQ ID NO: 46506 - protein, 339 aa, Treponema denticola; identical to SEQ ID NO: 27578

SEQ ID NO: 46507 - DNA, 885 bp, Geobacter sulfurreducens; identical to SEQ ID NO: 27579
  CDS (1)..(885)

SEQ ID NO: 46508 - protein, 294 aa, Geobacter sulfurreducens; identical to SEQ ID NO: 27580

SEQ ID NO: 46509 - DNA, 1158 bp, Agrobacterium tumefaciens; identical to SEQ ID NO: 27581
  CDS (1)..(1158)

SEQ ID NO: 46510 - protein, 385 aa, Agrobacterium tumefaciens; identical to SEQ ID NO: 27582

SEQ ID NO: 46511 - DNA, 903 bp, Wolinella succinogenes; identical to SEQ ID NO: 27583
  CDS (1)..(903)

SEQ ID NO: 46512 - protein, 300 aa, Wolinella succinogenes; identical to SEQ ID NO: 27584

SEQ ID NO: 46513 - DNA, 1110 bp, Gloeobacter violaceus; identical to SEQ ID NO: 27585
  CDS (1)..(1110)

SEQ ID NO: 46514 - protein, 369 aa, Gloeobacter violaceus; identical to SEQ ID NO: 27586

SEQ ID NO: 46515 - DNA, 1170 bp, Gloeobacter violaceus; identical to SEQ ID NO: 27587
  CDS (1)..(1170)

SEQ ID NO: 46516 - protein, 389 aa, Gloeobacter violaceus; identical to SEQ ID NO: 27588

SEQ ID NO: 46517 - DNA, 1092 bp, Chromobacterium violaceum; identical to SEQ ID NO: 27589
  CDS (1)..(1092)

SEQ ID NO: 46518 - protein, 363 aa, Chromobacterium violaceum; identical to SEQ ID NO: 27590

SEQ ID NO: 46519 - DNA, 930 bp, Chromobacterium violaceum; identical to SEQ ID NO: 27591
  CDS (1)..(930)

SEQ ID NO: 46520 - protein, 309 aa, Chromobacterium violaceum; identical to SEQ ID NO: 27592

SEQ ID NO: 46521 - DNA, 1155 bp, Synechococcus sp; identical to SEQ ID NO: 27593
  CDS (1)..(1155)

SEQ ID NO: 46522 - protein, 384 aa, Synechococcus sp; identical to SEQ ID NO: 27594

SEQ ID NO: 46523 - DNA, 1155 bp, Prochlorococcus marinus subsp; identical to SEQ ID NO: 27595
  CDS (1)..(1155)

SEQ ID NO: 46524 - protein, 384 aa, Prochlorococcus marinus subsp; identical to SEQ ID NO: 27596

SEQ ID NO: 46525 - DNA, 1155 bp, Prochlorococcus marinus; identical to SEQ ID NO: 27597
  CDS (1)..(1155)

SEQ ID NO: 46526 - protein, 384 aa, Prochlorococcus marinus; identical to SEQ ID NO: 27598

SEQ ID NO: 46527 - DNA, 885 bp, Bordetella pertussis; identical to SEQ ID NO: 27599
  CDS (1)..(885)

SEQ ID NO: 46528 - protein, 294 aa, Bordetella pertussis; identical to SEQ ID NO: 27600

SEQ ID NO: 46529 - DNA, 1797 bp, Bordetella pertussis; identical to SEQ ID NO: 27601
  CDS (1)..(1797)

SEQ ID NO: 46530 - protein, 598 aa, Bordetella pertussis; identical to SEQ ID NO: 27602

SEQ ID NO: 46531 - DNA, 882 bp, Bordetella pertussis; identical to SEQ ID NO: 27603
  CDS (1)..(882)

SEQ ID NO: 46532 - protein, 293 aa, Bordetella pertussis; identical to SEQ ID NO: 27604

SEQ ID NO: 46533 - DNA, 1950 bp, Bordetella pertussis; identical to SEQ ID NO: 27605
  CDS (1)..(1950)

SEQ ID NO: 46534 - protein, 649 aa, Bordetella pertussis; identical to SEQ ID NO: 27606

SEQ ID NO: 46535 - DNA, 927 bp, Bordetella pertussis; identical to SEQ ID NO: 27607
  CDS (1)..(927)

SEQ ID NO: 46536 - protein, 308 aa, Bordetella pertussis; identical to SEQ ID NO: 27608

SEQ ID NO: 46537 - DNA, 1239 bp, Bordetella pertussis; identical to SEQ ID NO: 27609
  CDS (1)..(1239)

SEQ ID NO: 46538 - protein, 412 aa, Bordetella pertussis; identical to SEQ ID NO: 27610

SEQ ID NO: 46539 - DNA, 921 bp, Bordetella pertussis; identical to SEQ ID NO: 27611
  CDS (1)..(921)

SEQ ID NO: 46540 - protein, 306 aa, Bordetella pertussis; identical to SEQ ID NO: 27612

SEQ ID NO: 46541 - DNA, 1038 bp, Bordetella parapertussis; identical to SEQ ID NO: 27613
  CDS (1)..(1038)

SEQ ID NO: 46542 - protein, 345 aa, Bordetella parapertussis; identical to SEQ ID NO: 27614

SEQ ID NO: 46543 - DNA, 1839 bp, Bordetella parapertussis; identical to SEQ ID NO: 27615
  CDS (1)..(1839)

SEQ ID NO: 46544 - protein, 612 aa, Bordetella parapertussis; identical to SEQ ID NO: 27616

SEQ ID NO: 46545 - DNA, 873 bp, Bordetella parapertussis; identical to SEQ ID NO: 27617
  CDS (1)..(873)

SEQ ID NO: 46546 - protein, 290 aa, Bordetella parapertussis; identical to SEQ ID NO: 27618

SEQ ID NO: 46547 - DNA, 930 bp, Bordetella parapertussis; identical to SEQ ID NO: 27619
  CDS (1)..(930)

SEQ ID NO: 46548 - protein, 309 aa, Bordetella parapertussis; identical to SEQ ID NO: 27620

SEQ ID NO: 46549 - DNA, 888 bp, Bordetella parapertussis; identical to SEQ ID NO: 27621
  CDS (1)..(888)

SEQ ID NO: 46550 - protein, 295 aa, Bordetella parapertussis; identical to SEQ ID NO: 27622

SEQ ID NO: 46551 - DNA, 876 bp, Bordetella parapertussis; identical to SEQ ID NO: 27623
  CDS (1)..(876)

SEQ ID NO: 46552 - protein, 291 aa, Bordetella parapertussis; identical to SEQ ID NO: 27624

SEQ ID NO: 46553 - DNA, 882 bp, Bordetella parapertussis; identical to SEQ ID NO: 27625
  CDS (1)..(882)

SEQ ID NO: 46554 - protein, 293 aa, Bordetella parapertussis; identical to SEQ ID NO: 27626

SEQ ID NO: 46555 - DNA, 876 bp, Bordetella parapertussis; identical to SEQ ID NO: 27627
  CDS (1)..(876)

SEQ ID NO: 46556 - protein, 291 aa, Bordetella parapertussis; identical to SEQ ID NO: 27628

SEQ ID NO: 46557 - DNA, 930 bp, Bordetella bronchiseptica; identical to SEQ ID NO: 27629
  CDS (1)..(930)

SEQ ID NO: 46558 - protein, 309 aa, Bordetella bronchiseptica; identical to SEQ ID NO: 27630

SEQ ID NO: 46559 - DNA, 873 bp, Bordetella bronchiseptica; identical to SEQ ID NO: 27631
  CDS (1)..(873)

SEQ ID NO: 46560 - protein, 290 aa, Bordetella bronchiseptica; identical to SEQ ID NO: 27632

SEQ ID NO: 46561 - DNA, 957 bp, Bordetella bronchiseptica; identical to SEQ ID NO: 27633
  CDS (1)..(957)

SEQ ID NO: 46562 - protein, 318 aa, Bordetella bronchiseptica; identical to SEQ ID NO: 27634

SEQ ID NO: 46563 - DNA, 1950 bp, Bordetella bronchiseptica; identical to SEQ ID NO: 27635
  CDS (1)..(1950)

SEQ ID NO: 46564 - protein, 649 aa, Bordetella bronchiseptica; identical to SEQ ID NO: 27636

SEQ ID NO: 46565 - DNA, 876 bp, Bordetella bronchiseptica; identical to SEQ ID NO: 27637
  CDS (1)..(876)

SEQ ID NO: 46566 - protein, 291 aa, Bordetella bronchiseptica; identical to SEQ ID NO: 27638

SEQ ID NO: 46567 - DNA, 888 bp, Bordetella bronchiseptica; identical to SEQ ID NO: 27639
  CDS (1)..(888)

SEQ ID NO: 46568 - protein, 295 aa, Bordetella bronchiseptica; identical to SEQ ID NO: 27640

SEQ ID NO: 46569 - DNA, 867 bp, Bordetella bronchiseptica; identical to SEQ ID NO: 27641
  CDS (1)..(867)

SEQ ID NO: 46570 - protein, 288 aa, Bordetella bronchiseptica; identical to SEQ ID NO: 27642

SEQ ID NO: 46571 - DNA, 873 bp, Bordetella bronchiseptica; identical to SEQ ID NO: 27643
  CDS (1)..(873)

SEQ ID NO: 46572 - protein, 290 aa, Bordetella bronchiseptica; identical to SEQ ID NO: 27644

SEQ ID NO: 46573 - DNA, 930 bp, Bordetella bronchiseptica; identical to SEQ ID NO: 27645
  CDS (1)..(930)

SEQ ID NO: 46574 - protein, 309 aa, Bordetella bronchiseptica; identical to SEQ ID NO: 27646

SEQ ID NO: 46575 - DNA, 942 bp, Rhizobium leguminosarum; identical to SEQ ID NO: 27647
  CDS (1)..(942)

SEQ ID NO: 46576 - protein, 313 aa, Rhizobium leguminosarum; identical to SEQ ID NO: 27648

SEQ ID NO: 46577 - DNA, 861 bp, Bacillus cereus; identical to SEQ ID NO: 27649
  CDS (1)..(861)

SEQ ID NO: 46578 - protein, 286 aa, Bacillus cereus; identical to SEQ ID NO: 27650

SEQ ID NO: 46579 - DNA, 933 bp, Streptomyces avermitilis; identical to SEQ ID NO: 27651
  CDS (1)..(933)

SEQ ID NO: 46580 - protein, 310 aa, Streptomyces avermitilis; identical to SEQ ID NO: 27652

SEQ ID NO: 46581 - DNA, 891 bp, Streptomyces avermitilis; identical to SEQ ID NO: 27653
  CDS (1)..(891)

SEQ ID NO: 46582 - protein, 296 aa, Streptomyces avermitilis; identical to SEQ ID NO: 27654

SEQ ID NO: 46583 - DNA, 897 bp, Streptomyces avermitilis; identical to SEQ ID NO: 27655
  CDS (1)..(897)

SEQ ID NO: 46584 - protein, 298 aa, Streptomyces avermitilis; identical to SEQ ID NO: 27656

SEQ ID NO: 46585 - DNA, 1005 bp, Tropheryma whipplei; identical to SEQ ID NO: 27657
  CDS (1)..(1005)

SEQ ID NO: 46586 - protein, 334 aa, Tropheryma whipplei; identical to SEQ ID NO: 27658

SEQ ID NO: 46587 - DNA, 918 bp, Pseudomonas fluorescens; identical to SEQ ID NO: 27659
  CDS (1)..(918)

SEQ ID NO: 46588 - protein, 305 aa, Pseudomonas fluorescens; identical to SEQ ID NO: 27660

SEQ ID NO: 46589 - DNA, 867 bp, Azoarcus evansii; identical to SEQ ID NO: 27661
  CDS (1)..(867)

SEQ ID NO: 46590 - protein, 288 aa, Azoarcus evansii; identical to SEQ ID NO: 27662

SEQ ID NO: 46591 - DNA, 894 bp, Vibrio parahaemolyticus; identical to SEQ ID NO: 27663
  CDS (1)..(894)

SEQ ID NO: 46592 - protein, 297 aa, Vibrio parahaemolyticus; identical to SEQ ID NO: 27664

SEQ ID NO: 46593 - DNA, 1314 bp, Pseudomonas syringae; identical to SEQ ID NO: 27665
  CDS (1)..(1314)

SEQ ID NO: 46594 - protein, 437 aa, Pseudomonas syringae; identical to SEQ ID NO: 27666

SEQ ID NO: 46595 - DNA, 1590 bp, Pseudomonas syringae; identical to SEQ ID NO: 27667
  CDS (1)..(1590)

SEQ ID NO: 46596 - protein, 529 aa, Pseudomonas syringae; identical to SEQ ID NO: 27668

SEQ ID NO: 46597 - DNA, 1266 bp, Pseudomonas syringae; identical to SEQ ID NO: 27669
  CDS (1)..(1266)

SEQ ID NO: 46598 - protein, 421 aa, Pseudomonas syringae; identical to SEQ ID NO: 27670

SEQ ID NO: 46599 - DNA, 924 bp, Pseudomonas syringae; identical to SEQ ID NO: 27671
  CDS (1)..(924)

SEQ ID NO: 46600 - protein, 307 aa, Pseudomonas syringae; identical to SEQ ID NO: 27672

SEQ ID NO: 46601 - DNA, 882 bp, Pseudomonas syringae; identical to SEQ ID NO: 27673
  CDS (1)..(882)

SEQ ID NO: 46602 - protein, 293 aa, Pseudomonas syringae; identical to SEQ ID NO: 27674

SEQ ID NO: 46603 - DNA, 882 bp, Pseudomonas syringae; identical to SEQ ID NO: 27675
  CDS (1)..(882)

SEQ ID NO: 46604 - protein, 293 aa, Pseudomonas syringae; identical to SEQ ID NO: 27676

SEQ ID NO: 46605 - DNA, 882 bp, Pseudomonas syringae; identical to SEQ ID NO: 27677
  CDS (1)..(882)

SEQ ID NO: 46606 - protein, 293 aa, Pseudomonas syringae; identical to SEQ ID NO: 27678

SEQ ID NO: 46607 - DNA, 915 bp, Pseudomonas putida; identical to SEQ ID NO: 27679
  CDS (1)..(915)

SEQ ID NO: 46608 - protein, 304 aa, Pseudomonas putida; identical to SEQ ID NO: 27680

SEQ ID NO: 46609 - DNA, 1308 bp, Pseudomonas putida; identical to SEQ ID NO: 27681
  CDS (1)..(1308)

SEQ ID NO: 46610 - protein, 435 aa, Pseudomonas putida; identical to SEQ ID NO: 27682

SEQ ID NO: 46611 - DNA, 1041 bp, Pseudomonas putida; identical to SEQ ID NO: 27683
  CDS (1)..(1041)

SEQ ID NO: 46612 - protein, 346 aa, Pseudomonas putida; identical to SEQ ID NO: 27684

SEQ ID NO: 46613 - DNA, 882 bp, Pseudomonas putida; identical to SEQ ID NO: 27685
  CDS (1)..(882)

SEQ ID NO: 46614 - protein, 293 aa, Pseudomonas putida; identical to SEQ ID NO: 27686

SEQ ID NO: 46615 - DNA, 924 bp, Pseudomonas putida; identical to SEQ ID NO: 27687
  CDS (1)..(924)

SEQ ID NO: 46616 - protein, 307 aa, Pseudomonas putida; identical to SEQ ID NO: 27688

SEQ ID NO: 46617 - DNA, 1257 bp, Pseudomonas putida; identical to SEQ ID NO: 27689
  CDS (1)..(1257)

SEQ ID NO: 46618 - protein, 418 aa, Pseudomonas putida; identical to SEQ ID NO: 27690

SEQ ID NO: 46619 - DNA, 861 bp, Pseudomonas putida; identical to SEQ ID NO: 27691
  CDS (1)..(861)

SEQ ID NO: 46620 - protein, 286 aa, Pseudomonas putida; identical to SEQ ID NO: 27692

SEQ ID NO: 46621 - DNA, 879 bp, Lactobacillus plantarum; identical to SEQ ID NO: 27693
  CDS (1)..(879)

SEQ ID NO: 46622 - protein, 292 aa, Lactobacillus plantarum; identical to SEQ ID NO: 27694

SEQ ID NO: 46623 - DNA, 963 bp, Lactobacillus plantarum; identical to SEQ ID NO: 27695
  CDS (1)..(963)

SEQ ID NO: 46624 - protein, 320 aa, Lactobacillus plantarum; identical to SEQ ID NO: 27696

SEQ ID NO: 46625 - DNA, 876 bp, Bradyrhizobium japonicum; identical to SEQ ID NO: 27697
  CDS (1)..(876)

SEQ ID NO: 46626 - protein, 291 aa, Bradyrhizobium japonicum; identical to SEQ ID NO: 27698

SEQ ID NO: 46627 - DNA, 1770 bp, Bradyrhizobium japonicum; identical to SEQ ID NO: 27699
  CDS (1)..(1770)

SEQ ID NO: 46628 - protein, 589 aa, Bradyrhizobium japonicum; identical to SEQ ID NO: 27700

SEQ ID NO: 46629 - DNA, 1026 bp, Bradyrhizobium japonicum; identical to SEQ ID NO: 27701
  CDS (1)..(1026)

SEQ ID NO: 46630 - protein, 341 aa, Bradyrhizobium japonicum; identical to SEQ ID NO: 27702

SEQ ID NO: 46631 - DNA, 879 bp, Bradyrhizobium japonicum; identical to SEQ ID NO: 27703
  CDS (1)..(879)

SEQ ID NO: 46632 - protein, 292 aa, Bradyrhizobium japonicum; identical to SEQ ID NO: 27704

SEQ ID NO: 46633 - DNA, 1665 bp, Bradyrhizobium japonicum; identical to SEQ ID NO: 27705
  CDS (1)..(1665)

SEQ ID NO: 46634 - protein, 554 aa, Bradyrhizobium japonicum; identical to SEQ ID NO: 27706

SEQ ID NO: 46635 - DNA, 882 bp, Bradyrhizobium japonicum; identical to SEQ ID NO: 27707
  CDS (1)..(882)

SEQ ID NO: 46636 - protein, 293 aa, Bradyrhizobium japonicum; identical to SEQ ID NO: 27708

SEQ ID NO: 46637 - DNA, 855 bp, Bradyrhizobium japonicum; identical to SEQ ID NO: 27709
  CDS (1)..(855)

SEQ ID NO: 46638 - protein, 284 aa, Bradyrhizobium japonicum; identical to SEQ ID NO: 27710

SEQ ID NO: 46639 - DNA, 867 bp, Bradyrhizobium japonicum; identical to SEQ ID NO: 27711
  CDS (1)..(867)

SEQ ID NO: 46640 - protein, 288 aa, Bradyrhizobium japonicum; identical to SEQ ID NO: 27712

SEQ ID NO: 46641 - DNA, 867 bp, Bradyrhizobium japonicum; identical to SEQ ID NO: 27713
  CDS (1)..(867)

SEQ ID NO: 46642 - protein, 288 aa, Bradyrhizobium japonicum; identical to SEQ ID NO: 27714

SEQ ID NO: 46643 - DNA, 882 bp, Bradyrhizobium japonicum; identical to SEQ ID NO: 27715
  CDS (1)..(882)

SEQ ID NO: 46644 - protein, 293 aa, Bradyrhizobium japonicum; identical to SEQ ID NO: 27716

SEQ ID NO: 46645 - DNA, 918 bp, Bradyrhizobium japonicum; identical to SEQ ID NO: 27717
  CDS (1)..(918)

SEQ ID NO: 46646 - protein, 305 aa, Bradyrhizobium japonicum; identical to SEQ ID NO: 27718

SEQ ID NO: 46647 - DNA, 870 bp, Bradyrhizobium japonicum; identical to SEQ ID NO: 27719
  CDS (1)..(870)

SEQ ID NO: 46648 - protein, 289 aa, Bradyrhizobium japonicum; identical to SEQ ID NO: 27720

SEQ ID NO: 46649 - DNA, 1890 bp, Bradyrhizobium japonicum; identical to SEQ ID NO: 27721
  CDS (1)..(1890)

SEQ ID NO: 46650 - protein, 629 aa, Bradyrhizobium japonicum; identical to SEQ ID NO: 27722

SEQ ID NO: 46651 - DNA, 930 bp, Bradyrhizobium japonicum; identical to SEQ ID NO: 27723
  CDS (1)..(930)

SEQ ID NO: 46652 - protein, 309 aa, Bradyrhizobium japonicum; identical to SEQ ID NO: 27724

SEQ ID NO: 46653 - DNA, 873 bp, Bradyrhizobium japonicum; identical to SEQ ID NO: 27725
  CDS (1)..(873)

SEQ ID NO: 46654 - protein, 290 aa, Bradyrhizobium japonicum; identical to SEQ ID NO: 27726

SEQ ID NO: 46655 - DNA, 1044 bp, Bradyrhizobium japonicum; identical to SEQ ID NO: 27727
  CDS (1)..(1044)

SEQ ID NO: 46656 - protein, 347 aa, Bradyrhizobium japonicum; identical to SEQ ID NO: 27728

SEQ ID NO: 46657 - DNA, 1011 bp, Bradyrhizobium japonicum; identical to SEQ ID NO: 27729
  CDS (1)..(1011)

SEQ ID NO: 46658 - protein, 336 aa, Bradyrhizobium japonicum; identical to SEQ ID NO: 27730

SEQ ID NO: 46659 - DNA, 1047 bp, Bradyrhizobium japonicum; identical to SEQ ID NO: 27731
  CDS (1)..(1047)

SEQ ID NO: 46660 - protein, 348 aa, Bradyrhizobium japonicum; identical to SEQ ID NO: 27732

SEQ ID NO: 46661 - DNA, 903 bp, Bradyrhizobium japonicum; identical to SEQ ID NO: 27733
  CDS (1)..(903)

SEQ ID NO: 46662 - protein, 300 aa, Bradyrhizobium japonicum; identical to SEQ ID NO: 27734

SEQ ID NO: 46663 - DNA, 906 bp, Bradyrhizobium japonicum; identical to SEQ ID NO: 27735
  CDS (1)..(906)

SEQ ID NO: 46664 - protein, 301 aa, Bradyrhizobium japonicum; identical to SEQ ID NO: 27736

SEQ ID NO: 46665 - DNA, 1170 bp, Bradyrhizobium japonicum; identical to SEQ ID NO: 27737
  CDS (1)..(1170)

SEQ ID NO: 46666 - protein, 389 aa, Bradyrhizobium japonicum; identical to SEQ ID NO: 27738

SEQ ID NO: 46667 - DNA, 1608 bp, Bradyrhizobium japonicum; identical to SEQ ID NO: 27739
  CDS (1)..(1608)

SEQ ID NO: 46668 - protein, 535 aa, Bradyrhizobium japonicum; identical to SEQ ID NO: 27740

SEQ ID NO: 46669 - DNA, 876 bp, Bradyrhizobium japonicum; identical to SEQ ID NO: 27741
  CDS (1)..(876)

SEQ ID NO: 46670 - protein, 291 aa, Bradyrhizobium japonicum; identical to SEQ ID NO: 27742

SEQ ID NO: 46671 - DNA, 1011 bp, Bradyrhizobium japonicum; identical to SEQ ID NO: 27743
  CDS (1)..(1011)

SEQ ID NO: 46672 - protein, 336 aa, Bradyrhizobium japonicum; identical to SEQ ID NO: 27744

SEQ ID NO: 46673 - DNA, 858 bp, Bradyrhizobium japonicum; identical to SEQ ID NO: 27745
  CDS (1)..(858)

SEQ ID NO: 46674 - protein, 285 aa, Bradyrhizobium japonicum; identical to SEQ ID NO: 27746

SEQ ID NO: 46675 - DNA, 1617 bp, Yersinia pestis; identical to SEQ ID NO: 27747
  CDS (1)..(1617)

SEQ ID NO: 46676 - protein, 538 aa, Yersinia pestis; identical to SEQ ID NO: 27748

SEQ ID NO: 46677 - DNA, 936 bp, Synechococcus elongatus; identical to SEQ ID NO: 27749
  CDS (1)..(936)

SEQ ID NO: 46678 - protein, 311 aa, Synechococcus elongatus; identical to SEQ ID NO: 27750

SEQ ID NO: 46679 - DNA, 870 bp, Synechococcus elongatus; identical to SEQ ID NO: 27751
  CDS (1)..(870)

SEQ ID NO: 46680 - protein, 289 aa, Synechococcus elongatus; identical to SEQ ID NO: 27752

SEQ ID NO: 46681 - DNA, 1170 bp, Synechococcus elongatus; identical to SEQ ID NO: 27753
  CDS (1)..(1170)

SEQ ID NO: 46682 - protein, 389 aa, Synechococcus elongatus; identical to SEQ ID NO: 27754

SEQ ID NO: 46683 - DNA, 1158 bp, Synechococcus elongatus; identical to SEQ ID NO: 27755
  CDS (1)..(1158)

SEQ ID NO: 46684 - protein, 385 aa, Synechococcus elongatus; identical to SEQ ID NO: 27756

SEQ ID NO: 46685 - DNA, 870 bp, Streptococcus mutans; identical to SEQ ID NO: 27757
  CDS (1)..(870)

SEQ ID NO: 46686 - protein, 289 aa, Streptococcus mutans; identical to SEQ ID NO: 27758

SEQ ID NO: 46687 - DNA, 957 bp, Streptococcus mutans; identical to SEQ ID NO: 27759
  CDS (1)..(957)

SEQ ID NO: 46688 - protein, 318 aa, Streptococcus mutans; identical to SEQ ID NO: 27760

SEQ ID NO: 46689 - DNA, 870 bp, Streptococcus agalactiae; identical to SEQ ID NO: 27761
  CDS (1)..(870)

SEQ ID NO: 46690 - protein, 289 aa, Streptococcus agalactiae; identical to SEQ ID NO: 27762

SEQ ID NO: 46691 - DNA, 954 bp, Streptococcus agalactiae; identical to SEQ ID NO: 27763
  CDS (1)..(954)

SEQ ID NO: 46692 - protein, 317 aa, Streptococcus agalactiae; identical to SEQ ID NO: 27764

SEQ ID NO: 46693 - DNA, 987 bp, Oceanobacillus iheyensis; identical to SEQ ID NO: 27765
  CDS (1)..(987)

SEQ ID NO: 46694 - protein, 328 aa, Oceanobacillus iheyensis; identical to SEQ ID NO: 27766

SEQ ID NO: 46695 - DNA, 864 bp, Oceanobacillus iheyensis; identical to SEQ ID NO: 27767
  CDS (1)..(864)

SEQ ID NO: 46696 - protein, 287 aa, Oceanobacillus iheyensis; identical to SEQ ID NO: 27768

SEQ ID NO: 46697 - DNA, 885 bp, Corynebacterium efficiens; identical to SEQ ID NO: 27769
  CDS (1)..(885)

SEQ ID NO: 46698 - protein, 294 aa, Corynebacterium efficiens; identical to SEQ ID NO: 27770

SEQ ID NO: 46699 - DNA, 870 bp, Brucella suis; identical to SEQ ID NO: 27771
  CDS (1)..(870)

SEQ ID NO: 46700 - protein, 289 aa, Brucella suis; identical to SEQ ID NO: 27772

SEQ ID NO: 46701 - DNA, 888 bp, Brucella suis; identical to SEQ ID NO: 27773
  CDS (1)..(888)

SEQ ID NO: 46702 - protein, 295 aa, Brucella suis; identical to SEQ ID NO: 27774

SEQ ID NO: 46703 - DNA, 870 bp, Brucella suis; identical to SEQ ID NO: 27775
  CDS (1)..(870)

SEQ ID NO: 46704 - protein, 289 aa, Brucella suis; identical to SEQ ID NO: 27776

SEQ ID NO: 46705 - DNA, 885 bp, Brucella suis; identical to SEQ ID NO: 27777
  CDS (1)..(885)

SEQ ID NO: 46706 - protein, 294 aa, Brucella suis; identical to SEQ ID NO: 27778

SEQ ID NO: 46707 - DNA, 909 bp, Brucella suis; identical to SEQ ID NO: 27779
  CDS (1)..(909)

SEQ ID NO: 46708 - protein, 302 aa, Brucella suis; identical to SEQ ID NO: 27780

SEQ ID NO: 46709 - DNA, 1077 bp, Bifidobacterium longum; identical to SEQ ID NO: 27781
  CDS (1)..(1077)

SEQ ID NO: 46710 - protein, 358 aa, Bifidobacterium longum; identical to SEQ ID NO: 27782

SEQ ID NO: 46711 - DNA, 927 bp, Bifidobacterium longum; identical to SEQ ID NO: 27783
  CDS (1)..(927)

SEQ ID NO: 46712 - protein, 308 aa, Bifidobacterium longum; identical to SEQ ID NO: 27784

SEQ ID NO: 46713 - DNA, 822 bp, Pseudomonas resinovorans; identical to SEQ ID NO: 27785
  CDS (1)..(822)

SEQ ID NO: 46714 - protein, 273 aa, Pseudomonas resinovorans; identical to SEQ ID NO: 27786

SEQ ID NO: 46715 - DNA, 1080 bp, Corynebacterium glutamicum; identical to SEQ ID NO: 27787
  CDS (1)..(1080)

SEQ ID NO: 46716 - protein, 359 aa, Corynebacterium glutamicum; identical to SEQ ID NO: 27788

SEQ ID NO: 46717 - DNA, 885 bp, Corynebacterium glutamicum; identical to SEQ ID NO: 27789
  CDS (1)..(885)

SEQ ID NO: 46718 - protein, 294 aa, Corynebacterium glutamicum; identical to SEQ ID NO: 27790

SEQ ID NO: 46719 - DNA, 927 bp, Fusobacterium nucleatum; identical to SEQ ID NO: 27791
  CDS (1)..(927)

SEQ ID NO: 46720 - protein, 308 aa, Fusobacterium nucleatum; identical to SEQ ID NO: 27792

SEQ ID NO: 46721 - DNA, 858 bp, Fusobacterium nucleatum; identical to SEQ ID NO: 27793
  CDS (1)..(858)

SEQ ID NO: 46722 - protein, 285 aa, Fusobacterium nucleatum; identical to SEQ ID NO: 27794

SEQ ID NO: 46723 - DNA, 873 bp, Rhizobium leguminosarum; identical to SEQ ID NO: 27795
  CDS (1)..(873)

SEQ ID NO: 46724 - protein, 290 aa, Rhizobium leguminosarum; identical to SEQ ID NO: 27796

SEQ ID NO: 46725 - DNA, 885 bp, Burkholderia cepacia; identical to SEQ ID NO: 27797
  CDS (1)..(885)

SEQ ID NO: 46726 - protein, 294 aa, Burkholderia cepacia; identical to SEQ ID NO: 27798

SEQ ID NO: 46727 - DNA, 1827 bp, Ralstonia solanacearum; identical to SEQ ID NO: 27799
  CDS (1)..(1827)

SEQ ID NO: 46728 - protein, 608 aa, Ralstonia solanacearum; identical to SEQ ID NO: 27800

SEQ ID NO: 46729 - DNA, 900 bp, Ralstonia solanacearum; identical to SEQ ID NO: 27801
  CDS (1)..(900)

SEQ ID NO: 46730 - protein, 299 aa, Ralstonia solanacearum; identical to SEQ ID NO: 27802

SEQ ID NO: 46731 - DNA, 882 bp, Ralstonia solanacearum; identical to SEQ ID NO: 27803
  CDS (1)..(882)

SEQ ID NO: 46732 - protein, 293 aa, Ralstonia solanacearum; identical to SEQ ID NO: 27804

SEQ ID NO: 46733 - DNA, 942 bp, Ralstonia solanacearum; identical to SEQ ID NO: 27805
  CDS (1)..(942)

SEQ ID NO: 46734 - protein, 313 aa, Ralstonia solanacearum; identical to SEQ ID NO: 27806

SEQ ID NO: 46735 - DNA, 936 bp, Ralstonia solanacearum; identical to SEQ ID NO: 27807
  CDS (1)..(936)

SEQ ID NO: 46736 - protein, 311 aa, Ralstonia solanacearum; identical to SEQ ID NO: 27808

SEQ ID NO: 46737 - DNA, 1137 bp, Ralstonia solanacearum; identical to SEQ ID NO: 27809
  CDS (1)..(1137)

SEQ ID NO: 46738 - protein, 378 aa, Ralstonia solanacearum; identical to SEQ ID NO: 27810

SEQ ID NO: 46739 - DNA, 870 bp, Ralstonia solanacearum; identical to SEQ ID NO: 27811
  CDS (1)..(870)

SEQ ID NO: 46740 - protein, 289 aa, Ralstonia solanacearum; identical to SEQ ID NO: 27812

SEQ ID NO: 46741 - DNA, 1617 bp, Ralstonia solanacearum; identical to SEQ ID NO: 27813
  CDS (1)..(1617)

SEQ ID NO: 46742 - protein, 538 aa, Ralstonia solanacearum; identical to SEQ ID NO: 27814

SEQ ID NO: 46743 - DNA, 948 bp, Ralstonia solanacearum; identical to SEQ ID NO: 27815
  CDS (1)..(948)

SEQ ID NO: 46744 - protein, 315 aa, Ralstonia solanacearum; identical to SEQ ID NO: 27816

SEQ ID NO: 46745 - DNA, 960 bp, Pyrobaculum aerophilum; identical to SEQ ID NO: 27817
  CDS (1)..(960)

SEQ ID NO: 46746 - protein, 319 aa, Pyrobaculum aerophilum; identical to SEQ ID NO: 27818

SEQ ID NO: 46747 - DNA, 960 bp, Pyrobaculum aerophilum; identical to SEQ ID NO: 27819
  CDS (1)..(960)

SEQ ID NO: 46748 - protein, 319 aa, Pyrobaculum aerophilum; identical to SEQ ID NO: 27820

SEQ ID NO: 46749 - DNA, 873 bp, Pyrobaculum aerophilum; identical to SEQ ID NO: 27821
  CDS (1)..(873)

SEQ ID NO: 46750 - protein, 290 aa, Pyrobaculum aerophilum; identical to SEQ ID NO: 27822

SEQ ID NO: 46751 - DNA, 888 bp, Rhizobium meliloti; identical to SEQ ID NO: 27823
  CDS (1)..(888)

SEQ ID NO: 46752 - protein, 295 aa, Rhizobium meliloti; identical to SEQ ID NO: 27824

SEQ ID NO: 46753 - DNA, 891 bp, Rhizobium meliloti; identical to SEQ ID NO: 27825
  CDS (1)..(891)

SEQ ID NO: 46754 - protein, 296 aa, Rhizobium meliloti; identical to SEQ ID NO: 27826

SEQ ID NO: 46755 - DNA, 903 bp, Rhizobium meliloti; identical to SEQ ID NO: 27827
  CDS (1)..(903)

SEQ ID NO: 46756 - protein, 300 aa, Rhizobium meliloti; identical to SEQ ID NO: 27828

SEQ ID NO: 46757 - DNA, 897 bp, Rhizobium meliloti; identical to SEQ ID NO: 27829
  CDS (1)..(897)

SEQ ID NO: 46758 - protein, 298 aa, Rhizobium meliloti; identical to SEQ ID NO: 27830

SEQ ID NO: 46759 - DNA, 942 bp, Synechococcus sp; identical to SEQ ID NO: 27831
  CDS (1)..(942)

SEQ ID NO: 46760 - protein, 313 aa, Synechococcus sp; identical to SEQ ID NO: 27832

SEQ ID NO: 46761 - DNA, 1011 bp, Rhizobium loti; identical to SEQ ID NO: 27833
  CDS (1)..(1011)

SEQ ID NO: 46762 - protein, 336 aa, Rhizobium loti; identical to SEQ ID NO: 27834

SEQ ID NO: 46763 - DNA, 897 bp, Rhizobium loti; identical to SEQ ID NO: 27835
  CDS (1)..(897)

SEQ ID NO: 46764 - protein, 298 aa, Rhizobium loti; identical to SEQ ID NO: 27836

SEQ ID NO: 46765 - DNA, 909 bp, Rhizobium loti; identical to SEQ ID NO: 27837
  CDS (1)..(909)

SEQ ID NO: 46766 - protein, 302 aa, Rhizobium loti; identical to SEQ ID NO: 27838

SEQ ID NO: 46767 - DNA, 900 bp, Rhizobium loti; identical to SEQ ID NO: 27839
  CDS (1)..(900)

SEQ ID NO: 46768 - protein, 299 aa, Rhizobium loti; identical to SEQ ID NO: 27840

SEQ ID NO: 46769 - DNA, 906 bp, Rhizobium loti; identical to SEQ ID NO: 27841
  CDS (1)..(906)

SEQ ID NO: 46770 - protein, 301 aa, Rhizobium loti; identical to SEQ ID NO: 27842

SEQ ID NO: 46771 - DNA, 882 bp, Rhizobium loti; identical to SEQ ID NO: 27843
  CDS (1)..(882)

SEQ ID NO: 46772 - protein, 293 aa, Rhizobium loti; identical to SEQ ID NO: 27844

SEQ ID NO: 46773 - DNA, 963 bp, Rhizobium loti; identical to SEQ ID NO: 27845
  CDS (1)..(963)

SEQ ID NO: 46774 - protein, 320 aa, Rhizobium loti; identical to SEQ ID NO: 27846

SEQ ID NO: 46775 - DNA, 867 bp, Agrobacterium tumefaciens; identical to SEQ ID NO: 27847
  CDS (1)..(867)

SEQ ID NO: 46776 - protein, 288 aa, Agrobacterium tumefaciens; identical to SEQ ID NO: 27848

SEQ ID NO: 46777 - DNA, 1716 bp, Pseudomonas resinovorans; identical to SEQ ID NO: 27849
  CDS (1)..(1716)

SEQ ID NO: 46778 - protein, 571 aa, Pseudomonas resinovorans; identical to SEQ ID NO: 27850

SEQ ID NO: 46779 - DNA, 873 bp, Streptomyces coelicolor; identical to SEQ ID NO: 27851
  CDS (1)..(873)

SEQ ID NO: 46780 - protein, 290 aa, Streptomyces coelicolor; identical to SEQ ID NO: 27852

SEQ ID NO: 46781 - DNA, 900 bp, Streptomyces coelicolor; identical to SEQ ID NO: 27853
  CDS (1)..(900)

SEQ ID NO: 46782 - protein, 299 aa, Streptomyces coelicolor; identical to SEQ ID NO: 27854

SEQ ID NO: 46783 - DNA, 26 bp, Primer
atgtctgagcagtttttgtatttctt

SEQ ID NO: 46784 - DNA, 24 bp, Primer
ttatactttctctacctccgggcg

SEQ ID NO: 46785 - protein, 43 aa, consensus; identical to SEQ ID NO: 28576
  MISC_FEATURE (1)..(43): consensus for the disclosure of xaa see table XV

SEQ ID NO: 46786 - protein, 80 aa, consensus; identical to SEQ ID NO: 28577
  MISC_FEATURE (1)..(80): consensus for the disclosure of xaa see table XV

SEQ ID NO: 46787 - DNA, 864 bp, Escherichia coli
  CDS (1)..(864)
atgatccgcagtatgaccgcctacgcccggcgtgaaatcaagggtgaatgggggagcgcaacctgggaaatgcgctcggtaaaccagcgttatctggaaacttactttcgtctgccggagcagttccgtagccttgaacctgtcgttcgcgagcgtattcgttctcgcctgacgcgcggtaaagtggaatgtaccctgcgctatgagccagatgttagcgcgcaaggtgagctgatcctcaacgaaaaactggctaaacagctggtaactgccgcgaactgggtaaaaatgcagagtgacgaaggggaaatcaacccggttgatattctacgctggccgggcgtgatggcagcccaggagcaggatcttgacgccattgccgctgaaattctcgcggcgctggatggtacgctggacgactttattgtcgcgcgcgaaaccgaaggtcaggcactgaaagcattgatcgagcagcgtctggaaggcgtcaccgccgaagtggtcaaagtccgctcccatatgccggaaatcctgcaatggcagcgtgagcgtctggtcgcgaagctggaagatgctcaggtgcaactggaaaacaaccgtctggagcaggaactggttctgctggcacaacgaattgacgttgccgaagaactggatcgcctcgaagcgcatgtcaaagagacctacaacattctgaagaaaaaagaagcggttggtcgtcgtctggattttatgatgcaggagttcaaccgcgagtcgaacactcttgcgtcgaagtctatcaatgccgaagtgacaaactccgccatcgagctgaaagtgttgattgagcagatgcgcgagcagattcagaacatcgaataa

SEQ ID NO: 46788 - protein, 287 aa, Escherichia coli
MIRSMTAYARREIKGEWGSATWEMRSVNQRYLETYFRLPEQFRSLEPVVRERIRSRLTRGKVECTLRYEPDVSAQGELILNEKLAKQLVTAANWVKMQSDEGEINPVDILRWPGVMAAQEQDLDAIAAEILAALDGTLDDFIVARETEGQALKALIEQRLEGVTAEVVKVRSHMPEILQWQRERLVAKLEDAQVQLENNRLEQELVLLAQRIDVAEELDRLEAHVKETYNILKKKEAVGRRLDFMMQEFNRESNTLASKSINAEVTNSAIELKVLIEQMREQIQNIE

SEQ ID NO: 46789 - DNA, 891 bp, Mesorhizobium loti MAFF303099
  CDS (1)..(891)
atgaatttacagagcatgaccggatttgcgcgtgccgtcgccgagcatgacggcacctcgatcgcctgggaggtcaagtccgtcaacggcaagagcgtcgaggtgcggctgcggctgccgcaaggtttcgagcgtctggagccggcggtcaggcaaacgctgcagaagcgtttcgcacgcggcaatttccaggcgacgctgaccatcggccgcgccgccggcgcgcaggcgcaacccgtcgtcaacgaggcgtttctgaaggaccttgcgggtctcgccaagcggctgcaggaacagttcggcgttgctcccgcgacggccgatgggttgctgtcgctgcgtggcgtgctcgacattcccgaaaccgtggaaaccgaagaggcgcgcgccgcgctcgacatcgccatcatggctgcgctcgacgtatcgctgaacgggctggaactggcacggcaaagcgagggggcggcgctggctttgctgctgtccggccatatcgacgccatcgaggcattgacgctgcgtgcggaggcggatccgtcccgcgagacggcggcgatccgtgaacgcatcgctgagcaggtcaggctgctgatggacgcgtccgccaacctggatgcgagccggctgcacatggaagcggcattcctcgccaccaaggctgatattcgcgaggagatcgatcggctgaagacgcatgtcgcatctggccgggctttgcttgagggcggcggcgccgtcggtcggaagctcgattttctggcacaggaatttaaccgcgaatcgaatacgctgtgttcgaagtcgaacgccgcagccgtcaccgcgatcgggctggagctgaaggcggtggtcgaccagtttcgtgaacaggtccagaatctggagtag

SEQ ID NO: 46790 - protein, 296 aa, Mesorhizobium loti MAFF303099
MNLQSMTGFARAVAEHDGTSIAWEVKSVNGKSVEVRLRLPQGFERLEPAVRQTLQKRFARGNFQATLTIGRAAGAQAQPVVNEAFLKDLAGLAKRLQEQFGVAPATADGLLSLRGVLDIPETVETEEARAALDIAIMAALDVSLNGLELARQSEGAALALLLSGHIDAIEALTLRAEADPSRETAAIRERIAEQVRLLMDASANLDASRLHMEAAFLATKADIREEIDRLKTHVASGRALLEGGGAVGRKLDFLAQEFNRESNTLCSKSNAAAVTAIGLELKAVVDQFREQVQNLE

SEQ ID NO: 46791 - DNA, 867 bp, Borrelia burgdorferi B31
  CDS (1)..(867)
ttgaaaagcatgacgggatttttttatttggaaaagataattggtaactatatgtttagtgttaatttgaaatcttataatggaaagtttttagaatttaaatttaggttaccagaaattttttctggctatgatcttgatataagaaatttgatttcaaaatatattagcagaggcaatgtttttttaaatgtaggatataaagaattggttcctagtgtgaattttacgattaatcccaattatattgaggctatttctaggcttagagattctttggcacataccaatcttaatattaaaaacgaactaagtttgggcgattttttatcattaaaaggagctttgataattgatgaggatagtgaacatcaagaagagatttatgggttgtttaaaggtgttctagaagaagctttattacattacaataatggaagaagttttgaaggagaaaataccaagtcagacatagtgtcaacccttgtgttaatagagcgggaccttaaaattgttaaagatgcttgcagtgatataaatgtcaaattatttgcaagtattaaagaaaatatttctaaattaatggatgaatttagagatttaaatattgcagaagaggcagctaaaatggcaattcgtctagacattaatgaagagatcatgcgcttagattctcatatagaaactttttataaaaatcttgaatatgagatatgtggtaaagctcttgaatttatttctcaagaaatgcacagagaaataacaaccatgagtaataaggcggttgatcttgatattaagaatttgattttgaatatgaagttaaatttagaaaaaataaaagagcaaataaggaatgttgaatga

SEQ ID NO: 46792 - protein, 288 aa, Borrelia burgdorferi B31
MKSMTGFFYLEKIIGNYMFSVNLKSYNGKFLEFKFRLPEIFSGYDLDIRNLISKYISRGNVFLNVGYKELVPSVNFTINPNYIEAISRLRDSLAHTNLNIKNELSLGDFLSLKGALIIDEDSEHQEEIYGLFKGVLEEALLHYNNGRSFEGENTKSDIVSTLVLIERDLKIVKDACSDINVKLFASIKENISKLMDEFRDLNIAEEAAKMAIRLDINEEIMRLDSHIETFYKNLEYEICGKALEFISQEMHREITTMSNKAVDLDIKNLILNMKLNLEKIKEQIRNVE

SEQ ID NO: 46793 - DNA, 879 bp, Thermotoga maritima MSB8
  CDS (1)..(879)
gtgataaaaagcatgaccggcttcagcagagtcgaaaaggtgtctggtccctatcagttcagagtcgagatgaagtccttgaattcgaaaggccttaacatcataaaccagctgcccgggtatctttccatgaaagagatagagctgaacaaccttgttcaggagtacgtgagcagaggaaaagtccaaactcgagttcaggtgaagttcctggaacctcccaaggtgcttgagatagacaaaaacgttgtcagggcgtattattcgatgctcgatgaaatagtaggggaactttctcttcctgaacctgtgaaactctcggaccttctgaacttcagagaggtctttcgaatagagctttcagacgaggaaatagaaaatatctggaaccatctggttcccattctcagagaggccttggaaaagctcgttgaggaaagaaaaaaagagggtcaaaaaataggtgcggatctgaagaggattttggaagacctttcgtctcgagttgaagaaatagaaaaaatctctgatcagcttcctgcactttaccgtgaaaagataaaggaagaagtggagaagatccttccacaggatgtctctgtgaaagaagacattctggagaatcacgtggctttcatggccaccaaagccgacataagagaagagatcacccggctcagaagtcacataaaaagagctcttgagctaatagaaagcgacgagccggtcggaatgaatctggattttctcggtcaagagatgttgagggagttgaacacaatcctttccaagtctatctccggtgagataaccagccttgctctcgaggggaaggtactggtttctcagttcagggagcagattcagaacgttgagtga

SEQ ID NO: 46794 - protein, 292 aa, Thermotoga maritima MSB8
MIKSMTGFSRVEKVSGPYQFRVEMKSLNSKGLNIINQLPGYLSMKEIELNNLVQEYVSRGKVQTRVQVKFLEPPKVLEIDKNVVRAYYSMLDEIVGELSLPEPVKLSDLLNFREVFRIELSDEEIENIWNHLVPILREALEKLVEERKKEGQKIGADLKRILEDLSSRVEEIEKISDQLPALYREKIKEEVEKILPQDVSVKEDILENHVAFMATKADIREEITRLRSHIKRALELIESDEPVGMNLDFLGQEMLRELNTILSKSISGEITSLALEGKVLVSQFREQIQNVE

SEQ ID NO: 46795 - DNA, 885 bp, Bacillus halodurans C-125
  CDS (1)..(885)
atgatagcaagcatgacagggtatgggttcgcttcgattgaaggcgatgcatttaaagcaacggttgagcttcgatcagtcaaccatcgcttttttgaatggaattgccgcctgccgagaccattatctttcttagaagaagagctgaaaaaaatcgcgaaaaatgctgtgcaacgcgggaagcttgatgtttttattaaaatagaaggagaagcgttgacaaaaagagaacttgaagtcgattgggatctgctcaaacaatatgaggcagcttcacgaaaaatcgctcagaccattaatcaggagcatgtgctcgatattccctctctgctcttttctgaccagcttgtccaagtcaatgaggcaggggaagtggatgaagagcttatccaggtgatcaaacaagcaatggagaaagcggttcacgatttgcgacacatgcggatggaggaaggaagccacttaaaacaagatcttgacgttcgccttaacatcatgagtgagcttgtcgaacaaattgatacgtacagtccagaggtggttgatcattaccgggacaagttgcgaaagcgggtcaatgaatttttatcgggctttgagagccagttggatgaaagtaggcttctggctgaggtggccctttttgcagaaaaaagtgatatttcggaagaacttacgcgacttcgttctcatattgagcaattcgcgaacattctctcaggcgggggcgttgtaggaagaaagcttgattttcttgtacaagaaatgaaccgagaagcgaacacgatcggttcaaaggccaaccatttggcgattcgcagacatgtggttgagatgaagagtgaaatagagaaaatgaaagaacaagtgcaaaatattgaataa

SEQ ID NO: 46796 - protein, 294 aa, Bacillus halodurans C-125
MIASMTGYGFASIEGDAFKATVELRSVNHRFFEWNCRLPRPLSFLEEELKKIAKNAVQRGKLDVFIKIEGEALTKRELEVDWDLLKQYEAASRKIAQTINQEHVLDIPSLLFSDQLVQVNEAGEVDEELIQVIKQAMEKAVHDLRHMRMEEGSHLKQDLDVRLNIMSELVEQIDTYSPEVVDHYRDKLRKRVNEFLSGFESQLDESRLLAEVALFAEKSDISEELTRLRSHIEQFANILSGGGVVGRKLDFLVQEMNREANTIGSKANHLAIRRHVVEMKSEIEKMKEQVQNIE

SEQ ID NO: 46797 - DNA, 864 bp, Pasteurella multocida subsp. multocida str. Pm70
  CDS (1)..(864)
atgatttatagtatgaccgcttttgcacgcctcgaaatcaaacaggattggggtgatgccgtgtgggaaattcgctcagttaaccagcgctatttagaaacctttttccgcttgcctgagcaatttcgtggtttagaaaataccttgcgagaaaaactgcgtcaaaaactgacgcgtggcaaaattgaatgcacattgcgtattgataataaaaaacaagctgccacagaaatccatttaaacaaagcctttgcattacaagtgatacagtcattacagtggatcaaacaacaagccggggaaggcgagattcacttaaatgacgtgttgcgctatccgggcgtcgttgaagtaccagaacaagatcttgatttgattagccaacaattactcagcgcgtttgacagcttattaaccgagtttattgcaatgcgagcaagagagggcgaaaaactcaacacactccttcaacaacgtttagatgccgttgaagttgaagccaataaagtgcggtcaaaaatgccggaaattttacaatggcaacgagatcgtttattacagcgctttgacgaaatccaattacaagtggatccccaacgtgttgagcaggaaatggtgttattagcccaacgggttgatgtcgctgaagaactcgatcgtctgcaattacacgtcaaagaaaccaaagccattttacaaaaaggcggtgcggttggcagaaaattggattttatgatgcaagaacttaaccgtgaatcaaatacgctcgcgtccaaatctatcagtactgaagtcaccaattctgcggttgaactgaaagtccttatcgaacaaatgcgtgagcaaattcaaaacttagagtaa

SEQ ID NO: 46798 - protein, 287 aa, Pasteurella multocida subsp. multocida str. Pm70
MIYSMTAFARLEIKQDWGDAVWEIRSVNQRYLETFFRLPEQFRGLENTLREKLRQKLTRGKIECTLRIDNKKQAATEIHLNKAFALQVIQSLQWIKQQAGEGEIHLNDVLRYPGVVEVPEQDLDLISQQLLSAFDSLLTEFIAMRAREGEKLNTLLQQRLDAVEVEANKVRSKMPEILQWQRDRLLQRFDEIQLQVDPQRVEQEMVLLAQRVDVAEELDRLQLHVKETKAILQKGGAVGRKLDFMMQELNRESNTLASKSISTEVTNSAVELKVLIEQMREQIQNLE

SEQ ID NO: 46799 - DNA, 864 bp, Pseudomonas aeruginosa PAO1
  CDS (1)..(864)
atggtgcacagcatgaccgccttcgcccgcgtcgagcaggccggtacccacggcaccctgagctgggagctgcgctcggtcaaccaccgttacctggagccccacctgcgcctgcccgacgccttccgcgacctcgaaggcgcggtgcgcgaggcgctgcgccagggcctgtcgcgtggcaaggtggaatgcaccctgcgcttcgccgaggaaaccgccggcaagagcctgcaggtcgaccaggagcgcgcccgccaactggtcgccgccgccgaaggcgtagccgccctgatccgccagccggcgccgctcgatccgctcgccgtgctggcctggcccggcgtactggtggccgactcggccgatccgcaggcgctcaacgccgccgccctggaagccttcggccaggccctggagcaactcaaggccggccgctcgcgcgaaggcctggagctggcgaagctgctcaacgatcggctcgacgcgatgctggtggaagtcggcaacctgcgcgaactggtgccgaccatgctggccaaccagcggcagaagatcctcgaccgcttcgccgaactcaaggccgaactcgatccgcagcgcctggagcaggaactggtcctgctggcgcagaagagcgatgtcgccgaggagctggaccgcctcgccacccacgtcggcgaggtccgccgggtcctcaaggccggcggcgccgccggtcggcgcctggacttcctgatgcaggaactcaaccgggaagccaacactctaggctccaaggcgttcgacccgcgctcgacccaggcggcggtcaacctcaaggtcctgatcgagcagatgcgcgagcaggtccagaacatcgaatga

SEQ ID NO: 46800 - protein, 287 aa, Pseudomonas aeruginosa PAO1
MVHSMTAFARVEQAGTHGTLSWELRSVNHRYLEPHLRLPDAFRDLEGAVREALRQGLSRGKVECTLRFAEETAGKSLQVDQERARQLVAAAEGVAALIRQPAPLDPLAVLAWPGVLVADSADPQALNAAALEAFGQALEQLKAGRSREGLELAKLLNDRLDAMLVEVGNLRELVPTMLANQRQKILDRFAELKAELDPQRLEQELVLLAQKSDVAEELDRLATHVGEVRRVLKAGGAAGRRLDFLMQELNREANTLGSKAFDPRSTQAAVNLKVLIEQMREQVQNIE

SEQ ID NO: 46801 - DNA, 885 bp, Neisseria meningitidis Z2491
  CDS (1)..(885)
atgagcagcggaaatatccacatccacagcatgaccggctttgccaacgcggcggcagagtgcggcagcaaacgcatcaacctcgacatccgcgccgtcaaccaccgctttttggacattcaaatcaggatgccggatgatttgcgctatttggaaagcggtatccgcgagaaaatttcatcccatatcgcgcgcggcaaagtcgaatgcaaaatccaaattcaagatacggaaaacagcagacagtccttggaactcaactcggatttggtgaaccagcttgccgaaatcaacaaaaacctccgcaagcatcacgatttggcaaaactgggcgttgccgacatcctgcgtttccccggcgtattggcaagccaaagggaaaatacggaggaattggcaaaaagcattaccgaactgaccgaaaaagcgttaaaagactttactgccgcacgccggcgcgaagggaaaaaattgggcgagcacctgttacaacgcctcgaaagcatggaagaaatcatagatgcattgagcgaactctttcctaccctgctggaaacacataaagaaaaaatccgcgcccgcctcgtcgaagcagtcggcgacatcaataatgacaggctgcaacaggaatttgccctctttatccaaaaatccgacatcgacgaagagttcagccgcctacgcacccacattgccgaagtgcgtcgtatcgttaccgaacacaaaggcagcagcggcaaacggctggacttcctgatgcaggaattaaaccgcgaagccaacactttgggcagcaaatccattgccgccgaatgcacccaagcctcggtcgagctgaaagtcctgatcgaacagatgcgcgaacaagtgcagaatatcgaataa

SEQ ID NO: 46802 - protein, 294 aa, Neisseria meningitidis Z2491
MSSGNIHIHSMTGFANAAAECGSKRINLDIRAVNHRFLDIQIRMPDDLRYLESGIREKISSHIARGKVECKIQIQDTENSRQSLELNSDLVNQLAEINKNLRKHHDLAKLGVADILRFPGVLASQRENTEELAKSITELTEKALKDFTAARRREGKKLGEHLLQRLESMEEIIDALSELFPTLLETHKEKIRARLVEAVGDINNDRLQQEFALFIQKSDIDEEFSRLRTHIAEVRRIVTEHKGSSGKRLDFLMQELNREANTLGSKSIAAECTQASVELKVLIEQMREQVQNIE

SEQ ID NO: 46803 - DNA, 879 bp, Clostridium acetobutylicum ATCC 824
  CDS (1)..(879)
atgataagaagcatgacgggatttggtagggcttctaacgataatggcagacttggatttaatgttgaaattaagagtgtaaatcacagatattttgatttaaatataaagttacctagaaatcttatctcacttgaagaaaagataagaaaagaagtaggaaacaaaataaaaagaggtaaggtagatatatttataactcaaaatgtctatgatagcagtactactaatgtaaatttgaataaaggtcttgcttataattattgtgaatgtctaaaacaaataagagatgattttaatgtattagatgatatatctgtttcattgatatcaaaattccccgacgtaattactgtgacacaaaatgaggaggatttagatgaaatttctagcctacttttgaagcctattaacgaggcagttgatactatgttaagtatgagggaaaaagaaggggctaggcttaaggaagatatagaaggtaaattaactaatattgaagagttactagtgaatgtagaaaagagagctccttacacagtagagaattatagaaataagcttgaagaaagaataaaagatttacttgtcgataatcaagtagatgaagctaaacttgcaatggaggtgacaatttttgccgacaaatcatgtatagatgaagaaatagttaggcttaaaagtcatatatctcaatttaagagtactcttagcaagaatgaaccagtgggaagaaaattggattttatagttcacgagatgaatagggaagctaacacgataaattctaaatcaaatgatatcgatatagttcactgtgtccttgatataaaaaacgaaatagaaaaaataagagaacaaattcaaaatatagagtga

SEQ ID NO: 46804 - protein, 292 aa, Clostridium acetobutylicum ATCC 824
MIRSMTGFGRASNDNGRLGFNVEIKSVNHRYFDLNIKLPRNLISLEEKIRKEVGNKIKRGKVDIFITQNVYDSSTTNVNLNKGLAYNYCECLKQIRDDFNVLDDISVSLISKFPDVITVTQNEEDLDEISSLLLKPINEAVDTMLSMREKEGARLKEDIEGKLTNIEELLVNVEKRAPYTVENYRNKLEERIKDLLVDNQVDEAKLAMEVTIFADKSCIDEEIVRLKSHISQFKSTLSKNEPVGRKLDFIVHEMNREANTINSKSNDIDIVHCVLDIKNEIEKIREQIQNIE

SEQ ID NO: 46805 - DNA, 888 bp, Sinorhizobium meliloti 1021
  CDS (1)..(888)
atgccgctccaatcgatgaccggctttgccaggaaagaggggagcagcggacgctatcgctgggcttgggaactccgttcggtcaacggcaaaggtctcgacatgcggcttcgcctgccgccgggacttgaacgtatcgagcccgactgccgacgcctcgcctcgcagtatttctcgcgagggaacttgcaggtcggcctttcgctgagcggtactgaagcttcgacggaggcagttctcaacgaggaagcgctcgccgccgtcctgaagcttcgcgaacgattgggcgatgtcatcgatccggcgccgctcaaactcgatacgttgctttccattcgcggcattgtcgacttccgcgagccggaggagagcgagaacgagcgcgcggaacgcgacgcggagatactcgccggcctggaaggcgcgctcgccgatctgcggacgatgcgggaagaagagggcaaggcgctcgggcaggtgttgctagcccaggtggatcgcatcgagaaactgaccgcggtagtcgaaaacgatccgtcccgcagcccgcaggcgatcgccgacaggctggcgcagcaggtttcggtcatcatggccaacgcgtccggcatcgatcgcgaaaggctgcatgcagaggtcgcgctgcttgcgacgaaggccgatcttcgggaggaactcgaccggctgggctcgcatattgcggctgcccgcgacctcctgacaaagggcgggccggtcggacgcaagctcgatttccttgcacaggaatttaaccgcgaatcgaataccatctgttcgaaatcgaatgccgccgccgtgtctgccgccggtatcgaattgaaggtcgtgatcgaccagttccgcgaacaggttcagaatctggagtag

SEQ ID NO: 46806 - protein, 295 aa, Sinorhizobium meliloti 1021
MPLQSMTGFARKEGSSGRYRWAWELRSVNGKGLDMRLRLPPGLERIEPDCRRLASQYFSRGNLQVGLSLSGTEASTEAVLNEEALAAVLKLRERLGDVIDPAPLKLDTLLSIRGIVDFREPEESENERAERDAEILAGLEGALADLRTMREEEGKALGQVLLAQVDRIEKLTAVVENDPSRSPQAIADRLAQQVSVIMANASGIDRERLHAEVALLATKADLREELDRLGSHIAAARDLLTKGGPVGRKLDFLAQEFNRESNTICSKSNAAAVSAAGIELKVVIDQFREQVQNLE

SEQ ID NO: 46807 - DNA, 876 bp, Bacillus subtilis subsp. subtilis str. 168
  CDS (1)..(876)
atgatacgaagtatgacaggcttcggcagtgcaagcaaaacacaagacgatctctctgtaagcgttgaacttaaatctgtgaactacagatttaaagaagtgaacgctcgtttgccaaggcctttgctatattttgaagataagctgaaacagaccattctgcagcatattcagcgcggaagaattgagcttttcgtatccgttgacagcgatatgcttgttgagaaaaggcttgaaattgattggccgctgctcgatgagtttgtcgcagccgcgagagatatgaagaagcggtatcaattgtctgcagagcccgatgtaatggatttctttaagcttgatcatgtcgtccaggttcatgaagaacagacgcaaaatgacaagctggaggcgttgatcatcgatgctgcagaagaagcggtaaaaggtctctgtgaaatgcgtgaaaaagaggggctgctcttagcgaaagactgcctgatgcatattgatcagcttgaagagctggtgagagaaactgaattgctggctgcagatgtcgtatctcgttaccgggaacggctgtatgccagaatcaaagaatggactgaagacgtattagacgagagccggcttgtaacagaatgcgctatttttgcagaccgctctgatatcactgaagagattacaaggctgaagagccacttcgcccagtttcgtgatatattagctagtggcggagctgtcgggcgcaaactcgactttcttgttcaggagctcaatcgggaagcaaatacgatcggctcaaaagcaaatgatcatcagatcacaaagcttgtcgttgaaatgaaaagttctattgaaaaaataaaagaacaagtgcaaaatatagaatag

SEQ ID NO: 46808 - protein, 291 aa, Bacillus subtilis subsp. subtilis str. 168
MIRSMTGFGSASKTQDDLSVSVELKSVNYRFKEVNARLPRPLLYFEDKLKQTILQHIQRGRIELFVSVDSDMLVEKRLEIDWPLLDEFVAAARDMKKRYQLSAEPDVMDFFKLDHVVQVHEEQTQNDKLEALIIDAAEEAVKGLCEMREKEGLLLAKDCLMHIDQLEELVRETELLAADVVSRYRERLYARIKEWTEDVLDESRLVTECAIFADRSDITEEITRLKSHFAQFRDILASGGAVGRKLDFLVQELNREANTIGSKANDHQITKLVVEMKSSIEKIKEQVQNIE

SEQ ID NO: 46809 - DNA, 882 bp, Caulobacter crescentus CB15
  CDS (1)..(882)
atgccactgtcgggcatgacagggttcgcgcgtgttgaaggcgcgcacggcgcctggtcgtgggcggtggaggcccgcagcgtcaatggccgcaaccttgagacccgctttcgcggtccgccgggcttcgaaggcctggagcgcgccgcgcgtgacggggcccaagcgcggttccagcgtggccaactgaccgtcaacgtccaggccaagcgggcggaggtctcgggcgagacccgggtgaatgtccaggtcctggagcgctacctcaccgccggcggcccctatgtggccaccggcatgatcgccaagccgagcctggatggtctgctggcgctcaagggcgtgatcgaggcgcgcgaggacgaagacgacgccgagacgcgcgctgcggtcgaagccgccatggccgcttcaatcgctcaggccctggacggcctgaagacggcgcgcctggaagagggggcggcgctggatccgatcctgagcggcctggtcgcccggatcgagcaactgaccgcccaggccgagaccgaagccgccggccagccagcggtgatcaaggagcgcttcgcccgacgcatgaccgaactggtcggcgaggccgccagcgaggatcgcatcgttcaggaagccgccgcccaggcggtgaaggccgatgtgcgcgaagaactggaccgtctggccagccacgtggtggccgcgcgcggtctgctgtcgggcgagggcgcatcgggtcggcggctcgacttcctctcccaggaattcatgcgcgaatccaacaccctctgctcgaaatcggccctgaccagcctgaccgcgatcggtctggagctgaaggccgtcatcgagcagttccgcgagcaggttcagaacgttgaataa

SEQ ID NO: 46810 - protein, 293 aa, Caulobacter crescentus CB15
MPLSGMTGFARVEGAHGAWSWAVEARSVNGRNLETRFRGPPGFEGLERAARDGAQARFQRGQLTVNVQAKRAEVSGETRVNVQVLERYLTAGGPYVATGMIAKPSLDGLLALKGVIEAREDEDDAETRAAVEAAMAASIAQALDGLKTARLEEGAALDPILSGLVARIEQLTAQAETEAAGQPAVIKERFARRMTELVGEAASEDRIVQEAAAQAVKADVREELDRLASHVVAARGLLSGEGASGRRLDFLSQEFMRESNTLCSKSALTSLTAIGLELKAVIEQFREQVQNVE

SEQ ID NO: 46811 - DNA, 864 bp, Salmonella typhimurium LT2
  CDS (1)..(864)
atgatccgcagtatgaccgcctacgcccggcgtgaaatcaagggtgaatggggtagcgcgacctgggaaatgcgctcggtaaaccagcgttatctggaaacttactttcgtctgccggaacagttccgtagtcttgaacccgtcgtgcgcgaacgcattcgtacacgcctgacgcgcggcaaagtcgaatgtatgctgcgttttgaacccgatgccagcgcgcaaggcgagcttattctgaatgaaaagctagcgaaacaattagttagcgccgcaaactgggtcaaaatgcagagcgacgaaggggaaatcaatccggttgatattttgcgctggccaggtgtcatggcggcgcaagagcaggatctggacgcgattgccgcagaaattttagccgcactggacggtacgctggatgactttatcgtcgcgcgcgaaacggaaggccaggcgctgaaagcgctgattgaacaacggctggaaggcgtcagcgccgaagtagcgaaagtccgcgcgcatatgccggaaatcctgcaatggcagcgtgagcgcctggtcgcgaagctggaagatgctcaggttcagttggaaaacaaccgtctggagcaagagctggtgatgatggcgcaacgcattgatgtggcggaagagctggatcgtctggaagcgcacgtcaaagagacttacaacattctgaagaaaaaagaggcggtaggtcgccgtctggacttcatgatgcaagaatttaaccgtgagtcgaacaccctggcctccaaatccatcaacgctgatgtaactaactccgctattgaattaaaagtgttgatcgagcaaatgcgcgagcaaatccagaatattgaataa

SEQ ID NO: 46812 - protein, 287 aa, Salmonella typhimurium LT2
MIRSMTAYARREIKGEWGSATWEMRSVNQRYLETYFRLPEQFRSLEPVVRERIRTRLTRGKVECMLRFEPDASAQGELILNEKLAKQLVSAANWVKMQSDEGEINPVDILRWPGVMAAQEQDLDAIAAEILAALDGTLDDFIVARETEGQALKALIEQRLEGVSAEVAKVRAHMPEILQWQRERLVAKLEDAQVQLENNRLEQELVMMAQRIDVAEELDRLEAHVKETYNILKKKEAVGRRLDFMMQEFNRESNTLASKSINADVTNSAIELKVLIEQMREQIQNIE

SEQ ID NO: 46813 - DNA, 876 bp, Listeria innocua Clip11262
  CDS (1)..(876)
atggtgaaaagcatgacgggatttgggcgtgctacgaaagaatttgaagcgttcaaagtaaccattgaattaaaagcagtcaaccaccgctactccgaatttctttttcggatgccaaaacaacttgcttatttagaaggaaaattaaaaaagacgataagtaagcaaatcaaacgtggtagaattgaatgtttcttttccatcacaggagagcaaatttcaaaacgtgaactacatattgattgggacctcgcagacagctattaccgttttattaaacaagcaagcgctcgatatgaattacaagaattacctacaatgaccgatttacttcaagaacaagcttatctttctattgaagaagaagtggaagcaagtagcgagctagagcgactagttttagacacacttgcccgcgcaaccgagcgactggacgagatgagaagtatggaaggagcagaattactgctatatttcaaacaacatcttacagcactcgaaacaagtttggaaatcattcaagccgaaattccaaatacagaaaaacattatcaagaaaaaattgaaactcgcttacaaaacgttgtgggcgaccaatttgatcctagtatcgttcttacagaagtcgcaatgctacttgaaaaggcagatattaatgaagaagtagaacgaactaagagccatttaaagcaattttatggtattattttactcgaagaaccaattggacggaagctggattttcttatccaagaaatgaaccgcgaaatcaatactattggatccaaagcaagttctctaaaaatcaccgaacaagtggttgaaatgaaaacgacgctagagaaaattcgggaacaagtgcaaaatgtggaatga

SEQ ID NO: 46814 - protein, 291 aa, Listeria innocua Clip11262
MVKSMTGFGRATKEFEAFKVTIELKAVNHRYSEFLFRMPKQLAYLEGKLKKTISKQIKRGRIECFFSITGEQISKRELHIDWDLADSYYRFIKQASARYELQELPTMTDLLQEQAYLSIEEEVEASSELERLVLDTLARATERLDEMRSMEGAELLLYFKQHLTALETSLEIIQAEIPNTEKHYQEKIETRLQNVVGDQFDPSIVLTEVAMLLEKADINEEVERTKSHLKQFYGIILLEEPIGRKLDFLIQEMNREINTIGSKASSLKITEQVVEMKTTLEKIREQVQNVE

SEQ ID NO: 46815 - DNA, 888 bp, Agrobacterium tumefaciens str. C58
  CDS (1)..(888)
atgacattgcaatcgatgaccggctttgcgcgcagcgaaggaacctccggccgttaccgctgggcctgggaattgcgttctgtgaacggcaaggggctcgatgtgcgcctgcgtctgccgaccggtcttgaagcactcgaaaccggcctgcgcgaaattgcgagcgagcatctttcccgcggcaatattcaggcgggcctgacgctggcgattgcggaaaaccggcttgaggccgtgatcaaccgcgatgcgctggccgccgttctggcactcaagaaggagcttggtgatgtcgtcgatgacaagccgctgagcttcgataccttgctcactttgcgcggtctggtcgattttcgagaggcggaagacgacgctgaagcgcaggcagcgcgcaatggtgaggtgcttgccggtttcgccgctgccgtggaaaagctgaaggacatgcgcgagcgggaaggggcatcgctgtttgctatcctctccggccatatcaaccgtatcgagcagctcgtggacatcatcgagaatgatccatcccgccagcccgagcagatcgcggcacggctcgcccagcagatcgccctcatcggtgacggcatgcacgggctcgaccgtgaccgcctgcatgccgaggcggcgctgatcgccactaaggcggatctgcgtgaagagatcgaccggttgcacgcccatgtccaggcttcacgcgaactgttggagaatggcggacctgttggccgcaagctcgattttcttgcacaggaatttaaccgcgagtcgaatacaatctgttccaaatcgaatgccagtgcggtaaccgcagcgggcatagagttgaaagtggtgatcgaccagtttcgcgaacaggtccaaaatctggagtag

SEQ ID NO: 46816 - protein, 295 aa, Agrobacterium tumefaciens str. C58
MTLQSMTGFARSEGTSGRYRWAWELRSVNGKGLDVRLRLPTGLEALETGLREIASEHLSRGNIQAGLTLAIAENRLEAVINRDALAAVLALKKELGDVVDDKPLSFDTLLTLRGLVDFREAEDDAEAQAARNGEVLAGFAAAVEKLKDMREREGASLFAILSGHINRIEQLVDIIENDPSRQPEQIAARLAQQIALIGDGMHGLDRDRLHAEAALIATKADLREEIDRLHAHVQASRELLENGGPVGRKLDFLAQEFNRESNTICSKSNASAVTAAGIELKVVIDQFREQVQNLE

SEQ ID NO: 46817 - DNA, 945 bp, Brucella melitensis 16M
  CDS (1)..(945)
atgaaccggctcgatccggttccggcaacagtcgagaggaaggcgcatggcgctccagagcatgacaggttttgcgcgccatgcagcacagcatgcatggccgacggcgaggcgcgtatcgtctgggaagtgcgctcggtcaatggcaaggggcttgatcttcgcctgcgcctgccgcaagggctggaatcggtggaacatccggtccgctccctgctggcgcggcatttctcgcgcgggaattttcaggcgagcctgaccgtcgaacgcagcgaaacgcaggcgggctttgccatcaaccagcccatgctggccgaggtgctgaagctgggtgcggagttgcaggaaaaatatggcctggctccggcaagcgtggacggcattcttgcgctgcgcggcattatcgaccagtcgcaaagggcggaagacgaggaagagcgcgctgcgctggaagctacaatcgtcgcggcctttgagggcgccttgaaggcgatagccgaggcgcgcaggcaggaaggcaaggcgctttttaccattctttcgacccatctcgacacgatcgagcggctgacggcggatgcacgaaatgacccgtcgcgcgctaccgaggcgatcaaggcgcgccttgccgggcaggtggcgctgcttctggatgccacgcgcgaactggacgagacgcggctatatcaggaagcggcgtttctggccaccaaggcggatattcaggaagagcttgaccggctggaaacccatgtggccagtgcacgcaagcttctgggcgagggcgggccggtcgggcgaaagctcgattttctttcacaggaatttaatcgtgaggctaatacactgtgctccaaatcgaacgcagcgtcgatcacggctatcggactggggctgaaagcggtcgtcgatcagttccgcgaacaagtacagaatctggagtaa

SEQ ID NO: 46818 - protein, 314 aa, Brucella melitensis 16M
MNRLDPVPATVERKAHGAPEHDRFCAPCSTACMADGEARIVWEVRSVNGKGLDLRLRLPQGLESVEHPVRSLLARHFSRGNFQASLTVERSETQAGFAINQPMLAEVLKLGAELQEKYGLAPASVDGILALRGIIDQSQRAEDEEERAALEATIVAAFEGALKAIAEARRQEGKALFTILSTHLDTIERLTADARNDPSRATEAIKARLAGQVALLLDATRELDETRLYQEAAFLATKADIQEELDRLETHVASARKLLGEGGPVGRKLDFLSQEFNREANTLCSKSNAASITAIGLGLKAVVDQFREQVQNLE

SEQ ID NO: 46819 - DNA, 885 bp, Clostridium perfringens str. 13
  CDS (1)..(885)
atggttaaaagtatgactggttttgggagagcaactagtgaagagggaaaagaaagaatattttctctagaaatgaagagtgtaaaccatagatatttagacatgaacataagaatgccaagaagtatggtttctttagaagaaaaaataagaaatattatttcttctaaacttagcaggggaaaagttgatatctttataaattataaagattatgctaaaaatcaaggagttgctgttttaaatgaagatttagctaagagttatgtaaattctttagaacaattaaagtccttatttcctaatatgcaagacgacttaagtttatcattagttgctagatacccagatgtaataactatagaagaaaaatcagaagatttagaagctatatgggaagagataaactcactattaaatatggctgtagaaaatatgatttctatgagaaaagttgaaggtgagaaattagctagtgatatattagttaagtgtagctctatagaagaaatagtagcttttatagaagaaaaggcggaggttattgttgcttcttataagcaaaagttagaggatagacttaagaatttattaggggaagttccagtagatgaaaacagagtagctatggaagttgctgtttttgctgacaaagcttcaattgatgaagagataataagacttagaagtcatattaatcaattaagaaaaactttaactttagatgaacctataggtagaaagttagatttcatagtacaagaaatgaacagagaagctaatacaatagcatcaaagtcaacagatttagaaataaccaacaaggttatagatataaaaaatattattgaaaagattagagaacaagttcaaaacatagaataa

SEQ ID NO: 46820 - protein, 294 aa, Clostridium perfringens str. 13
MVKSMTGFGRATSEEGKERIFSLEMKSVNHRYLDMNIRMPRSMVSLEEKIRNIISSKLSRGKVDIFINYKDYAKNQGVAVLNEDLAKSYVNSLEQLKSLFPNMQDDLSLSLVARYPDVITIEEKSEDLEAIWEEINSLLNMAVENMISMRKVEGEKLASDILVKCSSIEEIVAFIEEKAEVIVASYKQKLEDRLKNLLGEVPVDENRVAMEVAVFADKASIDEEIIRLRSHINQLRKTLTLDEPIGRKLDFIVQEMNREANTIASKSTDLEITNKVIDIKNIIEKIREQVQNIE

SEQ ID NO: 46821 - DNA, 879 bp, Fusobacterium nucleatum subsp. nucleatum ATCC 25586
  CDS (1)..(879)
atgagaagtatgacaggttattccaagttaaattatgaagatgaaaactatgtaattaatatggaaataaaaagtgtgaataataaaaatttagccactaaaatcaaacttccatataatttaaacctacttgaaagttttataagagcagaaattgcctcttttataagtagaggttctattgattttagaattgaatttgaaaataaaaatgaaagtcttaaaaatttaaaatatgatgagaaactagcaaaatcttgtatggatattttgaataaaatagaagaagattttaatgataaattttcaaataaattggatttcctagttagaaattttggagttatttcacaaaaagatttagatacagatgaagaaaaatataaagaaattatagatttaaaacttaaagaattacttcaaaattttattaaaactaaggttgaagaaggaaatagattgagggttttctttaaagaacaattaagtattttaaaatcaaaattagaacaagtgaaaaaattaagaccacaggttgtagaaaactataaacaaagattactaaataatataaattctattaaagctgatataaattttaatgaagaagatattttaaaggaagttttattatttagtgatagagtggatataacagaagaaatatcaaggttagaaagtcatttcaaacaattagaacatgagtttgaaacagatgaaatctctcaggggaagaaaatagaatttattttccaagaagtatttagagaatttaatactatgggagtaaaatcaaatatgtatgaaatatctaaattggttgttgaaagtaaaaatgaattagaaaagatgagagaacagataatgaatattgaataa

SEQ ID NO: 46822 - protein, 292 aa, Fusobacterium nucleatum subsp. nucleatum ATCC 25586
MRSMTGYSKLNYEDENYVINMEIKSVNNKNLATKIKLPYNLNLLESFIRAEIASFISRGSIDFRIEFENKNESLKNLKYDEKLAKSCMDILNKIEEDFNDKFSNKLDFLVRNFGVISQKDLDTDEEKYKEIIDLKLKELLQNFIKTKVEEGNRLRVFFKEQLSILKSKLEQVKKLRPQVVENYKQRLLNNINSIKADINFNEEDILKEVLLFSDRVDITEEISRLESHFKQLEHEFETDEISQGKKIEFIFQEVFREFNTMGVKSNMYEISKLVVESKNELEKMREQIMNIE

SEQ ID NO: 46823 - DNA, 873 bp, Thermoanaerobacter tengcongensis MB4
  CDS (1)..(873)
atgataaagagcatgacggggtatggacgaagcgacattcgagatagaggatatgaaatttcagtcgagataaggtcattaaaccacaggtttttagacgtaaacataaagcttaatagactgttgagcggtttggaggaaagagtgagagagtttgtatcagaaaagataaaaagggggagggtagatttaagtataagttttgacgtatacgataagactttaagctttataaaaattgacgagccattattagaagaatatttaaagactttttctgaagtaaaagcaaaatttgatttggaaggttctataactgtaagcgatttgattgaccttccagaggtaataaaattagaaaatgaagaagttaatttggaggaagtctgggaaattttaaggattgctttagatgatgctataggtaaactgattgacatgaggttaaaagaaggtataaaattatacgatgatgtgacgaagaggatagaaaaagtctcagaaattgtaggtgaaatagaaggtttaagtctggtgatggtggaagactacagaaaaaagcttgaacagaggataaaggagttgggagtggaggtggacccagtaagaatctctatggaagtggcgttaattgccgataagtcctgtattgcggaagagattacgaggttgaaaagccatattagtcagtttaggtcatcccttaatgaggagggacctatcggtaaaaaattagattttatactgcaggagatgaacagggaagctaacacaatagcttccaaggcaatagactacaggatttccagcaaagttatcgatttgaaagatgagattgaaaaaattagagaacaagttcaaaatatagagtag

SEQ ID NO: 46824 - protein, 290 aa, Thermoanaerobacter tengcongensis MB4
MIKSMTGYGRSDIRDRGYEISVEIRSLNHRFLDVNIKLNRLLSGLEERVREFVSEKIKRGRVDLSISFDVYDKTLSFIKIDEPLLEEYLKTFSEVKAKFDLEGSITVSDLIDLPEVIKLENEEVNLEEVWEILRIALDDAIGKLIDMRLKEGIKLYDDVTKRIEKVSEIVGEIEGLSLVMVEDYRKKLEQRIKELGVEVDPVRISMEVALIADKSCIAEEITRLKSHISQFRSSLNEEGPIGKKLDFILQEMNREANTIASKAIDYRISSKVIDLKDEIEKIREQVQNIE

SEQ ID NO: 46825 - DNA, 888 bp, Chlorobium tepidum TLS
  CDS (1)..(888)
atgttggaaagcatgaccggatacggcagcgccgagcgttcggaaaaaggcatgaaggtgcttgtcgaactgcgttcggtcaataatcgttttgccgaaatcggcgtcaagctgcccaggcagttgctgtcgtgggagctggaggttagggagctgatccgtgccagtttccagcggggcaaaatatcggcgtttgtccagcttcagctcgaagaggccgaagcgttgccggtgactgtaaacccttcgaaagtgaggggctacaaggctcttcttgaaaccgtccgccgggaggcggaaatcgaagctccggtaaccctcgatcatgtgcttcgtttttccgagattttcgagcctgaccacaccattctggaacacccggacgagatctggcctatcgctcagtcggcacttattgaggctatcggcaatctcaaggagatgcgccggaaagagggtgaagagcttgcgattgacttcctgtcgaggatcgacgaaatcgagcgcacgctcaaagagatcaaggagattgccgctggtaatctcgaaacgatccgcaagcggctggcctcgaaaatcagcgccattgctgggtgcgatgtcgagtacagcaaggatcgccttgaaatggagatcgtcatggccgccgagcggctcgacatcaccgaggagtgcatccgcttcagcagccataacaagtttttcatcgaagagctgaacaacagttcgagcggctcgggccgcaagctcaatttcctcctgcaggagcagctccgcgaggccaacactatcgcgtccaagtcgcagaatgccgatatttcgcagaaagtggtgcatatcaaggaggagctcgaaaaggtcagggagcagttgcaaaacatcgaatga

SEQ ID NO: 46826 - protein, 295 aa, Chlorobium tepidum TLS
MLESMTGYGSAERSEKGMKVLVELRSVNNRFAEIGVKLPRQLLSWELEVRELIRASFQRGKISAFVQLQLEEAEALPVTVNPSKVRGYKALLETVRREAEIEAPVTLDHVLRFSEIFEPDHTILEHPDEIWPIAQSALIEAIGNLKEMRRKEGEELAIDFLSRIDEIERTLKEIKEIAAGNLETIRKRLASKISAIAGCDVEYSKDRLEMEIVMAAERLDITEECIRFSSHNKFFIEELNNSSSGSGRKLNFLLQEQLREANTIASKSQNADISQKVVHIKEELEKVREQLQNIE

SEQ ID NO: 46827 - DNA, 864 bp, Yersinia pestis KIM
  CDS (1)..(864)
atgatccgcagcatgaccgcctacgctcgacgtgatattaagggtgaatggggcaacgcagcctgggagctgcgttccgttaaccaacgctatttagaaacgtacattcgcttaccagaacaattccggagtctggaaccggtgatccgcgaacgtattcgcagccgtctgacacggggaaagattgaatgtcatttacgttttgagttggatgccaacgcacaaagctctttgatcctcaatgaaaaactggcgaagcagttagttgaagccggtaattgggtcaagatgcaaagtgatgaaggcgaaattaacccagtagatatcctgcgctggccaggggtaatgtctgctgaggaacaagatttggatgcgattagcaccgagttaatgcaggcgctagataccgccctagacgattttattgtttcccgagaaactgaaggggcagcactgaaaacgcttatcgagcagcgtttagagggggtcagcgctgaagtggttaaagtccgcgcacatatgccaaatatcttgcagtggcaacgtgagcgcttactgaacaaactggaagaagcgcaagttcagttggaaaatactcgtttggagcaggagttagtgctaatggcacagcgtatcgatgtggccgaagagctagatcgtttggaagcgcacgtcaaagaaacatacaacattctgaagaagaaagaagccgttggccgccgccttgattttatgatgcaagaattcaaccgcgagtcgaatacgctggcatcaaaatccatcaatgccgaggtcactaactccgctatcgagttaaaggtgttgattgagcagatgcgcgaacagatccagaacatcgagtaa

SEQ ID NO: 46828 - protein, 287 aa, Yersinia pestis KIM
MIRSMTAYARRDIKGEWGNAAWELRSVNQRYLETYIRLPEQFRSLEPVIRERIRSRLTRGKIECHLRFELDANAQSSLILNEKLAKQLVEAGNWVKMQSDEGEINPVDILRWPGVMSAEEQDLDAISTELMQALDTALDDFIVSRETEGAALKTLIEQRLEGVSAEVVKVRAHMPNILQWQRERLLNKLEEAQVQLENTRLEQELVLMAQRIDVAEELDRLEAHVKETYNILKKKEAVGRRLDFMMQEFNRESNTLASKSINAEVTNSAIELKVLIEQMREQIQNIE

SEQ ID NO: 46829 - DNA, 900 bp, Brucella suis 1330
  CDS (1)..(900)
atggcgctccagagcatgacaggttttgcgcgccatgcagcacagcatggcatggccgacggcgaggcgcgtatcgtctgggaagtgcgctcggtcaatggcaaggggcttgatcttcgcctgcgcctgccgcaagggctggaatcggtggaacatccggtccgctccctgctggcgcggcatttctcgcgcgggaattttcaggcgagcctgaccgtcgaacgcagcgaaacgcaggcgggctttgccatcaaccagcccatgctggccgaggtgctgaagctgggtgcggagttgcaggaaaaatatggcctggctccggcaagcgtggacggcattcttgcgctgcgcggcattatcgaccagtcgcaaagggcggaagacgaggaagagcgcgctgcgctggaagctacaatcgtcgcggcctttgagggcgccttgaaggcgatagccgaggcgcgcaggcaggaaggcaaggcgctttttaccattctttcgacccatctcgacacgatcgagcggctgacggcggatgcacgaaatgacccgtcgcgcgctaccgaggcgatcaaggcgcgccttgccgggcaggtggcgctgcttctggatgccacgcgcgaactggacgagacgcggctatatcaggaagcggcgtttctggccaccaaggcggatattcaggaagagcttgaccggctggaaacccatgtggccagtgcacgcaagcttctgggcgagggcgggccggtcgggcgaaagctcgattttctttcacaggaatttaatcgtgaggctaatacactgtgctccaaatcgaacgcagcgtcgatcacggctatcggactggggctgaaagcggtcgtcgatcagttccgcgaacaagtacagaatctggagtaa

SEQ ID NO: 46830 - protein, 299 aa, Brucella suis 1330
MALQSMTGFARHAAQHGMADGEARIVWEVRSVNGKGLDLRLRLPQGLESVEHPVRSLLARHFSRGNFQASLTVERSETQAGFAINQPMLAEVLKLGAELQEKYGLAPASVDGILALRGIIDQSQRAEDEEERAALEATIVAAFEGALKAIAEARRQEGKALFTILSTHLDTIERLTADARNDPSRATEAIKARLAGQVALLLDATRELDETRLYQEAAFLATKADIQEELDRLETHVASARKLLGEGGPVGRKLDFLSQEFNREANTLCSKSNAASITAIGLGLKAVVDQFREQVQNLE

SEQ ID NO: 46831 - DNA, 864 bp, Shewanella oneidensis MR-1
  CDS (1)..(864)
atgatccaaagcatgacagcctacgctcgcattgagcacaaagcacaatggggcactgcctcttgggaaattcgctcagttaaccagcgttatctcgaaacttaccttcgcctacccgaacaatttcgcagttttgagccagtgctgcgcgatcgcctacgcaaccgcttaagccgcggtaaagttgaggtgaacttacgctacgagttagccgacaatagcaataacgaacttaaattaaatcaagggttagccaaacagctgctcgacgctgccagttggctcaaacaagaagccggacaaggcgaagtcaacctcaccgatattttgcgctggccaggtgtactctcgagtgctgagcaagatatggacgcaattggcgccgatttaatgaccgcatttgacttagctatcgaccaatttatcgaagcccgtggccgtgagggcgcagccatcaaagacatgctgctaagtcgtttagatggcgtcagcgagcaaatcgccatcgtgcgtgagcatatgcctaaagtcatggaatatcagcgtgataaactcaccaaccgcctcgctgaaattaagggtgagctcgatcctgctcgcatcgagcaagaaatgattcttttagcccaaaaacaagatgtcgccgaagaaatggacagactcgaagcccacgttaacgaagcccgtcgcatcctcaaaaaaggcggcagtgaaggtcgtcgtttagattttatgatgcaagaatttaaccgcgaatcgaacaccctagcctctaaatccatcagcaccgaaatcacagccgccgcggttgatcttaaagttcttatcgagcagatgagagagcagatccagaatgtggaataa

SEQ ID NO: 46832 - protein, 287 aa, Shewanella oneidensis MR-1
MIQSMTAYARIEHKAQWGTASWEIRSVNQRYLETYLRLPEQFRSFEPVLRDRLRNRLSRGKVEVNLRYELADNSNNELKLNQGLAKQLLDAASWLKQEAGQGEVNLTDILRWPGVLSSAEQDMDAIGADLMTAFDLAIDQFIEARGREGAAIKDMLLSRLDGVSEQIAIVREHMPKVMEYQRDKLTNRLAEIKGELDPARIEQEMILLAQKQDVAEEMDRLEAHVNEARRILKKGGSEGRRLDFMMQEFNRESNTLASKSISTEITAAAVDLKVLIEQMREQIQNVE

SEQ ID NO: 46833 - DNA, 951 bp, Pseudomonas putida KT2440
  CDS (1)..(951)
ttgggcgccacggcgacactgcgctacaatcctgcgccttgcagccgagaggctcccaccgttcattcattacgcgaggtactccccatggtgcacagcatgaccgcttttgctcgtgtcgagcgcgccggcagccaaggcaccctggtctgggagctgcgttcggtcaaccaccgttatctggagccgcacctgcgcctgcccgaagccctgcgcgacctcgaaggcggtgtacgtgaaggcctgcgccagggcctgtcacgcggcaaggtggaatgcaccttgcgcctcaacgaagacagcaatggcaaaccgctgaaagtggaccatgagcgcgccgcgcaactggttgccgccgccgaggaagtggctggcctgatcaagcagccggcccccctgaacccgctggaagtgctgtcatggccaggcgtgctggtggccgacaccagcgacccccaggcactgaacgccgaagccatggcgctgttcgacgaagcgctggccgaactcaaggccgggcgccagcgcgaaggccaggaactggcccggctgatcaacgaacgcctggacaacatggccagcgaagtcactaccctgcgcgccctggtgccgcagatgctggcggcgcagcggcagaagattctcgaccgcttcggcgacatgcaagccgagctggacccacagcgcctggagcaggagatggtactgctggcccagaaaagcgacgtggcagaggaactcgaccgcctcagcacccacgtcaccgaagtgcgccgcgtgctcaagggtggcggcgccgctggccggcgcctggacttcctgatgcaggaactcaaccgcgaggccaacaccctcggctccaaggccttcgacccacgcagcacgcaagcggcggtcaacctgaaggtattgatcgaacagatgcgtgaacaagtacagaacatcgagtaa

SEQ ID NO: 46834 - protein, 316 aa, Pseudomonas putida KT2440
MGATATLRYNPAPCSREAPTVHSLREVLPMVHSMTAFARVERAGSQGTLVWELRSVNHRYLEPHLRLPEALRDLEGGVREGLRQGLSRGKVECTLRLNEDSNGKPLKVDHERAAQLVAAAEEVAGLIKQPAPLNPLEVLSWPGVLVADTSDPQALNAEAMALFDEALAELKAGRQREGQELARLINERLDNMASEVTTLRALVPQMLAAQRQKILDRFGDMQAELDPQRLEQEMVLLAQKSDVAEELDRLSTHVTEVRRVLKGGGAAGRRLDFLMQELNREANTLGSKAFDPRSTQAAVNLKVLIEQMREQVQNIE

SEQ ID NO: 46835 - DNA, 888 bp, Bradyrhizobium japonicum USDA 110
  CDS (1)..(888)
atggcgctgtcgtccatgaccggctttgcccgaagccacggcgctagcgggccgtacacgttcgaatgggaattgaagtcggtcaacgccaagggctttgacctcagggtgcggctgccgcaggggttcgacgagctcgaggcccacgccaagaagcgcgccggcgagcttttgtcgcgcggcaccgtctacgccaatctcaacgtcaagcgcgccaatgccgccgcctccgtccgtgtcaacgaggacgtgctcaacgccgtcctgaaggccgcctcgataatcgccggaaaggtcgatgcggtggcaccgagcgtcgacggcctgctcgccatcaagggcgtcgtcgaggtcgccgagcccgagggcgacgaggaggaggacaaggcggcgcgcgccgcggcagcggaggccttcgacaaggcgctcgccgatctcgtcgagatgcgcaagcgcgaggggacctcgctcgggcagatcctgacccagcgggtggacgaggtcgagcaactggcgaagaaggccgaagccgcacccggccgcaagccggaggcgatcaaggccaggctcgccgagcagatcgcaacgctgctcgacacctccgaccgtttcgatcccgaccgcctgatgcaggaggcgatcctgatcgcgaccagggccgacatccgcgaggagctcgaccgtatcgcctcgcatatcgcgcaggcgcgcgagctgatcggcaagggcggcccgatcgggcgcaagctcgacttcctggcgcaggagtttcaccgcgaggtcaatacctgctgctcgaagtcgaacgacatcgagctgaccaatacggggctcgccatgaaaaacgtggtcgagcaatttcgcgagcaggtccagaatctggagtga

SEQ ID NO: 46836 - protein, 295 aa, Bradyrhizobium japonicum USDA 110
MALSSMTGFARSHGASGPYTFEWELKSVNAKGFDLRVRLPQGFDELEAHAKKRAGELLSRGTVYANLNVKRANAAASVRVNEDVLNAVLKAASIIAGKVDAVAPSVDGLLAIKGVVEVAEPEGDEEEDKAARAAAAEAFDKALADLVEMRKREGTSLGQILTQRVDEVEQLAKKAEAAPGRKPEAIKARLAEQIATLLDTSDRFDPDRLMQEAILIATRADIREELDRIASHIAQARELIGKGGPIGRKLDFLAQEFHREVNTCCSKSNDIELTNTGLAMKNVVEQFREQVQNLE

SEQ ID NO: 46837 - DNA, 864 bp, Xylella fastidiosa Temecula1
  CDS (1)..(864)
atgatccatagcatgactgcgttcgccgcagatgagcaccttacaccatggggcctgttggcctgcgagctgcgttcagtcaaccaccgcttcctggatatcgtcatacgccttcctgaagaactccgtgctctggaatcacaactacgtgagcgcgtggccgcacgggtcagccgcggcaagctcgatttgacggtacgcctatcaccacaggagatccacactgggaagctggtagtgaacgaactgctgttatcccatctcagcaccctggcactacgcctatcagcacagttccccgcgttacgtgtcacatttgcagagctgctacagatccctggtgtcctgaagggtgagcagatcgacatgaccacgttacaaggacacgccgtggcgctgctagataaggtactggataacttcattgccacgcgggaacgcgaaggtctcaaaatgcaagcaatgatcgcgcaacgtgctagtgccattgaacgcatcgtcggtgaggttcgcaccctgattcccaccatccgcgaaggccaacacaacaaactaaacgctcgcatgaatcacctgtcgtatcccgtcgatcacggtcgcattgagcaagagttggtgctatggctacaaaagctagacgtggatgaggagttggatcgactcagcagtcacatcagcgaactacatcgcatcctccagcaacgcgaacccgtcgggcggcgcctggattttctaatgcaagaattcaaccgcgaagccaacacactcggctcaaaatcggtggacagccgcacttctaatgccacgattgagctgaaggtactgatcgaccagatccgcgagcaagtgcagaacatcgaataa

SEQ ID NO: 46838 - protein, 287 aa, Xylella fastidiosa Temecula1
MIHSMTAFAADEHLTPWGLLACELRSVNHRFLDIVIRLPEELRALESQLRERVAARVSRGKLDLTVRLSPQEIHTGKLVVNELLLSHLSTLALRLSAQFPALRVTFAELLQIPGVLKGEQIDMTTLQGHAVALLDKVLDNFIATREREGLKMQAMIAQRASAIERIVGEVRTLIPTIREGQHNKLNARMNHLSYPVDHGRIEQELVLWLQKLDVDEELDRLSSHISELHRILQQREPVGRRLDFLMQEFNREANTLGSKSVDSRTSNATIELKVLIDQIREQVQNIE

SEQ ID NO: 46839 - DNA, 888 bp, Clostridium tetani E88
  CDS (1)..(888)
atgaagtttatggtaaaaagtatgacgggctttggaagggcaacatttgaaaatgaaaaaagaagttttgtagttgaaattaaaagtgtaaatcacagatattgtgacataaacataaaaatgcccagaagcttaatccagctagaacaaaagataagagcaataatacaaaaatatgtaggtagaggaaaaatagacgtatttataaatcttaatacatatgataagagtaatgtggaaacaatttttaataaggatttagcagatggatatgtaaaaaatctagaagaaataaaaaatagatatggtatatcagaagaaatttctatagatttaattgctagatttcccgaggtcatcaccatagaacataaagagcaaaatattgatgaactttggatggaactttgcactcctttagaggaaggggttgtttctcttgtaaaaatgagagaaatagaaggttctaaacttaaagaaaatattttagaaaaatgtgaaaccattaaagaaatatgtaaagaagtcgaaattatagctcctaaggtagtaaaaatacacaaagaaaaattaaatttaagattagaagaacttttaaaagatgttgaaatagatgaagaaagattatctatggaggtggcattatttgcagatagaagctgtatagatgaagaagtagttagacttaaaagccacttaattcaagtgaaagatactttggaattagaggaacccataggtagaaaattagattttatagtacaagaaatgaatagggaagtaaatacaattgcttcaaaagctaacaatttagatatttcaaactttgtattaacaatgaaaaatgaaattgaaaaaataagagaacaaattcaaaatattgaataa

SEQ ID NO: 46840 - protein, 295 aa, Clostridium tetani E88
MKFMVKSMTGFGRATFENEKRSFVVEIKSVNHRYCDINIKMPRSLIQLEQKIRAIIQKYVGRGKIDVFINLNTYDKSNVETIFNKDLADGYVKNLEEIKNRYGISEEISIDLIARFPEVITIEHKEQNIDELWMELCTPLEEGVVSLVKMREIEGSKLKENILEKCETIKEICKEVEIIAPKVVKIHKEKLNLRLEELLKDVEIDEERLSMEVALFADRSCIDEEVVRLKSHLIQVKDTLELEEPIGRKLDFIVQEMNREVNTIASKANNLDISNFVLTMKNEIEKIREQIQNIE

SEQ ID NO: 46841 - DNA, 867 bp, Vibrio parahaemolyticus RIMD 2210633
  CDS (1)..(867)
atgatttacagtatgactgcgtatgcgcgcaaagaagtaaaaggcaattggggctcagcggtatgggaaatccgcagtgtaaaccagcgttacctagaaacctatttccgcatgccagaacaattccgagctttagaaccagttctacgcgagcgttttcgtaaacgcctagcgcgaggaaaagtggaatgtagccttcgtttcgaagcaaaccctgcagcaaaagccgaacttagcatcaatgaagcgttggcaacccaagtgattaaagctgctgaacaagttatgcacatgactggtgagcttagccgcatcaatccatttcaagtcatgcaatggcctggtgtgatggaaactcctgagcaaaacatggatgaggttaacaaagaacttcttgctgcatttgatgaagcaattagtgaatttattgaagcgcgtggccgtgaaggcgataacatgaaagcgctgatcgaacaacgcctagacgcgattaccgcagaagtggtgaaagttcgtgctcgcatgcctgaaatcctagaatggcaacgtgagcgtctattctcaaaatttgaagatgcgaaaattgaactggatgcttctcgtgtagaacaagagcttatcttgctagcgcaaaagtcagacgttgcagaagagctagatcgtctggattctcacgtgaaagaaacgaccaacatcctgaaaaaaggtggcgcagtcggtcgtcgtctggatttcatgatgcaagaattcaaccgtgagtcaaacacgctcgcttctaaatcgatcagcaccgacatcactgcgtcgggtgttgaactgaaagttctgatcgaacaaatgcgcgaacagatccaaaacatcgaataa

SEQ ID NO: 46842 - protein, 288 aa, Vibrio parahaemolyticus RIMD 2210633
MIYSMTAYARKEVKGNWGSAVWEIRSVNQRYLETYFRMPEQFRALEPVLRERFRKRLARGKVECSLRFEANPAAKAELSINEALATQVIKAAEQVMHMTGELSRINPFQVMQWPGVMETPEQNMDEVNKELLAAFDEAISEFIEARGREGDNMKALIEQRLDAITAEVVKVRARMPEILEWQRERLFSKFEDAKIELDASRVEQELILLAQKSDVAEELDRLDSHVKETTNILKKGGAVGRRLDFMMQEFNRESNTLASKSISTDITASGVELKVLIEQMREQIQNIE

SEQ ID NO: 46843 - DNA, 867 bp, Bacteroides thetaiotaomicron VPI-5482
  CDS (1)..(867)
atgacaggatacggcaaagctacggccgaacttccagataaaaagataaacgtagaaatcaagtcgctcaacagcaaagcaatggatctttccactcgcatcgctccggcttatcgtgaaaaagagatcgagatccgcaacgaaatctccaaagtgctggagcgtggaaaggtggacttcagcctctggatagagaaaaaagagagtgcggaaagcgcgactcctatcaaccaagtgttggtggaaggctactacaaacagattcaggcgatctcggaaaatctcggcatccccgtccccaccgactggtttcagacgttgctccgtatgccggacgttatgtctaagactgaaatccaagagttgacggaagaagaatgggaaatggtacgtgccaccgttctcgaagcaatcggtcatctggtagacttccgcaaacaggaaggcgccgcactggaaaagaagttccgcgaaaagatagctaacatcgcactattgctcgaaaagataactccttacgaaaaagaacgggtggagaaagtcaaggaacgtatcaccgacgcgctcgaaaagacgctgaacacggactatgacaagaaccgactggaacaagagctgatctactacatcgaaaagctggatgtcaacgaggaaaaacaacgcctcaccaaccacctgaaatatttcatcagcacgctggaaagcggcaacggacaaggcaaaaagctcggtttcatcgctcaggaaatgggacgggaaatcaatacgcttggcagcaagtccaaccatgccgaaatgcagaaaatcgttgtgcaaatgaaagatgaactggaacagatcaaggaacaggtgctgaacgtaatgtaa

SEQ ID NO: 46844 - protein, 288 aa, Bacteroides thetaiotaomicron VPI-5482
MTGYGKATAELPDKKINVEIKSLNSKAMDLSTRIAPAYREKEIEIRNEISKVLERGKVDFSLWIEKKESAESATPINQVLVEGYYKQIQAISENLGIPVPTDWFQTLLRMPDVMSKTEIQELTEEEWEMVRATVLEAIGHLVDFRKQEGAALEKKFREKIANIALLLEKITPYEKERVEKVKERITDALEKTLNTDYDKNRLEQELIYYIEKLDVNEEKQRLTNHLKYFISTLESGNGQGKKLGFIAQEMGREINTLGSKSNHAEMQKIVVQMKDELEQIKEQVLNVM

SEQ ID NO: 46845 - DNA, 885 bp, Enterococcus faecalis V583
  CDS (1)..(885)
atgaaaagtatgactggatttggaaaaaagaccattcaaaatgaaaattatcaattggatatcgaagtcaaaagtgtcaaccagcggtttttagatattcaattgcgtatgcccaaggaactgaatgcctatgaactggtgattcggcaagtaatcaaacgcacgttaaaacgtgggcgtgtggaagtctatgtaaatctccaaaaaatcggcaacaatcaaaaagaagtgcgcgtgcagtgggacttaattgatcaattattaacttcggtagatcaacatttaaaggaaaaatatccggaagcaacgtttgatgcaggggacacggtcaaccatttattaaagcaaaatgattttgtcgaaatagtggaagcagaaattgttgatcagacatttgaaccatttcttgttcaagcatttgaagcagccatcgctagtcttgaccaaagccgtgtgcaagaaggaacgcaaattaaacaagtcctgcttgactatgtagcagtgttgacccaatcaattcaagaactgcaagcgtttgtgggcgtttttgaacaagaataccgtcaacgttttgaagcgaaattaaacgaatggttaggtagccaagtggatgaaacacgcttattaacagaaatggccattttattggaaaaaggcgatattcatgaagaattggatcgtttggatatccatattgataagttgcatcagttgcttgacgaaacagaaccagtgggccgagaactagatttcttaattcaagaaatgaaccgtgaagtcaatacgattggttcgaaatcaagtccaattgaaataaaaaatagtgtcgttcaaatgaaaacaaccttagaaaagattcgtgaacaaattcaaaatgtcgaatag

SEQ ID NO: 46846 - protein, 294 aa, Enterococcus faecalis V583
MKSMTGFGKKTIQNENYQLDIEVKSVNQRFLDIQLRMPKELNAYELVIRQVIKRTLKRGRVEVYVNLQKIGNNQKEVRVQWDLIDQLLTSVDQHLKEKYPEATFDAGDTVNHLLKQNDFVEIVEAEIVDQTFEPFLVQAFEAAIASLDQSRVQEGTQIKQVLLDYVAVLTQSIQELQAFVGVFEQEYRQRFEAKLNEWLGSQVDETRLLTEMAILLEKGDIHEELDRLDIHIDKLHQLLDETEPVGRELDFLIQEMNREVNTIGSKSSPIEIKNSVVQMKTTLEKIREQIQNVE

SEQ ID NO: 46847 - DNA, 864 bp, Coxiella burnetii RSA 493
  CDS (1)..(864)
atgattgccagtatgaccgctttctctcgccagtctcatgaagcaacatgggggttattgacgtgggagatccgcacggtcaatcaccgctatctggaaattacactgcgtttgccggactttttgcgtgaatttgaacaagcttcccgagaggccattcaaaaggttttgcgccgaggcaaggttgaagccactttacggttccagcctggttgggacgtgccgtttgaaatgaatgtcaatcaagtgctgactgaacgcttggccaaagcgagtgagacggtcatctcctacttcccatcagcgacaatcaatgccatcgatgtgctctcctggcctggggtattgcaaaccaaggaaactcaggtggatgttatcggaaaggccgtattcgctttattaaattcggcattaaccgattgcatggatatacggcgtcgcgaaggcgagggacttaaactatttattgaagaacggctgaacaacgtgaaagggaaaatcgccattatcaagaaacgactgcctgctttgcaccaagcggcgcgcgagaaaatgatagtgcgttttgaagaattatccctcgcgttagataaagaacgcttggagcaagagatgctctggttggtacaaaaaagtgatgtcgccgaagaattacaacgcctagaggcgcacctgcttgaagtgaaacgtgttttagttgaaggaggtaccgtcggacgaaggctggattttttaatgcaagaattaaaccgagaggccaacaccttgggaaataaatcactggacgccgatgtttctcaagtattggtagatttaaaagtgcaaattgaacaaatgcgagaacaggtgcaaaacattgaataa

SEQ ID NO: 46848 - protein, 287 aa, Coxiella burnetii RSA 493
MIASMTAFSRQSHEATWGLLTWEIRTVNHRYLEITLRLPDFLREFEQASREAIQKVLRRGKVEATLRFQPGWDVPFEMNVNQVLTERLAKASETVISYFPSATINAIDVLSWPGVLQTKETQVDVIGKAVFALLNSALTDCMDIRRREGEGLKLFIEERLNNVKGKIAIIKKRLPALHQAAREKMIVRFEELSLALDKERLEQEMLWLVQKSDVAEELQRLEAHLLEVKRVLVEGGTVGRRLDFLMQELNREANTLGNKSLDADVSQVLVDLKVQIEQMREQVQNIE

SEQ ID NO: 46849 - DNA, 876 bp, Bacillus cereus ATCC 14579
  CDS (1)..(876)
atgatttctagtatgacagggtttggaagatcgaaagtagaaagtgatacttttcaaattacagtagaaatgaaatcggtgaaccaccgttttttagagatgagtattcgacttcctaagcaaatgatggtatttgaggacaaaattcgtaaaataattgcacagcaagttcgacgtgggcgcatcgaagtgtctattagtatagcaggtgaaggacttgttgaaagaaaattaagtgtgaattggtcacttcttgagcagtaccaatcgatgatggaagatataaaagggaaatttcaattacaagattctattacactcgaacaattaatggcaatgccagaagtaacagcaattgaagaaatagaaaatgtaaatgaacattttgagaacagtttatatgaggctgttcgtcaagctgctcatatgttgaaaacgatgagagatggcgaaggagaacgattacataaagatatagcgtatcgtttacaagagattagcaattgtgtaaatgcgattattccacatgcaccaattgttacacaaaaatatcgtgaacgattagaaaatcgcttaaaagaattacataatcaagatctagatgaacaaagattgctaacagaagtcgcaatctttgcagagcgttgtgatattcatgaagagttagttcgtttgcaaagtcatttagagcaatttcgtgaaacattgcagattgaagagcctgttggaaggaaaatggatttcatcgtgcaagagatgcatagagaaattaatacgattggttctaaggcaaatgacttaacaatttcaaaatatgttgtagaaatgaaaaataaccttgaaaaaattcgtgaacaagtacaaaatattgagtag

SEQ ID NO: 46850 - protein, 291 aa, Bacillus cereus ATCC 14579
MISSMTGFGRSKVESDTFQITVEMKSVNHRFLEMSIRLPKQMMVFEDKIRKIIAQQVRRGRIEVSISIAGEGLVERKLSVNWSLLEQYQSMMEDIKGKFQLQDSITLEQLMAMPEVTAIEEIENVNEHFENSLYEAVRQAAHMLKTMRDGEGERLHKDIAYRLQEISNCVNAIIPHAPIVTQKYRERLENRLKELHNQDLDEQRLLTEVAIFAERCDIHEELVRLQSHLEQFRETLQIEEPVGRKMDFIVQEMHREINTIGSKANDLTISKYVVEMKNNLEKIREQVQNIE

SEQ ID NO: 46851 - DNA, 867 bp, Nitrosomonas europaea ATCC 19718
  CDS (1)..(867)
atgcttgcaagcatgacaggttatgcagcagtttcccgggaaatcccgcaaggatcactggctttggaactgcgttcagtcaataaccgctatcttgatctgcaattcagactccccgatgaactccgtgcacttgaatccgaaatgcgcgattttctcggtagtggactgacgcggggaaaagttgattgtcgcctgactttttcatcttattcaaacagttaccgtcaacagcgactgaatcgtgatctgttgcaagacttgcagatcatgagcgatgagatcaagtctatttttcctgctgcaggcgatttttccgttgctgaaattctgcgctggcctggcgtactcgatagtgaccatatttcgatcgatgacttgcgtaccccgtgtatggcactgttacaaactgctctacaggaactcgtctccgcccggaagcgcgagggagaaaagctgcataacctgttgttggaacgtgtacaacgaatgcgtcaactggtattggatctgttgccggggttgcctgctattctggccagttttcaggaaagattactgaacagtttgaaagcagccgggctcgatgaaaaggatgaacgtatccggcaggaattcaccctgtttgccaacagagtcgatgtagacgaggagctgtcacgcctgcagggacacctgaacgaattcgaacacattctgcttgccgggggtgtcgtcggcaaacggctcgattttctgacacaggaactcaatcgggaagccaatacgctggcctccaagtcagtggcgagagaagtcacgcgaatagcagtggaaatgaaagtgctgatcgagcaattgcgcgagcagatccagaatattgaataa

SEQ ID NO: 46852 - protein, 288 aa, Nitrosomonas europaea ATCC 19718
MLASMTGYAAVSREIPQGSLALELRSVNNRYLDLQFRLPDELRALESEMRDFLGSGLTRGKVDCRLTFSSYSNSYRQQRLNRDLLQDLQIMSDEIKSIFPAAGDFSVAEILRWPGVLDSDHISIDDLRTPCMALLQTALQELVSARKREGEKLHNLLLERVQRMRQLVLDLLPGLPAILASFQERLLNSLKAAGLDEKDERIRQEFTLFANRVDVDEELSRLQGHLNEFEHILLAGGVVGKRLDFLTQELNREANTLASKSVAREVTRIAVEMKVLIEQLREQIQNIE

SEQ ID NO: 46853 - DNA, 1029 bp, Rhodopirellula baltica SH 1
  CDS (1)..(1029)
gtgacgcaggcgtctcttcgcacgcaagtaaattcctcttcaccgcacggcgggtcgccctacccttcgctgcgcagcatgaccggccagggccggggcgaaacctccactgccgccggttcggtcgtcactgagattcgctcggtcaacaatcgtgggctgaagatcattctccgtaccagtgattcggtttcggagtttgagcccaaaatggaggcattggtccgtcagcatttgcatcgtggcagcgtcacggtgcaggtgcggttcacgccgccacccggagctgatctgcctcgcatcaatgccgatgtggtgcgttcgtacgccgaacaactggcgcaagtcgctgattctttggcgatgggtgatgccgtcacctcaaccaacattgatttggctcacctgatgcagatgccaggtgtgctggaatcgccttctgccggatcgcagaaccgatcgtccgatgagcaagctttggcggccaagtggtcactggttcaggaaagcattgaatcggcactggatcggttcaagcagatgcgatcggatgaagccatcgcgatggccgaatcgatcgagcaagacatgacgctgattcaggctcgctgcgaggaaatcgccaaacgcagtcctcaggttgtggctcgataccaagagcgtttgcgagaacgcatcgaaaaggcattgtctgagaacggattgtcggtgggcgacccggtggatttgatccgagaagtccaacttttcgcggaccgatccgatatcagcgaagaactaacgcggttgggaagtcatttgggactgatgagaggcgttttggctggcgactcggcggagacggcttctagcgaatcgggcagtcgcggggaagcggtcgggcgaaagcttgatttcattattcaggagctcaatcgcgaaaccaacaccatcggcagcaaagccggcgacgcggaaattgctgagcacgtggtggagatcaagtgcgcgatcgaacgcatgcgtgaactcgttcagaatctggagtaa

SEQ ID NO: 46854 - protein, 342 aa, Rhodopirellula baltica SH 1
MTQASLRTQVNSSSPHGGSPYPSLRSMTGQGRGETSTAAGSVVTEIRSVNNRGLKIILRTSDSVSEFEPKMEALVRQHLHRGSVTVQVRFTPPPGADLPRINADVVRSYAEQLAQVADSLAMGDAVTSTNIDLAHLMQMPGVLESPSAGSQNRSSDEQALAAKWSLVQESIESALDRFKQMRSDEAIAMAESIEQDMTLIQARCEEIAKRSPQVVARYQERLRERIEKALSENGLSVGDPVDLIREVQLFADRSDISEELTRLGSHLGLMRGVLAGDSAETASSESGSRGEAVGRKLDFIIQELNRETNTIGSKAGDAEIAEHVVEIKCAIERMRELVQNLE

SEQ ID NO: 46855 - DNA, 864 bp, Wigglesworthia glossinidia endosymbiont of Glossina brevipalpis
  CDS (1)..(864)
atgatacatagtatgacttctttttctagatatgaattaaaaaaaaattactacaatattatatgggaattaaaatctgttaatcataaatatcttgatataaatattaatttaccagaagaaataaaatttatagaagaaacaatttacaaaagaattagtaaatatatttcaagaggtaaaatagattgtagtgcttatattaaatcaaataaatcaaaaaaaataaatttattaattgataaaaaattaatacttcaaatattaaaaattattatttatataaataaagaaattaatttcagcacagtaaatattttagacatactaaaatggccaggagttattttaaaaaaaaaatatttaaacaaaataaataacaaagtattaatttctagctttgaatatgcttttaacaatttattgaattatagactctcagaaggaagagaaataaaaaaaataattaaaacaaaaacagaaaaaattaattttaatatagaaaaaatgaattatattttacctaaatttttagaaaaacaaaaaattaaactaaaaaataaaatactagaaattaataataatatagaaattaataaattagaacaagacatttcattttttattcaaaaaacagacataaatgaagaaatagatagaataaaaattcatattaattctttaacaaaaacattaaacaatagaaaaccaattggaagaaaattagattttattttacaagaaataataagagaatctaatactatttcatctaaatcaactgcaatagaaataattcaattatcaattgaattaaaattattaacagatcaaattagagagcaagcaaaaaatattgaataa

SEQ ID NO: 46856 - protein, 287 aa, Wigglesworthia glossinidia endosymbiont of Glossina brevipalpis
MIHSMTSFSRYELKKNYYNIIWELKSVNHKYLDININLPEEIKFIEETIYKRISKYISRGKIDCSAYIKSNKSKKINLLIDKKLILQILKIIIYINKEINFSTVNILDILKWPGVILKKKYLNKINNKVLISSFEYAFNNLLNYRLSEGREIKKIIKTKTEKINFNIEKMNYILPKFLEKQKIKLKNKILEINNNIEINKLEQDISFFIQKTDINEEIDRIKIHINSLTKTLNNRKPIGRKLDFILQEIIRESNTISSKSTAIEIIQLSIELKLLTDQIREQAKNIE

SEQ ID NO: 46857 - DNA, 873 bp, Candidatus Blochmannia floridanus
  CDS (1)..(873)
atgattaatagtatgactgctttttctagatatgaagttgtttatttatggggaagtgcagtgtgggaaattcgttctatgaatcaacgatatttagatatttgtattactatacctaagaatgtcaatgatttgttttggataattagaaaaaaagttaagagttctcttacaagaggtaaaatagaatgtcatttacaacttaatattaatgtagatagtattaatactgttgtgtttgataataaattattttcttttttacttgataaaatcaaatatattaaatcacaaattaatgaaggggaaattgatcttgtagaaattttatcttttccaggaataatttcatataagcataataatgatgtatatcaaataaataatgaattattagctgcttttgaactaacattatatcaattaatacgtaatagagaaaaggaaggtagttttttaaaggataatgtagttaatcggttattacaaattactacagtaatcgatgaaattcagaaatatattcctcaaatattacaacaaaagcgtaaaaaacttttggattatattcagggtttttgtattaattttgatactagtcgattagaacaagaattattgttaatgacacaaaaaattgatgtttcagaagaaatagatcgtttgaaaattcatgttgaatctatgcaaaatcttttatctcaaaaaataaataaacctgttggaagacagttagattttattactcaagaattacaaagggaggctaatactttgtcgtcgaaattaatagatgcttatgtgacaggtttggttatttctttaaagatattaattgagcaaattcgtgaacaggttcaaaatattgagtaa

SEQ ID NO: 46858 - protein, 290 aa, Candidatus Blochmannia floridanus
MINSMTAFSRYEVVYLWGSAVWEIRSMNQRYLDICITIPKNVNDLFWIIRKKVKSSLTRGKIECHLQLNINVDSINTVVFDNKLFSFLLDKIKYIKSQINEGEIDLVEILSFPGIISYKHNNDVYQINNELLAAFELTLYQLIRNREKEGSFLKDNVVNRLLQITTVIDEIQKYIPQILQQKRKKLLDYIQGFCINFDTSRLEQELLLMTQKIDVSEEIDRLKIHVESMQNLLSQKINKPVGRQLDFITQELQREANTLSSKLIDAYVTGLVISLKILIEQIREQVQNIE

SEQ ID NO: 46859 - DNA, 927 bp, Bordetella bronchiseptica RB50
  CDS (1)..(927)
atgatccgcagcatgactgccttcggcaacgcccgcgccgacctcgagcagggctcgctcgcgctcgaactgcgcagcgtcaacagccgttatctcgacctgtatttccgcctgcccgacgagctgcgccacgtcgagacgccgctgcgcgaattgctgaccgccaagctggcgcgcggcaaggtcgaagtgcgcgtgtcgtatacccgcgccgcctccaccgaactctccacgctggacccgcaatggctgcgctcgctggccgcgcaactggacaacgcgcgcgccgtcctgcccgaagtcgccgcgccgcgcctggtcgaactgttcaactggcccggccagcgcggcaacgacgcgctcgatccgcaggcctggggcgcggcctgcatgcaggccgcccagcaagcgctggcgcagatgcaggaaggccgcgcccgcgaaggcgagcgcctggccgcgatgatgcgcgaatgcgccgacggcgtgggccgcattgtcgacggcgtcgaaacccacctgccccagctgctggccgatcaccgcgagaagctggcgctcaagctgcgcgaagcggtcgaatcggccttccccggcggcttcgcccacatcaccggaccggagctgtccgagcgcctgactcaggaagccacccttttcgcgttgcgcatcgacgtcgccgaagaactctcgcgcctgcgctcgcacctcgaagaattgcgccacctgctgggcgacggccccgccaaatccgacgccaagcgcggcggtagcgccggcaagcgcctggacttcctgttccaggaaatgaaccgcgaggccaacaccctgggttccaaggccggcagcctggaagtcacgcgcgcggcgatggatctcaagctgctgatcgagcagatgcgcgaacaggcgcagaacctggagtga

SEQ ID NO: 46860 - protein, 308 aa, Bordetella bronchiseptica RB50
MIRSMTAFGNARADLEQGSLALELRSVNSRYLDLYFRLPDELRHVETPLRELLTAKLARGKVEVRVSYTRAASTELSTLDPQWLRSLAAQLDNARAVLPEVAAPRLVELFNWPGQRGNDALDPQAWGAACMQAAQQALAQMQEGRAREGERLAAMMRECADGVGRIVDGVETHLPQLLADHREKLALKLREAVESAFPGGFAHITGPELSERLTQEATLFALRIDVAEELSRLRSHLEELRHLLGDGPAKSDAKRGGSAGKRLDFLFQEMNREANTLGSKAGSLEVTRAAMDLKLLIEQMREQAQNLE

SEQ ID NO: 46861 - DNA, 867 bp, Chromobacterium violaceum ATCC 12472
  CDS (1)..(867)
atgatattgagcatgaccggcttcgccgccgccacccgggaattccctggcggcatgttgagcctggaagtccgcgccgtcaatcaccgttacctggacgtgcagatgcgcttgccggaagagctgcgcatcatcgaaccccagctgcgcgagcagatcgccgcccgcgtcacccgcggcaagctggaatgccgcgtcggcctcaaccaggtggacagcgccgcccccacgctggaagtgaaccaggccttcctcgcccgcctgctggaagtctcccgcgacgtgcaaaaacagtgcggcgaaggcaagggactgtcggtcggcgaactgatgcgctggcccggcgtgctgaagagcaacgagctggcgccggaagtgctgcaccagctgtgcctggacgcgctgcaaaccgcgctggccgacttcaacgcctcgcgcggccgcgagggcgaaaagctgaaggccgtgctgatcgagcgcatcgaggcgatggaagccatcgtcgccgcgatcaaacccaagctgccgcaaatcctggaaaactacatggccaaactgtccggccgcctgcaggaggcgctgggcagcgtcgatgaagaccgcttgaaacaggaattcgcgctgttcgcgcagaagatagacgtggacgaggaactgtcgcgcctgaccacccacctctcagaagtgcgacgcatcctgaaatccggcggccaatccggcaagcgcctggacttcctgatgcaggagctgaaccgcgaagccaacaccctgggctccaagtcggtctccaccgacaccacccaggcctcggtggagctgaaagtgctgatcgagcagatgcgcgagcaaattcaaaacatagagtaa

SEQ ID NO: 46862 - protein, 288 aa, Chromobacterium violaceum ATCC 12472
MILSMTGFAAATREFPGGMLSLEVRAVNHRYLDVQMRLPEELRIIEPQLREQIAARVTRGKLECRVGLNQVDSAAPTLEVNQAFLARLLEVSRDVQKQCGEGKGLSVGELMRWPGVLKSNELAPEVLHQLCLDALQTALADFNASRGREGEKLKAVLIERIEAMEAIVAAIKPKLPQILENYMAKLSGRLQEALGSVDEDRLKQEFALFAQKIDVDEELSRLTTHLSEVRRILKSGGQSGKRLDFLMQELNREANTLGSKSVSTDTTQASVELKVLIEQMREQIQNIE

SEQ ID NO: 46863 - DNA, 891 bp, Porphyromonas gingivalis W83
  CDS (1)..(891)
atgatcctatctatgaccggattcggcaagcatacgattcaattcgccgataaaaaaataactgcgaccatcaagtcgctcaatagcaaacagttcgatctatcaaccaagatttccagccgttaccgtgatagagaactacctctcagggctttggtttcggccgacatcggacgggggaaagtggatttcagcttgtttctcgaggaatccggtagtacggatgttgtatctcagatattcgatacagaaaagatgtcctcttatttcttccaactcaaggaattcggcgaaaagatgggagtggaagtacccgcaggaggatggttcgaacagctacttcggatccccggagtcattcagatagatgaagataaagaagaagaaattccagaagatgaatgggctgtcgtaattgaaacttgtcggagagcccttgatcagctaatcggattccgcgagcaggagggtgctatgctggagcaggtgttcacggagaaaatatctaatatctcttctttgcttctgcaaatcgaacagtatgaacccgataggatccaacgaatcaaagagcggatagaagagaacctaaccaaaatatcagagaaagactacgacaagaacagattcgaacaagagatgatttattatatcgaaaagttggatgtaaatgaagagaagcatcgcttgcggaatcatctttcttattttctccaaaccatgcaaggcgagcccggacaagggaaaaaactcagcttcattgcacaagaaatcggcagagaaatcaatacgctcggctccaaaagcaatcatgtggagatgcagcaaatcgtcgtgcagatgaaagacgaattagaacagatcaaagagcaagtactgaacgtattatag

SEQ ID NO: 46864 - protein, 296 aa, Porphyromonas gingivalis W83
MILSMTGFGKHTIQFADKKITATIKSLNSKQFDLSTKISSRYRDRELPLRALVSADIGRGKVDFSLFLEESGSTDVVSQIFDTEKMSSYFFQLKEFGEKMGVEVPAGGWFEQLLRIPGVIQIDEDKEEEIPEDEWAVVIETCRRALDQLIGFREQEGAMLEQVFTEKISNISSLLLQIEQYEPDRIQRIKERIEENLTKISEKDYDKNRFEQEMIYYIEKLDVNEEKHRLRNHLSYFLQTMQGEPGQGKKLSFIAQEIGREINTLGSKSNHVEMQQIVVQMKDELEQIKEQVLNVL

SEQ ID NO: 46865 - DNA, 864 bp, Photorhabdus luminescens subsp. laumondii TTO1
  CDS (1)..(864)
atgatccgtagtatgactgcttttgcacggcgagatatcaaaagtgaatggggaaatgcggcttgggaactacgctccgttaatcagcgttatttagaaacttatatccgcctaccagaacaattcagaagcttggaaccggtgatccgtgagcgcattcgttcccgtctgactcgcggaaaagttgagtgcaacttacgttttgaactggattcacgctctcaaggcgaacttatcctgaatgaaactttagcaaaacagctagtcaatgcggcgaactgggtcaaacaacagagcaacgaaggtgaaatcaaccctgttgatattctgcgttggcctggcgttatggccgcagaagagcaagacctggatgctatcaacactcaattgttgcaagaactggatacaacactggatgcctttattcaaagccgtgaagccgaaggcaacgcacttaaaattatgattgaacaacgtttggacgcagtaaccgaagaagtcggtaaagttcgccaacaaatgcctgaaatcatgcaatggcagcgggaacgcctgcaaaccaaattggaagaagcgcaggtacagcttgaaaataaccgtcttgagcaagagttagttttactggctcaacgcctcgatgtggcagaagagttagatcgccttgatgcccacaccaaagaaacccgtaatattctaaagaaaaaagaagccgtcggccgccgactggattttatgatgcaggaattcaatcgcgaatctaatacgcttgcctccaaatctatcaacgccgatatcactaactccgctattgaattgaaagtgctaatcgaacagatgagggagcagattcagaatattgagtaa

SEQ ID NO: 46866 - protein, 287 aa, Photorhabdus luminescens subsp. laumondii TTO1
MIRSMTAFARRDIKSEWGNAAWELRSVNQRYLETYIRLPEQFRSLEPVIRERIRSRLTRGKVECNLRFELDSRSQGELILNETLAKQLVNAANWVKQQSNEGEINPVDILRWPGVMAAEEQDLDAINTQLLQELDTTLDAFIQSREAEGNALKIMIEQRLDAVTEEVGKVRQQMPEIMQWQRERLQTKLEEAQVQLENNRLEQELVLLAQRLDVAEELDRLDAHTKETRNILKKKEAVGRRLDFMMQEFNRESNTLASKSINADITNSAIELKVLIEQMREQIQNIE

SEQ ID NO: 46867 - DNA, 888 bp, Rhodopseudomonas palustris CGA009
  CDS (1)..(888)
atgtcgttatcgagcatgaccggatttgcacgcagccacggtgccagcggcccctacgtgttcgagtgggaattgaagtcggtgaacgccaaaggcttcgatttccggatgcggctgccgcccggatgggacgatatcgagccgccggtgcgcaagcgcgccgcggaggtgctgtcccgcggcaccatctacgccaatctcaccgtcaagcgcgccaacgcggtctcggccatccagatcaatcaggatgtgctggcctcggtgttgaaggtcgccagtgagatcgccggcaaggtcgacgcggtcgcgccgagcatcgatggactgctcggcatcaagggcgtcatcgaggtggtcgagcccgaggccgacgaggccgaagagaaggccgcacgtgccgccgtcgagtctgcattcggtgaagcgctgaagagcctcatcgagatgcgcaagcgggaggggtcgagcctcgccgcggtgctggctcaacgtctggatgagctggaagcgcttgccaagcaggcagaggctgcgccgggccgcaagcccgatgcgatcaaggcccgccttgccgaacagatcgcggcgctgctcgatacgtccgaccgcttcgactccgaccggctgcatcaggaagccatcatgatggcgaccaaggccgatattcgggaggagctcgatcgcatcgcttcgcacattgcgcagagccgcgagatgctcgccaagggtggcgccgtcgggcgccggctcgatttcctcgcgcaggaattcaaccgcgaggtcaacacctgctgctccaagtcgatcgatctggagctgaccaatgctggactggcgatgaagaacgtcgtcgagcagttccgcgaacaggttcagaatctggagtaa

SEQ ID NO: 46868 - protein, 295 aa, Rhodopseudomonas palustris CGA009
MSLSSMTGFARSHGASGPYVFEWELKSVNAKGFDFRMRLPPGWDDIEPPVRKRAAEVLSRGTIYANLTVKRANAVSAIQINQDVLASVLKVASEIAGKVDAVAPSIDGLLGIKGVIEVVEPEADEAEEKAARAAVESAFGEALKSLIEMRKREGSSLAAVLAQRLDELEALAKQAEAAPGRKPDAIKARLAEQIAALLDTSDRFDSDRLHQEAIMMATKADIREELDRIASHIAQSREMLAKGGAVGRRLDFLAQEFNREVNTCCSKSIDLELTNAGLAMKNVVEQFREQVQNLE

SEQ ID NO: 46869 - DNA, 879 bp, Bdellovibrio bacteriovorus HD100
  CDS (1)..(879)
atgaaaagcatgactgggtacggcaccgcaagagttcagactaaagacgtcactgtggaagtgagcatccgttccgtgaacggacgtttcctggagccacgttttcacctgcctcgtgaatttgtttcttatgaaggggagttgaagaagattctgagtggaacccttcatcgtggcacggtggatgttttcgtttcccgccgtgtgaagaacacggccagcaaggcgcagatgaccgtgaacgatgccttggccaagaaatacatgtccgcttataagcatctttccaaagagttgggcgtgccctttaatgttcaccttgaggtggtggcaagactgcctgaaatcatcaaagttgaagaaacctatgagcttttcactggtgaagacaagattctgaaaaaagcattcaccgaagcttgttccaactgcgacaaggaacgcgcccgcgaaggcaaatccctgcaaaaggatctgcaaaaactgctggtggctctggaaaaacaagtgaagattatcagtgagttgcgtggcgaagccaatgcgcaacttcaggaccgttacgagcaaaaagttcgtgcgcgccttaaaggcagtgaaatcgattccgcccgtttgtcccaggaaatcgtgattcagctggaaaaagccgacatcaacgaagagctgagccgtcttgcggaacacatcaagaactaccgtcagttggtgggctcggtcaccgctgaaggtaaaaagctggatttctatacccaggaattgctgcgtgaggtgaataccattgggtcaaagtctcaggtagccaagatcactgcggctgtggtagaagcaaaaacccttattgaaagacttagagaacaggttcaaaacgttcagtaa

SEQ ID NO: 46870 - protein, 292 aa, Bdellovibrio bacteriovorus HD100
MKSMTGYGTARVQTKDVTVEVSIRSVNGRFLEPRFHLPREFVSYEGELKKILSGTLHRGTVDVFVSRRVKNTASKAQMTVNDALAKKYMSAYKHLSKELGVPFNVHLEVVARLPEIIKVEETYELFTGEDKILKKAFTEACSNCDKERAREGKSLQKDLQKLLVALEKQVKIISELRGEANAQLQDRYEQKVRARLKGSEIDSARLSQEIVIQLEKADINEELSRLAEHIKNYRQLVGSVTAEGKKLDFYTQELLREVNTIGSKSQVAKITAAVVEAKTLIERLREQVQNVQ

SEQ ID NO: 46871 - DNA, 867 bp, Treponema denticola ATCC 35405
  CDS (1)..(867)
atgaaaagtatgacgggctatgcccttaccgaaaagaccgaacctaattcctttataagtttggaactaaaaagctataattcaagatatttggatttaaatttaaattttcccttttggctttctgcccttgagcctatttttagagcttacttttctgaaaaaatagcccgcggaaaggttgaagtttccctccatgtaaaggatgcggatatagatgtagatatcctcaccaatactaaggttgctaaggcctatgcaaaggctatgagggaggtggccgaggctgcaggaataaaccccgaaatagatataaaccgattttccgaaaaggacggtgtaatcattatagaaaggaatatagatatttccgcttgggaaaacaccctgcttcccatatttgaagagacttttacaaaatacgataagacgaggcttgatgaaggagatgtcttaaaaaaagatattttaagcaatctggacaggatttatgcctcattgaaggtaataaaaaaatatgcgcctcaaatggaagaaattttttgtcaaaatattaaagaaagatttaccgaacttttaggcagcgaaataaatgaacaacgcattatgcaggaagttgccgtaatgcttgtaaagtatacaatcaacgaagaaattgtcaggcttgaagcccattgtaattctctatctcatgagcttaaaaagaatgagcccataggaaaaaaactcgactttatctgtcaagagataaacagggaaataaacaccataggttcaaaaaatcagatgattgaaatggctcagtctattatcgaagtaaaagatgctcttgaaaacataagagaacaaagcaggaatgtagagtag

SEQ ID NO: 46872 - protein, 288 aa, Treponema denticola ATCC 35405
MKSMTGYALTEKTEPNSFISLELKSYNSRYLDLNLNFPFWLSALEPIFRAYFSEKIARGKVEVSLHVKDADIDVDILTNTKVAKAYAKAMREVAEAAGINPEIDINRFSEKDGVIIIERNIDISAWENTLLPIFEETFTKYDKTRLDEGDVLKKDILSNLDRIYASLKVIKKYAPQMEEIFCQNIKERFTELLGSEINEQRIMQEVAVMLVKYTINEEIVRLEAHCNSLSHELKKNEPIGKKLDFICQEINREINTIGSKNQMIEMAQSIIEVKDALENIREQSRNVE

SEQ ID NO: 46873 - DNA, 885 bp, Parachlamydia sp. UWE25
  CDS (1)..(885)
atgcttaaaagtatgactgcctttgggcgagccacatttaatacggaaatggggcattttactgttgaaattcaatccgtcaatcggaagtttttagaaattaatgtctctcttcctccagaattaagctattttgatgtagaaataaaaaaatggatacatccttttattactagaggtcaggtctctgtcaaaattactgcttcatttgaaggaaaatcgccttttatcattgtccctaatttagctttggcaaggcaaatgaaagcggcttgggaagaaatcgctcgtgagacaggatttgagatggatgaaatcaaactttctcttttatctaaagcggatgatattcttctttttgaagaaaaccgttcagaagaagatgcttatcggcgtattttaaggcaggtcctggatcaggccttaacaagttttatccaaatgaaatcccatgaaggggctgttttacaaggggatattttagctagggcagaaaagattcggcgagcaatcaaaatgattgaagaaagaagcccttttgcaactaaaaaatatcgcgaaaagttgctagcccgtttggaagaaattttgcctggtcaaatcgaaaatgaagaacgcattttgagagaaattgctttatttgctgagaaaattgacgtggtggaggaaattgttcgttttgactgccatctcacaaggtttgaggagcgcgttcaatcggctgatgcgagtgtgggaaaaacactggagtttattttgcaagaacttggacgagaagttaataccgttgggagtaagtcttctgacatagaaattgctaaattagtcattgatatcaagagtgaattagaacgaatccgtgagcaaattcaaaatatcgaatag

SEQ ID NO: 46874 - protein, 294 aa, Parachlamydia sp. UWE25
MLKSMTAFGRATFNTEMGHFTVEIQSVNRKFLEINVSLPPELSYFDVEIKKWIHPFITRGQVSVKITASFEGKSPFIIVPNLALARQMKAAWEEIARETGFEMDEIKLSLLSKADDILLFEENRSEEDAYRRILRQVLDQALTSFIQMKSHEGAVLQGDILARAEKIRRAIKMIEERSPFATKKYREKLLARLEEILPGQIENEERILREIALFAEKIDVVEEIVRFDCHLTRFEERVQSADASVGKTLEFILQELGREVNTVGSKSSDIEIAKLVIDIKSELERIREQIQNIE

SEQ ID NO: 46875 - DNA, 882 bp, Desulfovibrio vulgaris subsp. vulgaris str. Hildenborough
  CDS (1)..(882)
atgctgcgcagcatgacgggcttcggccgatgcttcattgaagatgcgggctggacgcagacgtgggaggttcgtagcgtcaacgggcgtcacctcgatgtgaagtggcgtcttcccatgctcctgcgggggcttgaggcgcgtttcgagaaggtgctgcgccgcttcggcacccgtggcagggtggatgtgaccctgtcgcttcaggccctcggcgaggggatgcagggcgtgcgcttcgacgccggacaggcgggtgccatgctcgacgccctgtccgaccttgccgccagccggggcgatacctacgcgcccgactacaaccggctgctggggctgaccttcctgtgggaggacgccggggccgaacccgatgaggagatggtggctgcgctcgaggcgggacttgccgccgcgctggaggactggaacgaatcgcgcgaggcagaggcacgcgccctgtcgcgcgacatggtgtcgcggctcatccgcatggacgagtgggtgtcgcgcatcgaggaacgtgcccccgacatcaaggaagagcgtttcacgctgctgcgcgaccgtctctctgaagcgctcgagggcatgggctcatcgctggaggaagggcgcttcctgcaggagatgaccttgctcgccgacaagcttgatgtcagcgaggaactcacgcggttgcgcgcccacctcgaccgcctgcgtgaactgctcgatggcggcggcgatgcgggcaagcggctcgatttcacgttgcaggagtgcttccgcgagatcaacacgtgcggcaacaagattcaggacgcgcagatttcgcgccttgtggtcgatttcaagaacgaactcgaaaagtgccgcgaacaggtacagaacatcgaatga

SEQ ID NO: 46876 - protein, 293 aa, Desulfovibrio vulgaris subsp. vulgaris str. Hildenborough
MLRSMTGFGRCFIEDAGWTQTWEVRSVNGRHLDVKWRLPMLLRGLEARFEKVLRRFGTRGRVDVTLSLQALGEGMQGVRFDAGQAGAMLDALSDLAASRGDTYAPDYNRLLGLTFLWEDAGAEPDEEMVAALEAGLAAALEDWNESREAEARALSRDMVSRLIRMDEWVSRIEERAPDIKEERFTLLRDRLSEALEGMGSSLEEGRFLQEMTLLADKLDVSEELTRLRAHLDRLRELLDGGGDAGKRLDFTLQECFREINTCGNKIQDAQISRLVVDFKNELEKCREQVQNIE

SEQ ID NO: 46877 - DNA, 864 bp, Erwinia carotovora subsp. atroseptica SCRI1043
  CDS (1)..(864)
atgattcgcagcatgaccgcttacgcccgccgagaaatcaagggcaactggggaagcgcagcctgggaactgcgttccgttaaccagcgctatctggaaacctatcttcgtttaccggaacaattccgcagcctcgaacccgtcgcccgtgagcgcatccgcgcccgtttgacacgcggcaaaatcgaatgcaacctgcgctttgaactcgacccaagtgcacaaagtgcgttgatcctgaacgaaaaactggctaaacagctggttaatgccgctaactgggtcaaaatgcagagcgacgagggtgaaatcaacccggtcgatattctgcgctggccgggagtgatgttggcagaagagcaggatctggacaccatcagcactgagctactgaaagcactggaaggtgcgctggatgacttcatcgccgcccgtgaaagcgaaggcaacgcgttgaaagccctgatcgaacagcgtctggctggtgttagcgccgaagtgaccaaagtccgtgcccagatgccgaacgtcctgctatggcagcgcgagcgcctgcaaagcaagctggaagatgcgcaggtacagttggaaaataaccgtctggaacaggaactagtgctgatggcgcagcgcgtcgacgtcgccgaagaactcgaccgcctcgatgctcacgtcaaagaaacctacaaaatcctgaaaaaagaagaagccgtcggccgccgcctcgacttcatgatgcaggaattcaaccgcgaatcgaacacgctggcctcgaaatccatcaacgccgacgtaaccgcttcagcaatcgagttgaaagtgctgatcgagcaaatgcgggaacagattcagaacatcgagtag

SEQ ID NO: 46878 - protein, 287 aa, Erwinia carotovora subsp. atroseptica SCRI1043
MIRSMTAYARREIKGNWGSAAWELRSVNQRYLETYLRLPEQFRSLEPVARERIRARLTRGKIECNLRFELDPSAQSALILNEKLAKQLVNAANWVKMQSDEGEINPVDILRWPGVMLAEEQDLDTISTELLKALEGALDDFIAARESEGNALKALIEQRLAGVSAEVTKVRAQMPNVLLWQRERLQSKLEDAQVQLENNRLEQELVLMAQRVDVAEELDRLDAHVKETYKILKKEEAVGRRLDFMMQEFNRESNTLASKSINADVTASAIELKVLIEQMREQIQNIE

SEQ ID NO: 46879 - DNA, 894 bp, Desulfotalea psychrophila LSv54
  CDS (1)..(894)
gtgaaaactatgtcagttaagagtatgacgggatttggcagaggggaagcggagaacagtactcgcacttggaatgtcgaggttcgcagtgtcaataatcgttatctggatgtgaaaataaaattgccaaggggctatgcaagtctggaagatcgagtgcgcaacgccgtatcagaacattttcagcgtggacgtgtggatctgctggttaatgttcagggtgatttttctgatttggtagagctctcggtgaatacctctcttgcccaaaagtatcaggatgcccttggtggaattgcagagagctgtggctgtgcttctgagctgacagcactccagttggcaacgttccctgaggtcttggttcgggagcaaaagagtgaggatcttgaagaggttgtctggcctgtcctctctggagccatagaggctgcccttacgggttgcgatcttatgcgtcttcaggagggagaaattttaatggaggatctgcttggccggttgagatttttttcaaagaccgttgaagagatagagctccatgttcctgcgcttgtggctcagcgtcatcaggctcttcaggagagactgcagaagctgctcgacaatgttcagcttgatcctcttcgtcttgcccaagagatagctctcttggcggataagactgatgtgacagaggaaattgttcgtctccgtagccatatcgctcagttttcccgttttgtggaagaggaagggaccgttggtcgtaaactggattttttgattcaggaatttctgcgcgaggtgaataccattgcctcaaagatcaacgatgcagatatagcccatcttacggtagcccttaagagtgagttggaaaagatacgtgagcagatacagaatatcgaataa

SEQ ID NO: 46880 - protein, 297 aa, Desulfotalea psychrophila LSv54
MKTMSVKSMTGFGRGEAENSTRTWNVEVRSVNNRYLDVKIKLPRGYASLEDRVRNAVSEHFQRGRVDLLVNVQGDFSDLVELSVNTSLAQKYQDALGGIAESCGCASELTALQLATFPEVLVREQKSEDLEEVVWPVLSGAIEAALTGCDLMRLQEGEILMEDLLGRLRFFSKTVEEIELHVPALVAQRHQALQERLQKLLDNVQLDPLRLAQEIALLADKTDVTEEIVRLRSHIAQFSRFVEEEGTVGRKLDFLIQEFLREVNTIASKINDADIAHLTVALKSELEKIREQIQNIE

SEQ ID NO: 46881 - DNA, 870 bp, Borrelia garinii PBi
  CDS (1)..(870)
gtgaaaagcatgacgggattttttcatttggaaaagataattggcaactatatgtttagtgttaatttaaagtcttataatggaaaatttttagaatttaaacttagactaccagaaatttttactagttatgatcttgatataagaaatttgatttcaaaatatattagcagaggaaatgtttttttaaatgtaggatataaagaattggttcctagtatgaattttacagttaatcctaattacattgaggctatttctagacttagagattctttggcacataccgatcttaatattaaaaacgaactaagtttaggcgattttttatcgttaaaaggagctttgataattgttgatgaagatactgagcatcaagaagagatttatggtctatttaaaggtgttttagaggaaaccttatttcattataataatgccagaagttttgaaggagaaaatactaaatcagatatagtgtcaacccttgcgctaatagagcgggatcttaaaattgttaagaatgcttgtaatgatataaatgttagattatttgcaagcattaaagaaaatatctctaaattaatggatgaatttagagatttaaacattgcagaagaggcagctaaaatggcaattcgcctagacatcaatgaagagatcatacgcttagattctcatatagaagttttttataaaaatcttgaatatgaaatatgtggcaaagttcttgaatttatttctcaagaaatgcatagagaaataacaactatgagtaataaggcggttgatcttgatattaaaaatttgattttaaatatgaagttaaatttagaaaaaataaaagagcaaataaggaatgttgaatga

SEQ ID NO: 46882 - protein, 289 aa, Borrelia garinii PBi
MKSMTGFFHLEKIIGNYMFSVNLKSYNGKFLEFKLRLPEIFTSYDLDIRNLISKYISRGNVFLNVGYKELVPSMNFTVNPNYIEAISRLRDSLAHTDLNIKNELSLGDFLSLKGALIIVDEDTEHQEEIYGLFKGVLEETLFHYNNARSFEGENTKSDIVSTLALIERDLKIVKNACNDINVRLFASIKENISKLMDEFRDLNIAEEAAKMAIRLDINEEIIRLDSHIEVFYKNLEYEICGKVLEFISQEMHREITTMSNKAVDLDIKNLILNMKLNLEKIKEQIRNVE

SEQ ID NO: 46883 - DNA, 879 bp, Symbiobacterium thermophilum IAM 14863
  CDS (1)..(879)
ttggcgcgcagtatgacggggttcggacggggcgaggccagcggcgaagcgggcagggtgaccgtcgaggtgaaggcggtcaaccaccggttttccgaggtcgtcttccgcatgccccgccagttcagcgccctggaggaccgggtgcgccggctgatccaggggcggacggcccggggccgtttcgaggtgtacgtcgcgtgggagccctcggccgaggcccgggcggtaaaggttgacaaggatctggcgctggcatattataatgctttgaggcagctagcggaagagatcgggagcaatcaggagctttcgctcgatacgctggcgagactgcctgaggtcctctctgttcaggagggggagctttccgacgacgagatctgggccctgctggagccggcgctgacgcaggcgatggcggggctgatcgccatgcgggagcgggagggcgccgccctggccgcggacctggccggccgcctggaccgcctggaggcgttccgggccgcggccgcggctcgtgcaccgcaggtggtggaggagtaccgccagcggctcacccgccgcctggaggagctgttgccgccgaccaacccggtcgatccgcagcggctcgcccaggaagtggccctgttcgccgaccgtgcggacatcacggaggagctgcagcggctggccagccacatcgaccagttccgccgggcgctggagaccgacgacgccgtgggacgcaagctggacttcctggtccaggagatggggcgcgaggtgaacaccatcgggtccaaggccaacgacgccgacctggcggcggcggtcgtggcggccaagagcgagctggagaagatccgggagcaggtccagaatctcgaatag

SEQ ID NO: 46884 - protein, 292 aa, Symbiobacterium thermophilum IAM 14863
MARSMTGFGRGEASGEAGRVTVEVKAVNHRFSEVVFRMPRQFSALEDRVRRLIQGRTARGRFEVYVAWEPSAEARAVKVDKDLALAYYNALRQLAEEIGSNQELSLDTLARLPEVLSVQEGELSDDEIWALLEPALTQAMAGLIAMREREGAALAADLAGRLDRLEAFRAAAAARAPQVVEEYRQRLTRRLEELLPPTNPVDPQRLAQEVALFADRADITEELQRLASHIDQFRRALETDDAVGRKLDFLVQEMGREVNTIGSKANDADLAAAVVAAKSELEKIREQVQNLE

SEQ ID NO: 46885 - DNA, 864 bp, Mannheimia succiniciproducens MBEL55E
  CDS (1)..(864)
atgatttacagcatgacagcctttgcacgccacgagatcaaaaaagattggggcgatgccgtatgggaaatccgttccgttaatcaacgttatttggaaaatttttttcggttgccggaacagtttcgcggtttagaaaacaatctgcgcgaaaaactgcggcaaaaccttacgcgcgggaaaatcgaatgcagtttacgcatcgacagtaaaaaacaaaccagtgccgaactgaatttaaataaagatctcgccgaacaggttattcagtccctaaaatggattaaacaacaagcgggtgaaggggaaattaatttaaatgacgtgttacgttatcccggtgtagtagaagcgccggaacaggatcttgacgccatcagccaggatttattaaacgctttcgacgaattattaaaagacttcattgccatgcgtgcccgcgaaggggaaaaattacacaccgttattcggcagcgtctggacgctatttcagtggaggccgataaagtgcgcgcacaaatgccggaagtgctgcaatggcaacgcgatcgcattctgcaacgttttgaagaaatccaactgcaaccggatccgtcccgtttagaacaggaaatggtgttgttggcgcaaagaattgatgtggcggaagaacttgaccgcctgcaaatgcatgttaaagaaaccgcctcgattctgaaaaaaggcggtgcggtcgggcgtaaactggattttatgatgcaggaattaaatcgcgaatcaaataccctcgcctcaaagtcaattaatgcggatatcaccgcttccgccgtggaattaaaagtattaatcgaacaaatgcgcgaacaaattcaaaatttagaataa

SEQ ID NO: 46886 - protein, 287 aa, Mannheimia succiniciproducens MBEL55E
MIYSMTAFARHEIKKDWGDAVWEIRSVNQRYLENFFRLPEQFRGLENNLREKLRQNLTRGKIECSLRIDSKKQTSAELNLNKDLAEQVIQSLKWIKQQAGEGEINLNDVLRYPGVVEAPEQDLDAISQDLLNAFDELLKDFIAMRAREGEKLHTVIRQRLDAISVEADKVRAQMPEVLQWQRDRILQRFEEIQLQPDPSRLEQEMVLLAQRIDVAEELDRLQMHVKETASILKKGGAVGRKLDFMMQELNRESNTLASKSINADITASAVELKVLIEQMREQIQNLE

SEQ ID NO: 46887 - DNA, 876 bp, Bacillus licheniformis ATCC 14580
  CDS (1)..(876)
atgatacggagtatgaccggtttcggcagcgcgagcaaaacgaaggatgggctgacagcagctgttgagctgaaatctgtcaactatcggtttaaagaagtaaacgcccgcatgccaagacctttgctctatttagaagacaaaataaagcaaacgatttttaaacatatacaaagggggcggctggagctgtttgtttccgttgacgacgaggctctggtcacccggaaaatccaggttgactggccgctgcttgaagagtaccagaaagccgcgcgcgaaatgaaagaccgctgcgggctttctggagacatcacgcttcaagacgcctttcagtttgagcatgtcatccaagttgaagaagagccaatccaaaatgacaagcttgaagaggttcttctggaagcggtcgaggctgccgttctagaattgtgcagcatgcgcgaagcggaagggctgaggctgaaggacgactgccttcagcatattgaaaggcttgaaaagctgacagacgacatcgcagagcttgctcccaaggtcgtcgaccactatcgggaacgccttgaggcgcggcttgaagaatggtcaacagacggtctcgatgaaagccgcctgctgacggaagtcgcactgtttgcagaccgttcggatatcacggaagaagtgacgaggctgaaaagccatttccgccagttccgcgatatttgcaaagcgggaggagccgcggggagaaagctcgatttcctcgtccaggagctcaaccgtgaagcgaacacgatcggttcaaaagcgaatgatcaccagatcacaaaacatgtggtcgaaatgaaaagctctattgaaaaaataaaagaacaagtgcaaaatatagaatag

SEQ ID NO: 46888 - protein, 291 aa, Bacillus licheniformis ATCC 14580
MIRSMTGFGSASKTKDGLTAAVELKSVNYRFKEVNARMPRPLLYLEDKIKQTIFKHIQRGRLELFVSVDDEALVTRKIQVDWPLLEEYQKAAREMKDRCGLSGDITLQDAFQFEHVIQVEEEPIQNDKLEEVLLEAVEAAVLELCSMREAEGLRLKDDCLQHIERLEKLTDDIAELAPKVVDHYRERLEARLEEWSTDGLDESRLLTEVALFADRSDITEEVTRLKSHFRQFRDICKAGGAAGRKLDFLVQELNREANTIGSKANDHQITKHVVEMKSSIEKIKEQVQNIE

SEQ ID NO: 46889 - DNA, 870 bp, Methylococcus capsulatus str. Bath
  CDS (1)..(870)
atgatccgcagcatgacggctttcgggaccgcgcaagggacggtgggaaactggcgggtgagctgggacctgcgtgccgtcaatcatcgctatctcgatgtcggcctgcgcctgccggatcccctgcgcggcctggaactggcggtgcgcaacaggataggcgagtcgttcaagcgggggcgggtggactgcaccctgacgtggagaccctcggcgccggaagccggcccgacatgtatcgacaccgcgctggtacgcggcctgctcggtgcgctgcgaaacgtcgaagcgctggaagaccgcagctggaccggcctgagcgccatcgaactgctgcgctggccaggcgtcatgcaggaaagcgagccggacctcgccacgctcgaacccgggctcctcgccgtgctcgaccgggcgctggccgaggcgcgggcgttccgtgagcgcgagggcgcccagatcgccgcgttgctggacctgcgctgtgccgacatccagcgcgcggtcggcgcggtacgggagcgcctgccggcgattctcgccggtatccggaacaaactgagggcgcggctggccgaactggccgccgagcccgatgccgcccgcctcgaacaggaactggtctacctcgcgcagaagatggacgtcgccgaagagctggatcgactgaccgcgcataccactgaaatgcggcacatcctcacccaacgggaacccgcggggcgccgcctggatttcctgatccaggaaatgaaccgcgaggccaacacgctggcgtccaagtcggccgatctggagaccacccgcgcggccgtggacatcaaggtactgatcgagcagatgcgcgaacaggtccagaacgtggagtga

SEQ ID NO: 46890 - protein, 289 aa, Methylococcus capsulatus str. Bath
MIRSMTAFGTAQGTVGNWRVSWDLRAVNHRYLDVGLRLPDPLRGLELAVRNRIGESFKRGRVDCTLTWRPSAPEAGPTCIDTALVRGLLGALRNVEALEDRSWTGLSAIELLRWPGVMQESEPDLATLEPGLLAVLDRALAEARAFREREGAQIAALLDLRCADIQRAVGAVRERLPAILAGIRNKLRARLAELAAEPDAARLEQELVYLAQKMDVAEELDRLTAHTTEMRHILTQREPAGRRLDFLIQEMNREANTLASKSADLETTRAAVDIKVLIEQMREQVQNVE

SEQ ID NO: 46891 - DNA, 867 bp, Legionella pneumophila str. Paris
  CDS (1)..(867)
atgattcatagtatgacggctttttctcgaatacaaaagcagtttgatataggtgatttttgttgggaaatcaggtctgttaaccatcgctatctcgatgtctcttttcgtttgccggagccctttcgatttcttgaagcagagttaagatccttgcttcgcgataagatacatcggggtaaactggagtgccatctaaagtacaaggacacaagttgtgataatcggtctatgcttataaatataggtacgattaatgcattacttgatttaagcagtaaattatctacctctcatcatctggctaatgatatgactgttagtcaagtgctttcatggccaggtgttgtggaggctaatccgctggatattgaggaattgtctcaaattgctttggagttatttcagaaaagtatcgataaattgtgtgaagtcagagctggagaaggcaggtcattaaaggcatatgttgaagaccgattgcaggctttgcgccaagaggtaatgaaatccaaaagcattgtggtttcaatgagtgccaagactaaagataaattacttacgcgtttgcatgaattgcaaatggacgttacagaggtgcgtgtagagcaagaaattgctttgctattagccaaacttgatgtgagtgaagagctggataggttagagactcatatagcggaagtaagccgcactttgaatgcagaaaaggtgacgggtagaagactggattttttaatgcaagaattaaatagagaggcgaataccctaagctcaaaatcggattcagcagagttaactttatgtgctgttgaaatgaaagtattgattgagcagatgcgtgaacaaattcagaattttgagtaa

SEQ ID NO: 46892 - protein, 288 aa, Legionella pneumophila str. Paris
MIHSMTAFSRIQKQFDIGDFCWEIRSVNHRYLDVSFRLPEPFRFLEAELRSLLRDKIHRGKLECHLKYKDTSCDNRSMLINIGTINALLDLSSKLSTSHHLANDMTVSQVLSWPGVVEANPLDIEELSQIALELFQKSIDKLCEVRAGEGRSLKAYVEDRLQALRQEVMKSKSIVVSMSAKTKDKLLTRLHELQMDVTEVRVEQEIALLLAKLDVSEELDRLETHIAEVSRTLNAEKVTGRRLDFLMQELNREANTLSSKSDSAELTLCAVEMKVLIEQMREQIQNFE

SEQ ID NO: 46893 - DNA, 864 bp, Photobacterium profundum SS9
  CDS (1)..(864)
atgattcatagcatgaccgcttatgctcgtcgcgaaattaaaggcgattggggcactgccgtttgggaaattcgttcagttaaccaacgttacctagaaacctaccttcgcatgccagagcaattccgtagtttagagcctgtactacgtgagcgttttcgtaagcgcctagcccgcggtaaagttgaatgtaacctgcgttttgaagcgaaccaagcagcaagcagcgaactcaccatcaatgaagaattagccaagcaagtcattaaagccgctaagtgggtaaaagacacggcgggtgaaggcaacattggtccttttcaggtattgaactggcctggtgtaatggaagcccctgagcaagatttggatgcgatcaataaagatttattggttggttttgatgaagcgattgctgactttattgccgcacgtgcaagcgaaggcgaaaacatgaaggaattgattgttcaacgccttgatgccattaccgctgaagcaaccaacgtacgcgcacaaatgcctgacattattaaatggcaacgtgaacgtctaaccagccgctttgaagatgcaaaagtggagctggatgctggtcgtattgagcaagagctgatcatgatggcacaaaaaagtgatgtcgctgaagagctagatcgcctagattcgcatgtgaaagaaacacaaaaaatcatgaagaaaggaggcgcatgtggccgtcgtcttgatttcatgatgcaagaattcaaccgcgaatcgaatacgctagcatcaaaatcaatcacgactgaaatcacagcatctgctgttgaattaaaagtattgattgagcaaatgcgcgagcagatccaaaacatcgaataa

SEQ ID NO: 46894 - protein, 287 aa, Photobacterium profundum SS9
MIHSMTAYARREIKGDWGTAVWEIRSVNQRYLETYLRMPEQFRSLEPVLRERFRKRLARGKVECNLRFEANQAASSELTINEELAKQVIKAAKWVKDTAGEGNIGPFQVLNWPGVMEAPEQDLDAINKDLLVGFDEAIADFIAARASEGENMKELIVQRLDAITAEATNVRAQMPDIIKWQRERLTSRFEDAKVELDAGRIEQELIMMAQKSDVAEELDRLDSHVKETQKIMKKGGACGRRLDFMMQEFNRESNTLASKSITTEITASAVELKVLIEQMREQIQNIE

SEQ ID NO: 46895 - DNA, 876 bp, Geobacillus kaustophilus HTA426
  CDS (1)..(876)
atggtttacagcatgaccggcttcggcgcaagcacaaaaaaaacggatcgtttgatggtggcggtggaaatgaaatcggtcaaccaccggttttgcgaaatttccattcgcctccctagacaatggctcgtgtttgaggataaaataaagaaagcaattttgccgtacgtgcggcgcggaaaagtggaagtgttcgtcacgattgccggcgaaggacttgtaaagcggaacgtacatattgattgggatttgctcagccaatattgggccgggttgcaggaggcagcaaagcgatttgccgttgacggcagcgtgacggcggccgagctgcttcggcttgatggggcggtcgaagtggtggaagaggaaggagcgaacgaggaggtcgagccgctgcttttgaccgctgtcgatgaagcggcaaaggcacttgttgccatgcgccggcgcgaaggggaggcgcttgccgcggatttgcgcgcccgtcttcatgaagtcgaagccggggtggaagccattgaacagcgggcgccgcttgttattgaacaataccgcgagcggcttgcgcgccgcctgcgcgaatgggcgcccgctccggtcgatgaggcgcgcctgctcacagaagtggcggtgtttgccgaaaaggcggacattcatgaggaattgaaacgcatccgcagccatttggcgcaaatggcagacgccttagaaatggacgaaccgatcgggaggaagctggactttttggtgcaagagttgaaccgggaagtcaacacgatcggcgccaaggcaaacgacagcctgattgccgcgcaagtcgttgagatgaaaagcgtacttgagaaaatgcgcgagcaagtgcaaaacgtggaataa

SEQ ID NO: 46896 - protein, 291 aa, Geobacillus kaustophilus HTA426
MVYSMTGFGASTKKTDRLMVAVEMKSVNHRFCEISIRLPRQWLVFEDKIKKAILPYVRRGKVEVFVTIAGEGLVKRNVHIDWDLLSQYWAGLQEAAKRFAVDGSVTAAELLRLDGAVEVVEEEGANEEVEPLLLTAVDEAAKALVAMRRREGEALAADLRARLHEVEAGVEAIEQRAPLVIEQYRERLARRLREWAPAPVDEARLLTEVAVFAEKADIHEELKRIRSHLAQMADALEMDEPIGRKLDFLVQELNREVNTIGAKANDSLIAAQVVEMKSVLEKMREQVQNVE

SEQ ID NO: 46897 - DNA, 864 bp, Idiomarina loihiensis L2TR
  CDS (1)..(864)
atgattcaaagtatgaccggttatgctcgttacgagcaaaaagccgactggggcaccgcagtttgggaaattcgttccgttaaccaacggtatctggaaacctacttccgcctgccggaaacctttcgctctctggaaaattcactacgtgagcagtttcgtaaaaagctgcagcgcggcaaagtcgagtgcaagcttagcctgcaggtagacgaagcgcagcaaagcgctttgtcgattaacgaagacctggcaaaaagcgtgattgccagcgccaagtgggtgagtcagcattccgctgcagggcagttaaaccctattgatgttttaaagtggcctggcgttgttgctgctcaggaccaggacatggacgagctgcaaaaagacgttttggccgcactggaaaagaccactaacgactttatcgagaaccgcaaaagcgaaggcgcagccattgataaaatgctgcaggaacgcctcgacggtgtgaccacgcaggtggcttttgtgcgtgagcgcatgccggaagtgatggcctggcaacgtgagcgcttactaacccgttttgaagaagctaaagttgagttagagccgcagcgcgtagagcaggaaatggtgatgctggcgcagaaaaccgacgtagccgaagagctcgaccgcttagacgcccacgtggaagaagcccgcaaaatactgaaaaaaggcggcccttgcggacgacgcctggactttatgatgcaagagttcaaccgcgaagcaaatacactcgcctctaagtctatcaactctgacattaccgcggctgcggtggaattaaaggttttgattgagcagatgcgtgagcagatccagaacatcgaataa

SEQ ID NO: 46898 - protein, 287 aa, Idiomarina loihiensis L2TR
MIQSMTGYARYEQKADWGTAVWEIRSVNQRYLETYFRLPETFRSLENSLREQFRKKLQRGKVECKLSLQVDEAQQSALSINEDLAKSVIASAKWVSQHSAAGQLNPIDVLKWPGVVAAQDQDMDELQKDVLAALEKTTNDFIENRKSEGAAIDKMLQERLDGVTTQVAFVRERMPEVMAWQRERLLTRFEEAKVELEPQRVEQEMVMLAQKTDVAEELDRLDAHVEEARKILKKGGPCGRRLDFMMQEFNREANTLASKSINSDITAAAVELKVLIEQMREQIQNIE

SEQ ID NO: 46899 - DNA, 867 bp, Azoarcus sp. EbN1
  CDS (1)..(867)
atgatccacagtatgaccggtttcgctgcacagacgcgggacctcgggccagtgagcctgcatatcgaactgcgcagcgtcaattcacgctacctcgatctgttcttccgcatcggcgacgaactgcgtcaggccgaaccggcgctgcgcgagcggatcacggcgaaactcacgcgtggcaaggtcgaatgccgcctcaacctgcagacgaacggtgccgccccgcgcagcctcgcgctgaacactgcgctgctcgaccagctgcgtgccgccgaacagctcgtgcgcgaacgcctgccgcaggccgggtgcctgtcggtcaatgaagtgctgcgctggcccggcatgctcgccgacgacggcgtgagcttcgagcagctgcagccggcgctgctcgaactcgcgcaggccgcgctcgacgaactcgccgcgacgcgccggcgcgaaggcggcaagctcgccgcgatgatccgcgagcggctcgtccgcctgcgtgaactggtcgcccaggccgagccccgcgtgcccgtgatcgtcaccgaataccaggagcggctcgcgacgcggctgcgcgatgcggtcgcctcgctcgacgaggaccgcatccgccaggaagtcgcgctgttcgcccaccgcatcgacgtcgccgaggaactgtcgcgcctcagcactcatctcgacgaagtcgaacgcatcctcgctgccggcggcgcagcaggaaaacgactcgacttcctgatgcaggagctgaaccgcgaagcgaacaccctggcctcgaaatccgccgccaccgacgtcaccggtatcgcgatggaaatgaaagtgctgatcgagcagatgcgggagcaggtgcaaaacattgaatga

SEQ ID NO: 46900 - protein, 288 aa, Azoarcus sp. EbN1
MIHSMTGFAAQTRDLGPVSLHIELRSVNSRYLDLFFRIGDELRQAEPALRERITAKLTRGKVECRLNLQTNGAAPRSLALNTALLDQLRAAEQLVRERLPQAGCLSVNEVLRWPGMLADDGVSFEQLQPALLELAQAALDELAATRRREGGKLAAMIRERLVRLRELVAQAEPRVPVIVTEYQERLATRLRDAVASLDEDRIRQEVALFAHRIDVAEELSRLSTHLDEVERILAAGGAAGKRLDFLMQELNREANTLASKSAATDVTGIAMEMKVLIEQMREQVQNIE

SEQ ID NO: 46901 - DNA, 891 bp, Silicibacter pomeroyi DSS-3
  CDS (1)..(891)
atgatcagatccatgaccggttttgcctcggcgcgcggcgagatggcgccattcagctggagctgggagctgcgcagcgtcaatgccaaggggctggacctgcgcctgcgcgtgcccgattggctggaagggttggaaaccgcgatccgcgccgatctgggcaaggcgctgggtcggggcagcgtcacgctcagcctgcggctgtcccggggcgaagagggcgcggcgctggcgctgaaccccgccgcgctgtcggcggtgctggacgcgctgtccgaggtcgaggatcaggcgatgacgcgcggcatgacgctggcgccctcgcgcgcggcggaccttctggcgctgcgcggggtgctggaggcgggtggcggcagcgacgacccggcaccgctggtaaagcggctgaaggccgagctgggcccgctgattgccgcattcctgcagatgcgcgagaccgagggagccgcactggccgaaatcctgcaaggcaacctgatccgtgtcgcggatctgaccgcgcaggcggcggcgctggctgaagcgcgcaaaccgctggtggccgagacgctgcgcgccaatctggcccgagtgctggacaatacggacggcgccgatcccgaccgggtggcgcaggaattggccatgcttgccgtcaaagccgacgtgaccgaggaactggaccgcctgcaggcccatatcaaggccgcccgcgacctgctggccaagggcggcgcggtggggcgcaagctggatttcctgatgcaggaattcaaccgggaagcgaacactctgtgttcgaagtcacaaaacgctgatctgaccggggtagggttggagctgaaagcggtgatcgaccagatgcgcgaacaggtccagaatgtggaataa

SEQ ID NO: 46902 - protein, 296 aa, Silicibacter pomeroyi DSS-3
MIRSMTGFASARGEMAPFSWSWELRSVNAKGLDLRLRVPDWLEGLETAIRADLGKALGRGSVTLSLRLSRGEEGAALALNPAALSAVLDALSEVEDQAMTRGMTLAPSRAADLLALRGVLEAGGGSDDPAPLVKRLKAELGPLIAAFLQMRETEGAALAEILQGNLIRVADLTAQAAALAEARKPLVAETLRANLARVLDNTDGADPDRVAQELAMLAVKADVTEELDRLQAHIKAARDLLAKGGAVGRKLDFLMQEFNREANTLCSKSQNADLTGVGLELKAVIDQMREQVQNVE

SEQ ID NO: 46903 - DNA, 891 bp, Rhodobacter sphaeroides 2.4.1
  CDS (1)..(891)
atgatcagctcgatgaccggcttcgcggcgcgccgcggccagggcgagggccactcctggctctgggaactgcgctcggtgaacggcaagggcctcgatctgcggttgcgggtgccggactggatcgaggggctggagcccgcgatccgggccgaactcggccgggttctgcaacggggcagcgtcagcctctcgctcaaggtcgcggccgagggcggaacggacgggctccgggtcaacgtcggcgcgctccagtcgatgctgcgcgcgctggccgaggtttcggcggctgcgcacggctcggggatcgagctgcgcccggcgagcccggccgacgtgctggggctgcgtggcgtcctcgaacaggcgacgggggtcgaggatacgggcccgctccgcgcggcgctgctggccgaactgccggagctgctggcggccttcaccgagatgcggcgcagcgagggcgaggctctggcccggctgatcggcgcgcagctcgaccggatcgaggcgcttactgccgaggcccgcaccgaggccgaggcgcgccgcgaggccgcgccattcgcgcttcgtgaaaatctggcccgtctcctcgcggcaggcgagggtctcgacgagacccgcatcgcgcaggagctggcgcttctggccgtcaagcaggacgtgaccgaagagctcgaccggctggcggcccatgtcgcggccgcccgcacgcttctgggcgagacggcgcccgtggggcggcggatggatttcctcgtgcaggagttcatgcgcgaggccaacacgctctgctcgaaggcgcagtcgctggcgctgacgcgggtcgggctcgacctgaagaccgtcatcgaccagatgcgcgagcagatccagaacgtggagtaa

SEQ ID NO: 46904 - protein, 296 aa, Rhodobacter sphaeroides 2.4.1
MISSMTGFAARRGQGEGHSWLWELRSVNGKGLDLRLRVPDWIEGLEPAIRAELGRVLQRGSVSLSLKVAAEGGTDGLRVNVGALQSMLRALAEVSAAAHGSGIELRPASPADVLGLRGVLEQATGVEDTGPLRAALLAELPELLAAFTEMRRSEGEALARLIGAQLDRIEALTAEARTEAEARREAAPFALRENLARLLAAGEGLDETRIAQELALLAVKQDVTEELDRLAAHVAAARTLLGETAPVGRRMDFLVQEFMREANTLCSKAQSLALTRVGLDLKTVIDQMREQIQNVE

SEQ ID NO: 46905 - DNA, 870 bp, Desulfitobacterium hafniense DCB-2
  CDS (1)..(870)
atgacagggtttggcaggggggaagcctccggttacggttaccaattcaccatcgagctgaaagcggtcaatcatcgctttttcgagacgtcggtacggatgccccgccatctgaatagtttagaagatagaatacgcaaaatcctgcaaagcaaaatcaaccgcggacgtattgatgtctatgttaatgtgaaggaaaccgaagaaaaaaagagattggtgaaggttgacaaagatttagccctgtcgtatgataagacactgaaggaactcgctttagccctcaatacaacctatgagacggatatttaccgtttagctgccttgcccgaggtttttgacctagaggatacggatattgatctggaactgatttgggaacccttgagccgtgccgtagccgaggctttgaatggcttcacagccatgcggcaggtggaaggggaaggcttagcggcagatcttttgcaccgtttacataccatcatgctggctaaagatgaaatagcaggttataccgacagcatcgttatagattatcaaacccgcttacaggagaggatagaggtccttctgggagataaggccattctcgatgaagctcgcctggccaatgaagtggctttttttgcagacagagcatccattaccgaagaattggttcgtctgcagagccatattgaccaaggccgggaagctctgcaaagctctgaacccgtcgggcgcaagctggattttctggttcaggaaatgaaccgggagatcaataccattggctcgaaggctaataatttaagcattactcagcatgtcgttcagatgaaaagcgaattagagaaaattcgggaacaagttcaaaatctggaataa

SEQ ID NO: 46906 - protein, 289 aa, Desulfitobacterium hafniense DCB-2
MTGFGRGEASGYGYQFTIELKAVNHRFFETSVRMPRHLNSLEDRIRKILQSKINRGRIDVYVNVKETEEKKRLVKVDKDLALSYDKTLKELALALNTTYETDIYRLAALPEVFDLEDTDIDLELIWEPLSRAVAEALNGFTAMRQVEGEGLAADLLHRLHTIMLAKDEIAGYTDSIVIDYQTRLQERIEVLLGDKAILDEARLANEVAFFADRASITEELVRLQSHIDQGREALQSSEPVGRKLDFLVQEMNREINTIGSKANNLSITQHVVQMKSELEKIREQVQNLE

SEQ ID NO: 46907 - DNA, 864 bp, Actinobacillus pleuropneumoniae serovar 1 str. 4074
  CDS (1)..(864)
atgatttacagtatgaccgctttcgcccatttagaaattaaaaaagagtggggtaatgccgtgtgggaaatccgctcggttaatcaacgttttttagagacctattttcgtttaccggagcaattccgtaatttagaaatgaccttacgcgagcgtttacgtgcatcacttacacgcggaaaagtagaatgtagtttacgtatcgaattaagcaataaccaaaatagtgaattggcattaaataaagcgtatgcggaaaaggtaatcagctcattacaaaccttgcgaggcattgctggtgagggtgagatcaacttagtggatattttacgttatccgggggtggttgatgctcaaacacaagatttggatcaaatcgggcaagacctgttagccggtttcgaacaaattttagcggactttattgcgatgcgtggtcgtgaaggtgccaatttacaagcattgatccaacagcgattagatacgattgccgagatcgcaaccaaagtacaagcgcaaatgccggaaattctgcaatggcagaaagataaattacaacaacgttttgatgagctgaatttgcaattagatccgcaacgtttagagcaagaaatggtgttaaccgcacagcgtgtggatgtggcggaagaattagaccgcttgcaattacacgtgaaagaaacgactaacgtcttgaaaaaaggcggagcggtaggtcgtaaattggactttatgatgcaagagctaaatcgtgaatccaatacgttggcatcaaaatctattaatgcggacgtaaccaattcagcggttgaattaaaagtattaatcgaacaaatgcgtgagcaaattcagaatttagagtag

SEQ ID NO: 46908 - protein, 287 aa, Actinobacillus pleuropneumoniae serovar 1 str. 4074
MIYSMTAFAHLEIKKEWGNAVWEIRSVNQRFLETYFRLPEQFRNLEMTLRERLRASLTRGKVECSLRIELSNNQNSELALNKAYAEKVISSLQTLRGIAGEGEINLVDILRYPGVVDAQTQDLDQIGQDLLAGFEQILADFIAMRGREGANLQALIQQRLDTIAEIATKVQAQMPEILQWQKDKLQQRFDELNLQLDPQRLEQEMVLTAQRVDVAEELDRLQLHVKETTNVLKKGGAVGRKLDFMMQELNRESNTLASKSINADVTNSAVELKVLIEQMREQIQNLE

SEQ ID NO: 46909 - DNA, 855 bp, Dechloromonas aromatica RCB
  CDS (1)..(855)
atgactggttatgccgttaaaacgcgcgatattgagcgcggaacactgcaacttgagcttaaaagcgtcaattcccgctatctcgattttcatttccgcgtcagtgatgaattgcgctcgctggaaatgcccctgcgtgaattgctggccgcgagattatcacgcggcaaagtggaatgccgactctctttcaatgcctcggcggcccgtgccgatcagctgcaactcaatggcgaactgctcgcgtcactgaagctgctgagcgagcgtgtgcggcatgaaatgcccgatgccagcccgctatcggtcaacgaaaccctgcgctggccaggcatgttcggcgaccaaagcgtcgatttcgctgcttttggaccggtcgtcatggcgctggcgcgcgaggtgctcgatgaatttaccgccagtcgggggcgcgaaggcgacaagctggcggcgatgatcgtcgagcgcgtcaatggcatgcgcgacatcgtgcgccgggtggcaccccgtattcctgaagcccaggcgatattcaccgacaagctgcgtcaacgtttgaccgaagcgctgggcaacgccagtgacgatcgcatcctgcaggaagtggccgttttcgcgacccgaatcgatgtcgccgaagagctttcacggctgactacccacctcgatgaagtcgagagggtgctgaagcaggggggcgcctgtggcaagcgcctcgatttcctgatgcaggaactcaatcgtgaagccaataccctgggctccaagtcggcaattaccgaggtttcacaggcgtcgatggatctcaagctgctgatcgaacagatgcgcgaacagatccaaaatttggagtga

SEQ ID NO: 46910 - protein, 284 aa, Dechloromonas aromatica RCB
MTGYAVKTRDIERGTLQLELKSVNSRYLDFHFRVSDELRSLEMPLRELLAARLSRGKVECRLSFNASAARADQLQLNGELLASLKLLSERVRHEMPDASPLSVNETLRWPGMFGDQSVDFAAFGPVVMALAREVLDEFTASRGREGDKLAAMIVERVNGMRDIVRRVAPRIPEAQAIFTDKLRQRLTEALGNASDDRILQEVAVFATRIDVAEELSRLTTHLDEVERVLKQGGACGKRLDFLMQELNREANTLGSKSAITEVSQASMDLKLLIEQMREQIQNLE

SEQ ID NO: 46911 - DNA, 867 bp, Methylobacillus flagellatus KT
  CDS (1)..(867)
atgattttcagcatgacgggttatgcctcgctggagcaagaggtgagccatggtgttctggtgctagaactgcgctcggtcaatcatcgctacctcgaattacaactcaagctggatgacaatgtgcgcatgttcgaaccacaggtgcgcgagctgatcggccagcgcctcaagcgtggcaaggtggaatgccgcatcagcctggctcagcgtgataccgagcaacggcaagtgcaactggatgatacggtattgcagcaattagcacagatgatggtcagcgtgcagcgccattttccggaaagccggcccttgagcgtggcggacattctgcgatggccgggggtagtgtcgagtgaagggatagaccacgaagccctgtcgatcgccattcgtgaaagcctgatgaagctggtgcagcagatgaccgaagcacgcgcacgcgagggcgccaagctcaaggccatcattgtcgaccgcctggcggaaatggaaactctggttgacagggtgcgtcccttgcttcctgagcaggtcaatatctaccgggagcgcctttatggcaaattgcaggatgcgatgggttcggcggatgatgagcgtatccgccaggagctcaccatctttgcccagcgtattgatgttgatgaggagctgagccgcctgggcgcgcatatagaggaagtcaagcgcattctcgaggcgggcagcccggcaggtaagcagctggatttcctcatgcaggaattgaaccgcgaggccaatacgctggcttccaagtctgtttccaccgaagtatcacaggccgccatggcactcaagctgctgatcgagcaaatgcgcgagcaggtgcagaacatagaatag

SEQ ID NO: 46912 - protein, 288 aa, Methylobacillus flagellatus KT
MIFSMTGYASLEQEVSHGVLVLELRSVNHRYLELQLKLDDNVRMFEPQVRELIGQRLKRGKVECRISLAQRDTEQRQVQLDDTVLQQLAQMMVSVQRHFPESRPLSVADILRWPGVVSSEGIDHEALSIAIRESLMKLVQQMTEARAREGAKLKAIIVDRLAEMETLVDRVRPLLPEQVNIYRERLYGKLQDAMGSADDERIRQELTIFAQRIDVDEELSRLGAHIEEVKRILEAGSPAGKQLDFLMQELNREANTLASKSVSTEVSQAAMALKLLIEQMREQVQNIE

SEQ ID NO: 46913 - DNA, 900 bp, Magnetospirillum magnetotacticum MS-1
  CDS (1)..(900)
ttgaccgtcgccagcatgaccggctatgcccgggccgaaggccgcgacacccagggctcttgggtgtgggaaggcaaaagcgtcaacgggcgcggcctggaactgcggtgcaagtcggcgccgggctatgacggtctggaagtggcggcccgcgaggcggcggccaagcgcctgaagcgcggcaatgtccagatctcgctcaccgtgcgctccgagaccgaacaatcccagatccgcgtcaacgaggccatgctggaacaattgctgggcatctgccgccagtggcagggccgcttccccgagatcacgcccgcccgcatggacggattgctggccatcaagggcgtgctggaaccggtgaccgaggccgagaccggcgatgccgacaccttgcgcgccgcccgcgagggcgccatgaaggcctcgctggaggccatgctcgaccagttggccgccatgcgtcaggtggaaggtactcgcatcggcgccgtgctgaccgcgcagttggatgagatcgccaccctgtcggccaaggcgggtgaatgcgccgtgctgcgccccgaagcggtgcgcgaacgcctgcgcgcccaggtggctcaggtgctcgacgccgcgccgaccctggccgaggaccgcatcgcccaggaagtggcgctgatcgccgtcaaggccgatgtgcgcgaagaactggaccgtctggccgcccatgtggccgccgcccgcgatctgctggcccagggcggtgccatcggccgcaagctggacttcctggcccaggagttcaaccgcgaggccaacacgctgtgctccaaatcatcggacgtggaactgacccgcgtcggactcgacctcaaagccgtcatcgaccagttcaaagagcaggtccagaatatcgagtag

SEQ ID NO: 46914 - protein, 299 aa, Magnetospirillum magnetotacticum MS-1
MTVASMTGYARAEGRDTQGSWVWEGKSVNGRGLELRCKSAPGYDGLEVAAREAAAKRLKRGNVQISLTVRSETEQSQIRVNEAMLEQLLGICRQWQGRFPEITPARMDGLLAIKGVLEPVTEAETGDADTLRAAREGAMKASLEAMLDQLAAMRQVEGTRIGAVLTAQLDEIATLSAKAGECAVLRPEAVRERLRAQVAQVLDAAPTLAEDRIAQEVALIAVKADVREELDRLAAHVAAARDLLAQGGAIGRKLDFLAQEFNREANTLCSKSSDVELTRVGLDLKAVIDQFKEQVQNIE

SEQ ID NO: 46915 - DNA, 822 bp, Rubrivivax gelatinosus PM1
  CDS (1)..(822)
atggtggaattgcgctcggtcaacagccgcttcctggacatcgcatttcgcatgcctgacgaaatgcgcgcgctggaaccggcgctgcgtgagctgatcaccggccagctgcggcgcggcaagatcgagttgcggctcgcgacgcgggacgacgccggcaccgcttggccccagccgcagaccgatcagctgcacacgctgtcgcgcctggaaaacaccgtgcaatcgtggctgccgaacgccccgccgctgacggtgcacgaggtgctgcagtggtgccgcggcgcggcgccggcggtgcggctcgacgacgcggcgctcgatgccgcccggcgcgccgtgacggggctggtcgaagcgcgcgcgcgcgagggcgagaagctcgttgtggtgctgatgcagcgcgtccaccgcgtgcggcagctggccagcgatgcccagccgctggtgccgcaggtggtgcagcgccagcagcaacgcttcttggagcgctggcaggaagccctggcatcgagcggtgctgcgcagaccctgccgcagcaggcactgcaggaacgcgccctgaacgaggcggccgcttatgccatccggatcgacgtggccgaggagctggcgcggctcggcgcccacctcgacgagatcgaacgtctgttgaaggccggtggcgagctcggcaagcgcctggacttcctgattcaagagttgcagcgcgaggccaacacgctgggctcgaagtcggccgcattggagctgacgcagatctccgtggagatgaaggtcgcgatcgagcagatgcgcgagcaggtgcagaacatcgagtga

SEQ ID NO: 46916 - protein, 273 aa, Rubrivivax gelatinosus PM1
MVELRSVNSRFLDIAFRMPDEMRALEPALRELITGQLRRGKIELRLATRDDAGTAWPQPQTDQLHTLSRLENTVQSWLPNAPPLTVHEVLQWCRGAAPAVRLDDAALDAARRAVTGLVEARAREGEKLVVVLMQRVHRVRQLASDAQPLVPQVVQRQQQRFLERWQEALASSGAAQTLPQQALQERALNEAAAYAIRIDVAEELARLGAHLDEIERLLKAGGELGKRLDFLIQELQREANTLGSKSAALELTQISVEMKVAIEQMREQVQNIE

SEQ ID NO: 46917 - DNA, 888 bp, Rhodospirillum rubrum
  CDS (1)..(888)
atggccctttcgagcatgaccggttttgcccgtacccagggggccctggggccgcagacctgggtctgggaggcgcgcagcgtcaatggcaagggtctggatatccgcctgcgcctgccaccgggcggcgacgcccttgaccagccggcccgccgcgccgtggccgagcgtttcaagcgcggttcgatctcgcttggcctgaccatgaccagcgacgatcaggaacaggcctatcgggtcaatgagccgctgctcaaaaagctgctggccgtgacccgcgagttggcgatggacggggtggaccggccgcgcatggatggcctgctcgggttgcgcggcgtgcttgaaccggttggccaagccgaagaggagggcgtccgcgaggcccgcgaggcggcccagctgcgcagcctggaagccacccttgacgccctggccctggcgcgcagcgaggaaggcgggcgtctggccggggtgctggcggggcatctcgaggttttggaagacctgcgcgcccaggccgccaacgccgaggccctgcgccccgacatggtgcgcgcccgcctgcgccgtcagatggccgacctgcttgaggccgcccccgatgccctgcccgaggagcggctggcccaggaactggccctgctggcggtcaaggccgatatccgcgaagagcttgatcgcctgggcgcccacctggaaggggcgcgcgagctgcttacccgcggcgaggcgatgggccggcgcttggagttcctgtcccaggagctgaaccgcgaggccaacaccctgtgctcgaaatcctccgacgtcgccttgacccgcatcgggttggacatgaaggcggtgatcgaccaattccgcgaacaaatcctcaatatcgaatag

SEQ ID NO: 46918 - protein, 295 aa, Rhodospirillum rubrum
MALSSMTGFARTQGALGPQTWVWEARSVNGKGLDIRLRLPPGGDALDQPARRAVAERFKRGSISLGLTMTSDDQEQAYRVNEPLLKKLLAVTRELAMDGVDRPRMDGLLGLRGVLEPVGQAEEEGVREAREAAQLRSLEATLDALALARSEEGGRLAGVLAGHLEVLEDLRAQAANAEALRPDMVRARLRRQMADLLEAAPDALPEERLAQELALLAVKADIREELDRLGAHLEGARELLTRGEAMGRRLEFLSQELNREANTLCSKSSDVALTRIGLDMKAVIDQFREQILNIE

SEQ ID NO: 46919 - DNA, 936 bp, Ralstonia metallidurans CH34
  CDS (1)..(936)
atgatccacagcatgacaggctatggcctggccacgggccaggcaccgctcaccaacgcccagggcgaaccgagtggccgtaccgcgtcggtttcggtggagttccgcactgtcaactcgcgcttcctcgacctgctgttccgcgcgccggaagagtgtcgcgccttcgagccggccctgcgcgagatgctgatgggcgagctgtcgcgtggcaagctggagtgccggatcaacctccagcgcaccgacaccggcggcgccacgctggcgctgaaccagacactgctcgaccagatccgtgcgctcgaagccaccgtcggggcaacgtttgcttcggccggcacgatgcgcatgggcgaaatcctgcgctggccgggcgtgctggtggagcccgaactgtcgcaggaagccctgcgcgatgccgtgatgggcgccgcccgggaagcgctgaaccagcttctggaagcccgccgccgtgaaggcgcggcgctcaaggccacgctggaggagcggatcgacgccatgctggcgatcgtcgagcgcctgacgccgatgattccgcagttgatcgcccaccaccaggaaaagctgaccgaacgcctgaaggaggcttttaacctggtcgcgccgaacggcatgccgtcaatgagccgcgacgagattgccgagcgcatccgccaggaagccacggtctacggcatccgcatcgacatcgccgaagaactggcgcgcctgcagacccatctcaacgaaacccggcatatcctgaagaagggtggccaggtcggtaagcggctggacttcatgatgcaggagctcaaccgcgaagcgaacacgctcggctcgaaagccgccgcgaaggaactcgccgatgcctcgatggagctcaagctcctgatcgagcagatgcgcgagcagattcaaaacctcgaataa

SEQ ID NO: 46920 - protein, 311 aa, Ralstonia metallidurans CH34
MIHSMTGYGLATGQAPLTNAQGEPSGRTASVSVEFRTVNSRFLDLLFRAPEECRAFEPALREMLMGELSRGKLECRINLQRTDTGGATLALNQTLLDQIRALEATVGATFASAGTMRMGEILRWPGVLVEPELSQEALRDAVMGAAREALNQLLEARRREGAALKATLEERIDAMLAIVERLTPMIPQLIAHHQEKLTERLKEAFNLVAPNGMPSMSRDEIAERIRQEATVYGIRIDIAEELARLQTHLNETRHILKKGGQVGKRLDFMMQELNREANTLGSKAAAKELADASMELKLLIEQMREQIQNLE

SEQ ID NO: 46921 - DNA, 924 bp, Burkholderia fungorum LB400
  CDS (1)..(924)
atgatctacagcatgactggctatgcgagcgccacgcgcgaactcgtcggggcctcaggcacaggcggcgtgagcgtatcggtcgaactgcgcacggtgaactcgcgctttctcgatctgaacttccgcatgccggaagacgtgcgcgtgagcgaacccacgctgcgcgaaatgttgatgaacaagctgtcgcgcggcaaggtcgatatccgtatcaatctgcaacgcagcgagcagtccgccaacgcgggctcgatcaatcgcgaagcactggcgcaactcgcgctgctcgaacgcacggtgctctccacgtttccggaagcggggcggctgcgtaccggcgaaattctgcgctggcccggcattcttgcggaaagcggcgtggcgcccgaagtgctgcgcgacgccgtgctcgcgtgcggcaagcaggccattacggacctgatcgacgtgcgcgcccgcgaaggtgcgcaactggcgaccatgctgctcgccaacgtcaccgaaatggaagcgatcgtcacgaagatcacgccgctcgtgccggaactgatcgccaagcaccagcagaagattgtcgagcgcttgcaggaagcgctcggtatcgccgcgccggatacggcggcgacgagcgtctcgcgcgaagaaatcaatgaacggattcgccaggaagtgacgatgtacggcatccgtatcgacatcgccgaagaactgtcgcgcctcacggcacacctgaacgaaacgcgtcacgtgatccagaagggcggcaaggtcggcaagcgcctcgacttcatgatgcaggagctcaatcgcgaagcgaacacgcttggttcgaaggcggccgcgaaggaactggcggattcgtcgatgaccctgaagctgctcatcgaacagatgcgcgaacaggtacagaatctggaataa

SEQ ID NO: 46922 - protein, 307 aa, Burkholderia fungorum LB400
MIYSMTGYASATRELVGASGTGGVSVSVELRTVNSRFLDLNFRMPEDVRVSEPTLREMLMNKLSRGKVDIRINLQRSEQSANAGSINREALAQLALLERTVLSTFPEAGRLRTGEILRWPGILAESGVAPEVLRDAVLACGKQAITDLIDVRAREGAQLATMLLANVTEMEAIVTKITPLVPELIAKHQQKIVERLQEALGIAAPDTAATSVSREEINERIRQEVTMYGIRIDIAEELSRLTAHLNETRHVIQKGGKVGKRLDFMMQELNREANTLGSKAAAKELADSSMTLKLLIEQMREQVQNLE

SEQ ID NO: 46923 - DNA, 882 bp, Enterococcus faecium
  CDS (1)..(882)
atgactggttttggcaaagccatccgcgaaacaaaagcgtatcagttagatattgaaataaaaagtgtcaaccagcgttttctagatgttcaaatacgaagtcctaaaatcctgaactttgttgaaaacgattttcgtcagcttattaaacagcagttaagccgcggtcgaatcgaagtatttgtgaatctagcttatattggcaaaaacgaaaaacagatcgtcatcaactgggaattgattgattcacttatcactcaattgacagacggaattcaacaacgatacggtagtcaaaatcaagtgtcaattagtcggatggcggaacgcttcgcgctggacgaaaacttcgtaacggtagaagaaaaaccggaagagagcatggaagaattggcacagttagctctagatacattgaaaagcgcacttgattctattgaggcgagtcgagaaaaagaaggtcaagctttagctttagtgttgaaaaagaatactgaagaattcaaagaagtactaaaaaaactcgatagttttgtagaaatctatgaaaaggaatttcaaataaggtatcaaaaaaagctggaggaatttcttggagcgaaagtcgatgagcaacggttgttgacggagctagccatcttgttggaacgcggagatattcacgaggaactggatcgtctggcgatccatgtacaaaaactagatgaacttatcgaagcacaatgtcctgtaggtcgggaattagatttcctgatccaagaaatgaatcgggaaatcaacacgatcggttccaaatcaaatgcaatcgaaattaaaaatcaagtcgtccagtctaagacgatcttagaaaaaatcagagaacaagtacaaaatattgaatga

SEQ ID NO: 46924 - protein, 293 aa, Enterococcus faecium
MTGFGKAIRETKAYQLDIEIKSVNQRFLDVQIRSPKILNFVENDFRQLIKQQLSRGRIEVFVNLAYIGKNEKQIVINWELIDSLITQLTDGIQQRYGSQNQVSISRMAERFALDENFVTVEEKPEESMEELAQLALDTLKSALDSIEASREKEGQALALVLKKNTEEFKEVLKKLDSFVEIYEKEFQIRYQKKLEEFLGAKVDEQRLLTELAILLERGDIHEELDRLAIHVQKLDELIEAQCPVGRELDFLIQEMNREINTIGSKSNAIEIKNQVVQSKTILEKIREQVQNIE

SEQ ID NO: 46925 - DNA, 888 bp, Magnetococcus sp. MC-1
  CDS (1)..(888)
atgcccaacagtatgaccggcattggtcggagcgaagcgagcgtgcagggcatgcgtcttgcttggcgtttgcgcagtgtcaaccaacgctttttagagatgaatctgcgtctacccgatctctttttggatgcggagccacggtttcgccaacgtctacgggggcactttgcgcgtggttcggtggaggcgacactgaccatgcagcaggatggccccagtcaggttaaaatgcagcttgatcgggaacggcttggtcagatcctggcggctgagaagaacatgcgcgaactggatggctctcaccgtggtgagctcagtatggatcggctgctctcctggcctggggtgctcaaggagttgcccgttgcgtgggatagccagcagttggaagagatttggcaccaagcggacagcttgcttgagtctgcttgtgaggagatgacccagtttcgtggtcgcgaaggggccgcgctggcgcagggtattttggagcgcctacacgagctggagcagttggcccagcagatcgaggcggatctacccagagtgcgggagattttggagaagcgtctgcacgaaaagttggcgcagattgcagaaaatcctgccgatcccgcgcgcatggcgcaagaggtgggctatttgctgaccaaggtggatgtatcagaggagttggagcgtctttcgatccatattcgtgagatgcgtgacacgttagagctcagtgagccagtggggcggcgtttagattttctttgccaggagcttaatcgggagtccaacaccctctgctccaaaccccaagatccgaccatttcccgtattggtgtggatatgaaagtagccatcgagaagatccgggagcaggtacaaaatctggagtag

SEQ ID NO: 46926 - protein, 295 aa, Magnetococcus sp. MC-1
MPNSMTGIGRSEASVQGMRLAWRLRSVNQRFLEMNLRLPDLFLDAEPRFRQRLRGHFARGSVEATLTMQQDGPSQVKMQLDRERLGQILAAEKNMRELDGSHRGELSMDRLLSWPGVLKELPVAWDSQQLEEIWHQADSLLESACEEMTQFRGREGAALAQGILERLHELEQLAQQIEADLPRVREILEKRLHEKLAQIAENPADPARMAQEVGYLLTKVDVSEELERLSIHIREMRDTLELSEPVGRRLDFLCQELNRESNTLCSKPQDPTISRIGVDMKVAIEKIREQVQNLE

SEQ ID NO: 46927 - DNA, 879 bp, Geobacter metallireducens GS-15
  CDS (1)..(879)
atgatcaagagtatgaccggctacggcaaggccgtggtcgaaacggaaacagggcggaccaccgtcgagatacggtcggtgaaccaccgctacggcgaggtcttcgtcaagatgccccgctcgttcctggccttcgagaatgacgtgcgcaaggccgtgggggaccgtctgaagcggggaaagatcgaagtcttcgtgcagcgtgaggagggagttggcggtcagaatcagccgctggtgaaccttcccctggcacgggcctaccgtgatgcgttcgagcggatgcggtccgaacttggtctggctgatccggtgaccctgccgctcctcctctcccagcgggacgtcctggctgcccgggaggagggggccgatgaggatatcctccggggcgagcttctccaggcggttcgtggcgcggtggaggccatggaggccatgaggatgcgcgaaggcgaagcgctcctggccgatctcagggaccgccgccagacccttgcgacgctcattgaccgggtggccgagcgtgcacccgccgtggtcgctgactatgcccagaagctgcgggagcggcttgcgcagcttctcgccgatacgaccctcgacgaagcgcggctcgcccaggaggtggcgctactggccgaccggtgcgatgttaccgaggagttggtccgtttccggagccacctgatccagttcgacgagacccttgcccttgcggagccggtggggcgcaagctggatttcctcatgcaggagctgaaccgcgaggtcaataccatcgggtccaaggccaatgacgccgccatggccgccatcgtggttgaactgaaggccgaactggaaaagatccgtgaacaggtacagaacatagaatag

SEQ ID NO: 46928 - protein, 292 aa, Geobacter metallireducens GS-15
MIKSMTGYGKAVVETETGRTTVEIRSVNHRYGEVFVKMPRSFLAFENDVRKAVGDRLKRGKIEVFVQREEGVGGQNQPLVNLPLARAYRDAFERMRSELGLADPVTLPLLLSQRDVLAAREEGADEDILRGELLQAVRGAVEAMEAMRMREGEALLADLRDRRQTLATLIDRVAERAPAVVADYAQKLRERLAQLLADTTLDEARLAQEVALLADRCDVTEELVRFRSHLIQFDETLALAEPVGRKLDFLMQELNREVNTIGSKANDAAMAAIVVELKAELEKIREQVQNIE

SEQ ID NO: 46929 - DNA, 870 bp, Cytophaga hutchinsonii
  CDS (1)..(870)
atgacaggttacggttcccagactgctgagaacgataaaatttcagttactgtagaaattaaatcccttaactctaaatttttagatttaaatctacggctttcaaaagagtattctgatagagaacttgaaataagaaacctgctgaacaatacggttgagcgtggaaaagtgggcttgagcatagatgttcaatcaaagggaggtgttaagccaaaagtatttatcaatagagaactggttgcattatattacaaagaccttaaggaaacggctgatgctataggtattgttgactcgtcagatttatttaagttagcactgcaaatgcctaaggcgatggaatctgaagttgaaaatccggataatacggaagactggctgctgattcaaaaagttttgctggatgctattgccaagtgcaatgaattccggacagatgaaggaaacacacttgcgttaaaatttaaggaatatattaaaacgattgccgactgcttgactcaggttgaagtatttgacccacagcgcatcgaagctattcgtacacgcatcagacagcattttgatgaattcagcaaatccgaacaattagacaacagccgttttgagcaggaattgattttctatattgaaaaacttgatatcagcgaggaaaaagtgcgtttgcgcagccacttaaattattttttagaatccatggatattcctgagcctagtggaaagaaattaggattcatcgcgcaggagatcggccgtgaaatcaatacgattggttctaaagcaaatgatgcaaatatccagcgttatgttgtacagatgaaagaggaactggaaaaaataaaagagcaggccctaaatattttatag

SEQ ID NO: 46930 - protein, 289 aa, Cytophaga hutchinsonii
MTGYGSQTAENDKISVTVEIKSLNSKFLDLNLRLSKEYSDRELEIRNLLNNTVERGKVGLSIDVQSKGGVKPKVFINRELVALYYKDLKETADAIGIVDSSDLFKLALQMPKAMESEVENPDNTEDWLLIQKVLLDAIAKCNEFRTDEGNTLALKFKEYIKTIADCLTQVEVFDPQRIEAIRTRIRQHFDEFSKSEQLDNSRFEQELIFYIEKLDISEEKVRLRSHLNYFLESMDIPEPSGKKLGFIAQEIGREINTIGSKANDANIQRYVVQMKEELEKIKEQALNIL

SEQ ID NO: 46931 - DNA, 885 bp, Clostridium thermocellum ATCC 27405
  CDS (1)..(885)
atgataagaagtatgacaggttttgggagaggaagagcccaagctgacggccgggagtttctggttgagattaaaaccgtgaaccatagatattgtgacatttatataaaattaccaaggcagatatcctttcttgaagataaagtaagggaagtaataggaaaaagtatttcaagggggaaggtagatgtcttcattaactatgaagattttagtgaagattcaaaaaatattttgattgatgaagggcttgcaaaaacatatattaaaagtgtggagtatttaagggataaatacggattgaaagatgatatatccgtatctctcatagcaaaattccctgatattctgaaagtggaaaaacccgaagaagatgaggagaaaatctggaatcttctttatgaagctttaagccacgcccttgattctttgataagcatgagagagacagagggcgaaggcttgaaaaatgatttgcttgaaaggacggatgctattgaaaaagttgttcaggaaataagcataagagcaccggaagttgtaaaagaatataaatgtaaacttgaaaatagaataaaggaaatattggaacagcaggtgatagatgagaatcgcctggcaatggaagttgccatttttgctgacagatgcaacattgacgaggagctggtcaggcttgaaagccatataaaccagctgcgtcagaccctaaacagtgattccgacacgcctgtcggaagaaaactggattttctgattcaggaaatgaacagggaaattaacaccataggttctaaagcaaatgatttgagcataacccagaatgtggttgagattaaaagtgaattggaaaagattagggaacaaatacaaaatattgagtaa

SEQ ID NO: 46932 - protein, 294 aa, Clostridium thermocellum ATCC 27405
MIRSMTGFGRGRAQADGREFLVEIKTVNHRYCDIYIKLPRQISFLEDKVREVIGKSISRGKVDVFINYEDFSEDSKNILIDEGLAKTYIKSVEYLRDKYGLKDDISVSLIAKFPDILKVEKPEEDEEKIWNLLYEALSHALDSLISMRETEGEGLKNDLLERTDAIEKVVQEISIRAPEVVKEYKCKLENRIKEILEQQVIDENRLAMEVAIFADRCNIDEELVRLESHINQLRQTLNSDSDTPVGRKLDFLIQEMNREINTIGSKANDLSITQNVVEIKSELEKIREQIQNIE

SEQ ID NO: 46933 - DNA, 855 bp, Microbulbifer degradans 2-40
  CDS (1)..(855)
atgacgggctttgcacgattagaacaacaatacgactggggcaccctctcctgcgaagttcgcacagtaaaccaccgctatttagaacccactattcgcatgcccgaatccttgcgtgccaccgagcccaaattgcgcgatcaaatacgcaaaaaactcagccgcggcaaagtagaagccaacgtgcacctgcgcacagaagcggccgactcctctaaccttggcttaaaccttactctagcaaaacaattggcaaaaatgagtgagcaactaagcgcagaactggctaacgccgcccccattaacccagtagagattctgcgctggccgggcgtaattcaaaccgcagaagtagacgccgaagtactgcaagctgccaccaccgagctatttaataaaacgctggaccagctcatcgccaaccgcgaccgcgaaggcgccgaactaggccaacttatagagcagcgcctaaacgccattgccgagcatgtggtagacgtacgcaagcgcgtacccgaaatacttgcccaatttcaagaaaagctacacgcaaaactagaagcgctaaaaatagaagtagacgaagatcgcttccaccaagaagttgtttacgtaacacaaaaatccgatgtagcagaagagctagaccgccttgaagcacacctaaccgaagtgcgcctagccctaaaacaaaaaggccccatcggccgccggttagattttttaatgcaagaattaaacagagaagccaacacactctcatcgaaatccatggcgagtgacaccactcaaaccgctgtagatttaaaagtacttatcgaacaaatgcgcgaacagattcaaaatatcgaataa

SEQ ID NO: 46934 - protein, 284 aa, Microbulbifer degradans 2-40
MTGFARLEQQYDWGTLSCEVRTVNHRYLEPTIRMPESLRATEPKLRDQIRKKLSRGKVEANVHLRTEAADSSNLGLNLTLAKQLAKMSEQLSAELANAAPINPVEILRWPGVIQTAEVDAEVLQAATTELFNKTLDQLIANRDREGAELGQLIEQRLNAIAEHVVDVRKRVPEILAQFQEKLHAKLEALKIEVDEDRFHQEVVYVTQKSDVAEELDRLEAHLTEVRLALKQKGPIGRRLDFLMQELNREANTLSSKSMASDTTQTAVDLKVLIEQMREQIQNIE

SEQ ID NO: 46935 - DNA, 879 bp, Moorella thermoacetica ATCC 39073
  CDS (1)..(879)
atgttgaacagcatgacgggctacggccggggcgaggccagcggcgccggcaaaaccgtgagcgtcgagatccgggccgtcaaccagcgcttcctggacgtagtagtgcgcctgccccgggcctacggcgccctggaagaaaagatccgtcaggagttgaaaaaaagcctcaaccggggccgtgtcgaggtagtactgactataaaggaagataatgcggaaaaacggcccgtcaacgttgacacgggactggcaatggcgtattataatgctttgaaggaattggctcaaaaattgtctatttcggcggatattaccgctgccgggctgttatccctgccggaagtcatcacagtagccgaaccggagtgggacgaggctactttatggccggtggtagccagggccctggcagcggccctggcaggtctcctggaaatgcgccgggccgaggggcagcgcctccaggccgacctggaggcccgggccgcttttgtccgccgccaggtggaagccatccgcgagcgcgcgccggaggtgccgcgggaatacgccgcccgcctgcgggagcgcgtggacgaactgaccggcggtatggccctcgacccgggccgcctggagatggaagtagccctgatggcggagcgcgctgacatcaccgaagaggtcgtccgtcttaccagccacctggagcagatgcaggccgccatggctggcgccgaaccggccgggaggcggctggactttatcctccaggaaatgtggcgggagataaataccatcgggtccaaggccggcgatctgaccatcagccacctggtagtagcggtcaagggcgagctggaaaagatgcgcgagcaggtccagaacatcgagtag

SEQ ID NO: 46936 - protein, 292 aa, Moorella thermoacetica ATCC 39073
MLNSMTGYGRGEASGAGKTVSVEIRAVNQRFLDVVVRLPRAYGALEEKIRQELKKSLNRGRVEVVLTIKEDNAEKRPVNVDTGLAMAYYNALKELAQKLSISADITAAGLLSLPEVITVAEPEWDEATLWPVVARALAAALAGLLEMRRAEGQRLQADLEARAAFVRRQVEAIRERAPEVPREYAARLRERVDELTGGMALDPGRLEMEVALMAERADITEEVVRLTSHLEQMQAAMAGAEPAGRRLDFILQEMWREINTIGSKAGDLTISHLVVAVKGELEKMREQVQNIE

SEQ ID NO: 46937 - DNA, 867 bp, Thiobacillus denitrificans ATCC 25259
  CDS (1)..(867)
atgaccaccagcatgaccgggttcgccgcccacagcttcaatgtcgaccatgcgagcgtcaatgtcgagctgcgaagcgtcaaccaacgttatctcgaactgcacttccgcctcgccgatgagttccgtccgctcgaaacgcagctgcgtgaactgcttcagcagcgcctggcgcggggcaaggtcgagtgcaggatcggcctggcgcacctgtccgccgccccgcccgataacggcctgaatccggccattcttgagcggctggtgcgttggcaggacgacgtgctcgagcggctccccggcgccgcccccttgagcgtcaacgaagtgctgcgctggccgggggcgatgcaaaacgccgtggtatcgcaggcgacgctcgacgaggcagcgctcgccgggtttcgcgcagccctcgacgaactcgtggaaagccggcgccgcgaaggcgccaagctgcggcagcacatcctcgatcgcctcgatgccgccgaggcgcaggtcgccgtcctgaagccgctgctgcccgttcttgccgcagcccagcgcgagaaactcggcgagcgcctgcgcgaggccctcggcgaggccggccacgagcggctcgcccaggaagtggcgctcgccgcccagaaggtcgacgtcgacgaggaagtgtcgcgcctggctacccacttcaccgaggtgaggcgcgtgctcgatcagtccggcgcggtcggcaagcgcctcgacttcctgatgcaggaattgcatcgcgaagcgaacacgctcggctcgaagtcggtcgcggtcgagacctcgcgcacctcgctcgaactcaaggtgctgatcgagcagatgcgcgagcaggtgcagaatattgaatga

SEQ ID NO: 46938 - protein, 288 aa, Thiobacillus denitrificans ATCC 25259
MTTSMTGFAAHSFNVDHASVNVELRSVNQRYLELHFRLADEFRPLETQLRELLQQRLARGKVECRIGLAHLSAAPPDNGLNPAILERLVRWQDDVLERLPGAAPLSVNEVLRWPGAMQNAVVSQATLDEAALAGFRAALDELVESRRREGAKLRQHILDRLDAAEAQVAVLKPLLPVLAAAQREKLGERLREALGEAGHERLAQEVALAAQKVDVDEEVSRLATHFTEVRRVLDQSGAVGKRLDFLMQELHREANTLGSKSVAVETSRTSLELKVLIEQMREQVQNIE

SEQ ID NO: 46939 - DNA, 882 bp, Silicibacter sp. TM1040
  CDS (1)..(882)
atgacaggctttgcctcagggcagggcggtgagggtgccttggcttggatctgggacatcagatcggtgaacgccaaggggctggatgtgcgtgtgcgcgtgcctgactggctcgaaggtcttgaaaatgaaattaaaaaacgcgcaaccaaaagcctaggtcgtggcaatgtcacgatcggactgcggctgagccgtgccgacgatggcaaaggcgagctacagatcaatgctgctgcgatgacggctgcactggcggcgatccagcagacacaggctgccgccaccgaagcgggcctggacctcacaccggtgcgagcgacggatatccttcagatacgtggcgtgctcgaacaggtcagtcacgaagccaaaaccgaagacctcgtgacccagctgctatccgaattcgactcacttttggccgacttcattaacatgcgttctaatgaaggggcggctctggaggtggttttgagcgcacaacttgaacggatcgaatccctgagccaggaggccgcccagcgcgccgcagcgcgcgaccccctcataaaggaggcgcttcgcgcaaatcttgcccgtgtgctggaccaaagcgacggcgcagatcccgaccgcgtggcgcaggagctcgccatgatcgcggtcaaagcagatgttaccgaagaactcgaccgcctgaaggcgcatattgccgccgcacgcaaactgctcgggcaggggggattggtggggcgaaagctcgacttcctgatgcaagagttcaaccgggaggccaacacgctctgttcaaaggcgcagaacgcggccttgaccgaagtgggtttggaactcaaaaccgtgatcgaccagatgcgcgagcaggttcagaacatagaataa

SEQ ID NO: 46940 - protein, 293 aa, Silicibacter sp. TM1040
MTGFASGQGGEGALAWIWDIRSVNAKGLDVRVRVPDWLEGLENEIKKRATKSLGRGNVTIGLRLSRADDGKGELQINAAAMTAALAAIQQTQAAATEAGLDLTPVRATDILQIRGVLEQVSHEAKTEDLVTQLLSEFDSLLADFINMRSNEGAALEVVLSAQLERIESLSQEAAQRAAARDPLIKEALRANLARVLDQSDGADPDRVAQELAMIAVKADVTEELDRLKAHIAAARKLLGQGGLVGRKLDFLMQEFNREANTLCSKAQNAALTEVGLELKTVIDQMREQVQNIE

SEQ ID NO: 46941 - DNA, 873 bp, Azotobacter vinelandii
  CDS (1)..(873)
atggacaccatggcgcacagcatgactgccttcgcccgcgtcgagcgggccggcgcccacggcaccctgagctgggaactgcgctcggtcaatcatcgctacctcgaaccgcacctgcgtctgccggaggccttcctcgatctcgagggcgccctgcgcgacgccctgcgccaggggctttcccgcggcaaggtcgaatgcaccctgcgcttcgacgaaggcagcgccggacagccgttgcagatcgaccgcgaacgtgccagccaactggtggccgccgccgaggacatcgccgccctgatccgccagccggccccgatcgaccccttcgacgtgctggcttggcccggcgtgctggtggccgatgccgccgatcaccagcgcctcagcgccgaagccctgagcctgttcgacgaggccctggcccagctcaaggccggccgcgcccgcgaaggcgcggaactggcccggttgctcgaggaacgcctggacgccatgctccaggaggtcgagaacctgcgccagttggtcccgcagatgctcgccaaccagcgccagaagatcctcgaccgtttccgcgacacgcagctggaactggacccgctacgcctcgaacaggaactggtgctgctcgcccagaagagcgacgcggccgaggaactggatcgcctctgcacccacatcgccgaggtccgccgcgtgctcaaggacagcggcacggtcggccgccggctggacttcctgatgcaggaactcaaccgcgaggccaacacccttggctccaaggccttcgatccccgctccacgcagaccgcggtcaacctcaaggtattgatcgaacagatgcgcgagcaggtacagaacatcgagtga

SEQ ID NO: 46942 - protein, 290 aa, Azotobacter vinelandii
MDTMAHSMTAFARVERAGAHGTLSWELRSVNHRYLEPHLRLPEAFLDLEGALRDALRQGLSRGKVECTLRFDEGSAGQPLQIDRERASQLVAAAEDIAALIRQPAPIDPFDVLAWPGVLVADAADHQRLSAEALSLFDEALAQLKAGRAREGAELARLLEERLDAMLQEVENLRQLVPQMLANQRQKILDRFRDTQLELDPLRLEQELVLLAQKSDAAEELDRLCTHIAEVRRVLKDSGTVGRRLDFLMQELNREANTLGSKAFDPRSTQTAVNLKVLIEQMREQVQNIE

SEQ ID NO: 46943 - DNA, 903 bp, Polaromonas sp. JS666
  CDS (1)..(903)
atgacgggttatgcgaccgtgcagtccagcgcggcgccatccggccccgaaactgattccggcccggacgccagttcccggctgggtgtcgaaatacgctcggtgaacagccgctttctcgacctggcctttcgcctgcccgatgaattgcgccaggcagagccggccctgcgtgaattgctcaccggcaagctcaaacgcggcaaggtggaactgcgggtgtcgcttgaaagcacctcggccagcagccttcgcgccccctcgtcggtgacgctgcagcgcctgggttcgctggaagacaacatcaagtcgtggctgccgcaggctgcggccctcagcgtggccgatatcctcaggatcgccaccaacgaggacaaaaagccgcatgatttcagcgaagaactgctcaagctggccaaaaaggctctgaaagacctgatgtccgcccgggagcgcgagggcgcgcgcctgacggtcatgctgctcgaccggactgcgcagttgcgcgcgctggcagcggccgctgtgcccatggttcccaagctggtggagcagcaaaagacgcgttttctggaacgctggaaagaggccatggccttgtccgacagcaccacgctgccggaaatcgcccaggacagggcactgaccgaagccacggcctttgccatccggattgacgtggccgaggaaatcacccgcctgtcgtcccacctggatgaaatagaccgcctgctcgccagcggcggcgaactcggcaagcggctggactttctcattcaggaactgcaccgcgaggccaacaccctgggctccaagtccgcctcgctggaactcacccgcatttctgtggacatgaaagtcctgatcgagcagatccgcgaacaggtgcagaacatcgagtga

SEQ ID NO: 46944 - protein, 300 aa, Polaromonas sp. JS666
MTGYATVQSSAAPSGPETDSGPDASSRLGVEIRSVNSRFLDLAFRLPDELRQAEPALRELLTGKLKRGKVELRVSLESTSASSLRAPSSVTLQRLGSLEDNIKSWLPQAAALSVADILRIATNEDKKPHDFSEELLKLAKKALKDLMSAREREGARLTVMLLDRTAQLRALAAAAVPMVPKLVEQQKTRFLERWKEAMALSDSTTLPEIAQDRALTEATAFAIRIDVAEEITRLSSHLDEIDRLLASGGELGKRLDFLIQELHREANTLGSKSASLELTRISVDMKVLIEQIREQVQNIE

SEQ ID NO: 46945 - DNA, 864 bp, Haemophilus influenzae
  CDS (1)..(864)
atgatttacagtatgactgcctttgcacgccttgaagtgaaaaaagattggggtgatgcggtatgggaaattcgttccgttaatcaacgttatttagaaaactttttccgtttgcccgagcaatttcgcggattagaaaacacgttgcgtgagaaacttcgtcaaaatcttactcgcggtaaaattgaatgttctctacgcattgaaacaaaaaaacaagcaaatgcagaattgaatttaaataaagaacttgcgaatcaagtaattcaatctttgcaatggattaaagctcaggctggagaaggggaaattaatttgacagacgtgttgcgttaccccggcgtagtggaagcgcaagagcaagatttagatgcgattagtcaagatttattgacagcctttgatgatttactgacagattttattgcaatgcgtggtcgtgagggggaaaaactgaacgatattattcaacaacgtttagattccattgcagtggaaacggataaagtgcggtcacaaatgccagcagttttacaatggcagcgtgaacgtttattgcaacgttttgaagatgctcaacttaatcttgatccgcaacgtgtggaacaagaaatgattttactcgctcaacgcattgatgtggcggaagagctagatcgtttacaaatgcacgtgaaagaaaccacgaatattttgaaaaaaggcggtgcagttggacgtaaattagattttatgatgcaagaattgaatcgggaatccaatacccttgcgtctaaatccattaatgcagatatcacggcttctgcggtggagctaaaagtgcttattgaacaaatgcgtgagcaaattcagaatttagaatag

SEQ ID NO: 46946 - protein, 287 aa, Haemophilus influenzae
MIYSMTAFARLEVKKDWGDAVWEIRSVNQRYLENFFRLPEQFRGLENTLREKLRQNLTRGKIECSLRIETKKQANAELNLNKELANQVIQSLQWIKAQAGEGEINLTDVLRYPGVVEAQEQDLDAISQDLLTAFDDLLTDFIAMRGREGEKLNDIIQQRLDSIAVETDKVRSQMPAVLQWQRERLLQRFEDAQLNLDPQRVEQEMILLAQRIDVAEELDRLQMHVKETTNILKKGGAVGRKLDFMMQELNRESNTLASKSINADITASAVELKVLIEQMREQIQNLE

SEQ ID NO: 46947 - DNA, 22 bp, Primer
atgatccgcagtatgaccgcct

SEQ ID NO: 46948 - DNA, 24 bp, Primer
ttattcgatgttctgaatctgctc

SEQ ID NO: 46949 - protein, 338 aa, consensus
  MISC_FEATURE (1)..(338): consensus for the disclosure of xaa see table XV
SMTXXXXXXXXXXXXXXXXXXXXXXXXXXXEXXSVNXXXXXXXXXXPXXXXXXEXXXRXXXXXXXXRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXEGXXLXXXXXXXXXXXXXXXXXXXXXXXXXXXXXXXXXXXXXXXXXXXXXXXXXXXXXXXXXXXXRXXXEXXXXXXXXDXXEEXXRLXXHXXXXXXXLXXXXXXXXXXXXXXXXXXXGXXLDFXXQEXXREXNTXXSKXXXXXXXXXXXXXKXXXEXXREQXQNXE

SEQ ID NO: 46950 - protein, 73 aa, consensus
  MISC_FEATURE (1)..(73): consensus for the disclosure of xaa see table XV
MXXXXXXXXXXXXXXXXXXXXXXXXXXXXXXXXXNXXXXXXXXXXXXXXXXXXXXXXXXXXXXXXRGXXXXXX

SEQ ID NO: 46951 - protein, 101 aa, consensus
  MISC_FEATURE (1)..(101): consensus for the disclosure of xaa see table XV
XXXXEXXXXXXXXXXXEEXXRXXXHXXXXXXXXXXXXXXXXXXXXXXXXXXXGXXXXFXXQEXXREXXTXXXKXXXXXXXXXXXXXKXXXXXXXEQXXNXX

SEQ ID NO: 46952 - DNA, 1518 bp, Escherichia coli; identical to SEQ ID NO: 32416
  CDS (1)..(1518)

SEQ ID NO: 46953 - protein, 505 aa, Escherichia coli; identical to SEQ ID NO: 32417

SEQ ID NO: 46954 - DNA, 1536 bp, Streptococcus thermophilus CNRZ1066; identical to SEQ ID NO: 32418
  CDS (1)..(1536)

SEQ ID NO: 46955 - protein, 511 aa, Streptococcus thermophilus CNRZ1066; identical to SEQ ID NO: 32419

SEQ ID NO: 46956 - DNA, 1512 bp, Idiomarina loihiensis L2TR; identical to SEQ ID NO: 32420
  CDS (1)..(1512)

SEQ ID NO: 46957 - protein, 503 aa, Idiomarina loihiensis L2TR; identical to SEQ ID NO: 32421

SEQ ID NO: 46958 - DNA, 1731 bp, Francisella tularensis subsp. tularensis; identical to SEQ ID NO: 32422
  CDS (1)..(1731)

SEQ ID NO: 46959 - protein, 576 aa, Francisella tularensis subsp. tularensis; identical to SEQ ID NO: 32423

SEQ ID NO: 46960 - DNA, 1737 bp, Xenopus tropicalis; identical to SEQ ID NO: 32424
  CDS (1)..(1737)

SEQ ID NO: 46961 - protein, 578 aa, Xenopus tropicalis; identical to SEQ ID NO: 32425

SEQ ID NO: 46962 - DNA, 1809 bp, Danio rerio; identical to SEQ ID NO: 32426
  CDS (1)..(1809)

SEQ ID NO: 46963 - protein, 602 aa, Danio rerio; identical to SEQ ID NO: 32427

SEQ ID NO: 46964 - DNA, 1809 bp, Arabidopsis thaliana; identical to SEQ ID NO: 32428
  CDS (1)..(1809)

SEQ ID NO: 46965 - protein, 602 aa, Arabidopsis thaliana; identical to SEQ ID NO: 32429

SEQ ID NO: 46966 - DNA, 1539 bp, Vibrio cholerae O1 biovar eltor str. N16961; identical to SEQ ID NO: 32430
  CDS (1)..(1539)

SEQ ID NO: 46967 - protein, 512 aa, Vibrio cholerae O1 biovar eltor str. N16961; identical to SEQ ID NO: 32431

SEQ ID NO: 46968 - DNA, 1584 bp, Chlamydophila pneumoniae J138; identical to SEQ ID NO: 32432
  CDS (1)..(1584)

SEQ ID NO: 46969 - protein, 527 aa, Chlamydophila pneumoniae J138; identical to SEQ ID NO: 32433

SEQ ID NO: 46970 - DNA, 1335 bp, Sulfolobus tokodaii str. 7; identical to SEQ ID NO: 32434
  CDS (1)..(1335)

SEQ ID NO: 46971 - protein, 444 aa, Sulfolobus tokodaii str. 7; identical to SEQ ID NO: 32435

SEQ ID NO: 46972 - DNA, 1518 bp, Escherichia coli K12; identical to SEQ ID NO: 32436
  CDS (1)..(1518)

SEQ ID NO: 46973 - protein, 505 aa, Escherichia coli K12; identical to SEQ ID NO: 32437

SEQ ID NO: 46974 - DNA, 1518 bp, Salmonella typhimurium LT2; identical to SEQ ID NO: 32438
  CDS (1)..(1518)

SEQ ID NO: 46975 - protein, 505 aa, Salmonella typhimurium LT2; identical to SEQ ID NO: 32439

SEQ ID NO: 46976 - DNA, 1449 bp, Pyrobaculum aerophilum str. IM2; identical to SEQ ID NO: 32440
  CDS (1)..(1449)

SEQ ID NO: 46977 - protein, 482 aa, Pyrobaculum aerophilum str. IM2; identical to SEQ ID NO: 32441

SEQ ID NO: 46978 - DNA, 1725 bp, Drosophila melanogaster; identical to SEQ ID NO: 32442
  CDS (1)..(1725)

SEQ ID NO: 46979 - protein, 574 aa, Drosophila melanogaster; identical to SEQ ID NO: 32443

SEQ ID NO: 46980 - DNA, 1323 bp, Encephalitozoon cuniculi; identical to SEQ ID NO: 32444
  CDS (1)..(1323)

SEQ ID NO: 46981 - protein, 440 aa, Encephalitozoon cuniculi; identical to SEQ ID NO: 32445

SEQ ID NO: 46982 - DNA, 1596 bp, Schizosaccharomyces pombe; identical to SEQ ID NO: 32446
  CDS (1)..(1596)

SEQ ID NO: 46983 - protein, 531 aa, Schizosaccharomyces pombe; identical to SEQ ID NO: 32447

SEQ ID NO: 46984 - DNA, 1776 bp, Schizosaccharomyces pombe; identical to SEQ ID NO: 32448
  CDS (1)..(1776)

SEQ ID NO: 46985 - protein, 591 aa, Schizosaccharomyces pombe; identical to SEQ ID NO: 32449

SEQ ID NO: 46986 - DNA, 1581 bp, Corynebacterium glutamicum ATCC 13032; identical to SEQ ID NO: 32450
  CDS (1)..(1581)

SEQ ID NO: 46987 - protein, 526 aa, Corynebacterium glutamicum ATCC 13032; identical to SEQ ID NO: 32451

SEQ ID NO: 46988 - DNA, 1683 bp, Bifidobacterium longum NCC2705; identical to SEQ ID NO: 32452
  CDS (1)..(1683)

SEQ ID NO: 46989 - protein, 560 aa, Bifidobacterium longum NCC2705; identical to SEQ ID NO: 32453

SEQ ID NO: 46990 - DNA, 1752 bp, Plasmodium falciparum 3D7; identical to SEQ ID NO: 32454
  CDS (1)..(1752)

SEQ ID NO: 46991 - protein, 583 aa, Plasmodium falciparum 3D7; identical to SEQ ID NO: 32455

SEQ ID NO: 46992 - DNA, 1641 bp, Rhodopirellula baltica SH 1; identical to SEQ ID NO: 32456
  CDS (1)..(1641)

SEQ ID NO: 46993 - protein, 546 aa, Rhodopirellula baltica SH 1; identical to SEQ ID NO: 32457

SEQ ID NO: 46994 - DNA, 1563 bp, Corynebacterium diphtheriae NCTC 13129; identical to SEQ ID NO: 32458
  CDS (1)..(1563)

SEQ ID NO: 46995 - protein, 520 aa, Corynebacterium diphtheriae NCTC 13129; identical to SEQ ID NO: 32459

SEQ ID NO: 46996 - DNA, 1536 bp, Onion yellows phytoplasma OY-M; identical to SEQ ID NO: 32460
  CDS (1)..(1536)

SEQ ID NO: 46997 - protein, 511 aa, Onion yellows phytoplasma OY-M; identical to SEQ ID NO: 32461

SEQ ID NO: 46998 - DNA, 1542 bp, Lactobacillus johnsonii NCC 533; identical to SEQ ID NO: 32462
  CDS (1)..(1542)

SEQ ID NO: 46999 - protein, 513 aa, Lactobacillus johnsonii NCC 533; identical to SEQ ID NO: 32463

SEQ ID NO: 47000 - DNA, 1515 bp, Bdellovibrio bacteriovorus HD100; identical to SEQ ID NO: 32464
  CDS (1)..(1515)

SEQ ID NO: 47001 - protein, 504 aa, Bdellovibrio bacteriovorus HD100; identical to SEQ ID NO: 32465

SEQ ID NO: 47002 - DNA, 1503 bp, Mycoplasma mycoides subsp. mycoides SC str. PG1; identical to SEQ ID NO: 32466
  CDS (1)..(1503)

SEQ ID NO: 47003 - protein, 500 aa, Mycoplasma mycoides subsp. mycoides SC str. PG1; identical to SEQ ID NO: 32467

SEQ ID NO: 47004 - DNA, 1500 bp, Bacillus cereus ATCC 10987; identical to SEQ ID NO: 32468
  CDS (1)..(1500)

SEQ ID NO: 47005 - protein, 499 aa, Bacillus cereus ATCC 10987; identical to SEQ ID NO: 32469

SEQ ID NO: 47006 - DNA, 1578 bp, Eremothecium gossypii; identical to SEQ ID NO: 32470
  CDS (1)..(1578)

SEQ ID NO: 47007 - protein, 525 aa, Eremothecium gossypii; identical to SEQ ID NO: 32471

SEQ ID NO: 47008 - DNA, 1770 bp, Eremothecium gossypii; identical to SEQ ID NO: 32472
  CDS (1)..(1770)

SEQ ID NO: 47009 - protein, 589 aa, Eremothecium gossypii; identical to SEQ ID NO: 32473

SEQ ID NO: 47010 - DNA, 1917 bp, Magnaporthe grisea 70-15; identical to SEQ ID NO: 32474
  CDS (1)..(1917)

SEQ ID NO: 47011 - protein, 638 aa, Magnaporthe grisea 70-15; identical to SEQ ID NO: 32475

SEQ ID NO: 47012 - DNA, 1833 bp, Gibberella zeae PH-1; identical to SEQ ID NO: 32476
  CDS (1)..(1833)

SEQ ID NO: 47013 - protein, 610 aa, Gibberella zeae PH-1; identical to SEQ ID NO: 32477

SEQ ID NO: 47014 - DNA, 1821 bp, Aspergillus nidulans FGSC A4; identical to SEQ ID NO: 32478
  CDS (1)..(1821)

SEQ ID NO: 47015 - protein, 606 aa, Aspergillus nidulans FGSC A4; identical to SEQ ID NO: 32479

SEQ ID NO: 47016 - DNA, 1776 bp, Candida glabrata CBS138; identical to SEQ ID NO: 32480
  CDS (1)..(1776)

SEQ ID NO: 47017 - protein, 591 aa, Candida glabrata CBS138; identical to SEQ ID NO: 32481

SEQ ID NO: 47018 - DNA, 1782 bp, Debaryomyces hansenii CBS767; identical to SEQ ID NO: 32482
  CDS (1)..(1782)

SEQ ID NO: 47019 - protein, 593 aa, Debaryomyces hansenii CBS767; identical to SEQ ID NO: 32483

SEQ ID NO: 47020 - DNA, 1761 bp, Oryza sativa (japonica cultivar-group); identical to SEQ ID NO: 32484
  CDS (1)..(1761)

SEQ ID NO: 47021 - protein, 586 aa, Oryza sativa (japonica cultivar-group); identical to SEQ ID NO: 32485

SEQ ID NO: 47022 - DNA, 1749 bp, Yarrowia lipolytica CLIB99; identical to SEQ ID NO: 32486
  CDS (1)..(1749)

SEQ ID NO: 47023 - protein, 582 aa, Yarrowia lipolytica CLIB99; identical to SEQ ID NO: 32487

SEQ ID NO: 47024 - DNA, 1488 bp, Leptospira interrogans serovar Copenhageni str. Fiocruz L1-130; identical to SEQ ID NO: 32488
  CDS (1)..(1488)

SEQ ID NO: 47025 - protein, 495 aa, Leptospira interrogans serovar Copenhageni str. Fiocruz L1-130; identical to SEQ ID NO: 32489

SEQ ID NO: 47026 - DNA, 1590 bp, Parachlamydia sp. UWE25; identical to SEQ ID NO: 32490
  CDS (1)..(1590)

SEQ ID NO: 47027 - protein, 529 aa, Parachlamydia sp. UWE25; identical to SEQ ID NO: 32491

SEQ ID NO: 47028 - DNA, 1506 bp, Desulfovibrio vulgaris subsp. vulgaris str. Hildenborough; identical to SEQ ID NO: 32492
  CDS (1)..(1506)

SEQ ID NO: 47029 - protein, 501 aa, Desulfovibrio vulgaris subsp. vulgaris str. Hildenborough; identical to SEQ ID NO: 32493

SEQ ID NO: 47030 - DNA, 1518 bp, Erwinia carotovora subsp. atroseptica SCRI1043; identical to SEQ ID NO: 32494
  CDS (1)..(1518)

SEQ ID NO: 47031 - protein, 505 aa, Erwinia carotovora subsp. atroseptica SCRI1043; identical to SEQ ID NO: 32495

SEQ ID NO: 47032 - DNA, 1500 bp, Mesoplasma florum L1; identical to SEQ ID NO: 32496
  CDS (1)..(1500)

SEQ ID NO: 47033 - protein, 499 aa, Mesoplasma florum L1; identical to SEQ ID NO: 32497

SEQ ID NO: 47034 - DNA, 1533 bp, Propionibacterium acnes KPA171202; identical to SEQ ID NO: 32498
  CDS (1)..(1533)

SEQ ID NO: 47035 - protein, 510 aa, Propionibacterium acnes KPA171202; identical to SEQ ID NO: 32499

SEQ ID NO: 47036 - DNA, 1515 bp, Leifsonia xyli subsp. xyli str. CTCB07; identical to SEQ ID NO: 32500
  CDS (1)..(1515)

SEQ ID NO: 47037 - protein, 504 aa, Leifsonia xyli subsp. xyli str. CTCB07; identical to SEQ ID NO: 32501

SEQ ID NO: 47038 - DNA, 1512 bp, Desulfotalea psychrophila LSv54; identical to SEQ ID NO: 32502
  CDS (1)..(1512)

SEQ ID NO: 47039 - protein, 503 aa, Desulfotalea psychrophila LSv54; identical to SEQ ID NO: 32503

SEQ ID NO: 47040 - DNA, 1488 bp, Symbiobacterium thermophilum IAM 14863; identical to SEQ ID NO: 32504
  CDS (1)..(1488)

SEQ ID NO: 47041 - protein, 495 aa, Symbiobacterium thermophilum IAM 14863; identical to SEQ ID NO: 32505

SEQ ID NO: 47042 - DNA, 1512 bp, Mannheimia succiniciproducens MBEL55E; identical to SEQ ID NO: 32506
  CDS (1)..(1512)

SEQ ID NO: 47043 - protein, 503 aa, Mannheimia succiniciproducens MBEL55E; identical to SEQ ID NO: 32507

SEQ ID NO: 47044 - DNA, 1728 bp, Bacteroides fragilis YCH46; identical to SEQ ID NO: 32508
  CDS (1)..(1728)

SEQ ID NO: 47045 - protein, 575 aa, Bacteroides fragilis YCH46; identical to SEQ ID NO: 32509

SEQ ID NO: 47046 - DNA, 1491 bp, Methylococcus capsulatus str. Bath; identical to SEQ ID NO: 32510
  CDS (1)..(1491)

SEQ ID NO: 47047 - protein, 496 aa, Methylococcus capsulatus str. Bath; identical to SEQ ID NO: 32511

SEQ ID NO: 47048 - DNA, 1467 bp, Nocardia farcinica IFM 10152; identical to SEQ ID NO: 32512
  CDS (1)..(1467)

SEQ ID NO: 47049 - protein, 488 aa, Nocardia farcinica IFM 10152; identical to SEQ ID NO: 32513

SEQ ID NO: 47050 - DNA, 1491 bp, Legionella pneumophila str. Paris; identical to SEQ ID NO: 32514
  CDS (1)..(1491)

SEQ ID NO: 47051 - protein, 496 aa, Legionella pneumophila str. Paris; identical to SEQ ID NO: 32515

SEQ ID NO: 47052 - DNA, 1509 bp, Photobacterium profundum SS9; identical to SEQ ID NO: 32516
  CDS (1)..(1509)

SEQ ID NO: 47053 - protein, 502 aa, Photobacterium profundum SS9; identical to SEQ ID NO: 32517

SEQ ID NO: 47054 - DNA, 1488 bp, Leuconostoc mesenteroides subsp. mesenteroides ATCC 8293; identical to SEQ ID NO: 32518
  CDS (1)..(1488)

SEQ ID NO: 47055 - protein, 495 aa, Leuconostoc mesenteroides subsp. mesenteroides ATCC 8293; identical to SEQ ID NO: 32519

SEQ ID NO: 47056 - DNA, 1503 bp, Azotobacter vinelandii; identical to SEQ ID NO: 32520
  CDS (1)..(1503)

SEQ ID NO: 47057 - protein, 500 aa, Azotobacter vinelandii; identical to SEQ ID NO: 32521

SEQ ID NO: 47058 - DNA, 1686 bp, Nostoc punctiforme PCC 73102; identical to SEQ ID NO: 32522
  CDS (1)..(1686)

SEQ ID NO: 47059 - protein, 561 aa, Nostoc punctiforme PCC 73102; identical to SEQ ID NO: 32523

SEQ ID NO: 47060 - DNA, 1503 bp, Actinobacillus pleuropneumoniae serovar 1 str. 4074; identical to SEQ ID NO: 32524
  CDS (1)..(1503)

SEQ ID NO: 47061 - protein, 500 aa, Actinobacillus pleuropneumoniae serovar 1 str. 4074; identical to SEQ ID NO: 32525

SEQ ID NO: 47062 - DNA, 1482 bp, Fusobacterium nucleatum subsp. vincentii ATCC 49256; identical to SEQ ID NO: 32526
  CDS (1)..(1482)

SEQ ID NO: 47063 - protein, 493 aa, Fusobacterium nucleatum subsp. vincentii ATCC 49256; identical to SEQ ID NO: 32527

SEQ ID NO: 47064 - DNA, 1545 bp, Psychrobacter sp. 273-4; identical to SEQ ID NO: 32528
  CDS (1)..(1545)

SEQ ID NO: 47065 - protein, 514 aa, Psychrobacter sp. 273-4; identical to SEQ ID NO: 32529

SEQ ID NO: 47066 - DNA, 1506 bp, Dechloromonas aromatica RCB; identical to SEQ ID NO: 32530
  CDS (1)..(1506)

SEQ ID NO: 47067 - protein, 501 aa, Dechloromonas aromatica RCB; identical to SEQ ID NO: 32531

SEQ ID NO: 47068 - DNA, 1509 bp, Haemophilus influenzae R2866; identical to SEQ ID NO: 32532
  CDS (1)..(1509)

SEQ ID NO: 47069 - protein, 502 aa, Haemophilus influenzae R2866; identical to SEQ ID NO: 32533

SEQ ID NO: 47070 - DNA, 1686 bp, Anabaena variabilis ATCC 29413; identical to SEQ ID NO: 32534
  CDS (1)..(1686)

SEQ ID NO: 47071 - protein, 561 aa, Anabaena variabilis ATCC 29413; identical to SEQ ID NO: 32535

SEQ ID NO: 47072 - DNA, 1515 bp, Synechococcus elongatus PCC 7942; identical to SEQ ID NO: 32536
  CDS (1)..(1515)

SEQ ID NO: 47073 - protein, 504 aa, Synechococcus elongatus PCC 7942; identical to SEQ ID NO: 32537

SEQ ID NO: 47074 - DNA, 1551 bp, Ralstonia eutropha JMP134; identical to SEQ ID NO: 32538
  CDS (1)..(1551)

SEQ ID NO: 47075 - protein, 516 aa, Ralstonia eutropha JMP134; identical to SEQ ID NO: 32539

SEQ ID NO: 47076 - DNA, 1530 bp, Methylobacillus flagellatus KT; identical to SEQ ID NO: 32540
  CDS (1)..(1530)

SEQ ID NO: 47077 - protein, 509 aa, Methylobacillus flagellatus KT; identical to SEQ ID NO: 32541

SEQ ID NO: 47078 - DNA, 1722 bp, Crocosphaera watsonii WH 8501; identical to SEQ ID NO: 32542
  CDS (1)..(1722)

SEQ ID NO: 47079 - protein, 573 aa, Crocosphaera watsonii WH 8501; identical to SEQ ID NO: 32543

SEQ ID NO: 47080 - DNA, 1482 bp, Exiguobacterium sp. 255-15; identical to SEQ ID NO: 32544
  CDS (1)..(1482)

SEQ ID NO: 47081 - protein, 493 aa, Exiguobacterium sp. 255-15; identical to SEQ ID NO: 32545

SEQ ID NO: 47082 - DNA, 1527 bp, Burkholderia cepacia R1808; identical to SEQ ID NO: 32546
  CDS (1)..(1527)

SEQ ID NO: 47083 - protein, 508 aa, Burkholderia cepacia R1808; identical to SEQ ID NO: 32547

SEQ ID NO: 47084 - DNA, 1527 bp, Rubrivivax gelatinosus PM1; identical to SEQ ID NO: 32548
  CDS (1)..(1527)

SEQ ID NO: 47085 - protein, 508 aa, Rubrivivax gelatinosus PM1; identical to SEQ ID NO: 32549

SEQ ID NO: 47086 - DNA, 1506 bp, Magnetococcus sp. MC-1; identical to SEQ ID NO: 32550
  CDS (1)..(1506)

SEQ ID NO: 47087 - protein, 501 aa, Magnetococcus sp. MC-1; identical to SEQ ID NO: 32551

SEQ ID NO: 47088 - DNA, 1491 bp, Thermobifida fusca; identical to SEQ ID NO: 32552
  CDS (1)..(1491)

SEQ ID NO: 47089 - protein, 496 aa, Thermobifida fusca; identical to SEQ ID NO: 32553

SEQ ID NO: 47090 - DNA, 1548 bp, Methanosarcina barkeri str. fusaro; identical to SEQ ID NO: 32554
  CDS (1)..(1548)

SEQ ID NO: 47091 - protein, 515 aa, Methanosarcina barkeri str. fusaro; identical to SEQ ID NO: 32555

SEQ ID NO: 47092 - DNA, 1476 bp, Geobacter metallireducens GS-15; identical to SEQ ID NO: 32556
  CDS (1)..(1476)

SEQ ID NO: 47093 - protein, 491 aa, Geobacter metallireducens GS-15; identical to SEQ ID NO: 32557

SEQ ID NO: 47094 - DNA, 1755 bp, Cytophaga hutchinsonii; identical to SEQ ID NO: 32558
  CDS (1)..(1755)

SEQ ID NO: 47095 - protein, 584 aa, Cytophaga hutchinsonii; identical to SEQ ID NO: 32559

SEQ ID NO: 47096 - DNA, 1509 bp, Microbulbifer degradans 2-40; identical to SEQ ID NO: 32560
  CDS (1)..(1509)

SEQ ID NO: 47097 - protein, 502 aa, Microbulbifer degradans 2-40; identical to SEQ ID NO: 32561

SEQ ID NO: 47098 - DNA, 1497 bp, Pediococcus pentosaceus ATCC 25745; identical to SEQ ID NO: 32562
  CDS (1)..(1497)

SEQ ID NO: 47099 - protein, 498 aa, Pediococcus pentosaceus ATCC 25745; identical to SEQ ID NO: 32563

SEQ ID NO: 47100 - DNA, 1569 bp, Trichodesmium erythraeum IMS101; identical to SEQ ID NO: 32564
  CDS (1)..(1569)

SEQ ID NO: 47101 - protein, 522 aa, Trichodesmium erythraeum IMS101; identical to SEQ ID NO: 32565

SEQ ID NO: 47102 - DNA, 1491 bp, Streptococcus suis 89/1591; identical to SEQ ID NO: 32566
  CDS (1)..(1491)

SEQ ID NO: 47103 - protein, 496 aa, Streptococcus suis 89/1591; identical to SEQ ID NO: 32567

SEQ ID NO: 47104 - DNA, 1506 bp, Thiobacillus denitrificans ATCC 25259; identical to SEQ ID NO: 32568
  CDS (1)..(1506)

SEQ ID NO: 47105 - protein, 501 aa, Thiobacillus denitrificans ATCC 25259; identical to SEQ ID NO: 32569

SEQ ID NO: 47106 - DNA, 1551 bp, Polaromonas sp. JS666; identical to SEQ ID NO: 32570
  CDS (1)..(1551)

SEQ ID NO: 47107 - protein, 516 aa, Polaromonas sp. JS666; identical to SEQ ID NO: 32571

SEQ ID NO: 47108 - DNA, 1734 bp, Brachydanio rerio; identical to SEQ ID NO: 32572
  CDS (1)..(1734)

SEQ ID NO: 47109 - protein, 577 aa, Brachydanio rerio; identical to SEQ ID NO: 32573

SEQ ID NO: 47110 - DNA, 1506 bp, uncultured bacterium 577; identical to SEQ ID NO: 32574
  CDS (1)..(1506)

SEQ ID NO: 47111 - protein, 501 aa, uncultured bacterium 577; identical to SEQ ID NO: 32575

SEQ ID NO: 47112 - DNA, 1491 bp, Candidatus Portiera aleyrodidarum; identical to SEQ ID NO: 32576
  CDS (1)..(1491)

SEQ ID NO: 47113 - protein, 496 aa, Candidatus Portiera aleyrodidarum; identical to SEQ ID NO: 32577

SEQ ID NO: 47114 - DNA, 1518 bp, Citrobacter freundii; identical to SEQ ID NO: 32578
  CDS (1)..(1518)

SEQ ID NO: 47115 - protein, 505 aa, Citrobacter freundii; identical to SEQ ID NO: 32579

SEQ ID NO: 47116 - DNA, 1497 bp, Escherichia coli; identical to SEQ ID NO: 32580
  CDS (1)..(1497)

SEQ ID NO: 47117 - protein, 498 aa, Escherichia coli; identical to SEQ ID NO: 32581

SEQ ID NO: 47118 - DNA, 1788 bp, Mus musculus; identical to SEQ ID NO: 32582
  CDS (1)..(1788)

SEQ ID NO: 47119 - protein, 595 aa, Mus musculus; identical to SEQ ID NO: 32583

SEQ ID NO: 47120 - DNA, 1551 bp, Methanosarcina barkeri; identical to SEQ ID NO: 32584
  CDS (1)..(1551)

SEQ ID NO: 47121 - protein, 516 aa, Methanosarcina barkeri; identical to SEQ ID NO: 32585

SEQ ID NO: 47122 - DNA, 1878 bp, Homo sapiens; identical to SEQ ID NO: 32586
  CDS (1)..(1878)

SEQ ID NO: 47123 - protein, 625 aa, Homo sapiens [sequence omitted]

SEQ ID NO: 47124 - DNA, 1536 bp, Methanosarcina acetivorans; identical to SEQ ID NO: 32588
  CDS (1)..(1536)

SEQ ID NO: 47125 - protein, 511 aa, Methanosarcina acetivorans; identical to SEQ ID NO: 32589

SEQ ID NO: 47126 - DNA, 1536 bp, Methanosarcina mazei; identical to SEQ ID NO: 32590
  CDS (1)..(1536)

SEQ ID NO: 47127 - protein, 511 aa, Methanosarcina mazei; identical to SEQ ID NO: 32591

SEQ ID NO: 47128 - DNA, 1779 bp, Saccharomyces cerevisiae; identical to SEQ ID NO: 32592
  CDS (1)..(1779)

SEQ ID NO: 47129 - protein, 592 aa, Saccharomyces cerevisiae; identical to SEQ ID NO: 32593

SEQ ID NO: 47130 - DNA, 1731 bp, Saccharomyces cerevisiae; identical to SEQ ID NO: 32594
  CDS (1)..(1731)

SEQ ID NO: 47131 - protein, 576 aa, Saccharomyces cerevisiae; identical to SEQ ID NO: 32595

SEQ ID NO: 47132 - DNA, 1530 bp, Acinetobacter sp; identical to SEQ ID NO: 32596
  CDS (1)..(1530)

SEQ ID NO: 47133 - protein, 509 aa, Acinetobacter sp; identical to SEQ ID NO: 32597

SEQ ID NO: 47134 - DNA, 1500 bp, Agrobacterium tumefaciens; identical to SEQ ID NO: 32598
  CDS (1)..(1500)

SEQ ID NO: 47135 - protein, 499 aa, Agrobacterium tumefaciens; identical to SEQ ID NO: 32599

SEQ ID NO: 47136 - DNA, 1686 bp, Anabaena sp; identical to SEQ ID NO: 32600
  CDS (1)..(1686)

SEQ ID NO: 47137 - protein, 561 aa, Anabaena sp; identical to SEQ ID NO: 32601

SEQ ID NO: 47138 - DNA, 1794 bp, Aquifex aeolicus; identical to SEQ ID NO: 32602
  CDS (1)..(1794)

SEQ ID NO: 47139 - protein, 597 aa, Aquifex aeolicus; identical to SEQ ID NO: 32603

SEQ ID NO: 47140 - DNA, 1881 bp, Arabidopsis thaliana; identical to SEQ ID NO: 32604
  CDS (1)..(1881)

SEQ ID NO: 47141 - protein, 626 aa, Arabidopsis thaliana; identical to SEQ ID NO: 32605

SEQ ID NO: 47142 - DNA, 1485 bp, Bacillus stearothermophilus; identical to SEQ ID NO: 32606
  CDS (1)..(1485)

SEQ ID NO: 47143 - protein, 494 aa, Bacillus stearothermophilus; identical to SEQ ID NO: 32607

SEQ ID NO: 47144 - DNA, 1500 bp, Bacillus subtilis; identical to SEQ ID NO: 32608
  CDS (1)..(1500)

SEQ ID NO: 47145 - protein, 499 aa, Bacillus subtilis; identical to SEQ ID NO: 32609

SEQ ID NO: 47146 - DNA, 1731 bp, Bacteroides thetaiotaomicron; identical to SEQ ID NO: 32610
  CDS (1)..(1731)

SEQ ID NO: 47147 - protein, 576 aa, Bacteroides thetaiotaomicron; identical to SEQ ID NO: 32611

SEQ ID NO: 47148 - DNA, 1521 bp, Buchnera aphidicola; identical to SEQ ID NO: 32612
  CDS (1)..(1521)

SEQ ID NO: 47149 - protein, 506 aa, Buchnera aphidicola; identical to SEQ ID NO: 32613

SEQ ID NO: 47150 - DNA, 1512 bp, Buchnera aphidicola; identical to SEQ ID NO: 32614
  CDS (1)..(1512)

SEQ ID NO: 47151 - protein, 503 aa, Buchnera aphidicola; identical to SEQ ID NO: 32615

SEQ ID NO: 47152 - DNA, 1719 bp, Caenorhabditis elegans; identical to SEQ ID NO: 32616
  CDS (1)..(1719)

SEQ ID NO: 47153 - protein, 572 aa, Caenorhabditis elegans; identical to SEQ ID NO: 32617

SEQ ID NO: 47154 - DNA, 1506 bp, Campylobacter jejuni; identical to SEQ ID NO: 32618
  CDS (1)..(1506)

SEQ ID NO: 47155 - protein, 501 aa, Campylobacter jejuni; identical to SEQ ID NO: 32619

SEQ ID NO: 47156 - DNA, 1458 bp, Candidatus Blochmannia floridanus; identical to SEQ ID NO: 32620
  CDS (1)..(1458)

SEQ ID NO: 47157 - protein, 485 aa, Candidatus Blochmannia floridanus; identical to SEQ ID NO: 32621

SEQ ID NO: 47158 - DNA, 1578 bp, Chlamydophila caviae; identical to SEQ ID NO: 32622
  CDS (1)..(1578)

SEQ ID NO: 47159 - protein, 525 aa, Chlamydophila caviae; identical to SEQ ID NO: 32623

SEQ ID NO: 47160 - DNA, 1536 bp, Chlorobium tepidum; identical to SEQ ID NO: 32624
  CDS (1)..(1536)

SEQ ID NO: 47161 - protein, 511 aa, Chlorobium tepidum; identical to SEQ ID NO: 32625

SEQ ID NO: 47162 - DNA, 1581 bp, Chlamydia trachomatis; identical to SEQ ID NO: 32626
  CDS (1)..(1581)

SEQ ID NO: 47163 - protein, 526 aa, Chlamydia trachomatis; identical to SEQ ID NO: 32627

SEQ ID NO: 47164 - DNA, 1509 bp, Chromobacterium violaceum; identical to SEQ ID NO: 32628
  CDS (1)..(1509)

SEQ ID NO: 47165 - protein, 502 aa, Chromobacterium violaceum; identical to SEQ ID NO: 32629

SEQ ID NO: 47166 - DNA, 1506 bp, Clostridium perfringens; identical to SEQ ID NO: 32630
  CDS (1)..(1506)

SEQ ID NO: 47167 - protein, 501 aa, Clostridium perfringens; identical to SEQ ID NO: 32631

SEQ ID NO: 47168 - DNA, 1509 bp, Clostridium tetani; identical to SEQ ID NO: 32632
  CDS (1)..(1509)

SEQ ID NO: 47169 - protein, 502 aa, Clostridium tetani; identical to SEQ ID NO: 32633

SEQ ID NO: 47170 - DNA, 1497 bp, Coxiella burnetii; identical to SEQ ID NO: 32634
  CDS (1)..(1497)

SEQ ID NO: 47171 - protein, 498 aa, Coxiella burnetii; identical to SEQ ID NO: 32635

SEQ ID NO: 47172 - DNA, 1794 bp, Cricetulus longicaudatus; identical to SEQ ID NO: 32636
  CDS (1)..(1794)

SEQ ID NO: 47173 - protein, 597 aa, Cricetulus longicaudatus; identical to SEQ ID NO: 32637

SEQ ID NO: 47174 - DNA, 1578 bp, Deinococcus radiodurans; identical to SEQ ID NO: 32638
  CDS (1)..(1578)

SEQ ID NO: 47175 - protein, 525 aa, Deinococcus radiodurans; identical to SEQ ID NO: 32639

SEQ ID NO: 47176 - DNA, 1497 bp, Enterococcus faecalis; identical to SEQ ID NO: 32640
  CDS (1)..(1497)

SEQ ID NO: 47177 - protein, 498 aa, Enterococcus faecalis; identical to SEQ ID NO: 32641

SEQ ID NO: 47178 - DNA, 1482 bp, Fusobacterium nucleatum; identical to SEQ ID NO: 32642
  CDS (1)..(1482)

SEQ ID NO: 47179 - protein, 493 aa, Fusobacterium nucleatum; identical to SEQ ID NO: 32643

SEQ ID NO: 47180 - DNA, 1494 bp, Gloeobacter violaceus; identical to SEQ ID NO: 32644
  CDS (1)..(1494)

SEQ ID NO: 47181 - protein, 497 aa, Gloeobacter violaceus; identical to SEQ ID NO: 32645

SEQ ID NO: 47182 - DNA, 1497 bp, Haemophilus ducreyi; identical to SEQ ID NO: 32646
  CDS (1)..(1497)

SEQ ID NO: 47183 - protein, 498 aa, Haemophilus ducreyi; identical to SEQ ID NO: 32647

SEQ ID NO: 47184 - DNA, 1557 bp, Helicobacter hepaticus; identical to SEQ ID NO: 32648
  CDS (1)..(1557)

SEQ ID NO: 47185 - protein, 518 aa, Helicobacter hepaticus; identical to SEQ ID NO: 32649

SEQ ID NO: 47186 - DNA, 1485 bp, Lactococcus lactis; identical to SEQ ID NO: 32650
  CDS (1)..(1485)

SEQ ID NO: 47187 - protein, 494 aa, Lactococcus lactis; identical to SEQ ID NO: 32651

SEQ ID NO: 47188 - DNA, 1500 bp, Lactobacillus plantarum; identical to SEQ ID NO: 32652
  CDS (1)..(1500)

SEQ ID NO: 47189 - protein, 499 aa, Lactobacillus plantarum; identical to SEQ ID NO: 32653

SEQ ID NO: 47190 - DNA, 1497 bp, Listeria monocytogenes; identical to SEQ ID NO: 32654
  CDS (1)..(1497)

SEQ ID NO: 47191 - protein, 498 aa, Listeria monocytogenes; identical to SEQ ID NO: 32655

SEQ ID NO: 47192 - DNA, 1767 bp, Lycopersicon esculentum; identical to SEQ ID NO: 32656
  CDS (1)..(1767)

SEQ ID NO: 47193 - protein, 588 aa, Lycopersicon esculentum; identical to SEQ ID NO: 32657

SEQ ID NO: 47194 - DNA, 1512 bp, Neisseria meningitidis; identical to SEQ ID NO: 32658
  CDS (1)..(1512)

SEQ ID NO: 47195 - protein, 503 aa, Neisseria meningitidis; identical to SEQ ID NO: 32659

SEQ ID NO: 47196 - DNA, 1509 bp, Nitrosomonas europaea; identical to SEQ ID NO: 32660
  CDS (1)..(1509)

SEQ ID NO: 47197 - protein, 502 aa, Nitrosomonas europaea; identical to SEQ ID NO: 32661

SEQ ID NO: 47198 - DNA, 1482 bp, Oceanobacillus iheyensis; identical to SEQ ID NO: 32662
  CDS (1)..(1482)

SEQ ID NO: 47199 - protein, 493 aa, Oceanobacillus iheyensis; identical to SEQ ID NO: 32663

SEQ ID NO: 47200 - DNA, 1809 bp, Oryza sativa; identical to SEQ ID NO: 32664
  CDS (1)..(1809)

SEQ ID NO: 47201 - protein, 602 aa, Oryza sativa; identical to SEQ ID NO: 32665

SEQ ID NO: 47202 - DNA, 1506 bp, Pasteurella multocida; identical to SEQ ID NO: 32666
  CDS (1)..(1506)

SEQ ID NO: 47203 - protein, 501 aa, Pasteurella multocida; identical to SEQ ID NO: 32667

SEQ ID NO: 47204 - DNA, 1737 bp, Porphyromonas gingivalis; identical to SEQ ID NO: 32668
  CDS (1)..(1737)

SEQ ID NO: 47205 - protein, 578 aa, Porphyromonas gingivalis; identical to SEQ ID NO: 32669

SEQ ID NO: 47206 - DNA, 1506 bp, Pseudomonas aeruginosa; identical to SEQ ID NO: 32670
  CDS (1)..(1506)

SEQ ID NO: 47207 - protein, 501 aa, Pseudomonas aeruginosa; identical to SEQ ID NO: 32671

SEQ ID NO: 47208 - DNA, 1503 bp, Pseudomonas syringae; identical to SEQ ID NO: 32672
  CDS (1)..(1503)

SEQ ID NO: 47209 - protein, 500 aa, Pseudomonas syringae; identical to SEQ ID NO: 32673

SEQ ID NO: 47210 - DNA, 1533 bp, Ralstonia solanacearum; identical to SEQ ID NO: 32674
  CDS (1)..(1533)

SEQ ID NO: 47211 - protein, 510 aa, Ralstonia solanacearum; identical to SEQ ID NO: 32675

SEQ ID NO: 47212 - DNA, 1497 bp, Rhizobium meliloti; identical to SEQ ID NO: 32676
  CDS (1)..(1497)

SEQ ID NO: 47213 - protein, 498 aa, Rhizobium meliloti; identical to SEQ ID NO: 32677

SEQ ID NO: 47214 - DNA, 1503 bp, Shewanella oneidensis; identical to SEQ ID NO: 32678
  CDS (1)..(1503)

SEQ ID NO: 47215 - protein, 500 aa, Shewanella oneidensis; identical to SEQ ID NO: 32679

SEQ ID NO: 47216 - DNA, 1488 bp, Staphylococcus aureus; identical to SEQ ID NO: 32680
  CDS (1)..(1488)

SEQ ID NO: 47217 - protein, 495 aa, Staphylococcus aureus; identical to SEQ ID NO: 32681

SEQ ID NO: 47218 - DNA, 1485 bp, Sulfolobus solfataricus; identical to SEQ ID NO: 32682
  CDS (1)..(1485)

SEQ ID NO: 47219 - protein, 494 aa, Sulfolobus solfataricus; identical to SEQ ID NO: 32683

SEQ ID NO: 47220 - DNA, 1521 bp, Synechococcus elongatus; identical to SEQ ID NO: 32684
  CDS (1)..(1521)

SEQ ID NO: 47221 - protein, 506 aa, Synechococcus elongatus; identical to SEQ ID NO: 32685

SEQ ID NO: 47222 - DNA, 1509 bp, Synechococcus sp; identical to SEQ ID NO: 32686
  CDS (1)..(1509)

SEQ ID NO: 47223 - protein, 502 aa, Synechococcus sp; identical to SEQ ID NO: 32687

SEQ ID NO: 47224 - DNA, 1509 bp, Thermotoga maritima; identical to SEQ ID NO: 32688
  CDS (1)..(1509)

SEQ ID NO: 47225 - protein, 502 aa, Thermotoga maritima; identical to SEQ ID NO: 32689

SEQ ID NO: 47226 - DNA, 1479 bp, Thermus thermophilus; identical to SEQ ID NO: 32690
  CDS (1)..(1479)

SEQ ID NO: 47227 - protein, 492 aa, Thermus thermophilus; identical to SEQ ID NO: 32691

SEQ ID NO: 47228 - DNA, 1500 bp, Thermoanaerobacter tengcongensis; identical to SEQ ID NO: 32692
  CDS (1)..(1500)

SEQ ID NO: 47229 - protein, 499 aa, Thermoanaerobacter tengcongensis; identical to SEQ ID NO: 32693

SEQ ID NO: 47230 - DNA, 1482 bp, Ureaplasma parvum; identical to SEQ ID NO: 32694
  CDS (1)..(1482)

SEQ ID NO: 47231 - protein, 493 aa, Ureaplasma parvum; identical to SEQ ID NO: 32695

SEQ ID NO: 47232 - DNA, 1518 bp, Vibrio parahaemolyticus; identical to SEQ ID NO: 32696
  CDS (1)..(1518)

SEQ ID NO: 47233 - protein, 505 aa, Vibrio parahaemolyticus; identical to SEQ ID NO: 32697

SEQ ID NO: 47234 - DNA, 1533 bp, Vibrio vulnificus; identical to SEQ ID NO: 32698
  CDS (1)..(1533)

SEQ ID NO: 47235 - protein, 510 aa, Vibrio vulnificus; identical to SEQ ID NO: 32699

SEQ ID NO: 47236 - DNA, 1482 bp, Wigglesworthia glossinidia brevipalpis; identical to SEQ ID NO: 32700
  CDS (1)..(1482)

SEQ ID NO: 47237 - protein, 493 aa, Wigglesworthia glossinidia brevipalpis; identical to SEQ ID NO: 32701

SEQ ID NO: 47238 - DNA, 1524 bp, Wolinella succinogenes; identical to SEQ ID NO: 32702
  CDS (1)..(1524)

SEQ ID NO: 47239 - protein, 507 aa, Wolinella succinogenes; identical to SEQ ID NO: 32703

SEQ ID NO: 47240 - DNA, 1518 bp, Xanthomonas campestris; identical to SEQ ID NO: 32704
  CDS (1)..(1518)

SEQ ID NO: 47241 - protein, 505 aa, Xanthomonas campestris; identical to SEQ ID NO: 32705

SEQ ID NO: 47242 - DNA, 1521 bp, Xylella fastidiosa; identical to SEQ ID NO: 32706
  CDS (1)..(1521)

SEQ ID NO: 47243 - protein, 506 aa, Xylella fastidiosa; identical to SEQ ID NO: 32707

SEQ ID NO: 47244 - DNA, 1518 bp, Yersinia pestis; identical to SEQ ID NO: 32708
  CDS (1)..(1518)

SEQ ID NO: 47245 - protein, 505 aa, Yersinia pestis; identical to SEQ ID NO: 32709

SEQ ID NO: 47246 - DNA, 23 bp, Primer
atgtctgaacaagaaacacgggg

SEQ ID NO: 47247 - DNA, 22 bp, Primer
ttatttctgtgggcgcatcgcc

SEQ ID NO: 47248 - protein, 561 aa, consensus; identical to SEQ ID NO: 32712
  MISC_FEATURE (1)..(561): consensus for the disclosure of xaa see table XV

SEQ ID NO: 47249 - protein, 34 aa, consensus; identical to SEQ ID NO: 32713
  MISC_FEATURE (1)..(34): consensus for the disclosure of xaa see table XV

SEQ ID NO: 47250 - protein, 46 aa, consensus; identical to SEQ ID NO: 32714
  MISC_FEATURE (1)..(46): consensus for the disclosure of xaa see table XV

SEQ ID NO: 47251 - protein, 135 aa, consensus; identical to SEQ ID NO: 32715
  MISC_FEATURE (1)..(135): consensus for the disclosure of xaa see table XV

SEQ ID NO: 47252 - protein, 62 aa, consensus; identical to SEQ ID NO: 32716
  MISC_FEATURE (1)..(62): consensus for the disclosure of xaa see table XV

SEQ ID NO: 47253 - protein, 45 aa, consensus; identical to SEQ ID NO: 32717
  MISC_FEATURE (1)..(45): consensus for the disclosure of xaa see table XV

SEQ ID NO: 47254 - DNA, 1425 bp, Escherichia coli K12; identical to SEQ ID NO: 28717
  CDS (1)..(1425)

SEQ ID NO: 47255 - protein, 474 aa, Escherichia coli K12; identical to SEQ ID NO: 28718

SEQ ID NO: 47256 - DNA, 1401 bp, Haemophilus influenzae; identical to SEQ ID NO: 28719
  CDS (1)..(1401)

SEQ ID NO: 47257 - protein, 466 aa, Haemophilus influenzae; identical to SEQ ID NO: 28720

SEQ ID NO: 47258 - DNA, 1350 bp, Bacillus subtilis; identical to SEQ ID NO: 28721
  CDS (1)..(1350)

SEQ ID NO: 47259 - protein, 449 aa, Bacillus subtilis; identical to SEQ ID NO: 28722

SEQ ID NO: 47260 - DNA, 1545 bp, Xylella fastidiosa; identical to SEQ ID NO: 28723
  CDS (1)..(1545)

SEQ ID NO: 47261 - protein, 514 aa, Xylella fastidiosa; identical to SEQ ID NO: 28724

SEQ ID NO: 47262 - DNA, 1251 bp, Nostoc sp. PCC 7120; identical to SEQ ID NO: 28725
  CDS (1)..(1251)

SEQ ID NO: 47263 - protein, 416 aa, Nostoc sp. PCC 7120; identical to SEQ ID NO: 28726

SEQ ID NO: 47264 - DNA, 1428 bp, Salmonella enterica subsp. enterica serovar Typhi; identical to SEQ ID NO: 28727
  CDS (1)..(1428)

SEQ ID NO: 47265 - protein, 475 aa, Salmonella enterica subsp. enterica serovar Typhi; identical to SEQ ID NO: 28728

SEQ ID NO: 47266 - DNA, 1290 bp, Nostoc sp. PCC 7120; identical to SEQ ID NO: 28729
  CDS (1)..(1290)

SEQ ID NO: 47267 - protein, 429 aa, Nostoc sp. PCC 7120; identical to SEQ ID NO: 28730

SEQ ID NO: 47268 - DNA, 1206 bp, Nostoc sp. PCC 7120; identical to SEQ ID NO: 28731
  CDS (1)..(1206)

SEQ ID NO: 47269 - protein, 401 aa, Nostoc sp. PCC 7120; identical to SEQ ID NO: 28732

SEQ ID NO: 47270 - DNA, 1545 bp, Agrobacterium tumefaciens; identical to SEQ ID NO: 28733
  CDS (1)..(1545)

SEQ ID NO: 47271 - protein, 514 aa, Agrobacterium tumefaciens; identical to SEQ ID NO: 28734

SEQ ID NO: 47272 - DNA, 1446 bp, Yersinia pestis; identical to SEQ ID NO: 28735
  CDS (1)..(1446)

SEQ ID NO: 47273 - protein, 481 aa, Yersinia pestis; identical to SEQ ID NO: 28736

SEQ ID NO: 47274 - DNA, 1572 bp, Agrobacterium tumefaciens; identical to SEQ ID NO: 28737
  CDS (1)..(1572)

SEQ ID NO: 47275 - protein, 523 aa, Agrobacterium tumefaciens; identical to SEQ ID NO: 28738

SEQ ID NO: 47276 - DNA, 1407 bp, Agrobacterium tumefaciens; identical to SEQ ID NO: 28739
  CDS (1)..(1407)

SEQ ID NO: 47277 - protein, 468 aa, Agrobacterium tumefaciens; identical to SEQ ID NO: 28740

SEQ ID NO: 47278 - DNA, 1425 bp, Brucella melitensis; identical to SEQ ID NO: 28741
  CDS (1)..(1425)

SEQ ID NO: 47279 - protein, 474 aa, Brucella melitensis; identical to SEQ ID NO: 28742

SEQ ID NO: 47280 - DNA, 1362 bp, Aquifex aeolicus; identical to SEQ ID NO: 28743
  CDS (1)..(1362)

SEQ ID NO: 47281 - protein, 453 aa, Aquifex aeolicus; identical to SEQ ID NO: 28744

SEQ ID NO: 47282 - DNA, 1500 bp, Neisseria meningitidis; identical to SEQ ID NO: 28745
  CDS (1)..(1500)

SEQ ID NO: 47283 - protein, 499 aa, Neisseria meningitidis; identical to SEQ ID NO: 28746

SEQ ID NO: 47284 - DNA, 1170 bp, Pseudomonas aeruginosa; identical to SEQ ID NO: 28747
  CDS (1)..(1170)

SEQ ID NO: 47285 - protein, 389 aa, Pseudomonas aeruginosa; identical to SEQ ID NO: 28748

SEQ ID NO: 47286 - DNA, 1407 bp, Sinorhizobium meliloti; identical to SEQ ID NO: 28749
  CDS (1)..(1407)

SEQ ID NO: 47287 - protein, 468 aa, Sinorhizobium meliloti; identical to SEQ ID NO: 28750

SEQ ID NO: 47288 - DNA, 1332 bp, Helicobacter pylori; identical to SEQ ID NO: 28751
  CDS (1)..(1332)

SEQ ID NO: 47289 - protein, 443 aa, Helicobacter pylori; identical to SEQ ID NO: 28752

SEQ ID NO: 47290 - DNA, 1419 bp, Caulobacter crescentus; identical to SEQ ID NO: 28753
  CDS (1)..(1419)

SEQ ID NO: 47291 - protein, 472 aa, Caulobacter crescentus; identical to SEQ ID NO: 28754

SEQ ID NO: 47292 - DNA, 1446 bp, Xylella fastidiosa; identical to SEQ ID NO: 28755
  CDS (1)..(1446)

SEQ ID NO: 47293 - protein, 481 aa, Xylella fastidiosa; identical to SEQ ID NO: 28756

SEQ ID NO: 47294 - DNA, 1458 bp, Treponema pallidum subsp. pallidum (syphilis spirochete); identical to SEQ ID NO: 28757
  CDS (1)..(1458)

SEQ ID NO: 47295 - protein, 485 aa, Treponema pallidum subsp. pallidum (syphilis spirochete); identical to SEQ ID NO: 28758

SEQ ID NO: 47296 - DNA, 1380 bp, Thermotoga maritima; identical to SEQ ID NO: 28759
  CDS (1)..(1380)

SEQ ID NO: 47297 - protein, 459 aa, Thermotoga maritima; identical to SEQ ID NO: 28760

SEQ ID NO: 47298 - DNA, 1371 bp, Vibrio cholerae; identical to SEQ ID NO: 28761
  CDS (1)..(1371)

SEQ ID NO: 47299 - protein, 456 aa, Vibrio cholerae; identical to SEQ ID NO: 28762

SEQ ID NO: 47300 - DNA, 1961 bp, Pseudomonas aeruginosa; identical to SEQ ID NO: 28763
  CDS (496)..(1920)

SEQ ID NO: 47301 - protein, 474 aa, Pseudomonas aeruginosa; identical to SEQ ID NO: 28764

SEQ ID NO: 47302 - DNA, 1593 bp, Caulobacter crescentus; identical to SEQ ID NO: 28765
  CDS (1)..(1593)

SEQ ID NO: 47303 - protein, 530 aa, Caulobacter crescentus; identical to SEQ ID NO: 28766

SEQ ID NO: 47304 - DNA, 1536 bp, Rickettsia conorii; identical to SEQ ID NO: 28767
  CDS (1)..(1536)

SEQ ID NO: 47305 - protein, 511 aa, Rickettsia conorii; identical to SEQ ID NO: 28768

SEQ ID NO: 47306 - DNA, 1452 bp, Borrelia burgdorferi (Lyme disease spirochete); identical to SEQ ID NO: 28769
  CDS (1)..(1452)

SEQ ID NO: 47307 - protein, 483 aa, Borrelia burgdorferi (Lyme disease spirochete); identical to SEQ ID NO: 28770

SEQ ID NO: 47308 - DNA, 1494 bp, Chlamydia trachomatis; identical to SEQ ID NO: 28771
  CDS (1)..(1494)

SEQ ID NO: 47309 - protein, 497 aa, Chlamydia trachomatis; identical to SEQ ID NO: 28772

SEQ ID NO: 47310 - DNA, 1431 bp, Helicobacter pylori; identical to SEQ ID NO: 28773
  CDS (1)..(1431)

SEQ ID NO: 47311 - protein, 476 aa, Helicobacter pylori; identical to SEQ ID NO: 28774

SEQ ID NO: 47312 - DNA, 1302 bp, Clostridium acetobutylicum; identical to SEQ ID NO: 28775
  CDS (1)..(1302)

SEQ ID NO: 47313 - protein, 433 aa, Clostridium acetobutylicum; identical to SEQ ID NO: 28776

SEQ ID NO: 47314 - DNA, 2009 bp, Brucella abortus; identical to SEQ ID NO: 28777
  CDS (275)..(1816)

SEQ ID NO: 47315 - protein, 513 aa, Brucella abortus; identical to SEQ ID NO: 28778

SEQ ID NO: 47316 - DNA, 1185 bp, Synechocystis sp; identical to SEQ ID NO: 28779
  CDS (1)..(1185)

SEQ ID NO: 47317 - protein, 394 aa, Synechocystis sp; identical to SEQ ID NO: 28780

SEQ ID NO: 47318 - DNA, 1251 bp, Synechocystis sp; identical to SEQ ID NO: 28781
  CDS (1)..(1251)

SEQ ID NO: 47319 - protein, 416 aa, Synechocystis sp; identical to SEQ ID NO: 28782

SEQ ID NO: 47320 - DNA, 1359 bp, Synechocystis sp; identical to SEQ ID NO: 28783
  CDS (1)..(1359)

SEQ ID NO: 47321 - protein, 452 aa, Synechocystis sp; identical to SEQ ID NO: 28784

SEQ ID NO: 47322 - DNA, 1740 bp, Lactococcus lactis; identical to SEQ ID NO: 28785
  CDS (230)..(1456)

SEQ ID NO: 47323 - protein, 408 aa, Lactococcus lactis; identical to SEQ ID NO: 28786

SEQ ID NO: 47324 - DNA, 1383 bp, Rhodobacter capsulatus; identical to SEQ ID NO: 28787
  CDS (1)..(1383)

SEQ ID NO: 47325 - protein, 460 aa, Rhodobacter capsulatus; identical to SEQ ID NO: 28788

SEQ ID NO: 47326 - DNA, 1392 bp, Haemophilus influenzae; identical to SEQ ID NO: 28789
  CDS (1)..(1392)

SEQ ID NO: 47327 - protein, 463 aa, Haemophilus influenzae; identical to SEQ ID NO: 28790

SEQ ID NO: 47328 - DNA, 1800 bp, Yersinia enterocolitica; identical to SEQ ID NO: 28791
  CDS (244)..(1680)

SEQ ID NO: 47329 - protein, 478 aa, Yersinia enterocolitica; identical to SEQ ID NO: 28792

SEQ ID NO: 47330 - DNA, 2027 bp, Azotobacter vinelandii; identical to SEQ ID NO: 28793
  CDS (483)..(1904)

SEQ ID NO: 47331 - protein, 473 aa, Azotobacter vinelandii; identical to SEQ ID NO: 28794

SEQ ID NO: 47332 - DNA, 1905 bp, Brucella abortus; identical to SEQ ID NO: 28795
  CDS (333)..(1835)

SEQ ID NO: 47333 - protein, 500 aa, Brucella abortus; identical to SEQ ID NO: 28796

SEQ ID NO: 47334 - DNA, 1466 bp, Campylobacter jejuni; identical to SEQ ID NO: 28797
  CDS (48)..(1466)

SEQ ID NO: 47335 - protein, 472 aa, Campylobacter jejuni; identical to SEQ ID NO: 28798

SEQ ID NO: 47336 - DNA, 1191 bp, Pseudomonas aeruginosa; identical to SEQ ID NO: 28799
  CDS (14)..(1183)

SEQ ID NO: 47337 - protein, 389 aa, Pseudomonas aeruginosa; identical to SEQ ID NO: 28800

SEQ ID NO: 47338 - DNA, 1488 bp, Burkholderia mallei ATCC 23344; identical to SEQ ID NO: 28801
  CDS (1)..(1488)

SEQ ID NO: 47339 - protein, 495 aa, Burkholderia mallei ATCC 23344; identical to SEQ ID NO: 28802

SEQ ID NO: 47340 - DNA, 1209 bp, Burkholderia pseudomallei K96243; identical to SEQ ID NO: 28803
  CDS (1)..(1209)

SEQ ID NO: 47341 - protein, 402 aa, Burkholderia pseudomallei K96243; identical to SEQ ID NO: 28804

SEQ ID NO: 47342 - DNA, 1458 bp, Burkholderia pseudomallei K96243; identical to SEQ ID NO: 28805
  CDS (1)..(1458)

SEQ ID NO: 47343 - protein, 485 aa, Burkholderia pseudomallei K96243; identical to SEQ ID NO: 28806

SEQ ID NO: 47344 - DNA, 1557 bp, Burkholderia pseudomallei K96243; identical to SEQ ID NO: 28807
  CDS (1)..(1557)

SEQ ID NO: 47345 - protein, 518 aa, Burkholderia pseudomallei K96243; identical to SEQ ID NO: 28808

SEQ ID NO: 47346 - DNA, 1419 bp, Burkholderia pseudomallei K96243; identical to SEQ ID NO: 28809
  CDS (1)..(1419)

SEQ ID NO: 47347 - protein, 472 aa, Burkholderia pseudomallei K96243; identical to SEQ ID NO: 28810

SEQ ID NO: 47348 - DNA, 1566 bp, Bacteroides fragilis; identical to SEQ ID NO: 28811
  CDS (19)..(1566)

SEQ ID NO: 47349 - protein, 515 aa, Bacteroides fragilis; identical to SEQ ID NO: 28812

SEQ ID NO: 47350 - DNA, 2358 bp, Bacillus licheniformis DSM 13; identical to SEQ ID NO: 28813
  CDS (501)..(1871)

SEQ ID NO: 47351 - protein, 456 aa, Bacillus licheniformis DSM 13; identical to SEQ ID NO: 28814

SEQ ID NO: 47352 - DNA, 1470 bp, Mannheimia succiniciproducens MBEL55E; identical to SEQ ID NO: 28815
  CDS (1)..(1470)

SEQ ID NO: 47353 - protein, 489 aa, Mannheimia succiniciproducens MBEL55E; identical to SEQ ID NO: 28816

SEQ ID NO: 47354 - DNA, 1425 bp, Borrelia garinii PBi; identical to SEQ ID NO: 28817
  CDS (1)..(1425)

SEQ ID NO: 47355 - protein, 474 aa, Borrelia garinii PBi; identical to SEQ ID NO: 28818

SEQ ID NO: 47356 - DNA, 1224 bp, Lactococcus lactis; identical to SEQ ID NO: 28819
  CDS (1)..(1224)

SEQ ID NO: 47357 - protein, 407 aa, Lactococcus lactis; identical to SEQ ID NO: 28820

SEQ ID NO: 47358 - DNA, 1557 bp, Rickettsia typhi; identical to SEQ ID NO: 28821
  CDS (1)..(1557)

SEQ ID NO: 47359 - protein, 518 aa, Rickettsia typhi; identical to SEQ ID NO: 28822

SEQ ID NO: 47360 - DNA, 1485 bp, Onchocerca volvulus endobacterium; identical to SEQ ID NO: 28823
  CDS (1)..(1485)

SEQ ID NO: 47361 - protein, 494 aa, Onchocerca volvulus endobacterium; identical to SEQ ID NO: 28824

SEQ ID NO: 47362 - DNA, 1455 bp, Desulfotalea psychrophila; identical to SEQ ID NO: 28825
  CDS (1)..(1455)

SEQ ID NO: 47363 - protein, 484 aa, Desulfotalea psychrophila; identical to SEQ ID NO: 28826

SEQ ID NO: 47364 - DNA, 1467 bp, Erwinia carotovora; identical to SEQ ID NO: 28827
  CDS (1)..(1467)

SEQ ID NO: 47365 - protein, 488 aa, Erwinia carotovora; identical to SEQ ID NO: 28828

SEQ ID NO: 47366 - DNA, 1371 bp, Erwinia carotovora; identical to SEQ ID NO: 28829
  CDS (1)..(1371)

SEQ ID NO: 47367 - protein, 456 aa, Erwinia carotovora; identical to SEQ ID NO: 28830

SEQ ID NO: 47368 - DNA, 1404 bp, Acinetobacter sp; identical to SEQ ID NO: 28831
  CDS (1)..(1404)

SEQ ID NO: 47369 - protein, 467 aa, Acinetobacter sp; identical to SEQ ID NO: 28832

SEQ ID NO: 47370 - DNA, 1518 bp, Bartonella quintana; identical to SEQ ID NO: 28833
  CDS (1)..(1518)

SEQ ID NO: 47371 - protein, 505 aa, Bartonella quintana; identical to SEQ ID NO: 28834

SEQ ID NO: 47372 - DNA, 1395 bp, Bartonella quintana; identical to SEQ ID NO: 28835
  CDS (1)..(1395)

SEQ ID NO: 47373 - protein, 464 aa, Bartonella quintana; identical to SEQ ID NO: 28836

SEQ ID NO: 47374 - DNA, 1512 bp, Bartonella quintana; identical to SEQ ID NO: 28837
  CDS (1)..(1512)

SEQ ID NO: 47375 - protein, 503 aa, Bartonella quintana; identical to SEQ ID NO: 28838

SEQ ID NO: 47376 - DNA, 1518 bp, Bartonella henselae; identical to SEQ ID NO: 28839
  CDS (1)..(1518)

SEQ ID NO: 47377 - protein, 505 aa, Bartonella henselae; identical to SEQ ID NO: 28840

SEQ ID NO: 47378 - DNA, 1392 bp, Bartonella henselae; identical to SEQ ID NO: 28841
  CDS (1)..(1392)

SEQ ID NO: 47379 - protein, 463 aa, Bartonella henselae; identical to SEQ ID NO: 28842

SEQ ID NO: 47380 - DNA, 1368 bp, Photobacterium profundum; identical to SEQ ID NO: 28843
  CDS (1)..(1368)

SEQ ID NO: 47381 - protein, 455 aa, Photobacterium profundum; identical to SEQ ID NO: 28844

SEQ ID NO: 47382 - DNA, 1455 bp, Parachlamydia sp; identical to SEQ ID NO: 28845
  CDS (1)..(1455)

SEQ ID NO: 47383 - protein, 484 aa, Parachlamydia sp; identical to SEQ ID NO: 28846

SEQ ID NO: 47384 - DNA, 1563 bp, Rhodopseudomonas palustris; identical to SEQ ID NO: 28847
  CDS (1)..(1563)

SEQ ID NO: 47385 - protein, 520 aa, Rhodopseudomonas palustris; identical to SEQ ID NO: 28848

SEQ ID NO: 47386 - DNA, 1506 bp, Rhodopseudomonas palustris; identical to SEQ ID NO: 28849
  CDS (1)..(1506)

SEQ ID NO: 47387 - protein, 501 aa, Rhodopseudomonas palustris; identical to SEQ ID NO: 28850

SEQ ID NO: 47388 - DNA, 1200 bp, Rhodopseudomonas palustris; identical to SEQ ID NO: 28851
  CDS (1)..(1200)

SEQ ID NO: 47389 - protein, 399 aa, Rhodopseudomonas palustris; identical to SEQ ID NO: 28852

SEQ ID NO: 47390 - DNA, 1392 bp, Rhodopseudomonas palustris; identical to SEQ ID NO: 28853
  CDS (1)..(1392)

SEQ ID NO: 47391 - protein, 463 aa, Rhodopseudomonas palustris; identical to SEQ ID NO: 28854

SEQ ID NO: 47392 - DNA, 1572 bp, Rhodopseudomonas palustris; identical to SEQ ID NO: 28855
  CDS (1)..(1572)

SEQ ID NO: 47393 - protein, 523 aa, Rhodopseudomonas palustris; identical to SEQ ID NO: 28856

SEQ ID NO: 47394 - DNA, 1401 bp, uncultured bacterium 580; identical to SEQ ID NO: 28857
  CDS (1)..(1401)

SEQ ID NO: 47395 - protein, 466 aa, uncultured bacterium 580; identical to SEQ ID NO: 28858

SEQ ID NO: 47396 - DNA, 1476 bp, uncultured bacterium 106; identical to SEQ ID NO: 28859
  CDS (1)..(1476)

SEQ ID NO: 47397 - protein, 491 aa, uncultured bacterium 106; identical to SEQ ID NO: 28860

SEQ ID NO: 47398 - DNA, 1143 bp, uncultured bacterium 105; identical to SEQ ID NO: 28861
  CDS (1)..(1143)

SEQ ID NO: 47399 - protein, 380 aa, uncultured bacterium 105; identical to SEQ ID NO: 28862

SEQ ID NO: 47400 - DNA, 1395 bp, Rhizobium sp; identical to SEQ ID NO: 28863
  CDS (1)..(1395)

SEQ ID NO: 47401 - protein, 464 aa, Rhizobium sp; identical to SEQ ID NO: 28864

SEQ ID NO: 47402 - DNA, 1449 bp, Desulfovibrio vulgaris; identical to SEQ ID NO: 28865
  CDS (1)..(1449)

SEQ ID NO: 47403 - protein, 482 aa, Desulfovibrio vulgaris; identical to SEQ ID NO: 28866

SEQ ID NO: 47404 - DNA, 1167 bp, Leptospira interrogans; identical to SEQ ID NO: 28867
  CDS (1)..(1167)

SEQ ID NO: 47405 - protein, 388 aa, Leptospira interrogans; identical to SEQ ID NO: 28868

SEQ ID NO: 47406 - DNA, 1494 bp, Wolbachia pipientis wMel; identical to SEQ ID NO: 28869
  CDS (1)..(1494)

SEQ ID NO: 47407 - protein, 497 aa, Wolbachia pipientis wMel; identical to SEQ ID NO: 28870

SEQ ID NO: 47408 - DNA, 1482 bp, Treponema denticola; identical to SEQ ID NO: 28871
  CDS (1)..(1482)

SEQ ID NO: 47409 - protein, 493 aa, Treponema denticola; identical to SEQ ID NO: 28872

SEQ ID NO: 47410 - DNA, 1395 bp, Geobacter sulfurreducens; identical to SEQ ID NO: 28873
  CDS (1)..(1395)

SEQ ID NO: 47411 - protein, 464 aa, Geobacter sulfurreducens; identical to SEQ ID NO: 28874

SEQ ID NO: 47412 - DNA, 1416 bp, Geobacter sulfurreducens; identical to SEQ ID NO: 28875
  CDS (1)..(1416)

SEQ ID NO: 47413 - protein, 471 aa, Geobacter sulfurreducens; identical to SEQ ID NO: 28876

SEQ ID NO: 47414 - DNA, 1221 bp, Lactobacillus johnsonii; identical to SEQ ID NO: 28877
  CDS (1)..(1221)

SEQ ID NO: 47415 - protein, 406 aa, Lactobacillus johnsonii; identical to SEQ ID NO: 28878

SEQ ID NO: 47416 - DNA, 1425 bp, Wolinella succinogenes; identical to SEQ ID NO: 28879
  CDS (1)..(1425)

SEQ ID NO: 47417 - protein, 474 aa, Wolinella succinogenes; identical to SEQ ID NO: 28880

SEQ ID NO: 47418 - DNA, 1368 bp, Vibrio vulnificus; identical to SEQ ID NO: 28881
  CDS (1)..(1368)

SEQ ID NO: 47419 - protein, 455 aa, Vibrio vulnificus; identical to SEQ ID NO: 28882

SEQ ID NO: 47420 - DNA, 1497 bp, Porphyromonas gingivalis; identical to SEQ ID NO: 28883
  CDS (1)..(1497)

SEQ ID NO: 47421 - protein, 498 aa, Porphyromonas gingivalis; identical to SEQ ID NO: 28884

SEQ ID NO: 47422 - DNA, 1320 bp, Gloeobacter violaceus; identical to SEQ ID NO: 28885
  CDS (1)..(1320)

SEQ ID NO: 47423 - protein, 439 aa, Gloeobacter violaceus; identical to SEQ ID NO: 28886

SEQ ID NO: 47424 - DNA, 1467 bp, Chromobacterium violaceum; identical to SEQ ID NO: 28887
  CDS (1)..(1467)

SEQ ID NO: 47425 - protein, 488 aa, Chromobacterium violaceum; identical to SEQ ID NO: 28888

SEQ ID NO: 47426 - DNA, 1413 bp, Chromobacterium violaceum; identical to SEQ ID NO: 28889
  CDS (1)..(1413)

SEQ ID NO: 47427 - protein, 470 aa, Chromobacterium violaceum; identical to SEQ ID NO: 28890

SEQ ID NO: 47428 - DNA, 1158 bp, Prochlorococcus marinus; identical to SEQ ID NO: 28891
  CDS (1)..(1158)

SEQ ID NO: 47429 - protein, 385 aa, Prochlorococcus marinus; identical to SEQ ID NO: 28892

SEQ ID NO: 47430 - DNA, 1125 bp, Synechococcus sp; identical to SEQ ID NO: 28893
  CDS (1)..(1125)

SEQ ID NO: 47431 - protein, 374 aa, Synechococcus sp; identical to SEQ ID NO: 28894

SEQ ID NO: 47432 - DNA, 1299 bp, Synechococcus sp; identical to SEQ ID NO: 28895
  CDS (1)..(1299)

SEQ ID NO: 47433 - protein, 432 aa, Synechococcus sp; identical to SEQ ID NO: 28896

SEQ ID NO: 47434 - DNA, 1527 bp, Rhodopirellula baltica; identical to SEQ ID NO: 28897
  CDS (1)..(1527)

SEQ ID NO: 47435 - protein, 508 aa, Rhodopirellula baltica; identical to SEQ ID NO: 28898

SEQ ID NO: 47436 - DNA, 1530 bp, Rhodopirellula baltica; identical to SEQ ID NO: 28899
  CDS (1)..(1530)

SEQ ID NO: 47437 - protein, 509 aa, Rhodopirellula baltica; identical to SEQ ID NO: 28900

SEQ ID NO: 47438 - DNA, 1890 bp, Rhodopirellula baltica; identical to SEQ ID NO: 28901
  CDS (1)..(1890)

SEQ ID NO: 47439 - protein, 629 aa, Rhodopirellula baltica; identical to SEQ ID NO: 28902

SEQ ID NO: 47440 - DNA, 1188 bp, Prochlorococcus marinus; identical to SEQ ID NO: 28903
  CDS (1)..(1188)

SEQ ID NO: 47441 - protein, 395 aa, Prochlorococcus marinus; identical to SEQ ID NO: 28904

SEQ ID NO: 47442 - DNA, 1176 bp, Prochlorococcus marinus; identical to SEQ ID NO: 28905
  CDS (1)..(1176)

SEQ ID NO: 47443 - protein, 391 aa, Prochlorococcus marinus; identical to SEQ ID NO: 28906

SEQ ID NO: 47444 - DNA, 1434 bp, Helicobacter hepaticus; identical to SEQ ID NO: 28907
  CDS (1)..(1434)

SEQ ID NO: 47445 - protein, 477 aa, Helicobacter hepaticus; identical to SEQ ID NO: 28908

SEQ ID NO: 47446 - DNA, 1419 bp, Haemophilus ducreyi; identical to SEQ ID NO: 28909
  CDS (1)..(1419)

SEQ ID NO: 47447 - protein, 472 aa, Haemophilus ducreyi; identical to SEQ ID NO: 28910

SEQ ID NO: 47448 - DNA, 1386 bp, Candidatus Blochmannia floridanus; identical to SEQ ID NO: 28911
  CDS (1)..(1386)

SEQ ID NO: 47449 - protein, 461 aa, Candidatus Blochmannia floridanus; identical to SEQ ID NO: 28912

SEQ ID NO: 47450 - DNA, 1137 bp, Bordetella pertussis; identical to SEQ ID NO: 28913
  CDS (1)..(1137)

SEQ ID NO: 47451 - protein, 378 aa, Bordetella pertussis; identical to SEQ ID NO: 28914

SEQ ID NO: 47452 - DNA, 1116 bp, Bordetella parapertussis; identical to SEQ ID NO: 28915
  CDS (1)..(1116)

SEQ ID NO: 47453 - protein, 371 aa, Bordetella parapertussis; identical to SEQ ID NO: 28916

SEQ ID NO: 47454 - DNA, 1488 bp, Bordetella parapertussis; identical to SEQ ID NO: 28917
  CDS (1)..(1488)

SEQ ID NO: 47455 - protein, 495 aa, Bordetella parapertussis; identical to SEQ ID NO: 28918

SEQ ID NO: 47456 - DNA, 1467 bp, Chlamydophila caviae; identical to SEQ ID NO: 28919
  CDS (1)..(1467)

SEQ ID NO: 47457 - protein, 488 aa, Chlamydophila caviae; identical to SEQ ID NO: 28920

SEQ ID NO: 47458 - DNA, 1419 bp, Streptomyces avermitilis; identical to SEQ ID NO: 28921
  CDS (1)..(1419)

SEQ ID NO: 47459 - protein, 472 aa, Streptomyces avermitilis; identical to SEQ ID NO: 28922

SEQ ID NO: 47460 - DNA, 1491 bp, Nitrosomonas europaea; identical to SEQ ID NO: 28923
  CDS (1)..(1491)

SEQ ID NO: 47461 - protein, 496 aa, Nitrosomonas europaea; identical to SEQ ID NO: 28924

SEQ ID NO: 47462 - DNA, 1323 bp, Enterococcus faecalis; identical to SEQ ID NO: 28925
  CDS (25)..(1323)

SEQ ID NO: 47463 - protein, 432 aa, Enterococcus faecalis; identical to SEQ ID NO: 28926

SEQ ID NO: 47464 - DNA, 1356 bp, Coxiella burnetii; identical to SEQ ID NO: 28927
  CDS (1)..(1356)

SEQ ID NO: 47465 - protein, 451 aa, Coxiella burnetii; identical to SEQ ID NO: 28928

SEQ ID NO: 47466 - DNA, 1368 bp, Enterobacter cloacae; identical to SEQ ID NO: 28929
  CDS (1)..(1368)

SEQ ID NO: 47467 - protein, 455 aa, Enterobacter cloacae; identical to SEQ ID NO: 28930

SEQ ID NO: 47468 - DNA, 1545 bp, Xylella fastidiosa; identical to SEQ ID NO: 28931
  CDS (1)..(1545)

SEQ ID NO: 47469 - protein, 514 aa, Xylella fastidiosa; identical to SEQ ID NO: 28932

SEQ ID NO: 47470 - DNA, 1377 bp, Xylella fastidiosa; identical to SEQ ID NO: 28933
  CDS (1)..(1377)

SEQ ID NO: 47471 - protein, 458 aa, Xylella fastidiosa; identical to SEQ ID NO: 28934

SEQ ID NO: 47472 - DNA, 1368 bp, Vibrio parahaemolyticus; identical to SEQ ID NO: 28935
  CDS (1)..(1368)

SEQ ID NO: 47473 - protein, 455 aa, Vibrio parahaemolyticus; identical to SEQ ID NO: 28936

SEQ ID NO: 47474 - DNA, 1161 bp, Pseudomonas syringae; identical to SEQ ID NO: 28937
  CDS (1)..(1161)

SEQ ID NO: 47475 - protein, 386 aa, Pseudomonas syringae; identical to SEQ ID NO: 28938

SEQ ID NO: 47476 - DNA, 1440 bp, Pseudomonas syringae; identical to SEQ ID NO: 28939
  CDS (1)..(1440)

SEQ ID NO: 47477 - protein, 479 aa, Pseudomonas syringae; identical to SEQ ID NO: 28940

SEQ ID NO: 47478 - DNA, 1479 bp, Pseudomonas putida; identical to SEQ ID NO: 28941
  CDS (1)..(1479)

SEQ ID NO: 47479 - protein, 492 aa, Pseudomonas putida; identical to SEQ ID NO: 28942

SEQ ID NO: 47480 - DNA, 1524 bp, Bradyrhizobium japonicum; identical to SEQ ID NO: 28943
  CDS (1)..(1524)

SEQ ID NO: 47481 - protein, 507 aa, Bradyrhizobium japonicum; identical to SEQ ID NO: 28944

SEQ ID NO: 47482 - DNA, 1272 bp, Bradyrhizobium japonicum; identical to SEQ ID NO: 28945
  CDS (1)..(1272)

SEQ ID NO: 47483 - protein, 423 aa, Bradyrhizobium japonicum; identical to SEQ ID NO: 28946

SEQ ID NO: 47484 - DNA, 1578 bp, Bradyrhizobium japonicum; identical to SEQ ID NO: 28947
  CDS (1)..(1578)

SEQ ID NO: 47485 - protein, 525 aa, Bradyrhizobium japonicum; identical to SEQ ID NO: 28948

SEQ ID NO: 47486 - DNA, 1587 bp, Bradyrhizobium japonicum; identical to SEQ ID NO: 28949
  CDS (1)..(1587)

SEQ ID NO: 47487 - protein, 528 aa, Bradyrhizobium japonicum; identical to SEQ ID NO: 28950

SEQ ID NO: 47488 - DNA, 1536 bp, Bacteroides thetaiotaomicron; identical to SEQ ID NO: 28951
  CDS (1)..(1536)

SEQ ID NO: 47489 - protein, 511 aa, Bacteroides thetaiotaomicron; identical to SEQ ID NO: 28952

SEQ ID NO: 47490 - DNA, 1410 bp, Escherichia coli O6; identical to SEQ ID NO: 28953
  CDS (1)..(1410)

SEQ ID NO: 47491 - protein, 469 aa, Escherichia coli O6; identical to SEQ ID NO: 28954

SEQ ID NO: 47492 - DNA, 1392 bp, Yersinia pestis; identical to SEQ ID NO: 28955
  CDS (1)..(1392)

SEQ ID NO: 47493 - protein, 463 aa, Yersinia pestis; identical to SEQ ID NO: 28956

SEQ ID NO: 47494 - DNA, 1374 bp, Wigglesworthia glossinidia brevipalpis; identical to SEQ ID NO: 28957
  CDS (1)..(1374)

SEQ ID NO: 47495 - protein, 457 aa, Wigglesworthia glossinidia brevipalpis; identical to SEQ ID NO: 28958

SEQ ID NO: 47496 - DNA, 1128 bp, Synechococcus elongatus; identical to SEQ ID NO: 28959
  CDS (1)..(1128)

SEQ ID NO: 47497 - protein, 375 aa, Synechococcus elongatus; identical to SEQ ID NO: 28960

SEQ ID NO: 47498 - DNA, 1170 bp, Synechococcus elongatus; identical to SEQ ID NO: 28961
  CDS (1)..(1170)

SEQ ID NO: 47499 - protein, 389 aa, Synechococcus elongatus; identical to SEQ ID NO: 28962

SEQ ID NO: 47500 - DNA, 1353 bp, Shewanella oneidensis; identical to SEQ ID NO: 28963
  CDS (1)..(1353)

SEQ ID NO: 47501 - protein, 450 aa, Shewanella oneidensis; identical to SEQ ID NO: 28964

SEQ ID NO: 47502 - DNA, 1518 bp, Chlorobium tepidum; identical to SEQ ID NO: 28965
  CDS (1)..(1518)

SEQ ID NO: 47503 - protein, 505 aa, Chlorobium tepidum; identical to SEQ ID NO: 28966

SEQ ID NO: 47504 - DNA, 1461 bp, Rhizobium etli; identical to SEQ ID NO: 28967
  CDS (1)..(1461)

SEQ ID NO: 47505 - protein, 486 aa, Rhizobium etli; identical to SEQ ID NO: 28968

SEQ ID NO: 47506 - DNA, 1368 bp, Pasteurella piscicida; identical to SEQ ID NO: 28969
  CDS (1)..(1368)

SEQ ID NO: 47507 - protein, 455 aa, Pasteurella piscicida; identical to SEQ ID NO: 28970

SEQ ID NO: 47508 - DNA, 1437 bp, Xanthomonas campestris; identical to SEQ ID NO: 28971
  CDS (1)..(1437)

SEQ ID NO: 47509 - protein, 478 aa, Xanthomonas campestris; identical to SEQ ID NO: 28972

SEQ ID NO: 47510 - DNA, 1437 bp, Xanthomonas axonopodis; identical to SEQ ID NO: 28973
  CDS (1)..(1437)

SEQ ID NO: 47511 - protein, 478 aa, Xanthomonas axonopodis; identical to SEQ ID NO: 28974

SEQ ID NO: 47512 - DNA, 1578 bp, Xanthomonas axonopodis; identical to SEQ ID NO: 28975
  CDS (1)..(1578)

SEQ ID NO: 47513 - protein, 525 aa, Xanthomonas axonopodis; identical to SEQ ID NO: 28976

SEQ ID NO: 47514 - DNA, 2077 bp, Klebsiella pneumoniae; identical to SEQ ID NO: 28977
  CDS (374)..(1807)

SEQ ID NO: 47515 - protein, 477 aa, Klebsiella pneumoniae; identical to SEQ ID NO: 28978

SEQ ID NO: 47516 - DNA, 1536 bp, Xanthomonas campestris; identical to SEQ ID NO: 28979
  CDS (1)..(1536)

SEQ ID NO: 47517 - protein, 511 aa, Xanthomonas campestris; identical to SEQ ID NO: 28980

SEQ ID NO: 47518 - DNA, 1473 bp, Ralstonia solanacearum; identical to SEQ ID NO: 28981
  CDS (1)..(1473)

SEQ ID NO: 47519 - protein, 490 aa, Ralstonia solanacearum; identical to SEQ ID NO: 28982

SEQ ID NO: 47520 - DNA, 1518 bp, Ralstonia solanacearum; identical to SEQ ID NO: 28983
  CDS (1)..(1518)

SEQ ID NO: 47521 - protein, 505 aa, Ralstonia solanacearum; identical to SEQ ID NO: 28984

SEQ ID NO: 47522 - DNA, 1368 bp, Salmonella typhimurium; identical to SEQ ID NO: 28985
  CDS (1)..(1368)

SEQ ID NO: 47523 - protein, 455 aa, Salmonella typhimurium; identical to SEQ ID NO: 28986

SEQ ID NO: 47524 - DNA, 1512 bp, Rhizobium meliloti; identical to SEQ ID NO: 28987
  CDS (1)..(1512)

SEQ ID NO: 47525 - protein, 503 aa, Rhizobium meliloti; identical to SEQ ID NO: 28988

SEQ ID NO: 47526 - DNA, 1398 bp, Rhizobium meliloti; identical to SEQ ID NO: 28989
  CDS (1)..(1398)

SEQ ID NO: 47527 - protein, 465 aa, Rhizobium meliloti; identical to SEQ ID NO: 28990

SEQ ID NO: 47528 - DNA, 1551 bp, Rhizobium loti; identical to SEQ ID NO: 28991
  CDS (1)..(1551)

SEQ ID NO: 47529 - protein, 516 aa, Rhizobium loti; identical to SEQ ID NO: 28992

SEQ ID NO: 47530 - DNA, 1542 bp, Rhizobium loti; identical to SEQ ID NO: 28993
  CDS (1)..(1542)

SEQ ID NO: 47531 - protein, 513 aa, Rhizobium loti; identical to SEQ ID NO: 28994

SEQ ID NO: 47532 - DNA, 1515 bp, Rhizobium loti; identical to SEQ ID NO: 28995
  CDS (1)..(1515)

SEQ ID NO: 47533 - protein, 504 aa, Rhizobium loti; identical to SEQ ID NO: 28996

SEQ ID NO: 47534 - DNA, 1287 bp, Rhizobium loti; identical to SEQ ID NO: 28997
  CDS (1)..(1287)

SEQ ID NO: 47535 - protein, 428 aa, Rhizobium loti; identical to SEQ ID NO: 28998

SEQ ID NO: 47536 - DNA, 1446 bp, Pseudomonas syringae; identical to SEQ ID NO: 28999
  CDS (1)..(1446)

SEQ ID NO: 47537 - protein, 481 aa, Pseudomonas syringae; identical to SEQ ID NO: 29000

SEQ ID NO: 47538 - DNA, 1380 bp, Pasteurella multocida; identical to SEQ ID NO: 29001
  CDS (1)..(1380)

SEQ ID NO: 47539 - protein, 459 aa, Pasteurella multocida; identical to SEQ ID NO: 29002

SEQ ID NO: 47540 - DNA, 1362 bp, Aeromonas hydrophila; identical to SEQ ID NO: 29003
  CDS (1)..(1362)

SEQ ID NO: 47541 - protein, 453 aa, Aeromonas hydrophila; identical to SEQ ID NO: 29004

SEQ ID NO: 47542 - DNA, 1503 bp, Myxococcus xanthus; identical to SEQ ID NO: 29005
  CDS (1)..(1503)

SEQ ID NO: 47543 - protein, 500 aa, Myxococcus xanthus; identical to SEQ ID NO: 29006

SEQ ID NO: 47544 - DNA, 1476 bp, Shigella sonnei; identical to SEQ ID NO: 29007
  CDS (1)..(1476)

SEQ ID NO: 47545 - protein, 491 aa, Shigella sonnei; identical to SEQ ID NO: 29008

SEQ ID NO: 47546 - DNA, 1512 bp, Bartonella henselae; identical to SEQ ID NO: 29009
  CDS (1)..(1512)

SEQ ID NO: 47547 - protein, 503 aa, Bartonella henselae; identical to SEQ ID NO: 29010

SEQ ID NO: 47548 - DNA, 1437 bp, Buchnera aphidicola; identical to SEQ ID NO: 29011
  CDS (1)..(1437)

SEQ ID NO: 47549 - protein, 478 aa, Buchnera aphidicola; identical to SEQ ID NO: 29012

SEQ ID NO: 47550 - DNA, 1515 bp, Rhizobium meliloti; identical to SEQ ID NO: 29013
  CDS (1)..(1515)

SEQ ID NO: 47551 - protein, 504 aa, Rhizobium meliloti; identical to SEQ ID NO: 29014

SEQ ID NO: 47552 - DNA, 1377 bp, Bacillus subtilis; identical to SEQ ID NO: 29015
  CDS (1)..(1377)

SEQ ID NO: 47553 - protein, 458 aa, Bacillus subtilis; identical to SEQ ID NO: 29016

SEQ ID NO: 47554 - DNA, 24 bp, Primer
atgaaaaaaaccacattagcactg

SEQ ID NO: 47555 - DNA, 25 bp, Primer
ttactgcattaacaggtagatggtg

SEQ ID NO: 47556 - protein, 406 aa, consensus; identical to SEQ ID NO: 29019
  MISC_FEATURE (1)..(406): consensus for the disclosure of xaa see table XV

SEQ ID NO: 47557 - protein, 66 aa, consensus; identical to SEQ ID NO: 29020
  MISC_FEATURE (1)..(66): consensus for the disclosure of xaa see table XV

SEQ ID NO: 47558 - protein, 37 aa, consensus; identical to SEQ ID NO: 29021
  MISC_FEATURE (1)..(37): consensus for the disclosure of xaa see table XV

SEQ ID NO: 47559 - protein, 30 aa, consensus; identical to SEQ ID NO: 29022
  MISC_FEATURE (1)..(30): consensus for the disclosure of xaa see table XV

SEQ ID NO: 47560 - protein, 34 aa, consensus; identical to SEQ ID NO: 29023
  MISC_FEATURE (1)..(34): consensus for the disclosure of xaa see table XV

SEQ ID NO: 47561 - protein, 68 aa, consensus; identical to SEQ ID NO: 29024
  MISC_FEATURE (1)..(68): consensus for the disclosure of xaa see table XV

SEQ ID NO: 47562 - DNA, 2200 bp, Escherichia coli K12; identical to SEQ ID NO: 17198
  CDS (776)..(2200)

SEQ ID NO: 47563 - protein, 474 aa, Escherichia coli K12; identical to SEQ ID NO: 17199

SEQ ID NO: 47564 - DNA, 3053 bp, Arabidopsis thaliana (mouse-ear cress); identical to SEQ ID NO: 17200
  CDS (1)..(2556)

SEQ ID NO: 47565 - protein, 851 aa, Arabidopsis thaliana (mouse-ear cress); identical to SEQ ID NO: 17201

SEQ ID NO: 47566 - DNA, 1422 bp, Salmonella enterica subsp. enterica serovar Typhi; identical to SEQ ID NO: 17202
  CDS (1)..(1422)

SEQ ID NO: 47567 - protein, 473 aa, Salmonella enterica subsp. enterica serovar Typhi; identical to SEQ ID NO: 17203

SEQ ID NO: 47568 - DNA, 1497 bp, Mycobacterium leprae; identical to SEQ ID NO: 17204
  CDS (1)..(1497)

SEQ ID NO: 47569 - protein, 498 aa, Mycobacterium leprae; identical to SEQ ID NO: 17205

SEQ ID NO: 47570 - DNA, 2829 bp, Arabidopsis thaliana (mouse-ear cress); identical to SEQ ID NO: 17206
  CDS (1)..(2829)

SEQ ID NO: 47571 - protein, 942 aa, Arabidopsis thaliana (mouse-ear cress); identical to SEQ ID NO: 17207

SEQ ID NO: 47572 - DNA, 1491 bp, Methanobacterium thermoautotrophicum; identical to SEQ ID NO: 17208
  CDS (1)..(1491)

SEQ ID NO: 47573 - protein, 496 aa, Methanobacterium thermoautotrophicum; identical to SEQ ID NO: 17209

SEQ ID NO: 47574 - DNA, 1392 bp, Sinorhizobium meliloti; identical to SEQ ID NO: 17210
  CDS (1)..(1392)

SEQ ID NO: 47575 - protein, 463 aa, Sinorhizobium meliloti; identical to SEQ ID NO: 17211

SEQ ID NO: 47576 - DNA, 1503 bp, Mycobacterium tuberculosis; identical to SEQ ID NO: 17212
  CDS (1)..(1503)

SEQ ID NO: 47577 - protein, 500 aa, Mycobacterium tuberculosis; identical to SEQ ID NO: 17213

SEQ ID NO: 47578 - DNA, 2091 bp, Saccharomyces cerevisiae; identical to SEQ ID NO: 17214
  CDS (233)..(1720)

SEQ ID NO: 47579 - protein, 495 aa, Saccharomyces cerevisiae; identical to SEQ ID NO: 17215

SEQ ID NO: 47580 - DNA, 5981 bp, Saccharomyces cerevisiae; identical to SEQ ID NO: 17216
  CDS (2282)..(5578)

SEQ ID NO: 47581 - protein, 1098 aa, Saccharomyces cerevisiae; identical to SEQ ID NO: 17217

SEQ ID NO: 47582 - DNA, 2358 bp, Kluyveromyces marxianus var. lactis, Candida sphaerica; identical to SEQ ID NO: 17218
  CDS (722)..(2188)

SEQ ID NO: 47583 - protein, 488 aa, Kluyveromyces marxianus var. lactis, Candida sphaerica; identical to SEQ ID NO: 17219

SEQ ID NO: 47584 - DNA, 3170 bp, Saccharomyces cerevisiae; identical to SEQ ID NO: 17220
  CDS (147)..(2837)

SEQ ID NO: 47585 - protein, 896 aa, Saccharomyces cerevisiae; identical to SEQ ID NO: 17221

SEQ ID NO: 47586 - DNA, 1500 bp, Synechocystis sp; identical to SEQ ID NO: 17222
  CDS (1)..(1500)

SEQ ID NO: 47587 - protein, 499 aa, Synechocystis sp; identical to SEQ ID NO: 17223

SEQ ID NO: 47588 - DNA, 2586 bp, Arabidopsis thaliana (mouse-ear cress); identical to SEQ ID NO: 17224
  CDS (1)..(2586)

SEQ ID NO: 47589 - protein, 861 aa, Arabidopsis thaliana (mouse-ear cress); identical to SEQ ID NO: 17225

SEQ ID NO: 47590 - DNA, 2388 bp, Arabidopsis thaliana (mouse-ear cress); identical to SEQ ID NO: 17226
  CDS (1)..(2388)

SEQ ID NO: 47591 - protein, 795 aa, Arabidopsis thaliana (mouse-ear cress); identical to SEQ ID NO: 17227

SEQ ID NO: 47592 - DNA, 2676 bp, Schizosaccharomyces pombe; identical to SEQ ID NO: 17228
  CDS (1)..(2676)

SEQ ID NO: 47593 - protein, 891 aa, Schizosaccharomyces pombe; identical to SEQ ID NO: 17229

SEQ ID NO: 47594 - DNA, 2550 bp, Schizosaccharomyces pombe; identical to SEQ ID NO: 17230
  CDS (1)..(2550)

SEQ ID NO: 47595 - protein, 849 aa, Schizosaccharomyces pombe; identical to SEQ ID NO: 17231

SEQ ID NO: 47596 - DNA, 2835 bp, Schizosaccharomyces pombe; identical to SEQ ID NO: 17232
  CDS (1)..(2835)

SEQ ID NO: 47597 - protein, 944 aa, Schizosaccharomyces pombe; identical to SEQ ID NO: 17233

SEQ ID NO: 47598 - DNA, 2580 bp, Schizosaccharomyces pombe; identical to SEQ ID NO: 17234
  CDS (52)..(2505)

SEQ ID NO: 47599 - protein, 817 aa, Schizosaccharomyces pombe; identical to SEQ ID NO: 17235

SEQ ID NO: 47600 - DNA, 1993 bp, Schizosaccharomyces pombe; identical to SEQ ID NO: 17236
  CDS (266)..(1705)

SEQ ID NO: 47601 - protein, 479 aa, Schizosaccharomyces pombe; identical to SEQ ID NO: 17237

SEQ ID NO: 47602 - DNA, 2621 bp, unidentified; identical to SEQ ID NO: 17238
  CDS (25)..(2487)

SEQ ID NO: 47603 - protein, 820 aa, unidentified; identical to SEQ ID NO: 17239

SEQ ID NO: 47604 - DNA, 2640 bp, Helianthus annuus; identical to SEQ ID NO: 17240
  CDS (171)..(2510)

SEQ ID NO: 47605 - protein, 779 aa, Helianthus annuus; identical to SEQ ID NO: 17241

SEQ ID NO: 47606 - DNA, 1913 bp, Selaginella lepidophylla; identical to SEQ ID NO: 17242
  CDS (111)..(1913)

SEQ ID NO: 47607 - protein, 600 aa, Selaginella lepidophylla; identical to SEQ ID NO: 17243

SEQ ID NO: 47608 - DNA, 4351 bp, Caenorhabditis elegans; identical to SEQ ID NO: 17244
  CDS (112)..(3996)

SEQ ID NO: 47609 - protein, 1294 aa, Caenorhabditis elegans; identical to SEQ ID NO: 17245

SEQ ID NO: 47610 - DNA, 2637 bp, Debaryomyces hansenii; identical to SEQ ID NO: 17246
  CDS (1)..(2637)

SEQ ID NO: 47611 - protein, 878 aa, Debaryomyces hansenii; identical to SEQ ID NO: 17247

SEQ ID NO: 47612 - DNA, 1443 bp, Debaryomyces hansenii; identical to SEQ ID NO: 17248
  CDS (1)..(1443)

SEQ ID NO: 47613 - protein, 480 aa, Debaryomyces hansenii; identical to SEQ ID NO: 17249

SEQ ID NO: 47614 - DNA, 2403 bp, Yarrowia lipolytica; identical to SEQ ID NO: 17250
  CDS (1)..(2403)

SEQ ID NO: 47615 - protein, 800 aa, Yarrowia lipolytica; identical to SEQ ID NO: 17251

SEQ ID NO: 47616 - DNA, 3447 bp, Kluyveromyces lactis; identical to SEQ ID NO: 17252
  CDS (1)..(3447)

SEQ ID NO: 47617 - protein, 1148 aa, Kluyveromyces lactis; identical to SEQ ID NO: 17253

SEQ ID NO: 47618 - DNA, 2631 bp, Kluyveromyces lactis; identical to SEQ ID NO: 17254
  CDS (1)..(2631)

SEQ ID NO: 47619 - protein, 876 aa, Kluyveromyces lactis; identical to SEQ ID NO: 17255

SEQ ID NO: 47620 - DNA, 1437 bp, Acinetobacter sp; identical to SEQ ID NO: 17256
  CDS (1)..(1437)

SEQ ID NO: 47621 - protein, 478 aa, Acinetobacter sp; identical to SEQ ID NO: 17257

SEQ ID NO: 47622 - DNA, 1476 bp, Candida glabrata; identical to SEQ ID NO: 17258
  CDS (1)..(1476)

SEQ ID NO: 47623 - protein, 491 aa, Candida glabrata; identical to SEQ ID NO: 17259

SEQ ID NO: 47624 - DNA, 3198 bp, Candida glabrata; identical to SEQ ID NO: 17260
  CDS (1)..(3198)

SEQ ID NO: 47625 - protein, 1065 aa, Candida glabrata; identical to SEQ ID NO: 17261

SEQ ID NO: 47626 - DNA, 3345 bp, Candida glabrata; identical to SEQ ID NO: 17262
  CDS (1)..(3345)

SEQ ID NO: 47627 - protein, 1114 aa, Candida glabrata; identical to SEQ ID NO: 17263

SEQ ID NO: 47628 - DNA, 2673 bp, Candida glabrata; identical to SEQ ID NO: 17264
  CDS (1)..(2673)

SEQ ID NO: 47629 - protein, 890 aa, Candida glabrata; identical to SEQ ID NO: 17265

SEQ ID NO: 47630 - DNA, 2013 bp, Cryptococcus neoformans var; identical to SEQ ID NO: 17266
  CDS (1)..(2013)

SEQ ID NO: 47631 - protein, 670 aa, Cryptococcus neoformans var; identical to SEQ ID NO: 17267

SEQ ID NO: 47632 - DNA, 1302 bp, Picrophilus torridus; identical to SEQ ID NO: 17268
  CDS (1)..(1302)

SEQ ID NO: 47633 - protein, 433 aa, Picrophilus torridus; identical to SEQ ID NO: 17269

SEQ ID NO: 47634 - DNA, 1482 bp, Rhodopseudomonas palustris; identical to SEQ ID NO: 17270
  CDS (1)..(1482)

SEQ ID NO: 47635 - protein, 493 aa, Rhodopseudomonas palustris; identical to SEQ ID NO: 17271

SEQ ID NO: 47636 - DNA, 1440 bp, Corynebacterium diphtheriae; identical to SEQ ID NO: 17272
  CDS (1)..(1440)

SEQ ID NO: 47637 - protein, 479 aa, Corynebacterium diphtheriae; identical to SEQ ID NO: 17273

SEQ ID NO: 47638 - DNA, 2589 bp, Oryza sativa; identical to SEQ ID NO: 17274
  CDS (1)..(2589)

SEQ ID NO: 47639 - protein, 862 aa, Oryza sativa; identical to SEQ ID NO: 17275

SEQ ID NO: 47640 - DNA, 2812 bp, Oryza sativa; identical to SEQ ID NO: 17276
  CDS (53)..(2527)

SEQ ID NO: 47641 - protein, 824 aa, Oryza sativa; identical to SEQ ID NO: 17277

SEQ ID NO: 47642 - DNA, 2208 bp, Thermoproteus tenax; identical to SEQ ID NO: 17278
  CDS (1)..(2208)

SEQ ID NO: 47643 - protein, 735 aa, Thermoproteus tenax; identical to SEQ ID NO: 17279

SEQ ID NO: 47644 - DNA, 1479 bp, Mycobacterium paratuberculosis; identical to SEQ ID NO: 17280
  CDS (1)..(1479)

SEQ ID NO: 47645 - protein, 492 aa, Mycobacterium paratuberculosis; identical to SEQ ID NO: 17281

SEQ ID NO: 47646 - DNA, 1461 bp, Geobacter sulfurreducens; identical to SEQ ID NO: 17282
  CDS (1)..(1461)

SEQ ID NO: 47647 - protein, 486 aa, Geobacter sulfurreducens; identical to SEQ ID NO: 17283

SEQ ID NO: 47648 - DNA, 3333 bp, Ashbya gossypii; identical to SEQ ID NO: 17284
  CDS (1)..(3333)

SEQ ID NO: 47649 - protein, 1110 aa, Ashbya gossypii; identical to SEQ ID NO: 17285

SEQ ID NO: 47650 - DNA, 1485 bp, Ashbya gossypii; identical to SEQ ID NO: 17286
  CDS (1)..(1485)

SEQ ID NO: 47651 - protein, 494 aa, Ashbya gossypii; identical to SEQ ID NO: 17287

SEQ ID NO: 47652 - DNA, 3498 bp, Oryza sativa; identical to SEQ ID NO: 17288
  CDS (176)..(2875)

SEQ ID NO: 47653 - protein, 899 aa, Oryza sativa; identical to SEQ ID NO: 17289

SEQ ID NO: 47654 - DNA, 3048 bp, Neurospora crassa; identical to SEQ ID NO: 17290
  CDS (1)..(3048)

SEQ ID NO: 47655 - protein, 1015 aa, Neurospora crassa; identical to SEQ ID NO: 17291

SEQ ID NO: 47656 - DNA, 1572 bp, Neurospora crassa; identical to SEQ ID NO: 17292
  CDS (1)..(1572)

SEQ ID NO: 47657 - protein, 523 aa, Neurospora crassa; identical to SEQ ID NO: 17293

SEQ ID NO: 47658 - DNA, 2730 bp, Neurospora crassa; identical to SEQ ID NO: 17294
  CDS (1)..(2730)

SEQ ID NO: 47659 - protein, 909 aa, Neurospora crassa; identical to SEQ ID NO: 17295

SEQ ID NO: 47660 - DNA, 1488 bp, Synechococcus sp; identical to SEQ ID NO: 17296
  CDS (1)..(1488)

SEQ ID NO: 47661 - protein, 495 aa, Synechococcus sp; identical to SEQ ID NO: 17297

SEQ ID NO: 47662 - DNA, 1350 bp, Thermus thermophilus; identical to SEQ ID NO: 17298
  CDS (1)..(1350)

SEQ ID NO: 47663 - protein, 449 aa, Thermus thermophilus; identical to SEQ ID NO: 17299

SEQ ID NO: 47664 - DNA, 3862 bp, Caenorhabditis elegans; identical to SEQ ID NO: 17300
  CDS (30)..(3722)

SEQ ID NO: 47665 - protein, 1230 aa, Caenorhabditis elegans; identical to SEQ ID NO: 17301

SEQ ID NO: 47666 - DNA, 1590 bp, Magnaporthe grisea; identical to SEQ ID NO: 17302
  CDS (1)..(1590)

SEQ ID NO: 47667 - protein, 529 aa, Magnaporthe grisea; identical to SEQ ID NO: 17303

SEQ ID NO: 47668 - DNA, 1485 bp, Bradyrhizobium japonicum; identical to SEQ ID NO: 17304
  CDS (1)..(1485)

SEQ ID NO: 47669 - protein, 494 aa, Bradyrhizobium japonicum; identical to SEQ ID NO: 17305

SEQ ID NO: 47670 - DNA, 1449 bp, Corynebacterium efficiens; identical to SEQ ID NO: 17306
  CDS (1)..(1449)

SEQ ID NO: 47671 - protein, 482 aa, Corynebacterium efficiens; identical to SEQ ID NO: 17307

SEQ ID NO: 47672 - DNA, 2774 bp, Arabidopsis thaliana; identical to SEQ ID NO: 17308
  CDS (102)..(2690)

SEQ ID NO: 47673 - protein, 862 aa, Arabidopsis thaliana; identical to SEQ ID NO: 17309

SEQ ID NO: 47674 - DNA, 2583 bp, Oryza sativa; identical to SEQ ID NO: 17310
  CDS (1)..(2583)

SEQ ID NO: 47675 - protein, 860 aa, Oryza sativa; identical to SEQ ID NO: 17311

SEQ ID NO: 47676 - DNA, 1458 bp, Corynebacterium glutamicum; identical to SEQ ID NO: 17312
  CDS (1)..(1458)

SEQ ID NO: 47677 - protein, 485 aa, Corynebacterium glutamicum; identical to SEQ ID NO: 17313

SEQ ID NO: 47678 - DNA, 2358 bp, Xanthomonas campestris; identical to SEQ ID NO: 17314
  CDS (1)..(2358)

SEQ ID NO: 47679 - protein, 785 aa, Xanthomonas campestris; identical to SEQ ID NO: 17315

SEQ ID NO: 47680 - DNA, 1368 bp, Xanthomonas axonopodis; identical to SEQ ID NO: 17316
  CDS (1)..(1368)

SEQ ID NO: 47681 - protein, 455 aa, Xanthomonas axonopodis; identical to SEQ ID NO: 17317

SEQ ID NO: 47682 - DNA, 2574 bp, Solanum tuberosum; identical to SEQ ID NO: 17318
  CDS (1)..(2574)

SEQ ID NO: 47683 - protein, 857 aa, Solanum tuberosum; identical to SEQ ID NO: 17319

SEQ ID NO: 47684 - DNA, 1380 bp, Encephalitozoon cuniculi; identical to SEQ ID NO: 17320
  CDS (1)..(1380)

SEQ ID NO: 47685 - protein, 459 aa, Encephalitozoon cuniculi; identical to SEQ ID NO: 17321

SEQ ID NO: 47686 - DNA, 1398 bp, Ralstonia solanacearum; identical to SEQ ID NO: 17322
  CDS (1)..(1398)

SEQ ID NO: 47687 - protein, 465 aa, Ralstonia solanacearum; identical to SEQ ID NO: 17323

SEQ ID NO: 47688 - DNA, 1674 bp, Ralstonia solanacearum; identical to SEQ ID NO: 17324
  CDS (1)..(1674)

SEQ ID NO: 47689 - protein, 557 aa, Ralstonia solanacearum; identical to SEQ ID NO: 17325

SEQ ID NO: 47690 - DNA, 2214 bp, Pyrobaculum aerophilum; identical to SEQ ID NO: 17326
  CDS (1)..(2214)

SEQ ID NO: 47691 - protein, 737 aa, Pyrobaculum aerophilum; identical to SEQ ID NO: 17327

SEQ ID NO: 47692 - DNA, 3001 bp, Arabidopsis thaliana; identical to SEQ ID NO: 17328
  CDS (204)..(2306)

SEQ ID NO: 47693 - protein, 700 aa, Arabidopsis thaliana; identical to SEQ ID NO: 17329

SEQ ID NO: 47694 - DNA, 3272 bp, Oryza sativa; identical to SEQ ID NO: 17330
  CDS (247)..(2985)

SEQ ID NO: 47695 - protein, 912 aa, Oryza sativa; identical to SEQ ID NO: 17331

SEQ ID NO: 47696 - DNA, 1681 bp, Amanita muscaria; identical to SEQ ID NO: 17332
  CDS (101)..(1552)

SEQ ID NO: 47697 - protein, 483 aa, Amanita muscaria; identical to SEQ ID NO: 17333

SEQ ID NO: 47698 - DNA, 1344 bp, Thermoplasma volcanium; identical to SEQ ID NO: 17334
  CDS (1)..(1344)

SEQ ID NO: 47699 - protein, 447 aa, Thermoplasma volcanium; identical to SEQ ID NO: 17335

SEQ ID NO: 47700 - DNA, 1563 bp, Rhizobium loti; identical to SEQ ID NO: 17336
  CDS (1)..(1563)

SEQ ID NO: 47701 - protein, 520 aa, Rhizobium loti; identical to SEQ ID NO: 17337

SEQ ID NO: 47702 - DNA, 2637 bp, Oryza sativa; identical to SEQ ID NO: 17338
  CDS (1)..(2637)

SEQ ID NO: 47703 - protein, 878 aa, Oryza sativa; identical to SEQ ID NO: 17339

SEQ ID NO: 47704 - DNA, 1326 bp, Thermoplasma acidophilum; identical to SEQ ID NO: 17340
  CDS (1)..(1326)

SEQ ID NO: 47705 - protein, 441 aa, Thermoplasma acidophilum; identical to SEQ ID NO: 17341

SEQ ID NO: 47706 - DNA, 1389 bp, Streptomyces coelicolor; identical to SEQ ID NO: 17342
  CDS (1)..(1389)

SEQ ID NO: 47707 - protein, 462 aa, Streptomyces coelicolor; identical to SEQ ID NO: 17343

SEQ ID NO: 47708 - DNA, 2635 bp, Arabidopsis thaliana; identical to SEQ ID NO: 17344
  CDS (1)..(2604)

SEQ ID NO: 47709 - protein, 867 aa, Arabidopsis thaliana; identical to SEQ ID NO: 17345

SEQ ID NO: 47710 - DNA, 2843 bp, Zygosaccharomyces rouxii; identical to SEQ ID NO: 17346
  CDS (24)..(2726)

SEQ ID NO: 47711 - protein, 900 aa, Zygosaccharomyces rouxii; identical to SEQ ID NO: 17347

SEQ ID NO: 47712 - DNA, 3197 bp, Drosophila melanogaster; identical to SEQ ID NO: 17348
  CDS (662)..(3091)

SEQ ID NO: 47713 - protein, 809 aa, Drosophila melanogaster; identical to SEQ ID NO: 17349

SEQ ID NO: 47714 - DNA, 1503 bp, Pseudomonas anguilliseptica; identical to SEQ ID NO: 17350
  CDS (1)..(1503)

SEQ ID NO: 47715 - protein, 500 aa, Pseudomonas anguilliseptica; identical to SEQ ID NO: 17351

SEQ ID NO: 47716 - DNA, 1503 bp, Synechococcus sp; identical to SEQ ID NO: 17352
  CDS (1)..(1503)

SEQ ID NO: 47717 - protein, 500 aa, Synechococcus sp; identical to SEQ ID NO: 17353

SEQ ID NO: 47718 - DNA, 1395 bp, Rhizobium sp; identical to SEQ ID NO: 17354
  CDS (1)..(1395)

SEQ ID NO: 47719 - protein, 464 aa, Rhizobium sp; identical to SEQ ID NO: 17355

SEQ ID NO: 47720 - DNA, 1437 bp, Candida albicans; identical to SEQ ID NO: 17356
  CDS (1)..(1437)

SEQ ID NO: 47721 - protein, 478 aa, Candida albicans; identical to SEQ ID NO: 17357

SEQ ID NO: 47722 - DNA, 1515 bp, Emericella nidulans; identical to SEQ ID NO: 17358
  CDS (1)..(1515)

SEQ ID NO: 47723 - protein, 504 aa, Emericella nidulans; identical to SEQ ID NO: 17359

SEQ ID NO: 47724 - DNA, 2695 bp, Pichia angusta; identical to SEQ ID NO: 17360
  CDS (793)..(2220)

SEQ ID NO: 47725 - protein, 475 aa, Pichia angusta; identical to SEQ ID NO: 17361

SEQ ID NO: 47726 - DNA, 1542 bp, Schizosaccharomyces pombe; identical to SEQ ID NO: 17362
  CDS (1)..(1542)

SEQ ID NO: 47727 - protein, 513 aa, Schizosaccharomyces pombe; identical to SEQ ID NO: 17363

SEQ ID NO: 47728 - DNA, 1520 bp, Yarrowia lipolytica; identical to SEQ ID NO: 17364
  CDS (27)..(1436)

SEQ ID NO: 47729 - protein, 469 aa, Yarrowia lipolytica; identical to SEQ ID NO: 17365

SEQ ID NO: 47730 - DNA, 1645 bp, Zygosaccharomyces rouxii; identical to SEQ ID NO: 17366
  CDS (77)..(1534)

SEQ ID NO: 47731 - protein, 485 aa, Zygosaccharomyces rouxii; identical to SEQ ID NO: 17367

SEQ ID NO: 47732 - DNA, 3069 bp, Saccharomyces cerevisiae; identical to SEQ ID NO: 17368
  CDS (1)..(3069)

SEQ ID NO: 47733 - protein, 1022 aa, Saccharomyces cerevisiae; identical to SEQ ID NO: 17369

SEQ ID NO: 47734 - DNA, 1554 bp, Aspergillus niger; identical to SEQ ID NO: 17370
  CDS (1)..(1554)

SEQ ID NO: 47735 - protein, 517 aa, Aspergillus niger; identical to SEQ ID NO: 17371

SEQ ID NO: 47736 - DNA, 25 bp, Primer
atgagtcgtttagtcgtagtatcta

SEQ ID NO: 47737 - DNA, 24 bp, Primer
ttacgcaagctttggaaaggtagc

SEQ ID NO: 47738 - protein, 98 aa, consensus; identical to SEQ ID NO: 18676
  MISC_FEATURE (1)..(98): consensus for the disclosure of xaa see table XV

SEQ ID NO: 47739 - protein, 47 aa, consensus; identical to SEQ ID NO: 18677
  MISC_FEATURE (1)..(47): consensus for the disclosure of xaa see table XV

SEQ ID NO: 47740 - protein, 117 aa, consensus; identical to SEQ ID NO: 18678
  MISC_FEATURE (1)..(117): consensus for the disclosure of xaa see table XV

SEQ ID NO: 47741 - protein, 75 aa, consensus; identical to SEQ ID NO: 18679
  MISC_FEATURE (1)..(75): consensus for the disclosure of xaa see table XV

SEQ ID NO: 47742 - DNA, 927 bp, Escherichia coli K12; identical to SEQ ID NO: 27377
  CDS (1)..(927)

SEQ ID NO: 47743 - protein, 308 aa, Escherichia coli K12; identical to SEQ ID NO: 27378

SEQ ID NO: 47744 - DNA, 1017 bp, Archaeoglobus fulgidus; identical to SEQ ID NO: 27379
  CDS (1)..(1017)

SEQ ID NO: 47745 - protein, 338 aa, Archaeoglobus fulgidus; identical to SEQ ID NO: 27380

SEQ ID NO: 47746 - DNA, 894 bp, Archaeoglobus fulgidus; identical to SEQ ID NO: 27381
  CDS (1)..(894)

SEQ ID NO: 47747 - protein, 297 aa, Archaeoglobus fulgidus; identical to SEQ ID NO: 27382

SEQ ID NO: 47748 - DNA, 1278 bp, Pseudomonas aeruginosa; identical to SEQ ID NO: 27383
  CDS (1)..(1278)

SEQ ID NO: 47749 - protein, 425 aa, Pseudomonas aeruginosa; identical to SEQ ID NO: 27384

SEQ ID NO: 47750 - DNA, 957 bp, Streptococcus pneumoniae; identical to SEQ ID NO: 27385
  CDS (1)..(957)

SEQ ID NO: 47751 - protein, 318 aa, Streptococcus pneumoniae; identical to SEQ ID NO: 27386

SEQ ID NO: 47752 - DNA, 999 bp, Brucella melitensis; identical to SEQ ID NO: 27387
  CDS (1)..(999)

SEQ ID NO: 47753 - protein, 332 aa, Brucella melitensis; identical to SEQ ID NO: 27388

SEQ ID NO: 47754 - DNA, 942 bp, Agrobacterium tumefaciens; identical to SEQ ID NO: 27389
  CDS (1)..(942)

SEQ ID NO: 47755 - protein, 313 aa, Agrobacterium tumefaciens; identical to SEQ ID NO: 27390

SEQ ID NO: 47756 - DNA, 897 bp, Agrobacterium tumefaciens; identical to SEQ ID NO: 27391
  CDS (1)..(897)

SEQ ID NO: 47757 - protein, 298 aa, Agrobacterium tumefaciens; identical to SEQ ID NO: 27392

SEQ ID NO: 47758 - DNA, 1035 bp, Agrobacterium tumefaciens; identical to SEQ ID NO: 27393
  CDS (1)..(1035)

SEQ ID NO: 47759 - protein, 344 aa, Agrobacterium tumefaciens; identical to SEQ ID NO: 27394

SEQ ID NO: 47760 - DNA, 864 bp, Brucella melitensis; identical to SEQ ID NO: 27395
  CDS (1)..(864)

SEQ ID NO: 47761 - protein, 287 aa, Brucella melitensis; identical to SEQ ID NO: 27396

SEQ ID NO: 47762 - DNA, 924 bp, Brucella melitensis; identical to SEQ ID NO: 27397
  CDS (1)..(924)

SEQ ID NO: 47763 - protein, 307 aa, Brucella melitensis; identical to SEQ ID NO: 27398

SEQ ID NO: 47764 - DNA, 927 bp, Yersinia pestis; identical to SEQ ID NO: 27399
  CDS (1)..(927)

SEQ ID NO: 47765 - protein, 308 aa, Yersinia pestis; identical to SEQ ID NO: 27400

SEQ ID NO: 47766 - DNA, 867 bp, Nostoc sp. PCC 7120; identical to SEQ ID NO: 27401
  CDS (1)..(867)

SEQ ID NO: 47767 - protein, 288 aa, Nostoc sp. PCC 7120; identical to SEQ ID NO: 27402

SEQ ID NO: 47768 - DNA, 951 bp, Nostoc sp. PCC 7120; identical to SEQ ID NO: 27403
  CDS (1)..(951)

SEQ ID NO: 47769 - protein, 316 aa, Nostoc sp. PCC 7120; identical to SEQ ID NO: 27404

SEQ ID NO: 47770 - DNA, 903 bp, Agrobacterium tumefaciens; identical to SEQ ID NO: 27405
  CDS (1)..(903)

SEQ ID NO: 47771 - protein, 300 aa, Agrobacterium tumefaciens; identical to SEQ ID NO: 27406

SEQ ID NO: 47772 - DNA, 924 bp, Pseudomonas aeruginosa; identical to SEQ ID NO: 27407
  CDS (1)..(924)

SEQ ID NO: 47773 - protein, 307 aa, Pseudomonas aeruginosa; identical to SEQ ID NO: 27408

SEQ ID NO: 47774 - DNA, 798 bp, Aeropyrum pernix; identical to SEQ ID NO: 27409
  CDS (1)..(798)

SEQ ID NO: 47775 - protein, 265 aa, Aeropyrum pernix; identical to SEQ ID NO: 27410

SEQ ID NO: 47776 - DNA, 885 bp, Aeropyrum pernix; identical to SEQ ID NO: 27411
  CDS (1)..(885)

SEQ ID NO: 47777 - protein, 294 aa, Aeropyrum pernix; identical to SEQ ID NO: 27412

SEQ ID NO: 47778 - DNA, 1065 bp, Aeropyrum pernix; identical to SEQ ID NO: 27413
  CDS (1)..(1065)

SEQ ID NO: 47779 - protein, 354 aa, Aeropyrum pernix; identical to SEQ ID NO: 27414

SEQ ID NO: 47780 - DNA, 1047 bp, Deinococcus radiodurans; identical to SEQ ID NO: 27415
  CDS (1)..(1047)

SEQ ID NO: 47781 - protein, 348 aa, Deinococcus radiodurans; identical to SEQ ID NO: 27416

SEQ ID NO: 47782 - DNA, 918 bp, Pseudomonas aeruginosa; identical to SEQ ID NO: 27417
  CDS (4)..(918)

SEQ ID NO: 47783 - protein, 304 aa, Pseudomonas aeruginosa; identical to SEQ ID NO: 27418

SEQ ID NO: 47784 - DNA, 954 bp, Pseudomonas aeruginosa; identical to SEQ ID NO: 27419
  CDS (1)..(954)

SEQ ID NO: 47785 - protein, 317 aa, Pseudomonas aeruginosa; identical to SEQ ID NO: 27420

SEQ ID NO: 47786 - DNA, 894 bp, Bacillus halodurans; identical to SEQ ID NO: 27421
  CDS (1)..(894)

SEQ ID NO: 47787 - protein, 297 aa, Bacillus halodurans; identical to SEQ ID NO: 27422

SEQ ID NO: 47788 - DNA, 1254 bp, Pseudomonas aeruginosa; identical to SEQ ID NO: 27423
  CDS (1)..(1254)

SEQ ID NO: 47789 - protein, 417 aa, Pseudomonas aeruginosa; identical to SEQ ID NO: 27424

SEQ ID NO: 47790 - DNA, 936 bp, Agrobacterium tumefaciens; identical to SEQ ID NO: 27425
  CDS (1)..(936)

SEQ ID NO: 47791 - protein, 311 aa, Agrobacterium tumefaciens; identical to SEQ ID NO: 27426

SEQ ID NO: 47792 - DNA, 948 bp, Methanococcus jannaschii; identical to SEQ ID NO: 27427
  CDS (1)..(948)

SEQ ID NO: 47793 - protein, 315 aa, Methanococcus jannaschii; identical to SEQ ID NO: 27428

SEQ ID NO: 47794 - DNA, 900 bp, Thermotoga maritima; identical to SEQ ID NO: 27429
  CDS (1)..(900)

SEQ ID NO: 47795 - protein, 299 aa, Thermotoga maritima; identical to SEQ ID NO: 27430

SEQ ID NO: 47796 - DNA, 1614 bp, Sinorhizobium meliloti; identical to SEQ ID NO: 27431
  CDS (1)..(1614)

SEQ ID NO: 47797 - protein, 537 aa, Sinorhizobium meliloti; identical to SEQ ID NO: 27432

SEQ ID NO: 47798 - DNA, 1080 bp, Thermotoga maritima; identical to SEQ ID NO: 27433
  CDS (1)..(1080)

SEQ ID NO: 47799 - protein, 359 aa, Thermotoga maritima; identical to SEQ ID NO: 27434

SEQ ID NO: 47800 - DNA, 858 bp, Deinococcus radiodurans; identical to SEQ ID NO: 27435
  CDS (1)..(858)

SEQ ID NO: 47801 - protein, 285 aa, Deinococcus radiodurans; identical to SEQ ID NO: 27436

SEQ ID NO: 47802 - DNA, 1053 bp, Campylobacter jejuni; identical to SEQ ID NO: 27437
  CDS (1)..(1053)

SEQ ID NO: 47803 - protein, 350 aa, Campylobacter jejuni; identical to SEQ ID NO: 27438

SEQ ID NO: 47804 - DNA, 918 bp, Sulfolobus solfataricus; identical to SEQ ID NO: 27439
  CDS (1)..(918)

SEQ ID NO: 47805 - protein, 305 aa, Sulfolobus solfataricus; identical to SEQ ID NO: 27440

SEQ ID NO: 47806 - DNA, 1050 bp, Deinococcus radiodurans; identical to SEQ ID NO: 27441
  CDS (1)..(1050)

SEQ ID NO: 47807 - protein, 349 aa, Deinococcus radiodurans; identical to SEQ ID NO: 27442

SEQ ID NO: 47808 - DNA, 903 bp, Deinococcus radiodurans; identical to SEQ ID NO: 27443
  CDS (1)..(903)

SEQ ID NO: 47809 - protein, 300 aa, Deinococcus radiodurans; identical to SEQ ID NO: 27444

SEQ ID NO: 47810 - DNA, 897 bp, Campylobacter jejuni; identical to SEQ ID NO: 27445
  CDS (1)..(897)

SEQ ID NO: 47811 - protein, 298 aa, Campylobacter jejuni; identical to SEQ ID NO: 27446

SEQ ID NO: 47812 - DNA, 939 bp, Archaeoglobus fulgidus; identical to SEQ ID NO: 27447
  CDS (1)..(939)

SEQ ID NO: 47813 - protein, 312 aa, Archaeoglobus fulgidus; identical to SEQ ID NO: 27448

SEQ ID NO: 47814 - DNA, 1071 bp, Deinococcus radiodurans; identical to SEQ ID NO: 27449
  CDS (1)..(1071)

SEQ ID NO: 47815 - protein, 356 aa, Deinococcus radiodurans; identical to SEQ ID NO: 27450

SEQ ID NO: 47816 - DNA, 864 bp, Sinorhizobium meliloti; identical to SEQ ID NO: 27451
  CDS (1)..(864)

SEQ ID NO: 47817 - protein, 287 aa, Sinorhizobium meliloti; identical to SEQ ID NO: 27452

SEQ ID NO: 47818 - DNA, 855 bp, Archaeoglobus fulgidus; identical to SEQ ID NO: 27453
  CDS (1)..(855)

SEQ ID NO: 47819 - protein, 284 aa, Archaeoglobus fulgidus; identical to SEQ ID NO: 27454

SEQ ID NO: 47820 - DNA, 972 bp, Archaeoglobus fulgidus; identical to SEQ ID NO: 27455
  CDS (1)..(972)

SEQ ID NO: 47821 - protein, 323 aa, Archaeoglobus fulgidus; identical to SEQ ID NO: 27456

SEQ ID NO: 47822 - DNA, 870 bp, Streptococcus pneumoniae; identical to SEQ ID NO: 27457
  CDS (1)..(870)

SEQ ID NO: 47823 - protein, 289 aa, Streptococcus pneumoniae; identical to SEQ ID NO: 27458

SEQ ID NO: 47824 - DNA, 888 bp, Agrobacterium tumefaciens; identical to SEQ ID NO: 27459
  CDS (1)..(888)

SEQ ID NO: 47825 - protein, 295 aa, Agrobacterium tumefaciens; identical to SEQ ID NO: 27460

SEQ ID NO: 47826 - DNA, 1278 bp, Escherichia coli; identical to SEQ ID NO: 27461
  CDS (1)..(1278)

SEQ ID NO: 47827 - protein, 425 aa, Escherichia coli; identical to SEQ ID NO: 27462

SEQ ID NO: 47828 - DNA, 861 bp, Synechocystis sp; identical to SEQ ID NO: 27463
  CDS (1)..(861)

SEQ ID NO: 47829 - protein, 286 aa, Synechocystis sp; identical to SEQ ID NO: 27464

SEQ ID NO: 47830 - DNA, 1167 bp, Synechocystis sp; identical to SEQ ID NO: 27465
  CDS (1)..(1167)

SEQ ID NO: 47831 - protein, 388 aa, Synechocystis sp; identical to SEQ ID NO: 27466

SEQ ID NO: 47832 - DNA, 1233 bp, Synechocystis sp; identical to SEQ ID NO: 27467
  CDS (1)..(1233)

SEQ ID NO: 47833 - protein, 410 aa, Synechocystis sp; identical to SEQ ID NO: 27468

SEQ ID NO: 47834 - DNA, 933 bp, Streptomyces coelicolor; identical to SEQ ID NO: 27469
  CDS (1)..(933)

SEQ ID NO: 47835 - protein, 310 aa, Streptomyces coelicolor; identical to SEQ ID NO: 27470

SEQ ID NO: 47836 - DNA, 861 bp, Rhodopseudomonas palustris; identical to SEQ ID NO: 27471
  CDS (1)..(861)

SEQ ID NO: 47837 - protein, 286 aa, Rhodopseudomonas palustris; identical to SEQ ID NO: 27472

SEQ ID NO: 47838 - DNA, 918 bp, Methylophilus methylotrophus; identical to SEQ ID NO: 27473
  CDS (1)..(918)

SEQ ID NO: 47839 - protein, 305 aa, Methylophilus methylotrophus; identical to SEQ ID NO: 27474

SEQ ID NO: 47840 - DNA, 1845 bp, Pseudomonas aeruginosa; identical to SEQ ID NO: 27475
  CDS (1)..(1845)

SEQ ID NO: 47841 - protein, 614 aa, Pseudomonas aeruginosa; identical to SEQ ID NO: 27476

SEQ ID NO: 47842 - DNA, 1860 bp, Symbiobacterium thermophilum; identical to SEQ ID NO: 27477
  CDS (1)..(1860)

SEQ ID NO: 47843 - protein, 619 aa, Symbiobacterium thermophilum; identical to SEQ ID NO: 27478

SEQ ID NO: 47844 - DNA, 1050 bp, Symbiobacterium thermophilum; identical to SEQ ID NO: 27479
  CDS (1)..(1050)

SEQ ID NO: 47845 - protein, 349 aa, Symbiobacterium thermophilum; identical to SEQ ID NO: 27480

SEQ ID NO: 47846 - DNA, 870 bp, Symbiobacterium thermophilum; identical to SEQ ID NO: 27481
  CDS (1)..(870)

SEQ ID NO: 47847 - protein, 289 aa, Symbiobacterium thermophilum; identical to SEQ ID NO: 27482

SEQ ID NO: 47848 - DNA, 1026 bp, Symbiobacterium thermophilum; identical to SEQ ID NO: 27483
  CDS (1)..(1026)

SEQ ID NO: 47849 - protein, 341 aa, Symbiobacterium thermophilum; identical to SEQ ID NO: 27484

SEQ ID NO: 47850 - DNA, 1068 bp, Desulfotalea psychrophila; identical to SEQ ID NO: 27485
  CDS (1)..(1068)

SEQ ID NO: 47851 - protein, 355 aa, Desulfotalea psychrophila; identical to SEQ ID NO: 27486

SEQ ID NO: 47852 - DNA, 891 bp, Desulfotalea psychrophila; identical to SEQ ID NO: 27487
  CDS (1)..(891)

SEQ ID NO: 47853 - protein, 296 aa, Desulfotalea psychrophila; identical to SEQ ID NO: 27488

SEQ ID NO: 47854 - DNA, 882 bp, Acinetobacter sp; identical to SEQ ID NO: 27489
  CDS (1)..(882)

SEQ ID NO: 47855 - protein, 293 aa, Acinetobacter sp; identical to SEQ ID NO: 27490

SEQ ID NO: 47856 - DNA, 1647 bp, Acinetobacter sp; identical to SEQ ID NO: 27491
  CDS (1)..(1647)

SEQ ID NO: 47857 - protein, 548 aa, Acinetobacter sp; identical to SEQ ID NO: 27492

SEQ ID NO: 47858 - DNA, 1059 bp, Bartonella quintana; identical to SEQ ID NO: 27493
  CDS (1)..(1059)

SEQ ID NO: 47859 - protein, 352 aa, Bartonella quintana; identical to SEQ ID NO: 27494

SEQ ID NO: 47860 - DNA, 1065 bp, Bartonella quintana; identical to SEQ ID NO: 27495
  CDS (1)..(1065)

SEQ ID NO: 47861 - protein, 354 aa, Bartonella quintana; identical to SEQ ID NO: 27496

SEQ ID NO: 47862 - DNA, 1065 bp, Bartonella henselae; identical to SEQ ID NO: 27497
  CDS (1)..(1065)

SEQ ID NO: 47863 - protein, 354 aa, Bartonella henselae; identical to SEQ ID NO: 27498

SEQ ID NO: 47864 - DNA, 1059 bp, Bartonella henselae; identical to SEQ ID NO: 27499
  CDS (1)..(1059)

SEQ ID NO: 47865 - protein, 352 aa, Bartonella henselae; identical to SEQ ID NO: 27500

SEQ ID NO: 47866 - DNA, 861 bp, Bacillus thuringiensis; identical to SEQ ID NO: 27501
  CDS (1)..(861)

SEQ ID NO: 47867 - protein, 286 aa, Bacillus thuringiensis; identical to SEQ ID NO: 27502

SEQ ID NO: 47868 - DNA, 972 bp, Bdellovibrio bacteriovorus; identical to SEQ ID NO: 27503
  CDS (1)..(972)

SEQ ID NO: 47869 - protein, 323 aa, Bdellovibrio bacteriovorus; identical to SEQ ID NO: 27504

SEQ ID NO: 47870 - DNA, 903 bp, Bdellovibrio bacteriovorus; identical to SEQ ID NO: 27505
  CDS (1)..(903)

SEQ ID NO: 47871 - protein, 300 aa, Bdellovibrio bacteriovorus; identical to SEQ ID NO: 27506

SEQ ID NO: 47872 - DNA, 1068 bp, Rhodopseudomonas palustris; identical to SEQ ID NO: 27507
  CDS (1)..(1068)

SEQ ID NO: 47873 - protein, 355 aa, Rhodopseudomonas palustris; identical to SEQ ID NO: 27508

SEQ ID NO: 47874 - DNA, 939 bp, Rhodopseudomonas palustris; identical to SEQ ID NO: 27509
  CDS (1)..(939)

SEQ ID NO: 47875 - protein, 312 aa, Rhodopseudomonas palustris; identical to SEQ ID NO: 27510

SEQ ID NO: 47876 - DNA, 948 bp, Rhodopseudomonas palustris; identical to SEQ ID NO: 27511
  CDS (1)..(948)

SEQ ID NO: 47877 - protein, 315 aa, Rhodopseudomonas palustris; identical to SEQ ID NO: 27512

SEQ ID NO: 47878 - DNA, 948 bp, Rhodopseudomonas palustris; identical to SEQ ID NO: 27513
  CDS (1)..(948)

SEQ ID NO: 47879 - protein, 315 aa, Rhodopseudomonas palustris; identical to SEQ ID NO: 27514

SEQ ID NO: 47880 - DNA, 873 bp, Rhodopseudomonas palustris; identical to SEQ ID NO: 27515
  CDS (1)..(873)

SEQ ID NO: 47881 - protein, 290 aa, Rhodopseudomonas palustris; identical to SEQ ID NO: 27516

SEQ ID NO: 47882 - DNA, 918 bp, Rhodopseudomonas palustris; identical to SEQ ID NO: 27517
  CDS (1)..(918)

SEQ ID NO: 47883 - protein, 305 aa, Rhodopseudomonas palustris; identical to SEQ ID NO: 27518

SEQ ID NO: 47884 - DNA, 1614 bp, Rhodopseudomonas palustris; identical to SEQ ID NO: 27519
  CDS (1)..(1614)

SEQ ID NO: 47885 - protein, 537 aa, Rhodopseudomonas palustris; identical to SEQ ID NO: 27520

SEQ ID NO: 47886 - DNA, 1008 bp, Rhodopseudomonas palustris; identical to SEQ ID NO: 27521
  CDS (1)..(1008)

SEQ ID NO: 47887 - protein, 335 aa, Rhodopseudomonas palustris; identical to SEQ ID NO: 27522

SEQ ID NO: 47888 - DNA, 873 bp, Rhodopseudomonas palustris; identical to SEQ ID NO: 27523
  CDS (1)..(873)

SEQ ID NO: 47889 - protein, 290 aa, Rhodopseudomonas palustris; identical to SEQ ID NO: 27524

SEQ ID NO: 47890 - DNA, 876 bp, Rhodopseudomonas palustris; identical to SEQ ID NO: 27525
  CDS (1)..(876)

SEQ ID NO: 47891 - protein, 291 aa, Rhodopseudomonas palustris; identical to SEQ ID NO: 27526

SEQ ID NO: 47892 - DNA, 1041 bp, Rhodopseudomonas palustris; identical to SEQ ID NO: 27527
  CDS (1)..(1041)

SEQ ID NO: 47893 - protein, 346 aa, Rhodopseudomonas palustris; identical to SEQ ID NO: 27528

SEQ ID NO: 47894 - DNA, 1773 bp, Rhodopseudomonas palustris; identical to SEQ ID NO: 27529
  CDS (1)..(1773)

SEQ ID NO: 47895 - protein, 590 aa, Rhodopseudomonas palustris; identical to SEQ ID NO: 27530

SEQ ID NO: 47896 - DNA, 834 bp, Rhodopseudomonas palustris; identical to SEQ ID NO: 27531
  CDS (1)..(834)

SEQ ID NO: 47897 - protein, 277 aa, Rhodopseudomonas palustris; identical to SEQ ID NO: 27532

SEQ ID NO: 47898 - DNA, 876 bp, Rhodopseudomonas palustris; identical to SEQ ID NO: 27533
  CDS (1)..(876)

SEQ ID NO: 47899 - protein, 291 aa, Rhodopseudomonas palustris; identical to SEQ ID NO: 27534

SEQ ID NO: 47900 - DNA, 876 bp, Rhodopseudomonas palustris; identical to SEQ ID NO: 27535
  CDS (1)..(876)

SEQ ID NO: 47901 - protein, 291 aa, Rhodopseudomonas palustris; identical to SEQ ID NO: 27536

SEQ ID NO: 47902 - DNA, 864 bp, Rhodopseudomonas palustris; identical to SEQ ID NO: 27537
  CDS (1)..(864)

SEQ ID NO: 47903 - protein, 287 aa, Rhodopseudomonas palustris; identical to SEQ ID NO: 27538

SEQ ID NO: 47904 - DNA, 927 bp, Rhodopseudomonas palustris; identical to SEQ ID NO: 27539
  CDS (1)..(927)

SEQ ID NO: 47905 - protein, 308 aa, Rhodopseudomonas palustris; identical to SEQ ID NO: 27540

SEQ ID NO: 47906 - DNA, 873 bp, Rhodopseudomonas palustris; identical to SEQ ID NO: 27541
  CDS (1)..(873)

SEQ ID NO: 47907 - protein, 290 aa, Rhodopseudomonas palustris; identical to SEQ ID NO: 27542

SEQ ID NO: 47908 - DNA, 867 bp, Rhodopseudomonas palustris; identical to SEQ ID NO: 27543
  CDS (1)..(867)

SEQ ID NO: 47909 - protein, 288 aa, Rhodopseudomonas palustris; identical to SEQ ID NO: 27544

SEQ ID NO: 47910 - DNA, 870 bp, uncultured bacterium 582; identical to SEQ ID NO: 27545
  CDS (1)..(870)

SEQ ID NO: 47911 - protein, 289 aa, uncultured bacterium 582; identical to SEQ ID NO: 27546

SEQ ID NO: 47912 - DNA, 1254 bp, symbiont bacterium of Paederus fuscipes; identical to SEQ ID NO: 27547
  CDS (1)..(1254)

SEQ ID NO: 47913 - protein, 417 aa, symbiont bacterium of Paederus fuscipes; identical to SEQ ID NO: 27548

SEQ ID NO: 47914 - DNA, 879 bp, Alcaligenes eutrophus; identical to SEQ ID NO: 27549
  CDS (1)..(879)

SEQ ID NO: 47915 - protein, 292 aa, Alcaligenes eutrophus; identical to SEQ ID NO: 27550

SEQ ID NO: 47916 - DNA, 882 bp, Rhizobium sp; identical to SEQ ID NO: 27551
  CDS (1)..(882)

SEQ ID NO: 47917 - protein, 293 aa, Rhizobium sp; identical to SEQ ID NO: 27552

SEQ ID NO: 47918 - DNA, 921 bp, Desulfovibrio vulgaris; identical to SEQ ID NO: 27553
  CDS (1)..(921)

SEQ ID NO: 47919 - protein, 306 aa, Desulfovibrio vulgaris; identical to SEQ ID NO: 27554

SEQ ID NO: 47920 - DNA, 906 bp, Desulfovibrio vulgaris; identical to SEQ ID NO: 27555
  CDS (1)..(906)

SEQ ID NO: 47921 - protein, 301 aa, Desulfovibrio vulgaris; identical to SEQ ID NO: 27556

SEQ ID NO: 47922 - DNA, 1224 bp, Desulfovibrio vulgaris; identical to SEQ ID NO: 27557
  CDS (1)..(1224)

SEQ ID NO: 47923 - protein, 407 aa, Desulfovibrio vulgaris; identical to SEQ ID NO: 27558

SEQ ID NO: 47924 - DNA, 909 bp, Desulfovibrio vulgaris; identical to SEQ ID NO: 27559
  CDS (1)..(909)

SEQ ID NO: 47925 - protein, 302 aa, Desulfovibrio vulgaris; identical to SEQ ID NO: 27560

SEQ ID NO: 47926 - DNA, 969 bp, Thermus thermophilus; identical to SEQ ID NO: 27561
  CDS (1)..(969)

SEQ ID NO: 47927 - protein, 322 aa, Thermus thermophilus; identical to SEQ ID NO: 27562

SEQ ID NO: 47928 - DNA, 978 bp, Thermus thermophilus; identical to SEQ ID NO: 27563
  CDS (1)..(978)

SEQ ID NO: 47929 - protein, 325 aa, Thermus thermophilus; identical to SEQ ID NO: 27564

SEQ ID NO: 47930 - DNA, 858 bp, Thermus thermophilus; identical to SEQ ID NO: 27565
  CDS (1)..(858)

SEQ ID NO: 47931 - protein, 285 aa, Thermus thermophilus; identical to SEQ ID NO: 27566

SEQ ID NO: 47932 - DNA, 876 bp, Thermus thermophilus; identical to SEQ ID NO: 27567
  CDS (1)..(876)

SEQ ID NO: 47933 - protein, 291 aa, Thermus thermophilus; identical to SEQ ID NO: 27568

SEQ ID NO: 47934 - DNA, 1068 bp, Thermus thermophilus; identical to SEQ ID NO: 27569
  CDS (1)..(1068)

SEQ ID NO: 47935 - protein, 355 aa, Thermus thermophilus; identical to SEQ ID NO: 27570

SEQ ID NO: 47936 - DNA, 894 bp, Thermus thermophilus; identical to SEQ ID NO: 27571
  CDS (1)..(894)

SEQ ID NO: 47937 - protein, 297 aa, Thermus thermophilus; identical to SEQ ID NO: 27572

SEQ ID NO: 47938 - DNA, 861 bp, Bacillus cereus; identical to SEQ ID NO: 27573
  CDS (1)..(861)

SEQ ID NO: 47939 - protein, 286 aa, Bacillus cereus; identical to SEQ ID NO: 27574

SEQ ID NO: 47940 - DNA, 900 bp, Treponema denticola; identical to SEQ ID NO: 27575
  CDS (1)..(900)

SEQ ID NO: 47941 - protein, 299 aa, Treponema denticola; identical to SEQ ID NO: 27576

SEQ ID NO: 47942 - DNA, 1020 bp, Treponema denticola; identical to SEQ ID NO: 27577
  CDS (1)..(1020)

SEQ ID NO: 47943 - protein, 339 aa, Treponema denticola; identical to SEQ ID NO: 27578

SEQ ID NO: 47944 - DNA, 885 bp, Geobacter sulfurreducens; identical to SEQ ID NO: 27579
  CDS (1)..(885)

SEQ ID NO: 47945 - protein, 294 aa, Geobacter sulfurreducens; identical to SEQ ID NO: 27580

SEQ ID NO: 47946 - DNA, 1158 bp, Agrobacterium tumefaciens; identical to SEQ ID NO: 27581
  CDS (1)..(1158)

SEQ ID NO: 47947 - protein, 385 aa, Agrobacterium tumefaciens; identical to SEQ ID NO: 27582

SEQ ID NO: 47948 - DNA, 903 bp, Wolinella succinogenes; identical to SEQ ID NO: 27583
  CDS (1)..(903)

SEQ ID NO: 47949 - protein, 300 aa, Wolinella succinogenes; identical to SEQ ID NO: 27584

SEQ ID NO: 47950 - DNA, 1110 bp, Gloeobacter violaceus; identical to SEQ ID NO: 27585
  CDS (1)..(1110)

SEQ ID NO: 47951 - protein, 369 aa, Gloeobacter violaceus; identical to SEQ ID NO: 27586

SEQ ID NO: 47952 - DNA, 1170 bp, Gloeobacter violaceus; identical to SEQ ID NO: 27587
  CDS (1)..(1170)

SEQ ID NO: 47953 - protein, 389 aa, Gloeobacter violaceus; identical to SEQ ID NO: 27588

SEQ ID NO: 47954 - DNA, 1092 bp, Chromobacterium violaceum; identical to SEQ ID NO: 27589
  CDS (1)..(1092)

SEQ ID NO: 47955 - protein, 363 aa, Chromobacterium violaceum; identical to SEQ ID NO: 27590

SEQ ID NO: 47956 - DNA, 930 bp, Chromobacterium violaceum; identical to SEQ ID NO: 27591
  CDS (1)..(930)

SEQ ID NO: 47957 - protein, 309 aa, Chromobacterium violaceum; identical to SEQ ID NO: 27592

SEQ ID NO: 47958 - DNA, 1155 bp, Synechococcus sp; identical to SEQ ID NO: 27593
  CDS (1)..(1155)

SEQ ID NO: 47959 - protein, 384 aa, Synechococcus sp; identical to SEQ ID NO: 27594

SEQ ID NO: 47960 - DNA, 1155 bp, Prochlorococcus marinus subsp; identical to SEQ ID NO: 27595
  CDS (1)..(1155)

SEQ ID NO: 47961 - protein, 384 aa, Prochlorococcus marinus subsp; identical to SEQ ID NO: 27596

SEQ ID NO: 47962 - DNA, 1155 bp, Prochlorococcus marinus; identical to SEQ ID NO: 27597
  CDS (1)..(1155)

SEQ ID NO: 47963 - protein, 384 aa, Prochlorococcus marinus; identical to SEQ ID NO: 27598

SEQ ID NO: 47964 - DNA, 885 bp, Bordetella pertussis; identical to SEQ ID NO: 27599
  CDS (1)..(885)

SEQ ID NO: 47965 - protein, 294 aa, Bordetella pertussis; identical to SEQ ID NO: 27600

SEQ ID NO: 47966 - DNA, 1797 bp, Bordetella pertussis; identical to SEQ ID NO: 27601
  CDS (1)..(1797)

SEQ ID NO: 47967 - protein, 598 aa, Bordetella pertussis; identical to SEQ ID NO: 27602

SEQ ID NO: 47968 - DNA, 882 bp, Bordetella pertussis; identical to SEQ ID NO: 27603
  CDS (1)..(882)

SEQ ID NO: 47969 - protein, 293 aa, Bordetella pertussis; identical to SEQ ID NO: 27604

SEQ ID NO: 47970 - DNA, 1950 bp, Bordetella pertussis; identical to SEQ ID NO: 27605
  CDS (1)..(1950)

SEQ ID NO: 47971 - protein, 649 aa, Bordetella pertussis; identical to SEQ ID NO: 27606

SEQ ID NO: 47972 - DNA, 927 bp, Bordetella pertussis; identical to SEQ ID NO: 27607
  CDS (1)..(927)

SEQ ID NO: 47973 - protein, 308 aa, Bordetella pertussis; identical to SEQ ID NO: 27608

SEQ ID NO: 47974 - DNA, 1239 bp, Bordetella pertussis; identical to SEQ ID NO: 27609
  CDS (1)..(1239)

SEQ ID NO: 47975 - protein, 412 aa, Bordetella pertussis; identical to SEQ ID NO: 27610

SEQ ID NO: 47976 - DNA, 921 bp, Bordetella pertussis; identical to SEQ ID NO: 27611
  CDS (1)..(921)

SEQ ID NO: 47977 - protein, 306 aa, Bordetella pertussis; identical to SEQ ID NO: 27612

SEQ ID NO: 47978 - DNA, 1038 bp, Bordetella parapertussis; identical to SEQ ID NO: 27613
  CDS (1)..(1038)

SEQ ID NO: 47979 - protein, 345 aa, Bordetella parapertussis; identical to SEQ ID NO: 27614

SEQ ID NO: 47980 - DNA, 1839 bp, Bordetella parapertussis; identical to SEQ ID NO: 27615
  CDS (1)..(1839)

SEQ ID NO: 47981 - protein, 612 aa, Bordetella parapertussis; identical to SEQ ID NO: 27616

SEQ ID NO: 47982 - DNA, 873 bp, Bordetella parapertussis; identical to SEQ ID NO: 27617
  CDS (1)..(873)

SEQ ID NO: 47983 - protein, 290 aa, Bordetella parapertussis; identical to SEQ ID NO: 27618

SEQ ID NO: 47984 - DNA, 930 bp, Bordetella parapertussis; identical to SEQ ID NO: 27619
  CDS (1)..(930)

SEQ ID NO: 47985 - protein, 309 aa, Bordetella parapertussis; identical to SEQ ID NO: 27620

SEQ ID NO: 47986 - DNA, 888 bp, Bordetella parapertussis; identical to SEQ ID NO: 27621
  CDS (1)..(888)

SEQ ID NO: 47987 - protein, 295 aa, Bordetella parapertussis; identical to SEQ ID NO: 27622

SEQ ID NO: 47988 - DNA, 876 bp, Bordetella parapertussis; identical to SEQ ID NO: 27623
  CDS (1)..(876)

SEQ ID NO: 47989 - protein, 291 aa, Bordetella parapertussis; identical to SEQ ID NO: 27624

SEQ ID NO: 47990 - DNA, 882 bp, Bordetella parapertussis; identical to SEQ ID NO: 27625
  CDS (1)..(882)

SEQ ID NO: 47991 - protein, 293 aa, Bordetella parapertussis; identical to SEQ ID NO: 27626

SEQ ID NO: 47992 - DNA, 876 bp, Bordetella parapertussis; identical to SEQ ID NO: 27627
  CDS (1)..(876)

SEQ ID NO: 47993 - protein, 291 aa, Bordetella parapertussis; identical to SEQ ID NO: 27628

SEQ ID NO: 47994 - DNA, 930 bp, Bordetella bronchiseptica; identical to SEQ ID NO: 27629
  CDS (1)..(930)

SEQ ID NO: 47995 - protein, 309 aa, Bordetella bronchiseptica; identical to SEQ ID NO: 27630

SEQ ID NO: 47996 - DNA, 873 bp, Bordetella bronchiseptica; identical to SEQ ID NO: 27631
  CDS (1)..(873)

SEQ ID NO: 47997 - protein, 290 aa, Bordetella bronchiseptica; identical to SEQ ID NO: 27632

SEQ ID NO: 47998 - DNA, 957 bp, Bordetella bronchiseptica; identical to SEQ ID NO: 27633
  CDS (1)..(957)

SEQ ID NO: 47999 - protein, 318 aa, Bordetella bronchiseptica; identical to SEQ ID NO: 27634

SEQ ID NO: 48000 - DNA, 1950 bp, Bordetella bronchiseptica; identical to SEQ ID NO: 27635
  CDS (1)..(1950)

SEQ ID NO: 48001 - protein, 649 aa, Bordetella bronchiseptica; identical to SEQ ID NO: 27636

SEQ ID NO: 48002 - DNA, 876 bp, Bordetella bronchiseptica; identical to SEQ ID NO: 27637
  CDS (1)..(876)

SEQ ID NO: 48003 - protein, 291 aa, Bordetella bronchiseptica; identical to SEQ ID NO: 27638

SEQ ID NO: 48004 - DNA, 888 bp, Bordetella bronchiseptica; identical to SEQ ID NO: 27639
  CDS (1)..(888)

SEQ ID NO: 48005 - protein, 295 aa, Bordetella bronchiseptica; identical to SEQ ID NO: 27640

SEQ ID NO: 48006 - DNA, 867 bp, Bordetella bronchiseptica; identical to SEQ ID NO: 27641
  CDS (1)..(867)

SEQ ID NO: 48007 - protein, 288 aa, Bordetella bronchiseptica; identical to SEQ ID NO: 27642

SEQ ID NO: 48008 - DNA, 873 bp, Bordetella bronchiseptica; identical to SEQ ID NO: 27643
  CDS (1)..(873)

SEQ ID NO: 48009 - protein, 290 aa, Bordetella bronchiseptica; identical to SEQ ID NO: 27644

SEQ ID NO: 48010 - DNA, 930 bp, Bordetella bronchiseptica; identical to SEQ ID NO: 27645
  CDS (1)..(930)

SEQ ID NO: 48011 - protein, 309 aa, Bordetella bronchiseptica; identical to SEQ ID NO: 27646

SEQ ID NO: 48012 - DNA, 942 bp, Rhizobium leguminosarum; identical to SEQ ID NO: 27647
  CDS (1)..(942)

SEQ ID NO: 48013 - protein, 313 aa, Rhizobium leguminosarum; identical to SEQ ID NO: 27648

SEQ ID NO: 48014 - DNA, 861 bp, Bacillus cereus; identical to SEQ ID NO: 27649
  CDS (1)..(861)

SEQ ID NO: 48015 - protein, 286 aa, Bacillus cereus; identical to SEQ ID NO: 27650

SEQ ID NO: 48016 - DNA, 933 bp, Streptomyces avermitilis; identical to SEQ ID NO: 27651
  CDS (1)..(933)

SEQ ID NO: 48017 - protein, 310 aa, Streptomyces avermitilis; identical to SEQ ID NO: 27652

SEQ ID NO: 48018 - DNA, 891 bp, Streptomyces avermitilis; identical to SEQ ID NO: 27653
  CDS (1)..(891)

SEQ ID NO: 48019 - protein, 296 aa, Streptomyces avermitilis; identical to SEQ ID NO: 27654

SEQ ID NO: 48020 - DNA, 897 bp, Streptomyces avermitilis; identical to SEQ ID NO: 27655
  CDS (1)..(897)

SEQ ID NO: 48021 - protein, 298 aa, Streptomyces avermitilis; identical to SEQ ID NO: 27656

SEQ ID NO: 48022 - DNA, 1005 bp, Tropheryma whipplei; identical to SEQ ID NO: 27657
  CDS (1)..(1005)

SEQ ID NO: 48023 - protein, 334 aa, Tropheryma whipplei; identical to SEQ ID NO: 27658

SEQ ID NO: 48024 - DNA, 918 bp, Pseudomonas fluorescens; identical to SEQ ID NO: 27659
  CDS (1)..(918)

SEQ ID NO: 48025 - protein, 305 aa, Pseudomonas fluorescens; identical to SEQ ID NO: 27660

SEQ ID NO: 48026 - DNA, 867 bp, Azoarcus evansii; identical to SEQ ID NO: 27661
  CDS (1)..(867)

SEQ ID NO: 48027 - protein, 288 aa, Azoarcus evansii; identical to SEQ ID NO: 27662

SEQ ID NO: 48028 - DNA, 894 bp, Vibrio parahaemolyticus; identical to SEQ ID NO: 27663
  CDS (1)..(894)

SEQ ID NO: 48029 - protein, 297 aa, Vibrio parahaemolyticus; identical to SEQ ID NO: 27664

SEQ ID NO: 48030 - DNA, 1314 bp, Pseudomonas syringae; identical to SEQ ID NO: 27665
  CDS (1)..(1314)

SEQ ID NO: 48031 - protein, 437 aa, Pseudomonas syringae; identical to SEQ ID NO: 27666

SEQ ID NO: 48032 - DNA, 1590 bp, Pseudomonas syringae; identical to SEQ ID NO: 27667
  CDS (1)..(1590)

SEQ ID NO: 48033 - protein, 529 aa, Pseudomonas syringae; identical to SEQ ID NO: 27668

SEQ ID NO: 48034 - DNA, 1266 bp, Pseudomonas syringae; identical to SEQ ID NO: 27669
  CDS (1)..(1266)

SEQ ID NO: 48035 - protein, 421 aa, Pseudomonas syringae; identical to SEQ ID NO: 27670

SEQ ID NO: 48036 - DNA, 924 bp, Pseudomonas syringae; identical to SEQ ID NO: 27671
  CDS (1)..(924)

SEQ ID NO: 48037 - protein, 307 aa, Pseudomonas syringae; identical to SEQ ID NO: 27672

SEQ ID NO: 48038 - DNA, 882 bp, Pseudomonas syringae; identical to SEQ ID NO: 27673
  CDS (1)..(882)

SEQ ID NO: 48039 - protein, 293 aa, Pseudomonas syringae; identical to SEQ ID NO: 27674

SEQ ID NO: 48040 - DNA, 882 bp, Pseudomonas syringae; identical to SEQ ID NO: 27675
  CDS (1)..(882)

SEQ ID NO: 48041 - protein, 293 aa, Pseudomonas syringae; identical to SEQ ID NO: 27676

SEQ ID NO: 48042 - DNA, 882 bp, Pseudomonas syringae; identical to SEQ ID NO: 27677
  CDS (1)..(882)

SEQ ID NO: 48043 - protein, 293 aa, Pseudomonas syringae; identical to SEQ ID NO: 27678

SEQ ID NO: 48044 - DNA, 915 bp, Pseudomonas putida; identical to SEQ ID NO: 27679
  CDS (1)..(915)

SEQ ID NO: 48045 - protein, 304 aa, Pseudomonas putida; identical to SEQ ID NO: 27680

SEQ ID NO: 48046 - DNA, 1308 bp, Pseudomonas putida; identical to SEQ ID NO: 27681
  CDS (1)..(1308)

SEQ ID NO: 48047 - protein, 435 aa, Pseudomonas putida; identical to SEQ ID NO: 27682

SEQ ID NO: 48048 - DNA, 1041 bp, Pseudomonas putida; identical to SEQ ID NO: 27683
  CDS (1)..(1041)

SEQ ID NO: 48049 - protein, 346 aa, Pseudomonas putida; identical to SEQ ID NO: 27684

SEQ ID NO: 48050 - DNA, 882 bp, Pseudomonas putida; identical to SEQ ID NO: 27685
  CDS (1)..(882)

SEQ ID NO: 48051 - protein, 293 aa, Pseudomonas putida; identical to SEQ ID NO: 27686

SEQ ID NO: 48052 - DNA, 924 bp, Pseudomonas putida; identical to SEQ ID NO: 27687
  CDS (1)..(924)

SEQ ID NO: 48053 - protein, 307 aa, Pseudomonas putida; identical to SEQ ID NO: 27688

SEQ ID NO: 48054 - DNA, 1257 bp, Pseudomonas putida; identical to SEQ ID NO: 27689
  CDS (1)..(1257)

SEQ ID NO: 48055 - protein, 418 aa, Pseudomonas putida; identical to SEQ ID NO: 27690

SEQ ID NO: 48056 - DNA, 861 bp, Pseudomonas putida; identical to SEQ ID NO: 27691
  CDS (1)..(861)

SEQ ID NO: 48057 - protein, 286 aa, Pseudomonas putida; identical to SEQ ID NO: 27692

SEQ ID NO: 48058 - DNA, 879 bp, Lactobacillus plantarum; identical to SEQ ID NO: 27693
  CDS (1)..(879)

SEQ ID NO: 48059 - protein, 292 aa, Lactobacillus plantarum; identical to SEQ ID NO: 27694

SEQ ID NO: 48060 - DNA, 963 bp, Lactobacillus plantarum; identical to SEQ ID NO: 27695
  CDS (1)..(963)

SEQ ID NO: 48061 - protein, 320 aa, Lactobacillus plantarum; identical to SEQ ID NO: 27696

SEQ ID NO: 48062 - DNA, 876 bp, Bradyrhizobium japonicum; identical to SEQ ID NO: 27697
  CDS (1)..(876)

SEQ ID NO: 48063 - protein, 291 aa, Bradyrhizobium japonicum; identical to SEQ ID NO: 27698

SEQ ID NO: 48064 - DNA, 1770 bp, Bradyrhizobium japonicum; identical to SEQ ID NO: 27699
  CDS (1)..(1770)

SEQ ID NO: 48065 - protein, 589 aa, Bradyrhizobium japonicum; identical to SEQ ID NO: 27700

SEQ ID NO: 48066 - DNA, 1026 bp, Bradyrhizobium japonicum; identical to SEQ ID NO: 27701
  CDS (1)..(1026)

SEQ ID NO: 48067 - protein, 341 aa, Bradyrhizobium japonicum; identical to SEQ ID NO: 27702

SEQ ID NO: 48068 - DNA, 879 bp, Bradyrhizobium japonicum; identical to SEQ ID NO: 27703
  CDS (1)..(879)

SEQ ID NO: 48069 - protein, 292 aa, Bradyrhizobium japonicum; identical to SEQ ID NO: 27704

SEQ ID NO: 48070 - DNA, 1665 bp, Bradyrhizobium japonicum; identical to SEQ ID NO: 27705
  CDS (1)..(1665)

SEQ ID NO: 48071 - protein, 554 aa, Bradyrhizobium japonicum; identical to SEQ ID NO: 27706

SEQ ID NO: 48072 - DNA, 882 bp, Bradyrhizobium japonicum; identical to SEQ ID NO: 27707
  CDS (1)..(882)

SEQ ID NO: 48073 - protein, 293 aa, Bradyrhizobium japonicum; identical to SEQ ID NO: 27708

SEQ ID NO: 48074 - DNA, 855 bp, Bradyrhizobium japonicum; identical to SEQ ID NO: 27709
  CDS (1)..(855)

SEQ ID NO: 48075 - protein, 284 aa, Bradyrhizobium japonicum; identical to SEQ ID NO: 27710

SEQ ID NO: 48076 - DNA, 867 bp, Bradyrhizobium japonicum; identical to SEQ ID NO: 27711
  CDS (1)..(867)

SEQ ID NO: 48077 - protein, 288 aa, Bradyrhizobium japonicum; identical to SEQ ID NO: 27712

SEQ ID NO: 48078 - DNA, 867 bp, Bradyrhizobium japonicum; identical to SEQ ID NO: 27713
  CDS (1)..(867)

SEQ ID NO: 48079 - protein, 288 aa, Bradyrhizobium japonicum; identical to SEQ ID NO: 27714

SEQ ID NO: 48080 - DNA, 882 bp, Bradyrhizobium japonicum; identical to SEQ ID NO: 27715
  CDS (1)..(882)

SEQ ID NO: 48081 - protein, 293 aa, Bradyrhizobium japonicum; identical to SEQ ID NO: 27716

SEQ ID NO: 48082 - DNA, 918 bp, Bradyrhizobium japonicum; identical to SEQ ID NO: 27717
  CDS (1)..(918)

SEQ ID NO: 48083 - protein, 305 aa, Bradyrhizobium japonicum; identical to SEQ ID NO: 27718

SEQ ID NO: 48084 - DNA, 870 bp, Bradyrhizobium japonicum; identical to SEQ ID NO: 27719
  CDS (1)..(870)

SEQ ID NO: 48085 - protein, 289 aa, Bradyrhizobium japonicum; identical to SEQ ID NO: 27720

SEQ ID NO: 48086 - DNA, 1890 bp, Bradyrhizobium japonicum; identical to SEQ ID NO: 27721
  CDS (1)..(1890)

SEQ ID NO: 48087 - protein, 629 aa, Bradyrhizobium japonicum; identical to SEQ ID NO: 27722

SEQ ID NO: 48088 - DNA, 930 bp, Bradyrhizobium japonicum; identical to SEQ ID NO: 27723
  CDS (1)..(930)

SEQ ID NO: 48089 - protein, 309 aa, Bradyrhizobium japonicum; identical to SEQ ID NO: 27724

SEQ ID NO: 48090 - DNA, 873 bp, Bradyrhizobium japonicum; identical to SEQ ID NO: 27725
  CDS (1)..(873)

SEQ ID NO: 48091 - protein, 290 aa, Bradyrhizobium japonicum; identical to SEQ ID NO: 27726

SEQ ID NO: 48092 - DNA, 1044 bp, Bradyrhizobium japonicum; identical to SEQ ID NO: 27727
  CDS (1)..(1044)

SEQ ID NO: 48093 - protein, 347 aa, Bradyrhizobium japonicum; identical to SEQ ID NO: 27728

SEQ ID NO: 48094 - DNA, 1011 bp, Bradyrhizobium japonicum; identical to SEQ ID NO: 27729
  CDS (1)..(1011)

SEQ ID NO: 48095 - protein, 336 aa, Bradyrhizobium japonicum; identical to SEQ ID NO: 27730

SEQ ID NO: 48096 - DNA, 1047 bp, Bradyrhizobium japonicum; identical to SEQ ID NO: 27731
  CDS (1)..(1047)

SEQ ID NO: 48097 - protein, 348 aa, Bradyrhizobium japonicum; identical to SEQ ID NO: 27732

SEQ ID NO: 48098 - DNA, 903 bp, Bradyrhizobium japonicum; identical to SEQ ID NO: 27733
  CDS (1)..(903)

SEQ ID NO: 48099 - protein, 300 aa, Bradyrhizobium japonicum; identical to SEQ ID NO: 27734

SEQ ID NO: 48100 - DNA, 906 bp, Bradyrhizobium japonicum; identical to SEQ ID NO: 27735
  CDS (1)..(906)

SEQ ID NO: 48101 - protein, 301 aa, Bradyrhizobium japonicum; identical to SEQ ID NO: 27736

SEQ ID NO: 48102 - DNA, 1170 bp, Bradyrhizobium japonicum; identical to SEQ ID NO: 27737
  CDS (1)..(1170)

SEQ ID NO: 48103 - protein, 389 aa, Bradyrhizobium japonicum; identical to SEQ ID NO: 27738

SEQ ID NO: 48104 - DNA, 1608 bp, Bradyrhizobium japonicum; identical to SEQ ID NO: 27739
  CDS (1)..(1608)

SEQ ID NO: 48105 - protein, 535 aa, Bradyrhizobium japonicum; identical to SEQ ID NO: 27740

SEQ ID NO: 48106 - DNA, 876 bp, Bradyrhizobium japonicum; identical to SEQ ID NO: 27741
  CDS (1)..(876)

SEQ ID NO: 48107 - protein, 291 aa, Bradyrhizobium japonicum; identical to SEQ ID NO: 27742

SEQ ID NO: 48108 - DNA, 1011 bp, Bradyrhizobium japonicum; identical to SEQ ID NO: 27743
  CDS (1)..(1011)

SEQ ID NO: 48109 - protein, 336 aa, Bradyrhizobium japonicum; identical to SEQ ID NO: 27744

SEQ ID NO: 48110 - DNA, 858 bp, Bradyrhizobium japonicum; identical to SEQ ID NO: 27745
  CDS (1)..(858)

SEQ ID NO: 48111 - protein, 285 aa, Bradyrhizobium japonicum; identical to SEQ ID NO: 27746

SEQ ID NO: 48112 - DNA, 1617 bp, Yersinia pestis; identical to SEQ ID NO: 27747
  CDS (1)..(1617)

SEQ ID NO: 48113 - protein, 538 aa, Yersinia pestis; identical to SEQ ID NO: 27748

SEQ ID NO: 48114 - DNA, 936 bp, Synechococcus elongatus; identical to SEQ ID NO: 27749
  CDS (1)..(936)

SEQ ID NO: 48115 - protein, 311 aa, Synechococcus elongatus; identical to SEQ ID NO: 27750

SEQ ID NO: 48116 - DNA, 870 bp, Synechococcus elongatus; identical to SEQ ID NO: 27751
  CDS (1)..(870)

SEQ ID NO: 48117 - protein, 289 aa, Synechococcus elongatus; identical to SEQ ID NO: 27752

SEQ ID NO: 48118 - DNA, 1170 bp, Synechococcus elongatus; identical to SEQ ID NO: 27753
  CDS (1)..(1170)

SEQ ID NO: 48119 - protein, 389 aa, Synechococcus elongatus; identical to SEQ ID NO: 27754

SEQ ID NO: 48120 - DNA, 1158 bp, Synechococcus elongatus; identical to SEQ ID NO: 27755
  CDS (1)..(1158)

SEQ ID NO: 48121 - protein, 385 aa, Synechococcus elongatus; identical to SEQ ID NO: 27756

SEQ ID NO: 48122 - DNA, 870 bp, Streptococcus mutans; identical to SEQ ID NO: 27757
  CDS (1)..(870)

SEQ ID NO: 48123 - protein, 289 aa, Streptococcus mutans; identical to SEQ ID NO: 27758

SEQ ID NO: 48124 - DNA, 957 bp, Streptococcus mutans; identical to SEQ ID NO: 27759
  CDS (1)..(957)

SEQ ID NO: 48125 - protein, 318 aa, Streptococcus mutans; identical to SEQ ID NO: 27760

SEQ ID NO: 48126 - DNA, 870 bp, Streptococcus agalactiae; identical to SEQ ID NO: 27761
  CDS (1)..(870)

SEQ ID NO: 48127 - protein, 289 aa, Streptococcus agalactiae; identical to SEQ ID NO: 27762

SEQ ID NO: 48128 - DNA, 954 bp, Streptococcus agalactiae; identical to SEQ ID NO: 27763
  CDS (1)..(954)

SEQ ID NO: 48129 - protein, 317 aa, Streptococcus agalactiae; identical to SEQ ID NO: 27764

SEQ ID NO: 48130 - DNA, 987 bp, Oceanobacillus iheyensis; identical to SEQ ID NO: 27765
  CDS (1)..(987)

SEQ ID NO: 48131 - protein, 328 aa, Oceanobacillus iheyensis; identical to SEQ ID NO: 27766

SEQ ID NO: 48132 - DNA, 864 bp, Oceanobacillus iheyensis; identical to SEQ ID NO: 27767
  CDS (1)..(864)

SEQ ID NO: 48133 - protein, 287 aa, Oceanobacillus iheyensis; identical to SEQ ID NO: 27768

SEQ ID NO: 48134 - DNA, 885 bp, Corynebacterium efficiens; identical to SEQ ID NO: 27769
  CDS (1)..(885)

SEQ ID NO: 48135 - protein, 294 aa, Corynebacterium efficiens; identical to SEQ ID NO: 27770

SEQ ID NO: 48136 - DNA, 870 bp, Brucella suis; identical to SEQ ID NO: 27771
  CDS (1)..(870)

SEQ ID NO: 48137 - protein, 289 aa, Brucella suis; identical to SEQ ID NO: 27772

SEQ ID NO: 48138 - DNA, 888 bp, Brucella suis; identical to SEQ ID NO: 27773
  CDS (1)..(888)

SEQ ID NO: 48139 - protein, 295 aa, Brucella suis; identical to SEQ ID NO: 27774

SEQ ID NO: 48140 - DNA, 870 bp, Brucella suis; identical to SEQ ID NO: 27775
  CDS (1)..(870)

SEQ ID NO: 48141 - protein, 289 aa, Brucella suis; identical to SEQ ID NO: 27776

SEQ ID NO: 48142 - DNA, 885 bp, Brucella suis; identical to SEQ ID NO: 27777
  CDS (1)..(885)

SEQ ID NO: 48143 - protein, 294 aa, Brucella suis; identical to SEQ ID NO: 27778

SEQ ID NO: 48144 - DNA, 909 bp, Brucella suis; identical to SEQ ID NO: 27779
  CDS (1)..(909)

SEQ ID NO: 48145 - protein, 302 aa, Brucella suis; identical to SEQ ID NO: 27780

SEQ ID NO: 48146 - DNA, 1077 bp, Bifidobacterium longum; identical to SEQ ID NO: 27781
  CDS (1)..(1077)

SEQ ID NO: 48147 - protein, 358 aa, Bifidobacterium longum; identical to SEQ ID NO: 27782

SEQ ID NO: 48148 - DNA, 927 bp, Bifidobacterium longum; identical to SEQ ID NO: 27783
  CDS (1)..(927)

SEQ ID NO: 48149 - protein, 308 aa, Bifidobacterium longum; identical to SEQ ID NO: 27784

SEQ ID NO: 48150 - DNA, 822 bp, Pseudomonas resinovorans; identical to SEQ ID NO: 27785
  CDS (1)..(822)

SEQ ID NO: 48151 - protein, 273 aa, Pseudomonas resinovorans; identical to SEQ ID NO: 27786

SEQ ID NO: 48152 - DNA, 1080 bp, Corynebacterium glutamicum; identical to SEQ ID NO: 27787
  CDS (1)..(1080)

SEQ ID NO: 48153 - protein, 359 aa, Corynebacterium glutamicum; identical to SEQ ID NO: 27788

SEQ ID NO: 48154 - DNA, 885 bp, Corynebacterium glutamicum; identical to SEQ ID NO: 27789
  CDS (1)..(885)

SEQ ID NO: 48155 - protein, 294 aa, Corynebacterium glutamicum; identical to SEQ ID NO: 27790

SEQ ID NO: 48156 - DNA, 927 bp, Fusobacterium nucleatum; identical to SEQ ID NO: 27791
  CDS (1)..(927)

SEQ ID NO: 48157 - protein, 308 aa, Fusobacterium nucleatum; identical to SEQ ID NO: 27792

SEQ ID NO: 48158 - DNA, 858 bp, Fusobacterium nucleatum; identical to SEQ ID NO: 27793
  CDS (1)..(858)

SEQ ID NO: 48159 - protein, 285 aa, Fusobacterium nucleatum; identical to SEQ ID NO: 27794

SEQ ID NO: 48160 - DNA, 873 bp, Rhizobium leguminosarum; identical to SEQ ID NO: 27795
  CDS (1)..(873)

SEQ ID NO: 48161 - protein, 290 aa, Rhizobium leguminosarum; identical to SEQ ID NO: 27796

SEQ ID NO: 48162 - DNA, 885 bp, Burkholderia cepacia; identical to SEQ ID NO: 27797
  CDS (1)..(885)

SEQ ID NO: 48163 - protein, 294 aa, Burkholderia cepacia; identical to SEQ ID NO: 27798

SEQ ID NO: 48164 - DNA, 1827 bp, Ralstonia solanacearum; identical to SEQ ID NO: 27799
  CDS (1)..(1827)

SEQ ID NO: 48165 - protein, 608 aa, Ralstonia solanacearum; identical to SEQ ID NO: 27800

SEQ ID NO: 48166 - DNA, 900 bp, Ralstonia solanacearum; identical to SEQ ID NO: 27801
  CDS (1)..(900)

SEQ ID NO: 48167 - protein, 299 aa, Ralstonia solanacearum; identical to SEQ ID NO: 27802

SEQ ID NO: 48168 - DNA, 882 bp, Ralstonia solanacearum; identical to SEQ ID NO: 27803
  CDS (1)..(882)

SEQ ID NO: 48169 - protein, 293 aa, Ralstonia solanacearum; identical to SEQ ID NO: 27804

SEQ ID NO: 48170 - DNA, 942 bp, Ralstonia solanacearum; identical to SEQ ID NO: 27805
  CDS (1)..(942)

SEQ ID NO: 48171 - protein, 313 aa, Ralstonia solanacearum; identical to SEQ ID NO: 27806

SEQ ID NO: 48172 - DNA, 936 bp, Ralstonia solanacearum; identical to SEQ ID NO: 27807
  CDS (1)..(936)

SEQ ID NO: 48173 - protein, 311 aa, Ralstonia solanacearum; identical to SEQ ID NO: 27808

SEQ ID NO: 48174 - DNA, 1137 bp, Ralstonia solanacearum; identical to SEQ ID NO: 27809
  CDS (1)..(1137)

SEQ ID NO: 48175 - protein, 378 aa, Ralstonia solanacearum; identical to SEQ ID NO: 27810

SEQ ID NO: 48176 - DNA, 870 bp, Ralstonia solanacearum; identical to SEQ ID NO: 27811
  CDS (1)..(870)

SEQ ID NO: 48177 - protein, 289 aa, Ralstonia solanacearum; identical to SEQ ID NO: 27812

SEQ ID NO: 48178 - DNA, 1617 bp, Ralstonia solanacearum; identical to SEQ ID NO: 27813
  CDS (1)..(1617)

SEQ ID NO: 48179 - protein, 538 aa, Ralstonia solanacearum; identical to SEQ ID NO: 27814

SEQ ID NO: 48180 - DNA, 948 bp, Ralstonia solanacearum; identical to SEQ ID NO: 27815
  CDS (1)..(948)

SEQ ID NO: 48181 - protein, 315 aa, Ralstonia solanacearum; identical to SEQ ID NO: 27816

SEQ ID NO: 48182 - DNA, 960 bp, Pyrobaculum aerophilum; identical to SEQ ID NO: 27817
  CDS (1)..(960)

SEQ ID NO: 48183 - protein, 319 aa, Pyrobaculum aerophilum; identical to SEQ ID NO: 27818

SEQ ID NO: 48184 - DNA, 960 bp, Pyrobaculum aerophilum; identical to SEQ ID NO: 27819
  CDS (1)..(960)

SEQ ID NO: 48185 - protein, 319 aa, Pyrobaculum aerophilum; identical to SEQ ID NO: 27820

SEQ ID NO: 48186 - DNA, 873 bp, Pyrobaculum aerophilum; identical to SEQ ID NO: 27821
  CDS (1)..(873)

SEQ ID NO: 48187 - protein, 290 aa, Pyrobaculum aerophilum; identical to SEQ ID NO: 27822

SEQ ID NO: 48188 - DNA, 888 bp, Rhizobium meliloti; identical to SEQ ID NO: 27823
  CDS (1)..(888)

SEQ ID NO: 48189 - protein, 295 aa, Rhizobium meliloti; identical to SEQ ID NO: 27824

SEQ ID NO: 48190 - DNA, 891 bp, Rhizobium meliloti; identical to SEQ ID NO: 27825
  CDS (1)..(891)

SEQ ID NO: 48191 - protein, 296 aa, Rhizobium meliloti; identical to SEQ ID NO: 27826

SEQ ID NO: 48192 - DNA, 903 bp, Rhizobium meliloti; identical to SEQ ID NO: 27827
  CDS (1)..(903)

SEQ ID NO: 48193 - protein, 300 aa, Rhizobium meliloti; identical to SEQ ID NO: 27828

SEQ ID NO: 48194 - DNA, 897 bp, Rhizobium meliloti; identical to SEQ ID NO: 27829
  CDS (1)..(897)

SEQ ID NO: 48195 - protein, 298 aa, Rhizobium meliloti; identical to SEQ ID NO: 27830

SEQ ID NO: 48196 - DNA, 942 bp, Synechococcus sp; identical to SEQ ID NO: 27831
  CDS (1)..(942)

SEQ ID NO: 48197 - protein, 313 aa, Synechococcus sp; identical to SEQ ID NO: 27832

SEQ ID NO: 48198 - DNA, 1011 bp, Rhizobium loti; identical to SEQ ID NO: 27833
  CDS (1)..(1011)

SEQ ID NO: 48199 - protein, 336 aa, Rhizobium loti; identical to SEQ ID NO: 27834

SEQ ID NO: 48200 - DNA, 897 bp, Rhizobium loti; identical to SEQ ID NO: 27835
  CDS (1)..(897)

SEQ ID NO: 48201 - protein, 298 aa, Rhizobium loti; identical to SEQ ID NO: 27836

SEQ ID NO: 48202 - DNA, 909 bp, Rhizobium loti; identical to SEQ ID NO: 27837
  CDS (1)..(909)

SEQ ID NO: 48203 - protein, 302 aa, Rhizobium loti; identical to SEQ ID NO: 27838

SEQ ID NO: 48204 - DNA, 900 bp, Rhizobium loti; identical to SEQ ID NO: 27839
  CDS (1)..(900)

SEQ ID NO: 48205 - protein, 299 aa, Rhizobium loti; identical to SEQ ID NO: 27840

SEQ ID NO: 48206 - DNA, 906 bp, Rhizobium loti; identical to SEQ ID NO: 27841
  CDS (1)..(906)

SEQ ID NO: 48207 - protein, 301 aa, Rhizobium loti; identical to SEQ ID NO: 27842

SEQ ID NO: 48208 - DNA, 882 bp, Rhizobium loti; identical to SEQ ID NO: 27843
  CDS (1)..(882)

SEQ ID NO: 48209 - protein, 293 aa, Rhizobium loti; identical to SEQ ID NO: 27844

SEQ ID NO: 48210 - DNA, 963 bp, Rhizobium loti; identical to SEQ ID NO: 27845
  CDS (1)..(963)

SEQ ID NO: 48211 - protein, 320 aa, Rhizobium loti; identical to SEQ ID NO: 27846

SEQ ID NO: 48212 - DNA, 867 bp, Agrobacterium tumefaciens; identical to SEQ ID NO: 27847
  CDS (1)..(867)

SEQ ID NO: 48213 - protein, 288 aa, Agrobacterium tumefaciens; identical to SEQ ID NO: 27848

SEQ ID NO: 48214 - DNA, 1716 bp, Pseudomonas resinovorans; identical to SEQ ID NO: 27849
  CDS (1)..(1716)

SEQ ID NO: 48215 - protein, 571 aa, Pseudomonas resinovorans; identical to SEQ ID NO: 27850

SEQ ID NO: 48216 - DNA, 873 bp, Streptomyces coelicolor; identical to SEQ ID NO: 27851
  CDS (1)..(873)

SEQ ID NO: 48217 - protein, 290 aa, Streptomyces coelicolor; identical to SEQ ID NO: 27852

SEQ ID NO: 48218 - DNA, 900 bp, Streptomyces coelicolor; identical to SEQ ID NO: 27853
  CDS (1)..(900)

SEQ ID NO: 48219 - protein, 299 aa, Streptomyces coelicolor; identical to SEQ ID NO: 27854

SEQ ID NO: 48220 - DNA, 26 bp, Primer
atgtctgagcagtttttgtatttctt

SEQ ID NO: 48221 - DNA, 24 bp, Primer
ttatactttctctacctccgggcg

SEQ ID NO: 48222 - protein, 43 aa, consensus; identical to SEQ ID NO: 28576
  MISC_FEATURE (1)..(43): consensus for the disclosure of xaa see table XV

SEQ ID NO: 48223 - protein, 80 aa, consensus; identical to SEQ ID NO: 28577
  MISC_FEATURE (1)..(80): consensus for the disclosure of xaa see table XV

SEQ ID NO: 48224 - DNA, 378 bp, Escherichia coli; identical to SEQ ID NO: 44321
  CDS (1)..(378)

SEQ ID NO: 48225 - protein, 125 aa, Escherichia coli; identical to SEQ ID NO: 44322

SEQ ID NO: 48226 - DNA, 474 bp, Gluconobacter oxydans 621H; identical to SEQ ID NO: 44323
  CDS (1)..(474)

SEQ ID NO: 48227 - protein, 157 aa, Gluconobacter oxydans 621H; identical to SEQ ID NO: 44324

SEQ ID NO: 48228 - DNA, 405 bp, Wolbachia endosymbiont strain TRS of Brugia malayi; identical to SEQ ID NO: 44325
  CDS (1)..(405)

SEQ ID NO: 48229 - protein, 134 aa, Wolbachia endosymbiont strain TRS of Brugia malayi; identical to SEQ ID NO: 44326

SEQ ID NO: 48230 - DNA, 384 bp, Xanthomonas oryzae pv. oryzae KACC10331; identical to SEQ ID NO: 44327
  CDS (1)..(384)

SEQ ID NO: 48231 - protein, 127 aa, Xanthomonas oryzae pv. oryzae KACC10331; identical to SEQ ID NO: 44328

SEQ ID NO: 48232 - DNA, 465 bp, Caulobacter crescentus CB15; identical to SEQ ID NO: 44329
  CDS (1)..(465)

SEQ ID NO: 48233 - protein, 154 aa, Caulobacter crescentus CB15; identical to SEQ ID NO: 44330

SEQ ID NO: 48234 - DNA, 402 bp, Agrobacterium tumefaciens str. C58; identical to SEQ ID NO: 44331
  CDS (1)..(402)

SEQ ID NO: 48235 - protein, 133 aa, Agrobacterium tumefaciens str. C58; identical to SEQ ID NO: 44332

SEQ ID NO: 48236 - DNA, 426 bp, Brucella melitensis 16M; identical to SEQ ID NO: 44333
  CDS (1)..(426)

SEQ ID NO: 48237 - protein, 141 aa, Brucella melitensis 16M; identical to SEQ ID NO: 44334

SEQ ID NO: 48238 - DNA, 405 bp, Bradyrhizobium japonicum USDA 110; identical to SEQ ID NO: 44335
  CDS (1)..(405)

SEQ ID NO: 48239 - protein, 134 aa, Bradyrhizobium japonicum USDA 110; identical to SEQ ID NO: 44336

SEQ ID NO: 48240 - DNA, 375 bp, Bordetella bronchiseptica RB50; identical to SEQ ID NO: 44337
  CDS (1)..(375)

SEQ ID NO: 48241 - protein, 124 aa, Bordetella bronchiseptica RB50; identical to SEQ ID NO: 44338

SEQ ID NO: 48242 - DNA, 378 bp, Erwinia carotovora subsp. atroseptica SCRI1043; identical to SEQ ID NO: 44339
  CDS (1)..(378)

SEQ ID NO: 48243 - protein, 125 aa, Erwinia carotovora subsp. atroseptica SCRI1043; identical to SEQ ID NO: 44340

SEQ ID NO: 48244 - DNA, 378 bp, Yersinia pseudotuberculosis IP 32953; identical to SEQ ID NO: 44341
  CDS (1)..(378)

SEQ ID NO: 48245 - protein, 125 aa, Yersinia pseudotuberculosis IP 32953; identical to SEQ ID NO: 44342

SEQ ID NO: 48246 - DNA, 381 bp, Methylococcus capsulatus str. Bath; identical to SEQ ID NO: 44343
  CDS (1)..(381)

SEQ ID NO: 48247 - protein, 126 aa, Methylococcus capsulatus str. Bath; identical to SEQ ID NO: 44344

SEQ ID NO: 48248 - DNA, 453 bp, Anaplasma marginale str. St. Maries; identical to SEQ ID NO: 44345
  CDS (1)..(453)

SEQ ID NO: 48249 - protein, 150 aa, Anaplasma marginale str. St. Maries; identical to SEQ ID NO: 44346

SEQ ID NO: 48250 - DNA, 375 bp, Idiomarina loihiensis L2TR; identical to SEQ ID NO: 44347
  CDS (1)..(375)

SEQ ID NO: 48251 - protein, 124 aa, Idiomarina loihiensis L2TR; identical to SEQ ID NO: 44348

SEQ ID NO: 48252 - DNA, 384 bp, Azoarcus sp. EbN1; identical to SEQ ID NO: 44349
  CDS (1)..(384)

SEQ ID NO: 48253 - protein, 127 aa, Azoarcus sp. EbN1; identical to SEQ ID NO: 44350

SEQ ID NO: 48254 - DNA, 405 bp, Ehrlichia ruminantium str. Welgevonden; identical to SEQ ID NO: 44351
  CDS (1)..(405)

SEQ ID NO: 48255 - protein, 134 aa, Ehrlichia ruminantium str. Welgevonden; identical to SEQ ID NO: 44352

SEQ ID NO: 48256 - DNA, 384 bp, Xylella fastidiosa Ann-1; identical to SEQ ID NO: 44353
  CDS (1)..(384)

SEQ ID NO: 48257 - protein, 127 aa, Xylella fastidiosa Ann-1; identical to SEQ ID NO: 44354

SEQ ID NO: 48258 - DNA, 393 bp, Magnetospirillum magnetotacticum MS-1; identical to SEQ ID NO: 44355
  CDS (1)..(393)

SEQ ID NO: 48259 - protein, 130 aa, Magnetospirillum magnetotacticum MS-1; identical to SEQ ID NO: 44356

SEQ ID NO: 48260 - DNA, 393 bp, Magnetospirillum magnetotacticum MS-1; identical to SEQ ID NO: 44357
  CDS (1)..(393)

SEQ ID NO: 48261 - protein, 130 aa, Magnetospirillum magnetotacticum MS-1; identical to SEQ ID NO: 44358

SEQ ID NO: 48262 - DNA, 381 bp, Azotobacter vinelandii; identical to SEQ ID NO: 44359
  CDS (1)..(381)

SEQ ID NO: 48263 - protein, 126 aa, Azotobacter vinelandii; identical to SEQ ID NO: 44360

SEQ ID NO: 48264 - DNA, 384 bp, Desulfitobacterium hafniense DCB-2; identical to SEQ ID NO: 44361
  CDS (1)..(384)

SEQ ID NO: 48265 - protein, 127 aa, Desulfitobacterium hafniense DCB-2; identical to SEQ ID NO: 44362

SEQ ID NO: 48266 - DNA, 384 bp, Methylobacillus flagellatus KT; identical to SEQ ID NO: 44363
  CDS (1)..(384)

SEQ ID NO: 48267 - protein, 127 aa, Methylobacillus flagellatus KT; identical to SEQ ID NO: 44364

SEQ ID NO: 48268 - DNA, 393 bp, Mesorhizobium sp. BNC1; identical to SEQ ID NO: 44365
  CDS (1)..(393)

SEQ ID NO: 48269 - protein, 130 aa, Mesorhizobium sp. BNC1; identical to SEQ ID NO: 44366

SEQ ID NO: 48270 - DNA, 384 bp, Ehrlichia canis str. Jake; identical to SEQ ID NO: 44367
  CDS (1)..(384)

SEQ ID NO: 48271 - protein, 127 aa, Ehrlichia canis str. Jake; identical to SEQ ID NO: 44368

SEQ ID NO: 48272 - DNA, 375 bp, Rubrivivax gelatinosus PM1; identical to SEQ ID NO: 44369
  CDS (1)..(375)

SEQ ID NO: 48273 - protein, 124 aa, Rubrivivax gelatinosus PM1; identical to SEQ ID NO: 44370

SEQ ID NO: 48274 - DNA, 381 bp, Pseudomonas fluorescens PfO-1; identical to SEQ ID NO: 44371
  CDS (1)..(381)

SEQ ID NO: 48275 - protein, 126 aa, Pseudomonas fluorescens PfO-1; identical to SEQ ID NO: 44372

SEQ ID NO: 48276 - DNA, 408 bp, Rhodospirillum rubrum; identical to SEQ ID NO: 44373
  CDS (1)..(408)

SEQ ID NO: 48277 - protein, 135 aa, Rhodospirillum rubrum; identical to SEQ ID NO: 44374

SEQ ID NO: 48278 - DNA, 375 bp, Ralstonia metallidurans CH34; identical to SEQ ID NO: 44375
  CDS (1)..(375)

SEQ ID NO: 48279 - protein, 124 aa, Ralstonia metallidurans CH34; identical to SEQ ID NO: 44376

SEQ ID NO: 48280 - DNA, 375 bp, Burkholderia fungorum LB400; identical to SEQ ID NO: 44377
  CDS (1)..(375)

SEQ ID NO: 48281 - protein, 124 aa, Burkholderia fungorum LB400; identical to SEQ ID NO: 44378

SEQ ID NO: 48282 - DNA, 381 bp, Magnetococcus sp. MC-1; identical to SEQ ID NO: 44379
  CDS (1)..(381)

SEQ ID NO: 48283 - protein, 126 aa, Magnetococcus sp. MC-1; identical to SEQ ID NO: 44380

SEQ ID NO: 48284 - DNA, 399 bp, Novosphingobium aromaticivorans DSM 12444; identical to SEQ ID NO: 44381
  CDS (1)..(399)

SEQ ID NO: 48285 - protein, 132 aa, Novosphingobium aromaticivorans DSM 12444; identical to SEQ ID NO: 44382

SEQ ID NO: 48286 - DNA, 387 bp, Cytophaga hutchinsonii; identical to SEQ ID NO: 44383
  CDS (1)..(387)

SEQ ID NO: 48287 - protein, 128 aa, Cytophaga hutchinsonii; identical to SEQ ID NO: 44384

SEQ ID NO: 48288 - DNA, 372 bp, Microbulbifer degradans 2-40; identical to SEQ ID NO: 44385
  CDS (1)..(372)

SEQ ID NO: 48289 - protein, 123 aa, Microbulbifer degradans 2-40; identical to SEQ ID NO: 44386

SEQ ID NO: 48290 - DNA, 384 bp, Thiobacillus denitrificans ATCC 25259; identical to SEQ ID NO: 44387
  CDS (1)..(384)

SEQ ID NO: 48291 - protein, 127 aa, Thiobacillus denitrificans ATCC 25259; identical to SEQ ID NO: 44388

SEQ ID NO: 48292 - DNA, 384 bp, Dechloromonas aromatica RCB; identical to SEQ ID NO: 44389
  CDS (1)..(384)

SEQ ID NO: 48293 - protein, 127 aa, Dechloromonas aromatica RCB; identical to SEQ ID NO: 44390

SEQ ID NO: 48294 - DNA, 414 bp, Chloroflexus aurantiacus; identical to SEQ ID NO: 44391
  CDS (1)..(414)

SEQ ID NO: 48295 - protein, 137 aa, Chloroflexus aurantiacus; identical to SEQ ID NO: 44392

SEQ ID NO: 48296 - DNA, 396 bp, Polaromonas sp. JS666; identical to SEQ ID NO: 44393
  CDS (1)..(396)

SEQ ID NO: 48297 - protein, 131 aa, Polaromonas sp. JS666; identical to SEQ ID NO: 44394

SEQ ID NO: 48298 - DNA, 903 bp, Oryza sativa; identical to SEQ ID NO: 44395
  CDS (1)..(903)

SEQ ID NO: 48299 - protein, 300 aa, Oryza sativa; identical to SEQ ID NO: 44396

SEQ ID NO: 48300 - DNA, 384 bp, Bdellovibrio bacteriovorus; identical to SEQ ID NO: 44397
  CDS (1)..(384)

SEQ ID NO: 48301 - protein, 127 aa, Bdellovibrio bacteriovorus; identical to SEQ ID NO: 44398

SEQ ID NO: 48302 - DNA, 393 bp, Brucella suis; identical to SEQ ID NO: 44399
  CDS (1)..(393)

SEQ ID NO: 48303 - protein, 130 aa, Brucella suis; identical to SEQ ID NO: 44400

SEQ ID NO: 48304 - DNA, 381 bp, Chromobacterium violaceum; identical to SEQ ID NO: 44401
  CDS (1)..(381)

SEQ ID NO: 48305 - protein, 126 aa, Chromobacterium violaceum; identical to SEQ ID NO: 44402

SEQ ID NO: 48306 - DNA, 387 bp, Deinococcus radiodurans; identical to SEQ ID NO: 44403
  CDS (1)..(387)

SEQ ID NO: 48307 - protein, 128 aa, Deinococcus radiodurans; identical to SEQ ID NO: 44404

SEQ ID NO: 48308 - DNA, 384 bp, Nitrosomonas europaea; identical to SEQ ID NO: 44405
  CDS (1)..(384)

SEQ ID NO: 48309 - protein, 127 aa, Nitrosomonas europaea; identical to SEQ ID NO: 44406

SEQ ID NO: 48310 - DNA, 378 bp, Photorhabdus luminescens; identical to SEQ ID NO: 44407
  CDS (1)..(378)

SEQ ID NO: 48311 - protein, 125 aa, Photorhabdus luminescens; identical to SEQ ID NO: 44408

SEQ ID NO: 48312 - DNA, 384 bp, Photobacterium profundum; identical to SEQ ID NO: 44409
  CDS (1)..(384)

SEQ ID NO: 48313 - protein, 127 aa, Photobacterium profundum; identical to SEQ ID NO: 44410

SEQ ID NO: 48314 - DNA, 381 bp, Pseudomonas aeruginosa; identical to SEQ ID NO: 44411
  CDS (1)..(381)

SEQ ID NO: 48315 - protein, 126 aa, Pseudomonas aeruginosa; identical to SEQ ID NO: 44412

SEQ ID NO: 48316 - DNA, 375 bp, Ralstonia solanacearum; identical to SEQ ID NO: 44413
  CDS (1)..(375)

SEQ ID NO: 48317 - protein, 124 aa, Ralstonia solanacearum; identical to SEQ ID NO: 44414

SEQ ID NO: 48318 - DNA, 393 bp, Rhizobium etli; identical to SEQ ID NO: 44415
  CDS (1)..(393)

SEQ ID NO: 48319 - protein, 130 aa, Rhizobium etli; identical to SEQ ID NO: 44416

SEQ ID NO: 48320 - DNA, 393 bp, Rhizobium loti; identical to SEQ ID NO: 44417
  CDS (1)..(393)

SEQ ID NO: 48321 - protein, 130 aa, Rhizobium loti; identical to SEQ ID NO: 44418

SEQ ID NO: 48322 - DNA, 393 bp, Rhodopseudomonas palustris; identical to SEQ ID NO: 44419
  CDS (1)..(393)

SEQ ID NO: 48323 - protein, 130 aa, Rhodopseudomonas palustris; identical to SEQ ID NO: 44420

SEQ ID NO: 48324 - DNA, 378 bp, Salmonella typhi; identical to SEQ ID NO: 44421
  CDS (1)..(378)

SEQ ID NO: 48325 - protein, 125 aa, Salmonella typhi; identical to SEQ ID NO: 44422

SEQ ID NO: 48326 - DNA, 378 bp, Salmonella typhimurium; identical to SEQ ID NO: 44423
  CDS (1)..(378)

SEQ ID NO: 48327 - protein, 125 aa, Salmonella typhimurium; identical to SEQ ID NO: 44424

SEQ ID NO: 48328 - DNA, 381 bp, Shewanella oneidensis; identical to SEQ ID NO: 44425
  CDS (1)..(381)

SEQ ID NO: 48329 - protein, 126 aa, Shewanella oneidensis; identical to SEQ ID NO: 44426

SEQ ID NO: 48330 - DNA, 381 bp, Vibrio cholerae; identical to SEQ ID NO: 44427
  CDS (1)..(381)

SEQ ID NO: 48331 - protein, 126 aa, Vibrio cholerae; identical to SEQ ID NO: 44428

SEQ ID NO: 48332 - DNA, 381 bp, Vibrio parahaemolyticus; identical to SEQ ID NO: 44429
  CDS (1)..(381)

SEQ ID NO: 48333 - protein, 126 aa, Vibrio parahaemolyticus; identical to SEQ ID NO: 44430

SEQ ID NO: 48334 - DNA, 402 bp, Wolbachia pipientis wMel; identical to SEQ ID NO: 44431
  CDS (1)..(402)

SEQ ID NO: 48335 - protein, 133 aa, Wolbachia pipientis wMel; identical to SEQ ID NO: 44432

SEQ ID NO: 48336 - DNA, 384 bp, Xanthomonas campestris; identical to SEQ ID NO: 44433
  CDS (1)..(384)

SEQ ID NO: 48337 - protein, 127 aa, Xanthomonas campestris; identical to SEQ ID NO: 44434

SEQ ID NO: 48338 - DNA, 384 bp, Xylella fastidiosa; identical to SEQ ID NO: 44435
  CDS (1)..(384)

SEQ ID NO: 48339 - protein, 127 aa, Xylella fastidiosa; identical to SEQ ID NO: 44436

SEQ ID NO: 48340 - DNA, 23 bp, Primer
atgatcaattcgccccgagtgtg

SEQ ID NO: 48341 - DNA, 24 bp, Primer
ttaatgaatgagtgtgggaacggc

SEQ ID NO: 48342 - protein, 78 aa, consensus; identical to SEQ ID NO: 44439
  MISC_FEATURE (1)..(78): consensus for the disclosure of xaa see table XV

SEQ ID NO: 48343 - protein, 112 aa, consensus; identical to SEQ ID NO: 44440
  MISC_FEATURE (1)..(112): consensus for the disclosure of xaa see table XV

SEQ ID NO: 48344 - protein, 114 aa, consensus; identical to SEQ ID NO: 44441
  MISC_FEATURE (1)..(114): consensus for the disclosure of xaa see table XV

SEQ ID NO: 48345 - DNA, 858 bp, Escherichia coli; identical to SEQ ID NO: 44442
  CDS (1)..(858)

SEQ ID NO: 48346 - protein, 285 aa, Escherichia coli; identical to SEQ ID NO: 44443

SEQ ID NO: 48347 - DNA, 693 bp, Escherichia coli K12; identical to SEQ ID NO: 44444
  CDS (1)..(693)

SEQ ID NO: 48348 - protein, 230 aa, Escherichia coli K12; identical to SEQ ID NO: 44445

SEQ ID NO: 48349 - DNA, 20 bp, Primer
atgacacaggcagaacgccg

SEQ ID NO: 48350 - DNA, 24 bp, Primer
ttattcctgattgtcagggttcga

SEQ ID NO: 48351 - protein, 228 aa, consensus; identical to SEQ ID NO: 44448
  MISC_FEATURE (1)..(228): consensus for the disclosure of xaa see table XV

SEQ ID NO: 48352 - DNA, 1158 bp, Escherichia coli
  CDS (1)..(1158)
ttgaaacgtagtctgcttttttctgccgtgctgtgtgcggcgtcattgacctccgtccatgcggcgcagccgatcactgaaccggagtttgcctctgatattgtcgatcgttatgccgatcatattttttacggcagcggtgccacggggatggcgctggttgttatcgacggtaaccagcgcgtctttcgcagttatggcgaaacgcgacctggtaataacgttcgcccgcagctggattcggtcgtgcgtattgcttccctcaccaagctaatgaccagtgagatgctggtgaaattgctcgaccaggggaccgtgaagttaaacgatccgctaagtaaatatgctccgccaggcgcacgcgtgccaacctacaatgggacgcccattacgctggtcaatctggcaacccataccagcgccctgccccgtgaacagcccggtggcgcggcacatcgtccggtgtttgtctggccaacgcgcgagcaacgctggaaatacctttctacggcgaagctgaaagccgcgccaggcagtcaggcggcgtactctaaccttgcgttcgacctgctggcagatgcactggcgaatgcgtccggcaagccttatacccagttgtttgaagagcagattacccgtccattggggatgaaagacaccacctacactccctcaccggatcagtgccgccgtttaatggttgctgagcgcggtgccagtccgtgcaataacacgctggcggcaattggcagcggcggcgtctattccacgcctggcgatatgatgcgctggatgcagcagtatttgtcatctgatttttatcagcgcagtaaccaggcagatcgcatgcagacgttgatttatcagcgcgcgcagtttacgaaagtgattggcatggatgtccccggcaaagcggatgcgcttggtttaggctgggtatatatggccccgaaagagggtcgtccggggattattcagaagacaggtggtggtggcggtttcattacctatatggcgatgatcccgcagaagaatattggcgcgtttgtggtggtcactcgttcgccgttgacgcgctttaaaaatatgagcgatggcatcaatgatctggtgaccgagctaagcgggaataaaccgttggttatccccgcatcctga

SEQ ID NO: 48353 - protein, 385 aa, Escherichia coli
MKRSLLFSAVLCAASLTSVHAAQPITEPEFASDIVDRYADHIFYGSGATGMALVVIDGNQRVFRSYGETRPGNNVRPQLDSVVRIASLTKLMTSEMLVKLLDQGTVKLNDPLSKYAPPGARVPTYNGTPITLVNLATHTSALPREQPGGAAHRPVFVWPTREQRWKYLSTAKLKAAPGSQAAYSNLAFDLLADALANASGKPYTQLFEEQITRPLGMKDTTYTPSPDQCRRLMVAERGASPCNNTLAAIGSGGVYSTPGDMMRWMQQYLSSDFYQRSNQADRMQTLIYQRAQFTKVIGMDVPGKADALGLGWVYMAPKEGRPGIIQKTGGGGGFITYMAMIPQKNIGAFVVVTRSPLTRFKNMSDGINDLVTELSGNKPLVIPAS

SEQ ID NO: 48354 - DNA, 1557 bp, Mesorhizobium loti MAFF303099
  CDS (1)..(1557)
gtgcggctggatcggaacccctggcattggcgaatctgggtctgcatcgccgtactggcgctttggccgcgtgccgcgtcggccgacaccatcacgccggagcgcatcgcagacgccctgtcgaagctcgacgcgctcgcccaaggcgcggtcgcggacggaggcgtgcccggtcttgccatcgcggtggtgcacgacgatgaggtgatcttcctcagaggtttcggccatcgcgaggcgggcaagcctgaggcggtcgacgccgacacggtgttccagatcgcctcgctttccaagccggtctccgccaccgtcgtggcggcgctggtgagcgacgggatcgtgtcctgggattcgaaggtcgccgacctcgatcccgccttccggctggccgatccctatccgaccagccaactcaccgtccgcgacctgttttcgcaccgcagcggactgcccggcaccgccggagacgacctcgaggacataggctacgaccgcgccgagatcctgcatcgcttgcggttcgtgccgccatcgtcgagcttccgtgccggctactcctacagcaatttcggactgaccgagggcgccgtcgcggccgcaatgccgacaggcaagtcctgggaggaggtcgcgcaggagaagctctaccgtccgctcggcatggcctcgactagttcccgtcattcggatttcgtcaagcacgccgatcgtgccgcgctgcacatcaaggtcgatggcgcctgggccgccaagatagagcgcgatccggatgcgcaggcgcccgcgggcggcgtcagttccaccgcgcgcgatctctcgcaatgggtgcgcctcattcttggcaacggggtctatgccggcaagacgctgattgccgccgatgcgctggatcagacgcatgtgccgctgatgacgcgcggcaagaatcctgtctccggcggcgagtccttctacggcctcggctggaatgtcgaattcggccggcatggcctgagctggggccatgccggtgccttcagcgtcggcgcacgcacgctggtgacgatcttcccgcaggataagcttggcatcgtcatcatcgccaacgccttcccgacaggcgtgccggagggattgtccgacagtttcgcggacctcgtcttcgacggttcggttcagaaggactgggttaaggcatgggacggaatctatgccggaatgttcggcccggtagtcgaggcggccaaggccacctatgccgcgccgccatctccggcacggccggccaggccggcaagtgcctatgccggccgctacgccaacgacttcttcggcgacgcggtcgtggcgagtgcgggagacggcctcgtgctcaaggtcggcccgcacggcgcccggtcctattccctggcgcatttcgatggcgatcttttcctgacctatcccgacgccgagacgccggacaggccaaccggcgtgagcttcgtcgtcggcccggacggcaaggcatcggccatgaccattggtttcctcgacgacaatcatctcggtacgttgcggcgtgtgggcgattag

SEQ ID NO: 48355 - protein, 518 aa, Mesorhizobium loti MAFF303099
MRLDRNPWHWRIWVCIAVLALWPRAASADTITPERIADALSKLDALAQGAVADGGVPGLAIAVVHDDEVIFLRGFGHREAGKPEAVDADTVFQIASLSKPVSATVVAALVSDGIVSWDSKVADLDPAFRLADPYPTSQLTVRDLFSHRSGLPGTAGDDLEDIGYDRAEILHRLRFVPPSSSFRAGYSYSNFGLTEGAVAAAMPTGKSWEEVAQEKLYRPLGMASTSSRHSDFVKHADRAALHIKVDGAWAAKIERDPDAQAPAGGVSSTARDLSQWVRLILGNGVYAGKTLIAADALDQTHVPLMTRGKNPVSGGESFYGLGWNVEFGRHGLSWGHAGAFSVGARTLVTIFPQDKLGIVIIANAFPTGVPEGLSDSFADLVFDGSVQKDWVKAWDGIYAGMFGPVVEAAKATYAAPPSPARPARPASAYAGRYANDFFGDAVVASAGDGLVLKVGPHGARSYSLAHFDGDLFLTYPDAETPDRPTGVSFVVGPDGKASAMTIGFLDDNHLGTLRRVGD

SEQ ID NO: 48356 - DNA, 1665 bp, Mesorhizobium loti MAFF303099
  CDS (1)..(1665)
atgagcagactttccgccgctgccatcgagctgttcgaggacctgatccggcagcaggtcgaggacaaggcgatcccctccatctcctatggccttgtcgaccgcgacgggctaatgggggcaggccatatccagcgccatgaccgcggcttcgtcatgggcgacgacacctgtttccgcatcggctcgatcaccaagaccttcaccgccgtcgccgtcatgcagctggccgaaaaggggctggtcgacctcgatgtcgatgtctccgaatatctgcctggcttcaagccacagaacccatttgccgggcgcgaaggcgggccgcacggcgcgcagatcagcctgcgcaaactgatgagccacaccgccggcctggtgcgcgagcccaagagcggccactatctcgacgcggcgcggccgccgctggccgacaccgttgccgaactcgccacctcgacactgaagcaggatccgagccttggccagatgcattattccaacgccggcatcgccgtggccgggagggtcatcgagacgctgacgcgcaagagctatgccgaatacgtcagtgagaacatcctgaagccgcttggcatggaccagacctcgtcgggcctggcgcccggcattgccgagcggctcgcgcctgccgacatgtggacgctggaaggcgacagcccggcgcctgtgttcgaccttggcggcccaccggccggcaacatctattcgaccaccagtgacatggcgcgctatgtccagtgcctgctgcgcggcgggttcgcgccggatggctggcaaatcgtctcgcccggatcgctacgcgagatgtgggtgccgatcggcaagcgcgcctcaggcgaaagggtggcgaacacctatggcctgtgcttcggcgtcggcgacgtcgacggctggacgtcggtcggccatggcggcgccgtctacggttattcgtcccagatgatcctgctgcccgctgccggcgtcggcgtgctgattttctcgacgctggatttctctaatcagataggcgcacggctcggcgtcgagggcctgcgcatcgcgctggccgagcgccgtatgggaacactgccggtgcggccgcagggcctgccgcccgtcgccgccgaccagcttgtggcgctgcctggccactaccggcacgacacctccggcgaagtcgtcgaggtcaaggccaaggccggcaagctctttctgatgggcgaaggcgtgccgttgcagatccgccctgtcgccggttcggatttcaccattgacgggcgtatctatggacacggcgctgaatatccgcacatgaacctgtcgtttcccgctcccggcgcactggtgtggaaaggggtgaactggtcgcgcatcgacgcgctgcccgctgaggcggtgccggccgaaatcgcgccgcacctcggcgaatacggcccggacttcaacatcacctatctgagctacagccatggcgagctgaaatgcctgatcgagtatttctgcacgcacggctgcgagccagtggaggccgggcgctttcgcatgcgcggcctcctctacgaggaggagatcctcgaaatcgacgccatcgacgatcacggccggcgcggcatccgggtcggcccgatgttcctcgagcgccggcacgcgccggccgcctga

SEQ ID NO: 48357 - protein, 554 aa, Mesorhizobium loti MAFF303099
MSRLSAAAIELFEDLIRQQVEDKAIPSISYGLVDRDGLMGAGHIQRHDRGFVMGDDTCFRIGSITKTFTAVAVMQLAEKGLVDLDVDVSEYLPGFKPQNPFAGREGGPHGAQISLRKLMSHTAGLVREPKSGHYLDAARPPLADTVAELATSTLKQDPSLGQMHYSNAGIAVAGRVIETLTRKSYAEYVSENILKPLGMDQTSSGLAPGIAERLAPADMWTLEGDSPAPVFDLGGPPAGNIYSTTSDMARYVQCLLRGGFAPDGWQIVSPGSLREMWVPIGKRASGERVANTYGLCFGVGDVDGWTSVGHGGAVYGYSSQMILLPAAGVGVLIFSTLDFSNQIGARLGVEGLRIALAERRMGTLPVRPQGLPPVAADQLVALPGHYRHDTSGEVVEVKAKAGKLFLMGEGVPLQIRPVAGSDFTIDGRIYGHGAEYPHMNLSFPAPGALVWKGVNWSRIDALPAEAVPAEIAPHLGEYGPDFNITYLSYSHGELKCLIEYFCTHGCEPVEAGRFRMRGLLYEEEILEIDAIDDHGRRGIRVGPMFLERRHAPAA

SEQ ID NO: 48358 - DNA, 870 bp, Pyrococcus horikoshii OT3
  CDS (1)..(870)
gtgataaccatggaattcgtagaacttgaaagctttatcgttgagaaaatgtcagaaaagaaagttccaggaattagtataagcataattaaggatggagaagtcatatatgcaaagggctttgggtataggaacgtcgaagctaaactcccatcaacgcctgaaacgatatatgggataggttcaataaccaagagcttcacggcattggcaataatgaagcttgccgaggaaggagctctaagcttggaagatccagtagaaaagtacgttaacataaagctgagacccttcgggaaacctgtgaccattcaccaccttcttacccattcttcaggaataccttcccttggatatgccgaggccttcatagagggcatgattggggaagatagatggcttccagttgcttcacccgatcaaataatagcgtttgccaaggatatggagaagtgggccgttgcaaagcctggtgagagatttttctacctaaatacgggttacgttctcctgggaaagataatctctaaagtctcaggagttccctatgaggaatacgtaaggaagaagattttggaacccctcggaatgaagcgctcttactttagcaaggaggaggttgagaaagataaggatgttgccatggggtatatagttgataaagaaggaaagctaattccccagggatttccctacgggattacctccgatggtggattgctaagtaatgtcctggatttggctaagtatctaaagatgtacatggaaagggatgagaaagttgtaagtaaggaatccatagaagcaatggagaaaccatacataaaggttccatgggagctctttggaggggaatcttacgggtattga

SEQ ID NO: 48359 - protein, 289 aa, Pyrococcus horikoshii OT3
MITMEFVELESFIVEKMSEKKVPGISISIIKDGEVIYAKGFGYRNVEAKLPSTPETIYGIGSITKSFTALAIMKLAEEGALSLEDPVEKYVNIKLRPFGKPVTIHHLLTHSSGIPSLGYAEAFIEGMIGEDRWLPVASPDQIIAFAKDMEKWAVAKPGERFFYLNTGYVLLGKIISKVSGVPYEEYVRKKILEPLGMKRSYFSKEEVEKDKDVAMGYIVDKEGKLIPQGFPYGITSDGGLLSNVLDLAKYLKMYMERDEKVVSKESIEAMEKPYIKVPWELFGGESYGY

SEQ ID NO: 48360 - DNA, 1599 bp, Mycobacterium tuberculosis H37Rv
  CDS (1)..(1599)
ttggctactatctgcggccatgaccaaacgagcggcaacggccgccatggtgatgttgctgacgttaacggttgcggatccacgcaccaggcacttggcccgccgtccgggttgcccgatgcctctcccaatgagaggtcagcgatacagatccccgctggccgcatcgacgatgccgtggcaaaggtcgacggcctggtcggcgagctgatgcagaataccggcatacccggaatggcagtggcgatagtccatggcggaaagacgttgtatgccaaagggttcggtgtcagagacgtgggcaaaggtggtggtccggacaacaaggtggacgccgacaccgtctttcagttggcgtcggtgtccaaatcggtcggcgccacggtggtggcgcatgcggtaaccgacaacgtcgtgacctgggatacgcccgtcgtatcgaagctgccgtggtttgcccttcgcgatccctacgtcaccggccaggtaaccattgctgacctctactcgcatcgctccggcctgcccgaccatgcgggcgatctgttggaggatttgggttatgaccgtcgacaggtactgcagcggctgaaatacctgccgctggcaccgtttcgaatcagctatgcctacaccaactttggtgtgaccgcggcggccgaagcggtcgcggccgcggccggccagtcctgggaggacctgtccgacgaggtgctctaccgcccgttggggatggggtctacgagttcccggttcaccgactttctggccaggcccaaccatgcggtcaaccacgtcaaggtcgcagaccgatgggaggcgcgctaccagcgcgatcccgacgcccaatcacctgcgggcggggtgagttcgtctcttaacgacatgacgcactggctggccatggtgctggccgacggcgtgtacaacggccgtcggatcacgtcgccggaggccctgctccccgtctacacgccgcaggtgatctctcgacacccggtgtcaccgagagcgcgggccagcttctatggctacggattcaacgtgggggtaacctcttcgggacgcaccgagtacagccattccggcgccttcgggctgggtgccgcggcgaatttcgtggtgctgccctccgaagacctggccatcatcgcgctgaccaacgccgggcccatcggcgtgccggagacgctgaccgccgaattcatggacttggtgcagtacggccaggtacgcgaggactgggcggccctgtacaagaaggcatttgccccgctgaacgagctcgcgggctcgctggtcggcaagcaatccccggccaacccagcgccgagcagaccgctgaacgactacgtcggcgtgtacgccaacgactactgggggcccgccaccgtgacctaccacgacggccaactgcgcctgtcgctggggccgaagaaccagacgttcgatttgacgcactgggacggcgacactttcacgttcacgttgtcgaccgaaaacgcattgcccggatcgatttccaaggccaccttcgccggcgacacgttaaacctggaatactacgacgccgacaagctgggaacgtttacccgatga

SEQ ID NO: 48361 - protein, 532 aa, Mycobacterium tuberculosis H37Rv
MATICGHDQTSGNGRHGDVADVNGCGSTHQALGPPSGLPDASPNERSAIQIPAGRIDDAVAKVDGLVGELMQNTGIPGMAVAIVHGGKTLYAKGFGVRDVGKGGGPDNKVDADTVFQLASVSKSVGATVVAHAVTDNVVTWDTPVVSKLPWFALRDPYVTGQVTIADLYSHRSGLPDHAGDLLEDLGYDRRQVLQRLKYLPLAPFRISYAYTNFGVTAAAEAVAAAAGQSWEDLSDEVLYRPLGMGSTSSRFTDFLARPNHAVNHVKVADRWEARYQRDPDAQSPAGGVSSSLNDMTHWLAMVLADGVYNGRRITSPEALLPVYTPQVISRHPVSPRARASFYGYGFNVGVTSSGRTEYSHSGAFGLGAAANFVVLPSEDLAIIALTNAGPIGVPETLTAEFMDLVQYGQVREDWAALYKKAFAPLNELAGSLVGKQSPANPAPSRPLNDYVGVYANDYWGPATVTYHDGQLRLSLGPKNQTFDLTHWDGDTFTFTLSTENALPGSISKATFAGDTLNLEYYDADKLGTFTR

SEQ ID NO: 48362 - DNA, 1554 bp, Mycobacterium tuberculosis H37Rv
  CDS (1)..(1554)
ttgtgtccgccgatcatcttgagttccgcgacgccgaccggcacgcggtgcgggacgcgccatgggcgcgcggtcgtcaccgaatacgtgcgtgcgctagatcgactgccgcacgaaatcgccactgcagtggttgaaactgtcaactgcgcagaccctggtgcagcgttcgacgaactcgatgcaaaaatcaacgcgggcatgaaggcctatgcgattccgggcgtcgcggttgctgtctgggccggcgggcaagaatacgtcaaaggctacggggtcaccaatgtcgaccatccgatgcctgttgacggcgacactgtcttcagaatcggttccaccacaaagactttcacaggtacggtgatgatgcggctggtcgagcgaggcaaggtggacctggattcacctgtgcgccgctacatccccgacttcgcggtagccgacgaatcagccagcgctacggttaccgttcgccaactgctcaaccataccgcaggctgggatggtcgcaatgggcaggactttgggcgcggcgatgacgcggtggcgctctatgtcaaggcgatgacacgcctaccgcagctcacccctccgggaaccgcgttcgcgtacaacaattcaggtcttgtggttgcgggccgcatcatcgagcttgtcgccggaacaacctacgaatctacggttcagaggctgttgcttgacccgctgcagcttgctcacacgcgctacttttccgaccaaataatcggtctgaatgtggccgcatcgcatagcgtggtcgacggcaaaccgattgccgttactgacttttggacattcccgcgcagctgcaaccccaccggtgggttgatgtccacagcgcgagatcagctgcgttacgcacagttccacctcggcgacggcagggcgcctaacggtgagcagattctgagccgacaatcgctgaaggcaatgcgctctaaccctggggcgggcggaacactttgggtggaactgaccgggatgggcgtgacctggatgctgcggccctccgcggagaatgtgaccatcgttgagcacggcggcacctggaaggggcagcgctctgggttcgtcatggtgcccgatcgaaacttcgccatgaccgtgctcactaactctgatggcggatttcatatgatcaacgaccttttcgcatccgactgggcattgcagagattcgccgggctcagcaatcttccggccacgccgcaacgccttggtgccgtcgacctggcgccctacgagggccggtacatcgccaagcaagtcgcccaaaatggcgacctcgagacaacggtcatcgacttccgggccagggacggccagcttgctggaagcatgagcaccgacgatgccaacccggatggccaaaacagcgccaatctgggcctcgccttctatcggcccgactatgggctcgaccttggacccgacaacaagcccaccggcagtcgctccaacttcgtgcgcgggccggacggcaacatcgcctggttctgtagccagcacggccgtctgttccgacgccaatag

SEQ ID NO: 48363 - protein, 517 aa, Mycobacterium tuberculosis H37Rv
MCPPIILSSATPTGTRCGTRHGRAVVTEYVRALDRLPHEIATAVVETVNCADPGAAFDELDAKINAGMKAYAIPGVAVAVWAGGQEYVKGYGVTNVDHPMPVDGDTVFRIGSTTKTFTGTVMMRLVERGKVDLDSPVRRYIPDFAVADESASATVTVRQLLNHTAGWDGRNGQDFGRGDDAVALYVKAMTRLPQLTPPGTAFAYNNSGLVVAGRIIELVAGTTYESTVQRLLLDPLQLAHTRYFSDQIIGLNVAASHSVVDGKPIAVTDFWTFPRSCNPTGGLMSTARDQLRYAQFHLGDGRAPNGEQILSRQSLKAMRSNPGAGGTLWVELTGMGVTWMLRPSAENVTIVEHGGTWKGQRSGFVMVPDRNFAMTVLTNSDGGFHMINDLFASDWALQRFAGLSNLPATPQRLGAVDLAPYEGRYIAKQVAQNGDLETTVIDFRARDGQLAGSMSTDDANPDGQNSANLGLAFYRPDYGLDLGPDNKPTGSRSNFVRGPDGNIAWFCSQHGRLFRRQ

SEQ ID NO: 48364 - DNA, 1245 bp, Rickettsia prowazekii str. Madrid E
  CDS (1)..(1245)
atgaaaatttttctttattatcgcacttttgtaaattgtgttctgataggtttggaatttatgatgtctagatattttttattgctattttttttaattactaattgtattgattgttttgcagatatacagcaaagaattcatgaagtagaaaaggaatatctaaataatagatttttaaatacagtttttatgtttgctgatgattataaatctttattaactggcgctaaaggaatttttgctttaaatggtgaacaattaaaggcaaatgaaatgatgcctattgcttctgctacaaagccttttacagccgcaggaatcttaaaattacaagaacaggaattgttgaatattaacgataaaatttgtaaataccttgctccggaaatgtggggtggcaaagtgccggattgggcatgtaaaatatcgattcataatttattaacacatagtagtggtattgcagaatattttagttttgttaaacttgatttaaatatgtctaagcaagaggtacacaaaaaaatattacaatttgtatcttctaagcctttagaaatatctataggaaaaaaatttaaatatagtaatactaattttgtcatactcggtatgattatcgaaaaagttgctaaaaaagatttagctaactttttttatgatgaattttttaaacctctgaacatgaaatctactagttttgcttcatatagtgaagctgctagaattcagaaaaatgttgtgagttctaattatccggtaaggtattttgtaacgcctaataatagcaataagcctacatttactcctgtaactgcagattttttagcagttccttgtgcagatggaggtataatatcaacaccaaacgatctagtaaaatggtatagagcattaaatgaaggaaaaatcctttctaagaagtcgtataaacttatgactactaagtattttgtagcacaaggtatagaaagccgtaagtcttatactggttatggtattttcctgactgatcttgattctaaacatttaatgattcattatactggaaaagcccttggaatacaaagtgcagtagggtatattttgcctaataatatttattttgctatattaagtaatactatgattaaaattcctgaagaagaaaaagataaaattgatatgaaaaatcctttaaatcagcttggaataatttatttcagagatgcaataataggtgcagctataaaaaaggattaa

SEQ ID NO: 48365 - protein, 414 aa, Rickettsia prowazekii str. Madrid E
MKIFLYYRTFVNCVLIGLEFMMSRYFLLLFFLITNCIDCFADIQQRIHEVEKEYLNNRFLNTVFMFADDYKSLLTGAKGIFALNGEQLKANEMMPIASATKPFTAAGILKLQEQELLNINDKICKYLAPEMWGGKVPDWACKISIHNLLTHSSGIAEYFSFVKLDLNMSKQEVHKKILQFVSSKPLEISIGKKFKYSNTNFVILGMIIEKVAKKDLANFFYDEFFKPLNMKSTSFASYSEAARIQKNVVSSNYPVRYFVTPNNSNKPTFTPVTADFLAVPCADGGIISTPNDLVKWYRALNEGKILSKKSYKLMTTKYFVAQGIESRKSYTGYGIFLTDLDSKHLMIHYTGKALGIQSAVGYILPNNIYFAILSNTMIKIPEEEKDKIDMKNPLNQLGIIYFRDAIIGAAIKKD

SEQ ID NO: 48366 - DNA, 1437 bp, Bacillus halodurans C-125
  CDS (1)..(1437)
atgaaaagattagtgacctgctgtatcatcttatttttgttgttttgtttatttctacctagtcgcgagagcttagcaaagccggacatagaaagtacgttggataactatgtagaaacatttctagggacgcatcgtatcccaggtgctgcgattgcgatcgtgcaggatcgtgaaacgatttatgcaaaaagctggggtgtaactggaggatcagaggaagcagtcactctggaaacaccttttttgataggatcggtcactaaatcgttaactgccttggcgatcgtgaaattgctggacgaaaacaagatcatgctggatgacccggtgcaagcgcatctcccatggttcacgcttcaggatcgagcagccgctacacaaataacgatcagacatctcctcgctcatacgagtggacttagtacatacacgggattagctatcgcagatcaagggtctgcagatgaaaacgcgatcgtaagccacgtgcgaaatctagcaactgaggaacttacagctgatcctggagagcaacatcaatatagcaatgcaaactacttaattcttggcgccctcgtagaagaggtgtccggtcagccattttctgaatatatgaagcagcaaattttttcatctcttgggatggagcatgcagcagcggatcatgtaacggcagcaagaaacgggtatctcggcagctatcaatcttggttcggcttcccagtaaaaagtcgcgtctcctatgataacggaggtaccccctatggctacatcgcggccagtgctgaggacatagcttcgtttattaagttccttcaagggaatgggccaaacgactttctaacagaagaaagcctatccttctatttatctcctcttgttcaacagagggaaaatcgctattacggctttggtttgcgactgaccacttttgattctggagagacgatgatttggcattcaggggcaacccctgattcacgggctgaattgttcatcttgccagaacacaaatggggtggcgtgattcttacaaataaaaaccatcgtttagaggaagaagccgtaactcatttacgcgagggcattattcagattttgcatggtgaacaaccactccaggttcctaaaaagcttccaacgattcaatggatcatgatcggattgttgttcatgcttctcataaggttcgtctctttactgaagacgatgaaaagtaacagcactcgtaaaaacatcagttggcggatatgggggctaacgtctattcttttcgctatcctgcttattccaatccttaactatagtgtccatgctccttggcacacgattactgtatttactcctgatgttgcatggcttacgatttttaccgtgattttattgtcgctaaatggccttacctccatttatgtttcattgcgaaaaggttga

SEQ ID NO: 48367 - protein, 478 aa, Bacillus halodurans C-125
MKRLVTCCIILFLLFCLFLPSRESLAKPDIESTLDNYVETFLGTHRIPGAAIAIVQDRETIYAKSWGVTGGSEEAVTLETPFLIGSVTKSLTALAIVKLLDENKIMLDDPVQAHLPWFTLQDRAAATQITIRHLLAHTSGLSTYTGLAIADQGSADENAIVSHVRNLATEELTADPGEQHQYSNANYLILGALVEEVSGQPFSEYMKQQIFSSLGMEHAAADHVTAARNGYLGSYQSWFGFPVKSRVSYDNGGTPYGYIAASAEDIASFIKFLQGNGPNDFLTEESLSFYLSPLVQQRENRYYGFGLRLTTFDSGETMIWHSGATPDSRAELFILPEHKWGGVILTNKNHRLEEEAVTHLREGIIQILHGEQPLQVPKKLPTIQWIMIGLLFMLLIRFVSLLKTMKSNSTRKNISWRIWGLTSILFAILLIPILNYSVHAPWHTITVFTPDVAWLTIFTVILLSLNGLTSIYVSLRKG

SEQ ID NO: 48368 - DNA, 1620 bp, Mycobacterium tuberculosis CDC1551
  CDS (1)..(1620)
ttgacgaagcggatccccccacgaagctgttcagatcggccgccaccggccgggtcgccgcggtccttgtgtccgccgatcatcttgagttccgcgacgccgaccggcacgcggtgcgggacgcgccatgggcgcgcggtcgtcaccgaatacgtgcgtgcgctagatcgactgccgcacgaaatcgccactgcagtggttgaaactgtcaactgcgcagaccctggtgcagcgttcgacgaactcgatgcaaaaatcaacgcgggcatgaaggcctatgcgattccgggcgtcgcggttgctgtctgggccggcgggcaagaatacgtcaaaggctacggggtcaccaatgtcgaccatccgatgcctgttgacggcgacactgtcttcagaatcggttccaccacaaagactttcacaggtacggtgatgatgcggctggtcgagcgaggcaaggtggacctggattcacctgtgcgccgctacatccccgacttcgcggtagccgacgaatcagccagcgctacggttaccgttcgccaactgctcaaccataccgcaggctgggatggtcgcaatgggcaggactttgggcgcggcgatgacgcggtggcgctctatgtcaaggcgatgacacgcctaccgcagctcacccctccgggaaccgcgttcgcgtacaacaattcaggtcttgtggttgcgggccgcatcatcgagcttgtcgccggaacaacctacgaatctacggttcagaggctgttgcttgacccgctgcagcttgctcacatgcgctacttttccgaccaaataatcggtctgaatgtggccgcatcgcatagcgtggtcgacggcaaaccgattgccgttactgacttttggacattcccgcgcagctgcaaccccaccggtgggttgatgtccacagcgcgagatcagctgcgttacgcacagttccacctcggcgacggcagggcgcctaacggtgagcagattctgagccgacaatcgctgaaggcaatgcgctctaaccctggggcgggcggaacactttgggtggaactgaccgggatgggcgtgacctggatgctgcggccctccgcggagaatgtgaccatcgttgagcacggcggcacctggaaggggcagcgctctgggttcgtcatggtgcccgatcgaaacttcgccatgaccgtgctcactaactctgatggcggatttcatatgatcaacgaccttttcgcatccgactgggcattgcagagattcgccgggctcagcaatcttccggccacgccgcaacgccttggtgccgtcgacctggcgccctacgagggccggtacatcgccaagcaagtcgcccaaaatggcgacctcgagacaacggtcatcgacttccgggccagggacggccagcttgctggaagcatgagcaccgacgatgccaacccggatggccaaaacagcgccaatctgggcctcgccttctatcggcccgactatgggctcgaccttggacccgacaacaagcccaccggcagtcgctccaacttcgtgcgcgggccggacggcaacatcgcctggttctgtagccagcacggccgtctgttccgacgccaatag

SEQ ID NO: 48369 - protein, 539 aa, Mycobacterium tuberculosis CDC1551
MTKRIPPRSCSDRPPPAGSPRSLCPPIILSSATPTGTRCGTRHGRAVVTEYVRALDRLPHEIATAVVETVNCADPGAAFDELDAKINAGMKAYAIPGVAVAVWAGGQEYVKGYGVTNVDHPMPVDGDTVFRIGSTTKTFTGTVMMRLVERGKVDLDSPVRRYIPDFAVADESASATVTVRQLLNHTAGWDGRNGQDFGRGDDAVALYVKAMTRLPQLTPPGTAFAYNNSGLVVAGRIIELVAGTTYESTVQRLLLDPLQLAHMRYFSDQIIGLNVAASHSVVDGKPIAVTDFWTFPRSCNPTGGLMSTARDQLRYAQFHLGDGRAPNGEQILSRQSLKAMRSNPGAGGTLWVELTGMGVTWMLRPSAENVTIVEHGGTWKGQRSGFVMVPDRNFAMTVLTNSDGGFHMINDLFASDWALQRFAGLSNLPATPQRLGAVDLAPYEGRYIAKQVAQNGDLETTVIDFRARDGQLAGSMSTDDANPDGQNSANLGLAFYRPDYGLDLGPDNKPTGSRSNFVRGPDGNIAWFCSQHGRLFRRQ

SEQ ID NO: 48370 - DNA, 1116 bp, Mycobacterium tuberculosis CDC1551
  CDS (1)..(1116)
atggattcgactgtaacggcctcgatccgacgcatgctgggactgctcgccgccacattgctgctcggcggctgcaccggccagcacacgacacgcacagcggcgagcaccacatacacgccccacatcaaggccagcagtcaggacgtactggacggcgccatcaatgccgacgagccaggttgttcggccgcggtaggagtcgaggggaaagttatctggtcaggcgttcgcggcattgcggatctggcatccggcgccaagatcaccacggacaccgtgttcgacatcgcgtcggtgtccaagcagttcaccgccaccgcgatcctgctgctcgtcgaagccggaaagctaacactcgacgacccgatatcccaatacgtacccgagctacccgactgggcccaaaccgtcaccgtcgagcagctcatgcatcaaaccagcggcatccctgattacgtcgcattgctggcagccagggggtatcaggtcagcgaccgcaccatcgaggccgaagcccggcaggcgttagcggccgcccccgagctgcaattcaagcctggcaccaggttcgattactccaactccaactacttgctgctcggcgagattgtccaccgcgcatcgggacaaccgctgcctgagttcctcagcgccgagatctttcaaccgcttggtctggccatggtggtggatccggtcgggaaggttcccaacaaagccgtgtcatatgagaagggcactggtggaaaccggtccgagtaccgggtgggcaatccggcctgggagcagatcggcgacggtggcatccagaccacgcctagccaactggcccggtgggcggacaactaccggacaggaagcgtcggcggcctgaaactgctcgaagcacaacttgccggtgcggtggaaaccgaacccggtggcggcgaccgctacggcgccggaatcgtgtcgcgcgccgacggaacactcgaccacgcgggcgcctgggccggattcgtcacggcattccacatcagcagtgaccgacggacttcggtggccatcagctgcaacaccgacaagccggacccggtggccatggccgatgcgctggggcgcctttggatgtag

SEQ ID NO: 48371 - protein, 371 aa, Mycobacterium tuberculosis CDC1551
MDSTVTASIRRMLGLLAATLLLGGCTGQHTTRTAASTTYTPHIKASSQDVLDGAINADEPGCSAAVGVEGKVIWSGVRGIADLASGAKITTDTVFDIASVSKQFTATAILLLVEAGKLTLDDPISQYVPELPDWAQTVTVEQLMHQTSGIPDYVALLAARGYQVSDRTIEAEARQALAAAPELQFKPGTRFDYSNSNYLLLGEIVHRASGQPLPEFLSAEIFQPLGLAMVVDPVGKVPNKAVSYEKGTGGNRSEYRVGNPAWEQIGDGGIQTTPSQLARWADNYRTGSVGGLKLLEAQLAGAVETEPGGGDRYGAGIVSRADGTLDHAGAWAGFVTAFHISSDRRTSVAISCNTDKPDPVAMADALGRLWM

SEQ ID NO: 48372 - DNA, 1209 bp, Rickettsia conorii str. Malish 7
  CDS (1)..(1209)
ttgataagtttgtggagtgttgcagttatgatgcgtagatatttgttattgttgcttttttttattactaattgtattgattgttttgcagatatacagcaaagaatcaatgaagcagaaaaagaatatatcagtaatagatttttaaatgccgtttttatgtttgccgatgattataaacctttattaaccggtgctaaaggaatttttgctttaaatggtgagcaattaaaagcaaatgaaatgatgcctattgtttctgctacaaagccttttacagcagcgggaatcttaaaattacaagaacaggcattattaaatattaacgataaaatttataaatatcttgatccggaaatgtggggtggaaaagtgccggattgggcatataaaatatctatccataatttattaacgcatagtagcggtattgctgaatattttagttttgttaaacttgatttaaatatgcctaagaaagagattcacaagaaaatattacaatttgtttcttctaaacctttagaaatatctatagggaaaaaatttaaatatagtaatactaattttgttatactcggtatgattatagaaaaggtggctaaaaaagatttagctaactttttttatgatgaattttttaaaccgcttaatatgaaatctactagttttgcttcatatagtgaagccgctagaatccaaaaaaacgttattagttctaattatccggtaagatattttttaacgcctaataatagtaataaacctatatttactcctgtaactgctgattttttagcagttccttgtgctgacggtggtataatatcaacaccggttgatcttattagatggtatagggcattaaatgaggagaaaattctttctaagaagtcgtataaacttatgactactaaatattttttagcacaagatatagaagggcgtaagtcttatatgggttacggtatttttcttactgatcttgattctaaacgtttaatgattcattatacgggaaaggcccttggaatacaaagtgaagcaggatatgttttgcctgataatctttattttgctatactcagtaatactatgataaaaattcctgaagaagaaaaagataaaattgacatgaaaaatcctttaaatcaacttggaataatttattttagagatgcaataataggggcagctataaaaaattaa

SEQ ID NO: 48373 - protein, 402 aa, Rickettsia conorii str. Malish 7
MISLWSVAVMMRRYLLLLLFFITNCIDCFADIQQRINEAEKEYISNRFLNAVFMFADDYKPLLTGAKGIFALNGEQLKANEMMPIVSATKPFTAAGILKLQEQALLNINDKIYKYLDPEMWGGKVPDWAYKISIHNLLTHSSGIAEYFSFVKLDLNMPKKEIHKKILQFVSSKPLEISIGKKFKYSNTNFVILGMIIEKVAKKDLANFFYDEFFKPLNMKSTSFASYSEAARIQKNVISSNYPVRYFLTPNNSNKPIFTPVTADFLAVPCADGGIISTPVDLIRWYRALNEEKILSKKSYKLMTTKYFLAQDIEGRKSYMGYGIFLTDLDSKRLMIHYTGKALGIQSEAGYVLPDNLYFAILSNTMIKIPEEEKDKIDMKNPLNQLGIIYFRDAIIGAAIKN

SEQ ID NO: 48374 - DNA, 1497 bp, Staphylococcus aureus subsp. aureus Mu50
  CDS (1)..(1497)
atgactactaaaaaactgtattttctatccatttctattatcattttagtcgccatttcaattgctatatatataacattaaatagcaatacgaagacacggttaaccaatgattcgcaacaacaaatagataaaattatcgagcatgatttacaaaagggacacattcctggagcatcaattttaatagtaaaaaatggcaaagtttttttaaataaaggttatggttatcaagatgttgataaaaaagtcaaagcttctcccacaacaaagtatgaaattgcttctaatactaaagctttcacaggtcttgcaattttaaaattagctcaagaaggtcgattaaacttaaatgatgacgtatccaaacatgtgcctcattttaaaatgaactataatggtcaaaatgaaactattacgattaagcaacttttggctcaaacaagtggtatacctagtgatattacaagcgaagacgccgtaacaaataaaaataatcgtttaaatgatgtaacccgtgcaattatgggtgatgaattacatcataagcccggagaagaatttgaatactcaaatatgaactatgatttattaggtttaattatccaaaacgttacgaagcaatcctatacaaaatatattacaaattcatggctcaagcctttgcatatgacacatacatcattcaaacaaaccaataacaaatcaaaacatgatgctattggctacgaattacaaggttcgacacctgtcgtctctaaacctgaatttaacctttgggatacaccatcagcatatatgatgacatcaactgaagatttggaacattggataaaattccaacttaatccacctgataaatacaaatcattagttcaacaatcacataaaaatttatcatcaacaattggtgaacctaatgccaatgcatatgcttcgggctggtttaccaataatgatgaacatttagtgtttcattcaggaacgctcgataacttttcatcatttattttactaaatccaaaacaaaattatggaattgttgtgcttgcaaatctaaattcggaatatgtacccaaattagttgagcatcttaatacacaaattgtaaatcacaagcgatattcgacggttgcgtctatactcaatcaatataaagaccaatttaatattgttaccgttttgatgacaacacttattttattagcatttatattctcagcttatcgtgcttggcaaatgcgccatggtcaaattcttttgcgtagatcaaaacggattgctgtattgagttggctaactttatgtttatgtatcgctatagcgctcatattatatgcattaccatatctcattctcggtagcaataattggtcttttgtactgacttggctaccaatagaaattaaattagcactaatcacaacattaattgcattattcagtacattaattgtaattctgttattccttcatacaaagataacgaagacataa

SEQ ID NO: 48375 - protein, 498 aa, Staphylococcus aureus subsp. aureus Mu50
MTTKKLYFLSISIIILVAISIAIYITLNSNTKTRLTNDSQQQIDKIIEHDLQKGHIPGASILIVKNGKVFLNKGYGYQDVDKKVKASPTTKYEIASNTKAFTGLAILKLAQEGRLNLNDDVSKHVPHFKMNYNGQNETITIKQLLAQTSGIPSDITSEDAVTNKNNRLNDVTRAIMGDELHHKPGEEFEYSNMNYDLLGLIIQNVTKQSYTKYITNSWLKPLHMTHTSFKQTNNKSKHDAIGYELQGSTPVVSKPEFNLWDTPSAYMMTSTEDLEHWIKFQLNPPDKYKSLVQQSHKNLSSTIGEPNANAYASGWFTNNDEHLVFHSGTLDNFSSFILLNPKQNYGIVVLANLNSEYVPKLVEHLNTQIVNHKRYSTVASILNQYKDQFNIVTVLMTTLILLAFIFSAYRAWQMRHGQILLRRSKRIAVLSWLTLCLCIAIALILYALPYLILGSNNWSFVLTWLPIEIKLALITTLIALFSTLIVILLFLHTKITKT

SEQ ID NO: 48376 - DNA, 1176 bp, Bacillus subtilis subsp. subtilis str. 168
  CDS (1)..(1176)
atgacaagcccaacccgcagaagaactgcgaaacgcagacggagaaaactaaataaaagaggaaaactgttgtttggtcttttagcagtgatggtttgcattacgatttggaatgctcttcatcgaaatagtgaagaaaacgaaccatctcaagaaactgcagcggtttcaaataccgatcagaaaaaagaggtcaaaaagaaaactgccaaaaaatcagaggaacaaatcaaaacagtggatcgaaaccaaaaaatcagcaattatttaaaagagatcggtttcagcggaacagccatgattgtcagaaatggagaaatcgtaacaaataaaggttttggctatgctgaccgtaaacactacattcaaaataatccattgacatctttttatgtcggttcatcacaaaaagcgctgattgcaactgctattttgcagcttgaggaaaaggggaaacttcagacaagtgatccggtaagcacgtatttacctcattttcccaacggacaaacgattactttgaagaatctgcttacacatacatcggggataaacggacatattgaaggaaacggcgccattactccggacgatttaataaaagatatagaacttcagggaatcaaacgtcagccgggcgtatgggactacaaggattccaactattctgttcttgcttatattattgctgaagtaagcggtgagccctatgaacagtacataaagaatcatatttttaaacctgcgggaatgacgcatgcaggcttttacaaaacatatgaaaaagaaccttatcctgccgtcgggtataagatggagggcagcaaaacagttacaccgtatatacctgatttatcccagctgtatggagcgggtgatatttatatgagcgctatagatatgtacaaatttgaccaagcgctgatagacggaaaactgtattcgcaaaaaagctatgaaaagatgtttacgccagggagcagctccacatacggcatgggattttatgttgctcccggaagctattcaaaccatggtgttatgccgggcttcaatatcttgaacagctttagcaaatctgggcaaaccattgttattttgttctcaaacattcaaaataatgctaaattgggccaagtgaacaataaaatataccagcttctaaatcaagaatga

SEQ ID NO: 48377 - protein, 391 aa, Bacillus subtilis subsp. subtilis str. 168
MTSPTRRRTAKRRRRKLNKRGKLLFGLLAVMVCITIWNALHRNSEENEPSQETAAVSNTDQKKEVKKKTAKKSEEQIKTVDRNQKISNYLKEIGFSGTAMIVRNGEIVTNKGFGYADRKHYIQNNPLTSFYVGSSQKALIATAILQLEEKGKLQTSDPVSTYLPHFPNGQTITLKNLLTHTSGINGHIEGNGAITPDDLIKDIELQGIKRQPGVWDYKDSNYSVLAYIIAEVSGEPYEQYIKNHIFKPAGMTHAGFYKTYEKEPYPAVGYKMEGSKTVTPYIPDLSQLYGAGDIYMSAIDMYKFDQALIDGKLYSQKSYEKMFTPGSSSTYGMGFYVAPGSYSNHGVMPGFNILNSFSKSGQTIVILFSNIQNNAKLGQVNNKIYQLLNQE

SEQ ID NO: 48378 - DNA, 1563 bp, Caulobacter crescentus CB15
  CDS (1)..(1563)
atgatcacacgccgcccgcttatcgccgccctggcgttcgcccccatggccgttgcgcccattcaagtcctggccagttcgacgctacggcgccggacgaaggcccaggcgatcgacgactttgctcgccgcgccctggccgagcttgcgaccgtgcctggtctttcgctggccgtggtgcaagggcgggaggtcgtcatggcggccggctatggcgtcgccgatctcgggaccggacgccccgcgcatgccgatacggcgttctacatcgcgtcttcgaccaaggccttcaccgccctggcgatcgccgccatcgccgcgcgcgggacgttcgcgctcgacgcgccgttgagccgctggatcggcgacagtccgttccccgccgatctggccgcttcggtcagtctctcggatcttctgtgtcaccgctcgggcctggagaaccagccgatcgcgcatcgcgccgccttcacgggcgagcacaccccggccgccatgagcgctctgttgcgaagcaccataaggagcaaggacacgccgcacggcgtctttcgctacaccaacaccggctacaatctcgccacgacgctcatcgaggaccgctttggcctggactggcgtgacatggtcgaccgggaggtgctccggccggccggcatgacgcgcaccaccgcgcggatcgacgccgctcgccggcgaaagggcgtcgctcttgggcacacacccgccgctgacggtcgcatcgcgcccagcccgttgcagaagactgacgccaccatgcagccggccggcggcctggtctcgaccgcccgcgagatggcgcgatggttggagatccagctgaacgatggcgttctggaggggcgtcgcctctttcccgaagggcttgtggcctccacgcatcgaccgcgggtcccgcagcaagccaagttcggcccctatgtccgcgacggctatggactaggctggcagacaggccgctatggcgagcagcccttgatccatcatttcggcaacttcgccggggctcgggcccatgtctccttgatgcccgcgcgcggtgtcggcgtcgcggtgatggcgaacgaggacgccttggccggggaggtgacggacctggtggccaactacgtctatgactgcctagccggacgggttgatctggaagcggtctacgaaagcgaactgtcggcattgaaggaccggatcgcaagacggcgcgccggcctgaccgccagtcgcgccgaacgcgcggcgcgtccgtggtcgctgagccgcgccaacgcgaactatctcggcgcttatcacaacccgcagatggggcggttggacatcgtcgaggcgaacgcgcgcctcatggtccgcgccggggcgatggcgtcgccggcggaggcgggcggtcagcccgagacgcttcgggtggagcttgttcccctgtccgggcaggtcatccgctttgttggcgatggcgagttggtcctcgatggccagacctatgtcaggcgacctgccgtcccgccgctcaagatggaaatccagcgcccgcgatcgatgacgcagtga

SEQ ID NO: 48379 - protein, 520 aa, Caulobacter crescentus CB15
MITRRPLIAALAFAPMAVAPIQVLASSTLRRRTKAQAIDDFARRALAELATVPGLSLAVVQGREVVMAAGYGVADLGTGRPAHADTAFYIASSTKAFTALAIAAIAARGTFALDAPLSRWIGDSPFPADLAASVSLSDLLCHRSGLENQPIAHRAAFTGEHTPAAMSALLRSTIRSKDTPHGVFRYTNTGYNLATTLIEDRFGLDWRDMVDREVLRPAGMTRTTARIDAARRRKGVALGHTPAADGRIAPSPLQKTDATMQPAGGLVSTAREMARWLEIQLNDGVLEGRRLFPEGLVASTHRPRVPQQAKFGPYVRDGYGLGWQTGRYGEQPLIHHFGNFAGARAHVSLMPARGVGVAVMANEDALAGEVTDLVANYVYDCLAGRVDLEAVYESELSALKDRIARRRAGLTASRAERAARPWSLSRANANYLGAYHNPQMGRLDIVEANARLMVRAGAMASPAEAGGQPETLRVELVPLSGQVIRFVGDGELVLDGQTYVRRPAVPPLKMEIQRPRSMTQ

SEQ ID NO: 48380 - DNA, 1473 bp, Caulobacter crescentus CB15
  CDS (1)..(1473)
gtggaaggaatgggtgggccgccgcgcgggcgccgggaagctggttcccaagggcttcgccaccaacaagcggttccgtcccaaatgaggatcggacggtcgcgtcgccgcgcgttgagcctgttggccggcgttttcggctgcgcggccgtcgccgcgactccggcgctggccctgcccaagggcaagccggaggagggcggcttcagcgccgaacgactgaaacgcctcgacgaccatatgcagaccatggtcgatcggggacagatcgccggcggtgtaaccgtcctggcgcgccacggacgggtggttcaggcccgcgccttcgggcgccgcgtgctgggcggcgacccgatgccgatggacgcgatcttccgcatccgctcggagaccaagccggtcaccggcgtcgccatgatgatgctctacgagcaggggctgtggcggctggacgatccggtgagtctgcacattccggagttcgccaatctgcgtgtggccaagggcgtcgatgagaccggacagccgatcctgaccccggtctccagatcgcccaccatgcgcgagctgatgacccatacggcgggcttcgcctatggactggccaacgatcccagcagcccggccgaccaggcctattaccgggccgaagtcctgcagtcggcgtcgctgaccgacctggtgcagaaggtgtcgggcctgccgatgttcgccgagcccgggcagctgtggcgctacagcgtggcggccgacatccagggctacatcgtcgagaagctgtcgggccagagcctgccggtgttcatgcaggagcgcatcttcacgccgctgggcatgaaggacacggccttctacgtccctgaggagaagcaggcacgtctggcggcgctgtatgacggcgatccggccaccgggcagttggtccctgcggtcgagggggcctggcgcgacgtcagcaagccgccggccgcgccgctgggcggcggtggtttggtgtcgacggctggcgatttcgcgcgcttcgcccagatgatcctcaacaagggtgagctcgacggcgtccggattctgaagccggaaaccgtggcgctgatgacccagaaccatctgcccgagggttttgtggtcaccaccaatggcaccgcaggggttctggcgccggcggctcggccttttccgttcgctgcgggtatgggctacgggatcgacatggcggtcgccgtcgacccggcggcgtctggcgcgccggtcggccccggcactgtcagctggggcggcagcgcaggcacctggttctggattgatccggccaacaacctgttctttgtcggcatgatccagcgactgggcggggtgggccccggcctggacgcgcaatcgcgtacgctcgtttaccaggcgctggagcggccgccgatgccgccggtccaggtgtctgcgaaggcccctgtgcggccgacggtctcgcgctga

SEQ ID NO: 48381 - protein, 490 aa, Caulobacter crescentus CB15
MEGMGGPPRGRREAGSQGLRHQQAVPSQMRIGRSRRRALSLLAGVFGCAAVAATPALALPKGKPEEGGFSAERLKRLDDHMQTMVDRGQIAGGVTVLARHGRVVQARAFGRRVLGGDPMPMDAIFRIRSETKPVTGVAMMMLYEQGLWRLDDPVSLHIPEFANLRVAKGVDETGQPILTPVSRSPTMRELMTHTAGFAYGLANDPSSPADQAYYRAEVLQSASLTDLVQKVSGLPMFAEPGQLWRYSVAADIQGYIVEKLSGQSLPVFMQERIFTPLGMKDTAFYVPEEKQARLAALYDGDPATGQLVPAVEGAWRDVSKPPAAPLGGGGLVSTAGDFARFAQMILNKGELDGVRILKPETVALMTQNHLPEGFVVTTNGTAGVLAPAARPFPFAAGMGYGIDMAVAVDPAASGAPVGPGTVSWGGSAGTWFWIDPANNLFFVGMIQRLGGVGPGLDAQSRTLVYQALERPPMPPVQVSAKAPVRPTVSR

SEQ ID NO: 48382 - DNA, 1611 bp, Caulobacter crescentus CB15
  CDS (1)..(1611)
atgctgaccaccacgcgccgcgccgccctgatctcgggcctcgccaccaccggcctggcggcgttcgggaaccgggcttttgcgcaagagacgggcgcggtcggcgcggcggtcgacaagttcgcccaggacgtgatggccgccttccctgaccagccgggcctggggatcacggtggttgagaacggccagatcaccctggccaagggctatggcgtcaaggcgctgggcggccaggaccgctgcgacgagagcaccgtcttcggcatcgcctccaacaccaaggccatgaccgccgccctgctggccatgctggtcgaggaggggcgggtcgagtgggacgcgccggtcacccaatacctgcccgactttgcgatgaaggacccgatcgtcaccaagctgctgacggtgcgcgatctcctggttcaccgcagcggcctgagccttggcgcgggcgacctgatgatctggccggcgcccacccacacccgggccgagatcgtggcgggcctgaagcacctgccgatcggcggccagttccggggcggctacgcctatgacaacgtcctctatgtcgtcgccggggcggtgatcgaggcggtgaccggccagacctgggagcaggtgatcaaggcgcggatcttcgacccgctgggcatgagcaacaccgtctccagcccgcgtctcgtcgaccagtcgcgccgcgccctgccgcatgcgcgcctgggaccgccggtgcggggcctggggccgcagaaggtgctgccgttcgacgccagctttgacgcggccggccccgccggcggggtcaattcctgtccggccgacatcggcaagtggatgcaggtgcaactgggccggggcgtctcggctgacggcaaacgcctgtggagcgaggcccaggcccgcgagatgtggaagccgcagaccatcaccagctcttccgacggcccgagcaacgagaacccggcgcggccctcgatgcaggcctacgccctgggctggtacgtgcaggatcaccggggcgagcgcctgctctggcacactggaggcctggccggcttcatctcctatacgggcctgctgcccggccggaagtccgggatcatgatcatgaccaacgccgaggagaacccggtgctgcggtcgctgcggttcggcggtccggatcggttgcaggggcgcagcgatttcgactggatcgcatcgtccaagcgcgtccaggccgaggccgacgcccagacgatcaaggacgctgcggcggccaccacgcccaagggcggcggcgctccgcccagcctgccgctggaggcctatgccggggtctatcgcgacccctggtacggcacggtgacgatcagcgtcacaggcaagggcaagaagaagggcctctacgtctcgttcgacaagacgccgctgctgcgcggcaagcttggtccgttcgacggtgagaccttcatcaccaccttcgaggatcgcacccaggaagacgccttcttcacgttcgacatcaaggacggcaaggcggtttcggccctggtcaaggcggtctcgccgctggccgacttcagctacgactaccacgacctgcgcctgaccaaggaagggtag

SEQ ID NO: 48383 - protein, 536 aa, Caulobacter crescentus CB15
MLTTTRRAALISGLATTGLAAFGNRAFAQETGAVGAAVDKFAQDVMAAFPDQPGLGITVVENGQITLAKGYGVKALGGQDRCDESTVFGIASNTKAMTAALLAMLVEEGRVEWDAPVTQYLPDFAMKDPIVTKLLTVRDLLVHRSGLSLGAGDLMIWPAPTHTRAEIVAGLKHLPIGGQFRGGYAYDNVLYVVAGAVIEAVTGQTWEQVIKARIFDPLGMSNTVSSPRLVDQSRRALPHARLGPPVRGLGPQKVLPFDASFDAAGPAGGVNSCPADIGKWMQVQLGRGVSADGKRLWSEAQAREMWKPQTITSSSDGPSNENPARPSMQAYALGWYVQDHRGERLLWHTGGLAGFISYTGLLPGRKSGIMIMTNAEENPVLRSLRFGGPDRLQGRSDFDWIASSKRVQAEADAQTIKDAAAATTPKGGGAPPSLPLEAYAGVYRDPWYGTVTISVTGKGKKKGLYVSFDKTPLLRGKLGPFDGETFITTFEDRTQEDAFFTFDIKDGKAVSALVKAVSPLADFSYDYHDLRLTKEG

SEQ ID NO: 48384 - DNA, 1728 bp, Caulobacter crescentus CB15
  CDS (1)..(1728)
atgcgccgtctttttgtcgctctagccgcaaccgccctcgttggcgtagcccccttgggcgccttcgcccagacggcggcggggccggcgaagcctgccacggtttcgaccgatcggttgtcggacgcggctatccgccagatcctggcccagcgggtcgacgtcgatcatcagagccggggtatggtggtcggggtgatcgacgcccgaggccggcgcgtgatcgcccacggcctcatgggcgccggtggcaagccggtcgacggtcagaccctgttcgagatcggctcggtcaccaaggcgctgaccagcctcttgctggccgacatggtccggcgcggtgaggtcaggctggaggatccggtggctgaccatctgccgccgggaacggtcgtgccgacccggaacggcaaggccatcaccctgatcgacctcgccacccacacctcgggcctgccgcgcctgccgaccaacatggcgatgaaggatccgctcaacccctacgccgactataccgaggctcagctggatgcgttcctgcgcgactatgtcctgacccgcgacatcggcgggatctacgaatactccaaccttggggtgggattgctgggtcgggccctggcctatcgcgcgggcggcgactacgagaccgtattgcgccagcgtgtgctgacgccgctgggcatgagcgacaccgccatcgtcctgtcaccggcccaggccgcgcgcttctccagcggccataacgccgcgctggaggccacgacgcattgggacctgcccagcctggccggcgcgggcgccctgcgctcgaccgccgacgatctgctgaagctgacggctgcggagcttggccttgtcgacacgccgctgaaggccgctatggccgaccagctggttccacgtcgccccgtcggcggcggcgtggaggtcgcgctaggctggcacgtctggtcaacacccgagggcggcatcgtcacccatagcggcggcaccatgggcttccaaagcttcgtcggtttcaatcgtaagaccggactgggtgtcgtggtgctgagcaacacggccggcgtcatgggcgtggacgatatcgggctgcacctgatgaccgggcagccactgaagaccccgcccaagacgcgcgtggcggttcccctcgcccccgccgccttcgacaagctggtcggccgctacgccatggcgccgggggcggtgatgacgatccgccgcgatggtgagcgcatgctgggccagctgaccgggcagccgacggtcgagttgttcgccgaaagcccgacaaccttctttctcaaggtggtcgacgcccaactgaccttcgccgtcgacgccgaggggcgcgggacggcggtgacgctgcaccagaacggccagaacacgacggccccgcgcttggccgaaggggctgaggtgcccgcgccgccgcgcccggccaaggtggcggcactgtccgtcgccgagctggacgccctgacgggccgatacgccctggctcccggattcgtcgtcaccgtgacccgcaagggccagagcctgttcgcccagctcaccggccagccggagttcgaggtgtttcccgaaagcgcgacccgcgtcttctggaccgtcgttcccgccgccgccagttttacgctgggtccggatgggaaggccgtgagcctgaccttgcatcagggcggccgcgacatgcccgcgccgcgacagccttag

SEQ ID NO: 48385 - protein, 575 aa, Caulobacter crescentus CB15
MRRLFVALAATALVGVAPLGAFAQTAAGPAKPATVSTDRLSDAAIRQILAQRVDVDHQSRGMVVGVIDARGRRVIAHGLMGAGGKPVDGQTLFEIGSVTKALTSLLLADMVRRGEVRLEDPVADHLPPGTVVPTRNGKAITLIDLATHTSGLPRLPTNMAMKDPLNPYADYTEAQLDAFLRDYVLTRDIGGIYEYSNLGVGLLGRALAYRAGGDYETVLRQRVLTPLGMSDTAIVLSPAQAARFSSGHNAALEATTHWDLPSLAGAGALRSTADDLLKLTAAELGLVDTPLKAAMADQLVPRRPVGGGVEVALGWHVWSTPEGGIVTHSGGTMGFQSFVGFNRKTGLGVVVLSNTAGVMGVDDIGLHLMTGQPLKTPPKTRVAVPLAPAAFDKLVGRYAMAPGAVMTIRRDGERMLGQLTGQPTVELFAESPTTFFLKVVDAQLTFAVDAEGRGTAVTLHQNGQNTTAPRLAEGAEVPAPPRPAKVAALSVAELDALTGRYALAPGFVVTVTRKGQSLFAQLTGQPEFEVFPESATRVFWTVVPAAASFTLGPDGKAVSLTLHQGGRDMPAPRQP

SEQ ID NO: 48386 - DNA, 1191 bp, Sinorhizobium meliloti 1021
  CDS (1)..(1191)
atgacacatttttccgcgacgaaattcgtaatggctgcggctgctttgctctgctgcggagccggcgcgcacgccgccgaccgaggcgaggaaggagagcttgcacgcttagtggacgagacgatccggccgctgatgagggagcatggcgttccgggaatggcgatcgcggtcaccgtccgcggaaagaagtacatcttcaactatggcctggcgtcgagagagagcgggcagaaggtcaccgacgaaacgatgttcgagatcggctcggtcagcaagaccttcacggcgatgctcgcatcctatgccgaagcgcgtggggatctgaccctatccgatcctgccggcaaatatctgcccgcgctcgccgggacccgttttgacgacatcagccttctcaatctcgggacctataccgccggcggactgccattgcagtttcccgattccgttaccgatcaggagagcatgatcgactactacagagattggcgcccgacctatgccgccgggacgcacaggctttactcgaacccgagcatcggcctcttcggctatctagccgcaaagagcatgggcgagcctttcgccgatctgatggagaagagcatattcccggcattcggcctgacgagcaccttcatagccgttccgcaggatcgggcggacgactatgcctatggttattcgaaagccggcaagccgatccgcgtcacgcgcggcgttctcgactcggaagcctacggcgtaaagacgaccgctgccgatctgatccgcttcgttgaggcaaacatcgatggaacgggcctggacgagccgatccggcgcgcgatcgccgcaacgcacaccggatacttcaaggtcggggccatgacgcaggggctcggctgggagatgtatccctatccgacgaagctcgacgatctgcttgccggcaattccagccggatggcgctcgagccgcacaaggtcagcaagctcgttccgcccgcggcgccccaggaaaacctgtggatcaacaagaccggctcgaccaacggtttcggcgcctatgcagccttcgtcccggccgagcgcatcggcatcgtgatgctggcgaacaggaattacccgattcctgcccgcgtgaaagccgcataccagatactgtcgacgctcgagagcggccccggatcggcggacgcccgctga

SEQ ID NO: 48387 - protein, 396 aa, Sinorhizobium meliloti 1021
MTHFSATKFVMAAAALLCCGAGAHAADRGEEGELARLVDETIRPLMREHGVPGMAIAVTVRGKKYIFNYGLASRESGQKVTDETMFEIGSVSKTFTAMLASYAEARGDLTLSDPAGKYLPALAGTRFDDISLLNLGTYTAGGLPLQFPDSVTDQESMIDYYRDWRPTYAAGTHRLYSNPSIGLFGYLAAKSMGEPFADLMEKSIFPAFGLTSTFIAVPQDRADDYAYGYSKAGKPIRVTRGVLDSEAYGVKTTAADLIRFVEANIDGTGLDEPIRRAIAATHTGYFKVGAMTQGLGWEMYPYPTKLDDLLAGNSSRMALEPHKVSKLVPPAAPQENLWINKTGSTNGFGAYAAFVPAERIGIVMLANRNYPIPARVKAAYQILSTLESGPGSADAR

SEQ ID NO: 48388 - DNA, 1614 bp, Nostoc sp. PCC 7120
  CDS (1)..(1614)
atgacactcccatcaccaaataaagtcgatgaattattttccgaatgggataaaccaggctctcctggttttgctttagccatcaccaaagatggtgagactgtctataagcgcggctatggtatcgctgacttagaacacaacataaagatttttccaaattcggtctttgatattgcctcaacgtccaagcagtttacagcgatgtgcattgctttacttgcaagaaaggggaaactttctttagatgacgagatccaaatctacatttcagagataccaagatatgagtatcccattactgtgcggcatctgattcaccacacaagcggcattcgtgattacttaaccctgatgggattggcaggaatgcgatgtgagaatgagtatcctgataacgaaatcattggtttaatagctcgtcaaaaagaattgaacttcaagccaggagaggagcatttgtacagcaactcaggatattttcttttggcagaaattgtcaaacgtgtctccggagaatctcttgcggtttttgctgataagcatattttcagtccccttgggatgaagacaactcactttcacgatgatttcacaaggattgtcagcaatagagcgattggctactctctgaaggacgaaggtagctttcggattgatatgtctattcttgatgtagtgggtgacggtggtatctacactacggttgaggatctatgtatctgggataagaatttttaccaaaacaaattaggaggatatgggcaagacctgatcgaagaaatcattacacctggaatattgaatagcggcgaagtgatagattatgcctttggtttagtcagagggcattaccgaggattagaaaccatcagtcacagtggcggatggatgggttacagatcacagatgcttcgattccccaaacagagattctctgtaatttgcttgtcaaatttgggcagcgctgaaccaccagagcttgccagaaaagtcgcagatatctacttagttgatgactttacggagcaaagcatagaatctgtaagccaccaaacccaaataatagaaattccatcggttaatttagagagcaagactggcttttatcaaaacctaaaaacaggaaccgtttgggagttattggtaaaggatagaaaattaatcgtggaatttgccggaatgagctttacacttgctcctgtgagttcaagtcattttgtcataatggatattccttctaatcccgatgttgaatttgaagagtcaggtttagatgaaccctctcatctttacgtttgtgtggatggcaaaccacgggacgttttccaacggctggactttgctcctcctgattctgaacagttgatggattttacaggagagtattattgccaagagttagatatcacctacagaatcagtatagaaggtggagagttgctgctaaatcgaagaaattctcttcgagaaaccctcaagccaattcataaagatttactggaaggtacggacatcactttgcagtttgtccgtgatgactttcatcaagttgctggattcaatatgagcgcaggatatggaagtgtcagaaacattcaatttttgaaataa

SEQ ID NO: 48389 - protein, 537 aa, Nostoc sp. PCC 7120
MTLPSPNKVDELFSEWDKPGSPGFALAITKDGETVYKRGYGIADLEHNIKIFPNSVFDIASTSKQFTAMCIALLARKGKLSLDDEIQIYISEIPRYEYPITVRHLIHHTSGIRDYLTLMGLAGMRCENEYPDNEIIGLIARQKELNFKPGEEHLYSNSGYFLLAEIVKRVSGESLAVFADKHIFSPLGMKTTHFHDDFTRIVSNRAIGYSLKDEGSFRIDMSILDVVGDGGIYTTVEDLCIWDKNFYQNKLGGYGQDLIEEIITPGILNSGEVIDYAFGLVRGHYRGLETISHSGGWMGYRSQMLRFPKQRFSVICLSNLGSAEPPELARKVADIYLVDDFTEQSIESVSHQTQIIEIPSVNLESKTGFYQNLKTGTVWELLVKDRKLIVEFAGMSFTLAPVSSSHFVIMDIPSNPDVEFEESGLDEPSHLYVCVDGKPRDVFQRLDFAPPDSEQLMDFTGEYYCQELDITYRISIEGGELLLNRRNSLRETLKPIHKDLLEGTDITLQFVRDDFHQVAGFNMSAGYGSVRNIQFLK

SEQ ID NO: 48390 - DNA, 2016 bp, Methanosarcina acetivorans C2A
  CDS (1)..(2016)
atgacgaagcatcggaattcccacagccgcagcataagttcggttactcgttcatcaggacactcagcaaacaggccaggaagaaaagcgttcatttttgcccttggtctggcagttattttcctgacttttagtgcagcatctgcttctcctataaagtcgaatgttacctcaaacgccagcgggccaacaaattcagcagagctggaagctttcatggatggagctgtaaatgcgcagctcaaagctaatcatattcccggagcaactgtagctgtggtcaaagacggccagatcatttttgccaaaggctatggttatgccgacattgataaacgccaaccggtcgttggaaatcaaactcttttccgtgtgggctctgtcagcaaactcttcgtatggacagcagtgatgcagcttgctgaacagggaaagctggacctcgatgccgatgttaacacttatctcaaggacttccaggtccctgctacctattccaagcctattaccctcaagaaccttatgtcccatacatcgggcttcgaagatttagctatcagtggacgcttttttgtgcacaactcaactgacattatgccgctcgaggagtacctgaaaaagggaatgcctgctcgagtgcgccctcctggagaactaaccgcctattcgaactacggctctgccctggctgcatatattgttgagcaggtatctggaatgccttttgataggtatgtggaagagaatatcctgcttccgctggatatgaacaatacgacattcgaccagcccttaccagccagactggcttcgaatatgtccaacggatatgtctattcgaataacgcttacacagccaaaccatttgaatacgtgcaggtctggccggcaagttctatgagttccacctctgaggatatggcgaaattcatgattgctcatcttcaaaacggaaggtatggcgataagcgtatactgcaggaggctacagcacagcaaatgcatagccgcctctttacgaacgctccaggggttaacggtgtaacttatggatttctggagataaatccggaaaatccgagagttatagggcatgaaggcgacactatcctgttccacacccagctggcgctgataccagaaagtcaacttggcctttttatctccttgaacgaagaggatagcgaatcggcagcctttgagttactgcaggcttttatggatcattactatcccacgccgcctcccccggtcccggaacccatccccggatttggaaagaatgcaagtctttttgctggcaactatcgcccaacaaggagtgcctacactaattttgaaaaattaacctctatctcccagaggatacggatatctccgggctcgaacagcaccctcataatttctcagctcaccggagggtcaaaaaaatggatagaagtaaaaccgcttactttcatcccggctgatggtctgccttcccaggacggcctggtctttggcaaagatagccagggccacataaattatctcttcataaaactggatcccacggcagcctatgagaaagtgccctggcacgatgatctcagcattaatcttttcctgctgggaacttgcattctccttttcttatcgacgctcatctggccgataagcctgattatcaagcactctcctcgagaacccaaaaaacctgtcagagctgccagattgtttgcaggcggagccagcgtgattaaccttctgttcctgatagggttaatatttcttttccgggataaaactgcaaatgtagaatttatatactctgtctctaccttcctgatactcctgttagcaattgccctgatagctgcgattttggcgctgggatcttccgtattcgtagtccttgcgtggaaagataactactggagctatcccgaaagaattcattacagtctggtggtcctggctctgctggtgtttgtctggtggctcaataactggaacctgcttgggttcagattctaa

SEQ ID NO: 48391 - protein, 671 aa, Methanosarcina acetivorans C2A
MTKHRNSHSRSISSVTRSSGHSANRPGRKAFIFALGLAVIFLTFSAASASPIKSNVTSNASGPTNSAELEAFMDGAVNAQLKANHIPGATVAVVKDGQIIFAKGYGYADIDKRQPVVGNQTLFRVGSVSKLFVWTAVMQLAEQGKLDLDADVNTYLKDFQVPATYSKPITLKNLMSHTSGFEDLAISGRFFVHNSTDIMPLEEYLKKGMPARVRPPGELTAYSNYGSALAAYIVEQVSGMPFDRYVEENILLPLDMNNTTFDQPLPARLASNMSNGYVYSNNAYTAKPFEYVQVWPASSMSSTSEDMAKFMIAHLQNGRYGDKRILQEATAQQMHSRLFTNAPGVNGVTYGFLEINPENPRVIGHEGDTILFHTQLALIPESQLGLFISLNEEDSESAAFELLQAFMDHYYPTPPPPVPEPIPGFGKNASLFAGNYRPTRSAYTNFEKLTSISQRIRISPGSNSTLIISQLTGGSKKWIEVKPLTFIPADGLPSQDGLVFGKDSQGHINYLFIKLDPTAAYEKVPWHDDLSINLFLLGTCILLFLSTLIWPISLIIKHSPREPKKPVRAARLFAGGASVINLLFLIGLIFLFRDKTANVEFIYSVSTFLILLLAIALIAAILALGSSVFVVLAWKDNYWSYPERIHYSLVVLALLVFVWWLNNWNLLGFRF

SEQ ID NO: 48392 - DNA, 1323 bp, Xanthomonas campestris pv. campestris str. ATCC 33913
  CDS (1)..(1323)
atgatggtgggagcgatggcgatggctggcatgacagtgagtggtgtcaccttggccgctgagacggctgcattgccggccggcatgcagcagttcgatgcgcagatggagcgggtgcgcaagcagttcgatgtgcccggcattgccgtggccatcgtcaaggatggccagatcgtgctggagcgcggctatggtgtgcgcgagctgggcaagccggcgccggtgcaggccaacacgctgttcgccattgcttccaacaccaaggccttcaccgccgcatcgctgtcgatcctggccgatgagggcaagctctcgctggacgacagggtcatcgagcacctgccgtggttccgcatgtccgacccgtatgtcaccaacgaaatgcgcgtgcgcgacctgctcgcgcaccgcagcggtttgagcctgggcgcaggcgatctgctgtactggcccaccaccagttacaccaccgaagaagtggtgcagcgcttggccaaggtgccgctcaagggcggcttccgcgaccgctacgcctacgacaacatcctgtacgcggtcgcccagaaagtgatcgagcaggtatccgggcagagctatgccgcgttcctgcaacagcgcattttcacgccggtgggcatggccggcacacgcttcaatgccgaccacctgcaacccggcgatacggccgccgtggggcatgccaagtacgacttcagcaagctgcgcacggtagcgccgctgacctggtccaacaattctggcgccggtggtgtgtattccagtgcgcacgacatggcgttgtggatgaacgtgcaactggccggcggcacgctggccgatggcatccccttgttcagtgccaagcggcagcgcgagatgtggtcgatgatcacgccgatcaatgtgccggagccggcggtgcccgaactggccgcggcgcgccccaactttgccggctacggcgaaggttggagcctgagcgattaccgcggccatcggctggtgtggcacaccggcggttggcccggcatggtgtcgcggctgaccctggtgccggagcaaaaactcggcgtggtggtgctgaccaatcaggaagtgggcgcggcattcaacgcggtgacgctgcaggtgctggatgcgttcttgcagctgcccgccaccgactggaccgccgcctacgccaaggccgtggaaaaggcagatgccgaagccgataccagctggaaacaccatgagcaggcgcgtgccaagcgctcggcgccgtcgttaccgctgagtgggtacgccgcgacctatcgcgacccctgtacggcgaggtggtga

SEQ ID NO: 48393 - protein, 440 aa, Xanthomonas campestris pv. campestris str. ATCC 33913
MMVGAMAMAGMTVSGVTLAAETAALPAGMQQFDAQMERVRKQFDVPGIAVAIVKDGQIVLERGYGVRELGKPAPVQANTLFAIASNTKAFTAASLSILADEGKLSLDDRVIEHLPWFRMSDPYVTNEMRVRDLLAHRSGLSLGAGDLLYWPTTSYTTEEVVQRLAKVPLKGGFRDRYAYDNILYAVAQKVIEQVSGQSYAAFLQQRIFTPVGMAGTRFNADHLQPGDTAAVGHAKYDFSKLRTVAPLTWSNNSGAGGVYSSAHDMALWMNVQLAGGTLADGIPLFSAKRQREMWSMITPINVPEPAVPELAAARPNFAGYGEGWSLSDYRGHRLVWHTGGWPGMVSRLTLVPEQKLGVVVLTNQEVGAAFNAVTLQVLDAFLQLPATDWTAAYAKAVEKADAEADTSWKHHEQARAKRSAPSLPLSGYAATYRDPCTARW

SEQ ID NO: 48394 - DNA, 1380 bp, Xanthomonas campestris pv. campestris str. ATCC 33913
  CDS (1)..(1380)
atgacagaaatacgcaggcgccgacggttccgtccgttggccgttgggctgttcggggcattgctgcctctggcgctttcttccaccgcgcagacccctgccctgactgccaatagcttgcagccggcgaccgccgcgcagtcgcccactgctccgttgccttaccgcacgtcgctgcctgccagcagcgtgctggcgcctgccgctggcttcgatgtgccttcgttcgagtcgatggccgaccagctcacctacggcaaccgcgtacctggcatggcgatggccatcgtgcagggcggcaaggtgctcagcgcgcgcggctatggcgtcaccgacgtcaatcatccgcagcctgtcgacggccacaccgtgttccggctggcgtcgttgtccaaggcatttgccggcaccatggccgggctgctggtcaacgacggcgtgctgcgctgggacagcaaggtggtggactacgtccccggcttccagctcagcgactccactgccacccgtcagctcaccgtagccgaagtcctcagccaccgcgtcggcctgacccgcaacgcctacgaccgcgacatcgaatccaacgccgactactactcgctcagccacaagctggcagccgcgccactgcgctgcgcgcctggcgattgctatgcctaccagaacgtcgccttcagcctggtcggtgatgtggtgttcgcggcatcgggcagcttctatgagcaatcagtggagcgccgcatcttcaagccgctgggcatgaacgatgccagcatgggcctggccggtatccaggccagcccgcattgggcacgcccgcatgtgcgcagccgcaatggctgggtgtcgctgacgcccaagccgacctactaccgcctggcaccggccgccggcgtcaatgccagcgccagcgacatggcgcagtggctgctcgcccacaccgggcatcgcaccgacgtcctgcctgcgccgctgctggcgacattgcacgcaccgctgatctccacaccgggcgaaatgcgctcgggctggcgccacgagcgcgtggacgcagccagctatgcactgggctggcgcgtgttcgactacgccgggcatcaggtgatcttccacgccggcgccgtgcagggctatcgcggcctggtggcgttgctgcccgaacgcgacctcggcattgccatcatgtggaacggcgaaagcggcctgccctcgggcatgctgccgaccatcctggatcgcgcgcttggcctgccggccaagcgttggctggatatcgatgtggacggcgacttcggcagcgagaacatgctggccgagcgtccggatcctgccggtaagggcgcctcgtccggcaagtcggtggcatcgccgcgctga

SEQ ID NO: 48395 - protein, 459 aa, Xanthomonas campestris pv. campestris str. ATCC 33913
MTEIRRRRRFRPLAVGLFGALLPLALSSTAQTPALTANSLQPATAAQSPTAPLPYRTSLPASSVLAPAAGFDVPSFESMADQLTYGNRVPGMAMAIVQGGKVLSARGYGVTDVNHPQPVDGHTVFRLASLSKAFAGTMAGLLVNDGVLRWDSKVVDYVPGFQLSDSTATRQLTVAEVLSHRVGLTRNAYDRDIESNADYYSLSHKLAAAPLRCAPGDCYAYQNVAFSLVGDVVFAASGSFYEQSVERRIFKPLGMNDASMGLAGIQASPHWARPHVRSRNGWVSLTPKPTYYRLAPAAGVNASASDMAQWLLAHTGHRTDVLPAPLLATLHAPLISTPGEMRSGWRHERVDAASYALGWRVFDYAGHQVIFHAGAVQGYRGLVALLPERDLGIAIMWNGESGLPSGMLPTILDRALGLPAKRWLDIDVDGDFGSENMLAERPDPAGKGASSGKSVASPR

SEQ ID NO: 48396 - DNA, 1185 bp, Xanthomonas axonopodis pv. citri str. 306
  CDS (1)..(1185)
gtgctttgcagtggtcaggcgtgggcgggcgggccgggtcggccgcccgcgccggacgccatcacacgcacactccagcaacacatggacgccgccggcatcgtcggcctgggcgcggcgatcatccgcgaccgcaaggtggtctggaccggcggcgtcggttttgccgaccgtgcgcgcggcacgccattcacgcccgacaccgtcatgaacatcggctcgatcagcaagaccgtgaccggcgtggcgctgatgcaggcggtgcaggacggcaagctggcgctggatgcggacatcaacacctatctgccgttcgccgtgcgcaacccgcagtttccgcaggtgccgatcaccctgcggcaactggccacgcacacctccagcctgaccgaccgctgggaggtctaccgcgacacctatcgctggcaaggcctgccggtcgcgccgttgggcgacttcttgcgcggctatctggcgcccggcgggcgcgactaccaggcgcagaactacctgccggtcaaacccggcacgcatcgcgaatactccaacatcggtgccggcctggtgggctacatcgtcgcgcgcgcggtgggccagtcgctggagcgctacacgcacacgcgcatcttcgcgccactgggcatgcagcacactgcctggcatgcggccgatctgccggccgccgcccaggccacgctgtatgtgagccagttcggtgtgagcgtgccgatcccgccgtacgaactcaccacctaccccgacggcggcgtgcgcaccagcgtcaacgacctctccaggctgttcatcgccctgctcgatggcgggcagtaccagggcgtgcgtattctggataccaccaccaccgcgcagatgctgcgtttccagtacaccgccgccaacacgcccgacaatgtcgccttgaacgagaagaactccggcatcttctggtccaccaagtacaacgtcacccgcatcggccacggcggctcggacccgggcgtgcacaccgagatgctgtcggacctggcgcacgacaatgcggtagtgctgatcagcaacacctccttggacagcagcgatgccagggtcaatgcgcagctcttcgacgatctgtgggcgtatgccgtggagctcaggcagcaagcggcctccgctgccggccgtcgccgccccgcaccggattga

SEQ ID NO: 48397 - protein, 394 aa, Xanthomonas axonopodis pv. citri str. 306
MLCSGQAWAGGPGRPPAPDAITRTLQQHMDAAGIVGLGAAIIRDRKVVWTGGVGFADRARGTPFTPDTVMNIGSISKTVTGVALMQAVQDGKLALDADINTYLPFAVRNPQFPQVPITLRQLATHTSSLTDRWEVYRDTYRWQGLPVAPLGDFLRGYLAPGGRDYQAQNYLPVKPGTHREYSNIGAGLVGYIVARAVGQSLERYTHTRIFAPLGMQHTAWHAADLPAAAQATLYVSQFGVSVPIPPYELTTYPDGGVRTSVNDLSRLFIALLDGGQYQGVRILDTTTTAQMLRFQYTAANTPDNVALNEKNSGIFWSTKYNVTRIGHGGSDPGVHTEMLSDLAHDNAVVLISNTSLDSSDARVNAQLFDDLWAYAVELRQQAASAAGRRRPAPD

SEQ ID NO: 48398 - DNA, 1596 bp, Xanthomonas axonopodis pv. citri str. 306
  CDS (1)..(1596)
gtgaccttgaaccgatggctgagtgggggcgtgctgatggtggcaagcttggcgacgacaacgcacgcggccgaactccccgccggcatgcagcagttcgatgcgcagatggaacgcgtgcgcaagcagttcgacgtgcccggtattgcggtggccatcgtcaaggacggccaggtggtgctggagcgcggctacggcgtgcgcgagaccggcaagcccgcgccggtgcaggccgacacgttgtttgcgattgcctccaataccaaggcgttcactgccgcatcgctgtcgattctggccgatgaaggcaagctctcgctcgatgacaaggtcatcgaccatctgccgtggttccgcatgtccgacccgtatgtgagcgggcagatgcgcatccgcgatctgctggcgcaccgcagcggcctgagcctgggtgcaggcgatttattgttctggcccagcaccagctacaccaccgaagaggtcgtgcagcgcctggccaaggtgccgctgaagggcggttttcgcgaccgctatgcgtacgacaacatcctgtacgcagtcgcccagaaggtgatcgagcaggtctccgggcagagttacgcggcatttctgcagcaacgcatcttcgacccggtgggcatgcgcggcacgcgcttcaacgccgaccatctgcagcccggcgatcacgccgcagtcgggcatgccaagtacgactttaccgagctgcgcacggtggcgccgctgacctggtccaacaactccggcgccggcggcatctattccagcgtgcacgacatggcgctgtggatgaatgtgcaactggccggcggcatcctgcccgatggcaaacccctgttcagcgccaagcgtcagcaggaaatgtggtcgatgatcacgccgatcccgatcggcgaggtgcaggtgcccgagcttgccgcggcgcggccgaacttcgccggctacggtgagggctggagcctgagcgattaccgcggccatcgcatggtctggcacaccggcggctggcccggcatggtgtcgcgcctgacgctgctgccggatcagaagctgggtgtggtggtgttgaccaatcaggaggtgggcgctgcgttcaatgcggtgaccttccaggtgctggatgcgttcttgcaggtgccgtccaccgattggaccgccgcttacgccaagctggtggagaaggccgatagcgaggcggacgcgagttggaacaagcaccaggacgcgcgtgcgtcgcggtccacgccgtcgttgccgctgcgcagttacgcggccacctatcgcgacccctggtacggcgatgtggcgattgtgcaggacggcaagcggctgcgcctgcagttcgccaggaccgcccagttggtgggcacgctggagcattggcagcacgacagcttcatcgtgcgctgggacgaccgctccttgaatgccgatgccttcgtcaatttcgcgctgaccccggatggcgcggtgcgcgagatgcgcatggagccgatttcgccgttgaccgatttcagcttcgatttccaggacctggtgctgacgccggtgccgatgccgaccgctgcgggcaaatga

SEQ ID NO: 48399 - protein, 531 aa, Xanthomonas axonopodis pv. citri str. 306
MTLNRWLSGGVLMVASLATTTHAAELPAGMQQFDAQMERVRKQFDVPGIAVAIVKDGQVVLERGYGVRETGKPAPVQADTLFAIASNTKAFTAASLSILADEGKLSLDDKVIDHLPWFRMSDPYVSGQMRIRDLLAHRSGLSLGAGDLLFWPSTSYTTEEVVQRLAKVPLKGGFRDRYAYDNILYAVAQKVIEQVSGQSYAAFLQQRIFDPVGMRGTRFNADHLQPGDHAAVGHAKYDFTELRTVAPLTWSNNSGAGGIYSSVHDMALWMNVQLAGGILPDGKPLFSAKRQQEMWSMITPIPIGEVQVPELAAARPNFAGYGEGWSLSDYRGHRMVWHTGGWPGMVSRLTLLPDQKLGVVVLTNQEVGAAFNAVTFQVLDAFLQVPSTDWTAAYAKLVEKADSEADASWNKHQDARASRSTPSLPLRSYAATYRDPWYGDVAIVQDGKRLRLQFARTAQLVGTLEHWQHDSFIVRWDDRSLNADAFVNFALTPDGAVREMRMEPISPLTDFSFDFQDLVLTPVPMPTAAGK

SEQ ID NO: 48400 - DNA, 1371 bp, Xanthomonas axonopodis pv. citri str. 306
  CDS (1)..(1371)
atgcgcacgcgccgacggttccgaccgttggctatcgggctgttcggggcgttattgcccctggccctctcatccaccgcgcagacacccgcgcccaccgccgctgcgttgcaggcggccactgtggctcagtcgcccaccgcaccgctgccctatcgcacctcgctgccggccaaccaggtgttggcacctgctgccggtttcgatgtggcggcattcgaatcgatggccgaccagctgacctacggcaaccgggtgcccgggatggcgatggccatcgtgcagggcggcaaggtgctcagcgcgcgcggctatggcgtcaccgatgtcaatcatccgcagccggtcgatggccacacggtgtttcgcctggcctcgctttccaaagccttcgccggcaccatggccggcctgctggtcaacgatggcgtgctgcgctgggacagcaaggtggtcgactatgtgccgggcttccagctcagcgacaacgcggccacccgtcaactcaccgtggccgaagtgctcagccatcgcgtcggcctgacccgcaacgcctacgaccgcgatatcgaatccaacgtcgactactactcgctcagccataagctggcggctgcgccgctgcgttgcgcaccgggcgattgctacgcgtatcaaaacgtcgccttcagcctggttggcgatgtggtgttcgccgcatcgggcagcttctacgagcaatcggtagagcgccgcatcttcaagccgctgggcatgaacgacgccagcatggggctggccggtatccaggcaagcccgcactgggcacgtccgcatgtgcgcagccgcaatggctgggtctcgctgacgcccaagcccacctactaccgtctggcgcccgctgcgggcgtcaacgccagcgccagcgatatggcgcagtggctgctcgcgcacaccggccatcgcaccgatgtgctgcctgcgccgctgttggcgacgctgcacgcgccgttgatctccacgccgggcgaaatgcgttcgggctggcgccacgagcgcgtggacgcggccagctatgcgctgggctggcgcgtgttcgattacgccggccatcaagtggtgttccatgccggcgcggtgcaaggttatcgcggtttggtcgcactgctgccggagcgcgacctgggtgttgcgatcctgtggaacggcgaaagcggcctgccctcgggcatgctgccgaccatcctggatcgcgcgctcggcctgccggccaagcgctggctggacatcgacgtggacggcgacttcggcagcgagaacatgctggcagaaaaacccgacccggctggcaagggtgcgtcttccggcaagtcggtggcctcgccgcgctga

SEQ ID NO: 48401 - protein, 456 aa, Xanthomonas axonopodis pv. citri str. 306
MRTRRRFRPLAIGLFGALLPLALSSTAQTPAPTAAALQAATVAQSPTAPLPYRTSLPANQVLAPAAGFDVAAFESMADQLTYGNRVPGMAMAIVQGGKVLSARGYGVTDVNHPQPVDGHTVFRLASLSKAFAGTMAGLLVNDGVLRWDSKVVDYVPGFQLSDNAATRQLTVAEVLSHRVGLTRNAYDRDIESNVDYYSLSHKLAAAPLRCAPGDCYAYQNVAFSLVGDVVFAASGSFYEQSVERRIFKPLGMNDASMGLAGIQASPHWARPHVRSRNGWVSLTPKPTYYRLAPAAGVNASASDMAQWLLAHTGHRTDVLPAPLLATLHAPLISTPGEMRSGWRHERVDAASYALGWRVFDYAGHQVVFHAGAVQGYRGLVALLPERDLGVAILWNGESGLPSGMLPTILDRALGLPAKRWLDIDVDGDFGSENMLAEKPDPAGKGASSGKSVASPR

SEQ ID NO: 48402 - DNA, 1497 bp, Staphylococcus aureus subsp. aureus MW2
  CDS (1)..(1497)
atgactactaaaaaactgtattttctatccatttctattatcattttagtcgccatttcaattgctatacatataacattaaatagcaatacgaagacacggttaaccaatgattcgcaacaacaaatagatacaattatcgagcatgatttacaaaagggacacattcctggagcatcaattttaatagtaaaaaatggcaaagtttttttaaataaaggttatggttatcaagatgttgataaaaaagtcaaagcttctcccacaacaaagtatgaaattgcttctaatacgaaagctttcacaggtcttgcaattttaaaattagctcaagaaggtcgattaaacttaaatgatgccgtatccaaacatgtgcctcattttaaaatgaactataatggtcaaaatgaaactattacgattaagcaacttttggctcaaacaagtggtatacctagtgatattacaagcgaagacgccgtaacaaataaaaataatcgtttaaatgatgtaacccgtgcaattatgggtgatgaattacatcataagcccggagaagaatttgaatactcaaatatgaactatgatttattaggtttaattatccaaaatgtcacaaagcaatcatatacgcaatatataacagaccattggcttaaaccacttcaaatgaaacacacgacatttaaacaaacaaattacaaatcaaaacatgatgctattggctacgaattacaaggttcgacacctgtcgtctctaaacctgaatttaacctttgggatacaccatcagcatatatgatgacatcaactgaagatttggaacattggataaaattccaacttaatccacctgataaatacaaatcattagttcaacaatcacataaaaatttatcatcaacaattggtgaacctaatgccaatccatatgcttcgggctggtttaccaataatgatgaacatttagtgtttcattcaggaacgctcgataacttttcatcatttattttactaaatccaaaacaaaattatggaattgttgtgcttgcaaatctaaattcggaatatgtacccaaattagttgagcatcttaatacacaaattgtaaatcacaagcgatattcgacggttgcgtctatactcaatcaatataaagaccaatttaatattgttaccgttttgatgacaacacttattttattagcatttatattctcagcttatcgtgcttggcaaatgcgccatggtcaaattcttttgcgtagatcaaaacggattgctgtattgagttggctaactttatgtttatgtatcgctatagcgctcatattatatgcattaccatatctcattctcggtagcaataattggtcttttgtactgacttggctaccaatagaaattaaattagcactaatcacaacattaattgcattattcagtacattaattgtaattctgttattccttcatacaaagataacgaagacataa

SEQ ID NO: 48403 - protein, 498 aa, Staphylococcus aureus subsp. aureus MW2
MTTKKLYFLSISIIILVAISIAIHITLNSNTKTRLTNDSQQQIDTIIEHDLQKGHIPGASILIVKNGKVFLNKGYGYQDVDKKVKASPTTKYEIASNTKAFTGLAILKLAQEGRLNLNDAVSKHVPHFKMNYNGQNETITIKQLLAQTSGIPSDITSEDAVTNKNNRLNDVTRAIMGDELHHKPGEEFEYSNMNYDLLGLIIQNVTKQSYTQYITDHWLKPLQMKHTTFKQTNYKSKHDAIGYELQGSTPVVSKPEFNLWDTPSAYMMTSTEDLEHWIKFQLNPPDKYKSLVQQSHKNLSSTIGEPNANPYASGWFTNNDEHLVFHSGTLDNFSSFILLNPKQNYGIVVLANLNSEYVPKLVEHLNTQIVNHKRYSTVASILNQYKDQFNIVTVLMTTLILLAFIFSAYRAWQMRHGQILLRRSKRIAVLSWLTLCLCIAIALILYALPYLILGSNNWSFVLTWLPIEIKLALITTLIALFSTLIVILLFLHTKITKT

SEQ ID NO: 48404 - DNA, 1167 bp, Yersinia pestis KIM
  CDS (1)..(1167)
atggataaaagattgttgaaacgtctctctgccccgctgctggctgctgctttgtggactattccgttgcacagccatgccgatactcagccgttgacctcgcaagatactaagctgttgacctcgcaaattgttgaccaatacgccgaacatatcttctataacagtggagctgtaggaatggctctggtggttatcgataacaatcaggtcgtcaaccgtagctttggtgaaacgcaacccggcaacaatattcgcccacggccagactcactgatccgcattgcatcaataaccaagctaatgaccagcgaaatcatggtaaaactggctgatgatggcatcgttaagttaactgacccgttaaaaaaatatgcaccgaaaggggtcaacgttccctcttacagtgctaagcaacctattaggctgttgcatctggccagccataccagcggcctcccccgtgagcaacccggcggcccgcaaaaaagaccggtgtttacctggccgaccaaagataatcgctggcaatggttgaaactggccaaagtgaccgttccaccaggcgtgaaagccgcttactctaatttagcttacgacttactggctgacgcactgtcacgagctgcggggaaaccgtatgcccacttattacgtgataaaatcaccgcaccactggggatgaaaaataccaccctgaccccgacggcggagcaatgtaaacgcctgatgataggtgttggcagcagtcgttgtgggaatacagttgcagcagcaggtagtggcggcatttactcgacccccgaagatatgcagcactggatgcaacaattcttagcttctgataacagcgcccccaagcgttccgccaaacgtgagcaagcgctttacttccagcgcggtgacttggtgtcattgaaaggtatggatgtcgccggtcaagctgatgctctgggcttaggctgggtttatatggcacctaaagctgacttaccgggcattatgcaaaaaaccggcggtggcggtggatttattacttatatggcgatggtcccagaaaaaaacattggcgtttttgtggtggtcacacgaagccaactgactaaattcagcaatatgagtgatggtgtgaatcaattggttgctgagttggtgaaaaatcattga

SEQ ID NO: 48405 - protein, 388 aa, Yersinia pestis KIM
MDKRLLKRLSAPLLAAALWTIPLHSHADTQPLTSQDTKLLTSQIVDQYAEHIFYNSGAVGMALVVIDNNQVVNRSFGETQPGNNIRPRPDSLIRIASITKLMTSEIMVKLADDGIVKLTDPLKKYAPKGVNVPSYSAKQPIRLLHLASHTSGLPREQPGGPQKRPVFTWPTKDNRWQWLKLAKVTVPPGVKAAYSNLAYDLLADALSRAAGKPYAHLLRDKITAPLGMKNTTLTPTAEQCKRLMIGVGSSRCGNTVAAAGSGGIYSTPEDMQHWMQQFLASDNSAPKRSAKREQALYFQRGDLVSLKGMDVAGQADALGLGWVYMAPKADLPGIMQKTGGGGGFITYMAMVPEKNIGVFVVVTRSQLTKFSNMSDGVNQLVAELVKNH

SEQ ID NO: 48406 - DNA, 1485 bp, Oceanobacillus iheyensis HTE831
  CDS (1)..(1485)
atgaggaagaaagtaatgtcgttgctatttacgtttatccttttattttccacttttatatcaggcgctactggtatttacgcttcagagagtggattaaatccaggagatgctcatgatgttgaaatgctgcaacagccattagatgatctagatccatttattgagaatgcaatatctgatcaggtgatgcctggtgctgttgttctagtcgctcgagatggacagattgttaaacatgatgcatatggctatgctgcgcgctatacggatggtaattttaccgaaatggaaaatccaattgaaatgcaggaaaataccatctttgatacagcgtctatttcaaagctttttacagcaacagcaattatgactctttgggatgaaggattgtttgaattggatgatccggtagctttatatattcctgagtttgcaagtaatgggaaagaagaagtcacaatcaagcaattattaacccatacatcaggttttcgtgcatctactacggtacccgtccatgaaattgaaggggatcgtgaagatcgtttggactttgtcttaaatgaaactttagaagtgccgccgggtactcgttacctctatagtgatgtcgattttattacactaggagtgttaatcgaacgtctaagcggacaacgtcaagatgaatacgtggcagaaaatataacagaacctctacaaatgagtgatacgatgtatagtccacctgcttcactaaagaacagaattgctgcaacggagtatcaagccaatgtaaatcgtggacttgtttggggaagtgttcatgatgaaaaagcatgggcattggacggtgttgctggacatgccggggtttttagttcggcagaggatttagccgtgttcggacagatgatgttaaatgaaggaagttaccaaggtgaacagattttatccgaggaagcctttgacctcatcactacaaattggaatggtgccttcccaggccaagaccaaggtttggggtgggaattaaatcaaagttggtacatggatgatttagcagaacagaatacgatagggcatacaggctatacaggtacgtccatcgtgattagccctaacaagaaatcgattacgatattactaactaatagagtacatccaacaagaaatacggtatcaacaaatccgacccgccgaatggtgtcggagaagactgcctctgctatcgatgcttggagtgccgaaagtatggcgtctcttgttaatcgtttggttgatcgaggtgaaattacagatgtctctactactcgatcacttcttacacacttaagaacagtctctcattttgagtcacttgatcaagctcataaagttcgtaaacacttagaaggtcttcaattattagtggattttcataatgagaataattcgatatcagataatgcatacgaaacgttaactacggatatcgattatttaacaggaaaatggcaataa

SEQ ID NO: 48407 - protein, 494 aa, Oceanobacillus iheyensis HTE831
MRKKVMSLLFTFILLFSTFISGATGIYASESGLNPGDAHDVEMLQQPLDDLDPFIENAISDQVMPGAVVLVARDGQIVKHDAYGYAARYTDGNFTEMENPIEMQENTIFDTASISKLFTATAIMTLWDEGLFELDDPVALYIPEFASNGKEEVTIKQLLTHTSGFRASTTVPVHEIEGDREDRLDFVLNETLEVPPGTRYLYSDVDFITLGVLIERLSGQRQDEYVAENITEPLQMSDTMYSPPASLKNRIAATEYQANVNRGLVWGSVHDEKAWALDGVAGHAGVFSSAEDLAVFGQMMLNEGSYQGEQILSEEAFDLITTNWNGAFPGQDQGLGWELNQSWYMDDLAEQNTIGHTGYTGTSIVISPNKKSITILLTNRVHPTRNTVSTNPTRRMVSEKTASAIDAWSAESMASLVNRLVDRGEITDVSTTRSLLTHLRTVSHFESLDQAHKVRKHLEGLQLLVDFHNENNSISDNAYETLTTDIDYLTGKWQ

SEQ ID NO: 48408 - DNA, 1134 bp, Shigella flexneri 2a str. 301
  CDS (1)..(1134)
atgttcaaaacgacgctctgcgccttattaattaccgcctcttactccacatttgctgcccctcaacaaatcaacgatattgtgcatcgcacaattaccccgcttatagagcaacaaaagatccccggtatggcggtggcggtaatttatcagggtaaaccttattactttacctggggctatgcggacatcgccaaaaagcagcccgtcacacagcaaacgttgtttgagttaggttcggtcagcaaaacatttacgggcgtgcttggtggcgacgctattgctcgaggggaaatcaagttaagcgatcccgcaacaaaatactggcctgaacttaccgctaaacagtggaatgggatcacactattacatcttgcgacctacaccgctggcggcctgccattgcaggtgccggatgaagtgaaatcctcaagcgacttgctgcgcttctatcaaaactggcagcctgcatgggctccaggaacacaacgtctgtatgccaactccagtatcggtttgttcggcgcactggctgtgaagccgtctggtttgagttttgagcaggcgatgcaaactcgtgtcttccagccactcaaactcaaccatacgtggattaatgtacctcccccagaagaaaagaattacgcctggggatatcgcgaaggtaaggcagtgcatgtttcgccaggggcgttagatgctgaagcttatggtgtgaagtcgaccattgaagatatggcccgctgggtgcaaagcaatttacccccccttgatatcaatgagaaaacgcttcaacaagggatacaactggcacaatctcgctactggcaaaccggcgatatgtatcagggcctgggctgggaaatgctggactggccggtcaatcctgacagcatcattaacggcagtgacaataaaattgcactggcagcacgcccggtaaaagcgattaagcccccaactcctgcagtacgcgcatcatgggtacataaaacgggggcgaccggcggatttggtagctatgtcgcgtttattccagaaaaagagctgggtatcgtgatgctggctaacaaaaactatcccaatccagcgagagtcgccgccgcctgtcagattctcaacgctctacagtaa

SEQ ID NO: 48409 - protein, 377 aa, Shigella flexneri 2a str. 301
MFKTTLCALLITASYSTFAAPQQINDIVHRTITPLIEQQKIPGMAVAVIYQGKPYYFTWGYADIAKKQPVTQQTLFELGSVSKTFTGVLGGDAIARGEIKLSDPATKYWPELTAKQWNGITLLHLATYTAGGLPLQVPDEVKSSSDLLRFYQNWQPAWAPGTQRLYANSSIGLFGALAVKPSGLSFEQAMQTRVFQPLKLNHTWINVPPPEEKNYAWGYREGKAVHVSPGALDAEAYGVKSTIEDMARWVQSNLPPLDINEKTLQQGIQLAQSRYWQTGDMYQGLGWEMLDWPVNPDSIINGSDNKIALAARPVKAIKPPTPAVRASWVHKTGATGGFGSYVAFIPEKELGIVMLANKNYPNPARVAAACQILNALQ

SEQ ID NO: 48410 - DNA, 1029 bp, Corynebacterium efficiens YS-314
  CDS (1)..(1029)
atgcgcagaacaaccaccatcctcaccatcgtcaccgcagcactggccctgactgccgccatcgccacggcagcgctcgcccttgccatcggtcccaggcccatcaccaccgccacccggcacaccggtgatcccaccctggcgaccatcctcgcggagcacgcaccaccgggaagccggaacatctcggcattcatcctccgggacggacaggccacgtttgccggcctgggatcagatgaacacaccgagttcgagatcgggtccatcaccaagaccttcaccgcggacctgctcacccgggccgtcgaccgcggggaactgaccctggacaccacggttggcgagatcatcgaggccaccggttcagagatcaacgatgtcaccctggaggagctggccgcccacacctccggtctgccacgtctggcaaagatgggactgccgcagttcatcgcctcggtcaccggtagcaatccctatgccgaccacacgcgggaggaactcctcgacgccgcccgggacgcctccctgactgaccgcggggaggtcgcctactccaacttcgggttcgccctgctggggcaactgctggccgaagccgccggcacctgctaccccaccctgatccaggatgagatcctggctccactgggcatggaggacacctacctcatgacccccggatctgtacccggggacgccccacggggcctgaccacccgcgggcgggaatccaccccgtgggagatggaggccgacgccccggccggagcgctgcgctccactgcccgggacatggccgtctgggctgatcatgtgctgagctcacccctgccggattacacctgggcccacgacaccggcgacaccgtcttccacaacggtgggaccggtggtttcatgtccatgctgctgattgacccttccactaatacggcgacgtttgccatcaccgacaccaacgccggcatggaggacctggggcgggtcctgttagaccacgcccgaacgaaggaggcggtctga

SEQ ID NO: 48411 - protein, 342 aa, Corynebacterium efficiens YS-314
MRRTTTILTIVTAALALTAAIATAALALAIGPRPITTATRHTGDPTLATILAEHAPPGSRNISAFILRDGQATFAGLGSDEHTEFEIGSITKTFTADLLTRAVDRGELTLDTTVGEIIEATGSEINDVTLEELAAHTSGLPRLAKMGLPQFIASVTGSNPYADHTREELLDAARDASLTDRGEVAYSNFGFALLGQLLAEAAGTCYPTLIQDEILAPLGMEDTYLMTPGSVPGDAPRGLTTRGRESTPWEMEADAPAGALRSTARDMAVWADHVLSSPLPDYTWAHDTGDTVFHNGGTGGFMSMLLIDPSTNTATFAITDTNAGMEDLGRVLLDHARTKEAV

SEQ ID NO: 48412 - DNA, 1143 bp, Pseudomonas putida KT2440
  CDS (1)..(1143)
atgctccgcccacgtctggctgcacttgcagccgccattacccttgccttaggccctgccagcgcccaggccgacgaccagttacaggccaaggtcgaccagatcatccgcccgctcatgcaggaacaaggcatcaccggcatggctgtggccatctatgcacgcgaccacgcgcattacttcagctacggtgtggccagcaaggccgacaacgtaccggtcagccgcgatacgctgttcgagatcggttcgctgagcaagacctacacggccaccctggccgcgcttgccagcgccgagggcaagcttgacctcgaggccccggccaagcgctatcacccggcattggccggcgtccccatcggcgacgcgacggtgctggaactgggcgcctatagcgccgactgcctgccactgcagttccccgacaccgtacaaacaccgcaacaggtagtcgatttcttccgccactggcaacctcgtgccaaacctggcacccagcgctgctactccaaccccagcctgggtttgttcggtgacctggccgcccgtgcgcagcaccaaccgttttccacgctgatgagtgagggcctgctgacgaagatgggcctgaaaaacacctaccttcaggttccggccagcgcccaggggctttatgcccaagggtatgacgccgacgacaagccggtgcgtgtagggcccggcccttacgccgatgaggcctacggcatcaaaaccagcgccagcgacctgctgcgctatgtgcggttgcacatgcagccgcagggcctgccaccggccctggcgaaagccaccgccattacccagcagggctacttccaggttggcgccatgacgcaaggcctgggctgggaacgctacccctacccggtcacgctgagcacactgatcgatggcaacagcccacagctgatccgcgaaccgcaggccaccactcgcttgcaaccggccctgcccgcgctaccggcagcctggtacaacaagaccggcgccaccaacggcttcggcgcgtacgccgcgttcgtgccggcagaacagctggcagtcgtgctgctggccaatcggaattaccccaaccaggcgcgggttcaagccgccttcgacatcctttccggcttataa

SEQ ID NO: 48413 - protein, 380 aa, Pseudomonas putida KT2440
MLRPRLAALAAAITLALGPASAQADDQLQAKVDQIIRPLMQEQGITGMAVAIYARDHAHYFSYGVASKADNVPVSRDTLFEIGSLSKTYTATLAALASAEGKLDLEAPAKRYHPALAGVPIGDATVLELGAYSADCLPLQFPDTVQTPQQVVDFFRHWQPRAKPGTQRCYSNPSLGLFGDLAARAQHQPFSTLMSEGLLTKMGLKNTYLQVPASAQGLYAQGYDADDKPVRVGPGPYADEAYGIKTSASDLLRYVRLHMQPQGLPPALAKATAITQQGYFQVGAMTQGLGWERYPYPVTLSTLIDGNSPQLIREPQATTRLQPALPALPAAWYNKTGATNGFGAYAAFVPAEQLAVVLLANRNYPNQARVQAAFDILSGL

SEQ ID NO: 48414 - DNA, 1284 bp, Bradyrhizobium japonicum USDA 110
  CDS (1)..(1284)
atgaagccatggagaagtgacatgaacgggcgccgcgcgctgatcgcggcgctcgtcgttctggtcggtgtggtcggcgcgagagcaggctacgaggggcgccccgcgcacagcctctcgcctgaaggcttggcaaaagtctccgactacatccgcaacgaggtcgcgaccggcaagatacccggcgcgatcctgctgctccagcagcacggcaagccggtctattacgagaattttggcgtccgcgacgtcgcgaccgagatctcgatgagcgcggacacgatcttccgcctctattcgatgtcgaagccgatcacctccgtgatggcgatgatgctggtcgaggagggcaagctcgcgctcgacgatcccgtttcaaagtacattccggcctttgccggcatgaaggtcggcgtcgaaaagaaaggcgaggacggcaaggtcgggctggcgctggagccgctcgaacatccggtcacgatcaaggatctgatgcgtcacacctccggactgccttatggctattacggcggcggcgcggtgcgcgagctctatgccgaggcgaagctcttcaatcgcaatctcagcaatgccgacttcgccgcgaagatcgccacgctgccgctggtcgagcagccgggcacggtgtgggattacggcttttccaccgacgtgctcggacgcgtcgtcgaggtgatctcgggaaagacgctgctccagttcgagagggagcggctgctgggtccgctcggcatgaccgagacggcattcttcgtcgccgatcccgccaagtttccccgcattgccgagccgatgccggaggaccgcaacatcaatccgacgacgcaggtccgcgatatcaggcggccggcgacctgggagtcgggcggtggcgggatggttggcaccgtcggcgactacgcccgtttcgcgcagatgctgctgaatggcggcacctatgacggccggcgctatctcaagcccgagaccattgcgctgatggcgtcggatcatatcggaccggagaccagaatcgcgcgcgaccagaactattatccgggcgcgtcctccggctacggcctcggctttgcggtgcgcacgtccgtgccggcgggtacgtcatggccactcggcgaatatcgctgggacggcgtcggcggcaccttcttcttcatcgatcccgaagacgatctgttcgggatcttcatggtgcagaccccgtcgcagcgcggccggatccagctggcgctgaagacgctgatctatcaggcgatggggcgctga

SEQ ID NO: 48415 - protein, 427 aa, Bradyrhizobium japonicum USDA 110
MKPWRSDMNGRRALIAALVVLVGVVGARAGYEGRPAHSLSPEGLAKVSDYIRNEVATGKIPGAILLLQQHGKPVYYENFGVRDVATEISMSADTIFRLYSMSKPITSVMAMMLVEEGKLALDDPVSKYIPAFAGMKVGVEKKGEDGKVGLALEPLEHPVTIKDLMRHTSGLPYGYYGGGAVRELYAEAKLFNRNLSNADFAAKIATLPLVEQPGTVWDYGFSTDVLGRVVEVISGKTLLQFERERLLGPLGMTETAFFVADPAKFPRIAEPMPEDRNINPTTQVRDIRRPATWESGGGGMVGTVGDYARFAQMLLNGGTYDGRRYLKPETIALMASDHIGPETRIARDQNYYPGASSGYGLGFAVRTSVPAGTSWPLGEYRWDGVGGTFFFIDPEDDLFGIFMVQTPSQRGRIQLALKTLIYQAMGR

SEQ ID NO: 48416 - DNA, 1158 bp, Salmonella enterica subsp. enterica serovar Typhi Ty2
  CDS (1)..(1158)
ttgaaacgtagtctgctttttactgccatgctgtttgcggcatcacttacttctgtccaggcggctcagccgattgccgatccggtttttgcctctgatatcgttgatcgttatgccgagcatatcttttatggtagcggcgccacgggcatggcgctggtggtgatcgacggcaatcaacgcgtgtttcgtagtttcggtgacaccagaccgggcaataatgttcgtccacagcttgactcggtcattcgtatcgcttctctcaccaagctcatgaccagtgaaatgttggtaaaattgctcgatcagggaacggtaaaattaaacgatccgctcagcaaatatgcgcctcccggcgcgcatgtcccgacgtatcaaggcacgccgattacgttggtcaacttagcgacccacaccagcgcgcttccgcgagaacagcccggcggcgcggcgcatcgtccggtatttgtctggccaacccgcgaacaacgctggaactggctctccacagcaacgttaaaagtcgcgcccggttcacaggcggcctattccaatctggcgttcgacctgttagccgacgcgctggcgaccgcctccggcaaaccttatacgcaactgtttgaagaaaagattacccgcccgctgggaatgaaagacaccacgtttaccccctctcccgatcagtgtaagcgtctgatggtggcagagaaaggcgcaagcccctgtaataatacgctggctgccattggcagcggcggagtctattctacgccaggagatatgatgcgctggatgcaacagtatctgtcgtcagatttctatcaccgtagccatcaggccgatcgtatgcaaacgttgatttatcagcgcgcacagttaaagaaaatcatcgggatggacgtaccgggtaaagccgacgcgctcggtctgggctgggtctatatggcgccaaaagacggacgtcctggcattatccagaaaacgggaggcggcggcggttttattacctatatggcgatgatcccacaatataatattggcgcttttgtggtcgtaacccgttcccccctcacccgttttaccaatatgagcgacgggattaacgatttggttactgagctaagcggcaataaaccgattgctattcctgcatcctga

SEQ ID NO: 48417 - protein, 385 aa, Salmonella enterica subsp. enterica serovar Typhi Ty2
MKRSLLFTAMLFAASLTSVQAAQPIADPVFASDIVDRYAEHIFYGSGATGMALVVIDGNQRVFRSFGDTRPGNNVRPQLDSVIRIASLTKLMTSEMLVKLLDQGTVKLNDPLSKYAPPGAHVPTYQGTPITLVNLATHTSALPREQPGGAAHRPVFVWPTREQRWNWLSTATLKVAPGSQAAYSNLAFDLLADALATASGKPYTQLFEEKITRPLGMKDTTFTPSPDQCKRLMVAEKGASPCNNTLAAIGSGGVYSTPGDMMRWMQQYLSSDFYHRSHQADRMQTLIYQRAQLKKIIGMDVPGKADALGLGWVYMAPKDGRPGIIQKTGGGGGFITYMAMIPQYNIGAFVVVTRSPLTRFTNMSDGINDLVTELSGNKPIAIPAS

SEQ ID NO: 48418 - DNA, 1887 bp, Mycobacteriophage Omega
  CDS (1)..(1887)
atgacaatcaaagggtatttcgtttacgcgaaagagaaggacgcttcaggcgatttcgttcagttgaatcccgacccggtgttgccgccgtacgggacaaacggtttgaagtcgaacaccacgtacgagttctatgtgaagacggtggacaacgccggctggttgtcggacccgtcggatacctacgagttcaccactcccgcgcacactgcgggtgatttgttgtcgccggaggaccaggcgatggtggatttgattgtggaggagtcccgcgcggagaccggccagccgggagtgatgttgcagatcaccggtccgcgcgggaactatgcgaaggcgtatggcaccaccgtgggcggcacggttcgcccgttgacgttggatgaccacttccgcatgggttcctccacgaagatgttcaccgcgattgcgtttttccaggccgtcgacaaaggcctcatcacgctggatgacactctggagcagtacgttccgggcatcccgaacggtaccgcgatcacgatggggcacatgctgtccatgcggtcgggtatcgcggagtatacggcgggtatcaacgcgctctggatcacgctgtttccgacgtggccatggacgggcgcgaaggacttcctgggctctatgaaagggccgtcaaatttctatcctggcaccgactacctgtatacgaactccaactttgcgctgatcgggatggttctagagattgtcgacccggcccatcggccgatcaagcaaatcttcaaagaagacatcatagaccctcttgggctgacggaaacgtcatggccgccgatcggtccagttcctccccccgcgtcgatcgctgacacgttcaacccgaacttcctcgacgctgccggggcgctggcgacgaacatcaacgactacacgaagttcgcggaggcgttgcgggacaacgcgatgggcctgtcgcccgagtcgtatgacgcgtggctgtcaacgttctggaagcatcccacagggtgggacccgtacgcgaacgggttctacattccttccgagtactactacgggtacgggatagagtcgttcggaacgtggttcgggcatccgggactcttttcgggtggctggtcgtccacgattttctttgagcgggactcgggtgcgacattcacgctgcacgagaactcgaatacctccaaccccccggccgcgggctatacccgcatttgggtgcgggtggcggagtatctgtaccccggaacgattacgaatgaccaaaactggccggtgccgccggagccggtggatgttgggtttgatgcagtgtcgtcggccggggctggtgtcggtagcgccactgtgaacttcaaggcctccgagggggccacggtgttcgcggtggtggcgtgggaccgcgcgggctcagccccgtcggccacatatggcggcgccggcggtgtacttctcgggtccgtttcgcacgatggcgatccggcgaatggaggattggcgattttccgcatggagaacgcaggctccggcgttgctcgccagatgaaggccaccggcccgggctgggtgagtgcgtatgccatttcattcaacgatgttgtgtccgtgggaacccccacgttcgcgcacggcaacggcactgcgcacagccagtcggtgacggtaccgagcggggtgacgctgcaggcgttctcggccggggccgggggggcgtcgtcgtccaagctgacaacgattctgggggcgcgcttgcgcgcggagcagtcggggatcgccccgcccctgtgtgtcaacacgacgaccaggacgggaacggtgagcgccacctcgtcgcggccgaataagtgggctggcatggcggtgaacttgcagattgggggatga

SEQ ID NO: 48419 - protein, 628 aa, Mycobacteriophage Omega
MTIKGYFVYAKEKDASGDFVQLNPDPVLPPYGTNGLKSNTTYEFYVKTVDNAGWLSDPSDTYEFTTPAHTAGDLLSPEDQAMVDLIVEESRAETGQPGVMLQITGPRGNYAKAYGTTVGGTVRPLTLDDHFRMGSSTKMFTAIAFFQAVDKGLITLDDTLEQYVPGIPNGTAITMGHMLSMRSGIAEYTAGINALWITLFPTWPWTGAKDFLGSMKGPSNFYPGTDYLYTNSNFALIGMVLEIVDPAHRPIKQIFKEDIIDPLGLTETSWPPIGPVPPPASIADTFNPNFLDAAGALATNINDYTKFAEALRDNAMGLSPESYDAWLSTFWKHPTGWDPYANGFYIPSEYYYGYGIESFGTWFGHPGLFSGGWSSTIFFERDSGATFTLHENSNTSNPPAAGYTRIWVRVAEYLYPGTITNDQNWPVPPEPVDVGFDAVSSAGAGVGSATVNFKASEGATVFAVVAWDRAGSAPSATYGGAGGVLLGSVSHDGDPANGGLAIFRMENAGSGVARQMKATGPGWVSAYAISFNDVVSVGTPTFAHGNGTAHSQSVTVPSGVTLQAFSAGAGGASSSKLTTILGARLRAEQSGIAPPLCVNTTTRTGTVSATSSRPNKWAGMAVNLQIGG

SEQ ID NO: 48420 - DNA, 1386 bp, Streptomyces avermitilis MA-4680
  CDS (1)..(1386)
atgaagacatcccaagaagagctgctcccggcaacccgccgggctctgctgcaccggatcgcggttgctcaggccgaggggcgcgccccgtcgttggcagcggcggtcgtacggggcgggcagacggtgtggtacggctcgcggacctcggtggacgggcacgcgccggacgagaacgtgcagtacaggatcggctcgatcaccaagaccttcaccgccgtactcgtgctgcggctgcgggacgagggagtgctggacctcggcgaccccctggagaagcatctgccgggcacgggtgcgggggaggccaccatcgccgaactgctcgcgcatacgggcgggttggcggccgagtcgcccgcgccctggtgggagcgcacgcccggctcccttcgcccggagcttgccgatgtcctgggcgaactgccgctgaggcatccggtcggccggcggcaccattattcgaaccccggctacacgcttctgggtgctctggtcgaggaactgcgaggcgctccctgggaggaagtgctgcggcgcgaggtgctcgaaccgctgggcatgcgccggacgagcggagacccgcgggcgcctcatgcgggtggctgggcggtgcatccgtgggccgatgtgatgcttccggagcctgccgaggacctcggcaggatggcaccggccggtcagctctggtccacgaccggcgacttggcgcgcttcgccgtcttcctcgcccagggagacgagcgggtactgagcgcggattccgtccgggagatgcgtacgccggccgcgcccgccgaggccgcggacgtgatgtccggctccgcctacgggctgggtatgcagctccagtaccgggacggtcgactcctcgtcgggcactccggttccctgccgggctttcttgcgaacctcaccgtcagcgtggaggacgatctggcggccgtcgtgctggtcaactgcacttccggcccgatgccgtcggccgtcgccgccgatctcgtgcgcatcgtcgccgaggccgaaccccggattcccgagccgtggcgaccgctgcccgatgtcgacgagggcgtcctggagttggcggggcagtggtactgggggacccaggccttcgtgctgcggctgaccgtcgacggaggggtttcgctggagccgctgagcggcgtcggccgtcgggcgcgcctgcgggcgaacggtgacggcacctggaccgggctcgacggctattacgcgggagagctcctgaaggccgtacgacggcctgacgggtccgtgagccacctggacctcgggtcgttcgtgttcacgcggcagccgtacgacgagggggctccggtgccgggcggggtggatcctgaggggtggcgcggcatcccatag

SEQ ID NO: 48421 - protein, 461 aa, Streptomyces avermitilis MA-4680
MKTSQEELLPATRRALLHRIAVAQAEGRAPSLAAAVVRGGQTVWYGSRTSVDGHAPDENVQYRIGSITKTFTAVLVLRLRDEGVLDLGDPLEKHLPGTGAGEATIAELLAHTGGLAAESPAPWWERTPGSLRPELADVLGELPLRHPVGRRHHYSNPGYTLLGALVEELRGAPWEEVLRREVLEPLGMRRTSGDPRAPHAGGWAVHPWADVMLPEPAEDLGRMAPAGQLWSTTGDLARFAVFLAQGDERVLSADSVREMRTPAAPAEAADVMSGSAYGLGMQLQYRDGRLLVGHSGSLPGFLANLTVSVEDDLAAVVLVNCTSGPMPSAVAADLVRIVAEAEPRIPEPWRPLPDVDEGVLELAGQWYWGTQAFVLRLTVDGGVSLEPLSGVGRRARLRANGDGTWTGLDGYYAGELLKAVRRPDGSVSHLDLGSFVFTRQPYDEGAPVPGGVDPEGWRGIP

SEQ ID NO: 48422 - DNA, 2088 bp, Bacillus cereus ATCC 14579
  CDS (1)..(2088)
gtgatgaaaaataagctaactggtgtgttagccactgcattagcggtaactatgattctaccaacaggagcgaaagcattttctgaaagtaagactactgttgtaactggtgaagaagtagctagtcaggaactgaagaagagtgcagcagagaaagcggagctacttacgaagtcccatggggcagctagcgtgcagtatgcactaattgataatggaaaacttattttgtctggtcaggctggcaagaacgatatggaaggggaaaagccgctaaccaaagatactttatacgggattggttcagttagtaaaatgtatgcaacagcggctgtaatgaaattggtcgatgaaggaaaagtcgatttggatgctcctgttgtccgctatgttcctgattttaagatgaaggacggtcgatacaaacgtataacaccgcgtatgttattgaatcactcctctggattgcaaggttctacgttaggtaatgcatttttatttaacgataatgatacctatgcccatgataccttgttacagcaattgtcaaatcaaaacttgaaggcggaccctggtgctttctcagtatactgtaacgatggttttacgctggccgaaattttggtggaaagagttagtggtatgagctttactgaatttctacatcaaaactttacagggcctttaaaaatgaatcatacgaaaacgccacaggacaaatggagggatgaaaatcgggctggactatattactcggcgtaccaagggcaacttccaattgaatcggtgaatgttattggtacgggaggcatatcttccacggcagaagatatggtgcgattctcacaactatttatgggacagggaaaaggaatcctctctgataaggtagttaaggcaatggagcaagaggaatataaaaaaggaatgtggccgggggctggcgagaatatttttaactatggtcttggctgggatagtgtgaaactatacccattcagtgaatatgggatcaaagctttggctaagggcggcgatacggcattgcaacatgctatattagtcgtgcttccggaacagaaaatagcagcggctgtattgacatctggtggacggagctctacaaatcagctaatggcaactgaattgctgctcgctacgcttaaagaaaaaggtactattaaggaaatcaagccgaacaaatcctttggtaagccggtcaaagtcaaaatgcctcaaggcgtagcaaagaaagcaggattttatggcaatagcgaaactcatttcaaaattgaaattacgaagaacggtgaactattcttaccatctaatccagaagaaaaatatgtatatactgctgatggaagctttattaatgaggggggtacttccaagctcaacttcgtaaccgagaagaatggaagaacttatttgaaggagagcgcatataaatcttatccaggtttagggcaaagtgtgatgacccactatttagctgagaaactagaagacaacgtgctttcgaagaaaaccgctgctgcatgggcaaagagggaaggtgtcaagttttatcgtgtaaacgagaaatttagttctattcaatatcttgttcagtcgaaacatcttagtactcaaattactcgcaaggaaggcccagcaggctattgggatggcagaaaaattacaggtccgaacaccgcggtgcatcagatccaagtacccgtgatgaatggtcgtgatacgacggaaacacacttctatacagaaggcggcaatgaatatatcgagatggctggattgttatacgtaagtgaatctaatgtaaaaccaattgatgtaggccaatcatccaaagttacgctgggagcaaatggacatgcgaaatggtttacaattccacaagcggcaacagacaaaaggatgaccgtgacgctgccatcaaatggttcatttgcggtgtatgatgagaagggagtttgcgtcaacttcaccattgtgagtggcaataacaaggtggaacttccgaagaacggaacaatcgtattcgctggggcaccgaaatcggaatttgcaatctcggtgaactag

SEQ ID NO: 48423 - protein, 695 aa, Bacillus cereus ATCC 14579
MMKNKLTGVLATALAVTMILPTGAKAFSESKTTVVTGEEVASQELKKSAAEKAELLTKSHGAASVQYALIDNGKLILSGQAGKNDMEGEKPLTKDTLYGIGSVSKMYATAAVMKLVDEGKVDLDAPVVRYVPDFKMKDGRYKRITPRMLLNHSSGLQGSTLGNAFLFNDNDTYAHDTLLQQLSNQNLKADPGAFSVYCNDGFTLAEILVERVSGMSFTEFLHQNFTGPLKMNHTKTPQDKWRDENRAGLYYSAYQGQLPIESVNVIGTGGISSTAEDMVRFSQLFMGQGKGILSDKVVKAMEQEEYKKGMWPGAGENIFNYGLGWDSVKLYPFSEYGIKALAKGGDTALQHAILVVLPEQKIAAAVLTSGGRSSTNQLMATELLLATLKEKGTIKEIKPNKSFGKPVKVKMPQGVAKKAGFYGNSETHFKIEITKNGELFLPSNPEEKYVYTADGSFINEGGTSKLNFVTEKNGRTYLKESAYKSYPGLGQSVMTHYLAEKLEDNVLSKKTAAAWAKREGVKFYRVNEKFSSIQYLVQSKHLSTQITRKEGPAGYWDGRKITGPNTAVHQIQVPVMNGRDTTETHFYTEGGNEYIEMAGLLYVSESNVKPIDVGQSSKVTLGANGHAKWFTIPQAATDKRMTVTLPSNGSFAVYDEKGVCVNFTIVSGNNKVELPKNGTIVFAGAPKSEFAISVN

SEQ ID NO: 48424 - DNA, 2076 bp, Bacillus anthracis str. Ames
  CDS (1)..(2076)
atggaaaataaattatctggagtgttagccgctaccttagctctaacgatgagcctaccaacaggagcgatagcgtcttctagcagtaagactccggttgtatctagccaagaagttgctagcaaagatttggagaagattgctgcagagaacgctgcactgctcacgaagtcctatgagacgactagtgtacagtatgcgctgattgataatggtaaacttattttgtcaggacagacaggcaagaatgacatagaggggaaagagccattaaccaaagatactctatacggaattggttcaaccagtaaagtatatacagctgcggctgttatgaaattagtagacgaaggaaaagttgatttggatgcttctgttacccgctatattcctgagttcaaaatgaaagatgaacgatataaacgcattacaccgcgtatgctgttgaatcactcctcaggtttgcaaggttcgacgctcaataatgcatttttatttaaagataatgatgtttatgcccatgatatcttgttgcaacaattgtccaaccaaaacttgaaggcagaccctggcgcgttctcagtatactgtaatgacggttttacgctggctgagatcttggtagaaagagtcagcggtatgagttttactgaatttctacatcaaaagtttacagagccattaaaactgaatcatacgataacatcgcaagataaatgggaagacgaaaagcgggctggacaatattctccgacataccagggacagcttccaagtgaaatggtaaatgtgattggtacgggaggaatctcttctactgcagaagatgtggtgcgattctcacaaatatttatgggacagggaaaagaaatcctctctaataaagcagtcaaggcgatggaacaagaagaatataaaaaaggaatgtggccgggagatagcggaaatgtgttcaactatggtcttggctgggatagtgtgaaactatacccattcagtgaatatgggataaaagcgttgactaagggtggggatacgatgctgcaacatgctacattggtcgtacttccagaacagaagatggcagcagctgtattgtcctccggcggctccagcatgacaaatcaactgttggcaaataaattactgctagctaggcttaaagagaaagggacaattaaggatataaaaccagatagatccttcggcaagcccgtcaaggctaaagtgcctcaagacgtggtaaaaaaagcaggattttatggaaatagttatagccatttcaaaatagaaattacgaagaagggagaactgtttttaccaactaaaccagaagaaaaatatgtatatacggcggatggaagctttataaatgagaagggcacttccaagcttaacttcgtcacagagaagaatggaaaagtttatttgagagagagcgcatatgaattatcgccgggattggggcaaaatgtgctgactcactatttagcccagaaattagaaaacaatgtgttaccgaagaaaacagctgctgcatgggcgaagcgcgagggcggcaagttctacctcgttaacgaaaaatttaattctataaattatctaggacaacagatacctcttaatacacaaattacgctcaaagatggctattgggacggcaaaaaaattacaggtccgaatacggcgacgcatcaaattcaaattcccgtgatgaatgggcgggatacaaaggaagcccatttctatacagaggatggtactgaatatatggagatgtccagctttttatacgtcagtgaatctaacgtaaaatcccttgatacaggtcaattatcgaaagttacattgcaaaaaagtgggcatgcgaaatggtttacgatcccgcaagaggcagcagggaaaacgatgaatgtggaattgccatcaggaagttcattcgcggtgtatgatgagaatggagtatgcgtcaattttagcgttgttagtaataataacaaagtgaaactaccagagaacggaacggttgtatttgctggcgcaccgaactccgaatttacagtcgcattgaactag

SEQ ID NO: 48425 - protein, 691 aa, Bacillus anthracis str. Ames
MENKLSGVLAATLALTMSLPTGAIASSSSKTPVVSSQEVASKDLEKIAAENAALLTKSYETTSVQYALIDNGKLILSGQTGKNDIEGKEPLTKDTLYGIGSTSKVYTAAAVMKLVDEGKVDLDASVTRYIPEFKMKDERYKRITPRMLLNHSSGLQGSTLNNAFLFKDNDVYAHDILLQQLSNQNLKADPGAFSVYCNDGFTLAEILVERVSGMSFTEFLHQKFTEPLKLNHTITSQDKWEDEKRAGQYSPTYQGQLPSEMVNVIGTGGISSTAEDVVRFSQIFMGQGKEILSNKAVKAMEQEEYKKGMWPGDSGNVFNYGLGWDSVKLYPFSEYGIKALTKGGDTMLQHATLVVLPEQKMAAAVLSSGGSSMTNQLLANKLLLARLKEKGTIKDIKPDRSFGKPVKAKVPQDVVKKAGFYGNSYSHFKIEITKKGELFLPTKPEEKYVYTADGSFINEKGTSKLNFVTEKNGKVYLRESAYELSPGLGQNVLTHYLAQKLENNVLPKKTAAAWAKREGGKFYLVNEKFNSINYLGQQIPLNTQITLKDGYWDGKKITGPNTATHQIQIPVMNGRDTKEAHFYTEDGTEYMEMSSFLYVSESNVKSLDTGQLSKVTLQKSGHAKWFTIPQEAAGKTMNVELPSGSSFAVYDENGVCVNFSVVSNNNKVKLPENGTVVFAGAPNSEFTVALN

SEQ ID NO: 48426 - DNA, 1551 bp, Mycobacterium bovis AF2122/97
  CDS (1)..(1551)
gtgatgttgctgacgttaacgggttgcggatccacgcaccaggcacttggcccgccgtccgggttgcccgatgcctctcccaatgagaggtcagcgatacagatccccgctggccgcatcgacgatgccgtggcaaaggtcgacggcctggtcggcgagctgatgcagaataccggcatacccggaatggcagtggcgatagtccatggcggaaagacgttgtatgccaaagggttcggtgtcagagacgtgggcaaaggtggtggtccggacaacaaggtggacgccgacaccgtctttcagttggcgtcggtgtccaaatcggtcggcgccacggtggtggcgcatgcggtaaccgacaacgtcgtgacctgggatacgcccgtcgtatcgaagctgccgtggtttgcccttcgcgatccctacgtcaccggccaggtaaccattgctgacctctactcgcatcgctccggcctgcccgaccatgcgggcgatctgttggaggatttgggttatgaccgtcgacaggtactgcagcggctgaaatacctgccgctggcaccgtttcgaatcagctatgcctacaccaactttggtgtgaccgcggcggccgaagcggtcgcggccgcggccggccagtcctgggaggacctgtccgacgaggtgctctaccgcccgttggggatggggtctacgagttcccggttcaccgactttctggccaggcccaaccatgcggtcaaccacgtcaaggtcgcagaccgatgggaggcgcgctaccagcgcgatcccgacgcccaatcacctgcgggcggggtgagttcgtctcttaacgacatgacgcactggctggccatggtgctggccgacggcgtgtacaacggccgtcggatcacgtcgccggaggccctgctcctcgtctacacgccgcaggtgatctctcgacacccggtgtcaccgagagcgcgggccagcttctatggctacggattcaacgtgggggtaacctcttcgggacgcaccgagtacagccattccggcgccttcgggctgggtgccgcggcgaatttcgtggtgctgccctccgaagacctggccatcatcgcgctgaccaacgccgggcccatcggcgtgccggagacgctgaccgccgaattcatggacttggtgcagtacggccaggtacgcgaggactgggcggccctgtacaagaaggcatttgccccgctgaacgagctcgcgggctcgctggtcggcaagcaatccccggccaacccagcgccgagcagaccgctgaacgactacgtcggcgtgtacgccaacgactactgggggcccgccaccgtgacctaccacgacggccaactgcgcctgtcgctggggccgaagaaccagacgttcgatttgacgcactgggacggcgacactttcacgttcacgttgtcgaccgaaaacgcattgcccggatcgatttccaaggccaccttcgccggcgacacgttaaacctggaatactacgacgccgacaagctgggaacgtttacccgatga

SEQ ID NO: 48427 - protein, 516 aa, Mycobacterium bovis AF2122/97
MMLLTLTGCGSTHQALGPPSGLPDASPNERSAIQIPAGRIDDAVAKVDGLVGELMQNTGIPGMAVAIVHGGKTLYAKGFGVRDVGKGGGPDNKVDADTVFQLASVSKSVGATVVAHAVTDNVVTWDTPVVSKLPWFALRDPYVTGQVTIADLYSHRSGLPDHAGDLLEDLGYDRRQVLQRLKYLPLAPFRISYAYTNFGVTAAAEAVAAAAGQSWEDLSDEVLYRPLGMGSTSSRFTDFLARPNHAVNHVKVADRWEARYQRDPDAQSPAGGVSSSLNDMTHWLAMVLADGVYNGRRITSPEALLLVYTPQVISRHPVSPRARASFYGYGFNVGVTSSGRTEYSHSGAFGLGAAANFVVLPSEDLAIIALTNAGPIGVPETLTAEFMDLVQYGQVREDWAALYKKAFAPLNELAGSLVGKQSPANPAPSRPLNDYVGVYANDYWGPATVTYHDGQLRLSLGPKNQTFDLTHWDGDTFTFTLSTENALPGSISKATFAGDTLNLEYYDADKLGTFTR

SEQ ID NO: 48428 - DNA, 1170 bp, Rhodopirellula baltica SH 1
  CDS (1)..(1170)
atgaaccaaatcatctcgcgagtcgcctttgttttcctgttggctgtctcgactgccgcgaccggtcactcggaagacttcccatccgacgatgtgcggcggatcgtgaaggaaggcatccaagccggcaaatgccccggagcagttgtcgcgatcggcttcgacggacgaaccgtctttcagtctgctttcggggatcgtcaagtcgaaccgaccaaagttcccatgacagaagacacaatcttcgatctggcctcgttgaccaaaccgattgcgaccgcaaccagcgtgatgatcctggccgaccaaggcaaaatttcgatcgacgatccggtcagccaataccttcccgacttcgcaggtcaagacaaagaatccgtcacaatccggcacctgcttctgcacacctccggactgattcccgacaacggaatgtctgactacaaaggcacgcatgccgaatcgatcgcgaatttgatgaaccagaaacttcgcagcccacctggcacacgattccggtattccgatgttggcttcatggttcttggtgaactggtcgagcaggtctccgggaaaccgctgaatgaattcgctcaacaaaacatctttgaaccattgaagatgaaagacaccaactttcgatcgatcggacaagacgacgagcgctgcgcaaccacccaacaacgcgaaggtcactggatgcgaggcgaagtccacgaccctcgatgctacgccttgggcggcgtcgctggtcacgcgggattgtttagcaccgccgaggatctttccaagctcgccaacgttttgctgaaatcgggaaagaacgaagacgtgagtctgttttctcaatcaacctttgatgcgatgaccaccggcatcaaagtccctggtgcgtccgaaaatcaaattcaattgcgaagcctcggttgggacaagcaatccggttactcgtccaaccgaggcaaatcgatgaccgagtcggcctttggacatggcggcttcaccggcaccgcaatttggatcgatcctgaacaaaagctctatgtcattttcctcagcaaccgcgttcatcccgatggcaaaggttcagtcaattcgctcgccggcgagatcggaaccatcgccgcggactgggccatcgaacaactccgctcatctgaaactcgctga

SEQ ID NO: 48429 - protein, 389 aa, Rhodopirellula baltica SH 1
MNQIISRVAFVFLLAVSTAATGHSEDFPSDDVRRIVKEGIQAGKCPGAVVAIGFDGRTVFQSAFGDRQVEPTKVPMTEDTIFDLASLTKPIATATSVMILADQGKISIDDPVSQYLPDFAGQDKESVTIRHLLLHTSGLIPDNGMSDYKGTHAESIANLMNQKLRSPPGTRFRYSDVGFMVLGELVEQVSGKPLNEFAQQNIFEPLKMKDTNFRSIGQDDERCATTQQREGHWMRGEVHDPRCYALGGVAGHAGLFSTAEDLSKLANVLLKSGKNEDVSLFSQSTFDAMTTGIKVPGASENQIQLRSLGWDKQSGYSSNRGKSMTESAFGHGGFTGTAIWIDPEQKLYVIFLSNRVHPDGKGSVNSLAGEIGTIAADWAIEQLRSSETR

SEQ ID NO: 48430 - DNA, 2409 bp, Rhodopirellula baltica SH 1
  CDS (1)..(2409)
atgaaccacaacccgctctcccgtcacttcgcttccagacgattccccgctttccagaactggttcgcaggaatcgcattggcactcatggcttcgacatctctgcatgccggcccgcccgccgcatcaaaaacggacgaccatgactatcgccaactcatcgagcaactatcacaaacaattcgttccgaaatggaacagaagcaaatccccagcttctcaatcgcgttggtggcagatggaaaggttgtctcgtccgcagggttcggatttcaagatgccgacaagaccacccctgcttccgggaaaacggtctaccgagttggctcgatttctaagttgctgaccgacgtcgccttgatgcaactggtcgaacaaggcgaactggatttggatcaccctgttcaaaaggtgctacccgaattcaagatcgccgatgctgagcacagcgagaaaatcacgctacggcaactgactcagcaccgcgccggcatcgttcgcgaatcaccggtgggcaactacttcgatcccaccgaaccaaatctgaaagcaaccgtcgccagcctcgcggacactccgcctgtttacgccccaggctctcgcaccaaatactccaacgcgggggtatcggtcatcggattggcggttgaagaggccgctggagtgtcgcatccggaatacgtccaacaacacgtgctcgaaccactggggatgactcacaccagcttcgaaaagaacgaagccttgttggaacacaccgccgatggctggatgtggggctatgaccgtcccgcgtttgccgctcccgagttcctgctcggcaccggtccggccgggaacctgtattccagcgtcgaagacctggcccagttcagcttgttcgtgatggggcaacatcccgagaaaattctggaggacgcttctctcaatgagatgctccaacccggcgagacctccgacggaaaaccactgccctacggaatcggtttccgtgtcagcgacttccaaggacatcgccgagtcggtcatgggggagccgtgtatggcttctcaacccagctcgagatcttgccagacgagaacatcgccgtcatcgctgccagttcgctggacggaacgaacaactggatcacgcgaatctgtaaccaggcactggagggcatgcttgccgttcgaaacaaccaacaactgactccgcccgtttcaaccgaaccggtgccccgctcgcgagcccgcagtttggctggggtctactcctccatgcccggcgacgcttctcgaacggtgaccgtggactggatcggcgatcgactgctgctgtggaaaggaacattccaacgagaaatccgcagccgatcggacactggcgaattggtcctggacgatcgcttcgggtttggcccccgtattcaacaagaccaaacgtacctggtcatcgacgatgcgacctacacgcggctctccaacgctcccccaccagaaattcgcgacgaatggcgcgacctcatcggtgaatacggctgggaccacaacacgctctacatcctcgaacgccatggacaactgcacgcattgatcgagtggttctattactacccgctcacccaagtgagccaggatcgcttcgcgttccccgatcacgggctctatcacggcgaagaattgatcttcaaccgcgatgattcaggcgaaatcacagaagtcattgccgcccaggtcgcctttcaaaaacgcgaggtgggaaccaaagctggcgagaccttcaaaatcaagcgggaacttccggtcgacaaactgcgtgagctcgccgatgccgcgaaacctcctcatgaaggaggcaacttccgcccgtcggatctgaccgaactgacttcgcttgaccccagcatcgagttggacattcggtacgcgacgaccaacaacttcatggacacggttttctaccagcaaccgcgagcgttcgctcaacgtcccgccgccgaagccgccgtgaaagtgcaccaggaactcgcaaagcaaaacttgggtctgctcatttacgatgcctaccgaccgtggcgagtcaccaagatgttctgggacgcaactcctagcgaaatgaagaactttgtcgccaacccagcacagggttcacgacacaatcgcggttgcgccttggacctgacgctcttcgaccgcacgacccaagaagtcattccgatggtgtcaggttatgacgagttcagcgcacgatcgtttcccttgtatccgggtggcacccaaagagaacgttactaccgaggcttgctgcgacgagcgatggagaccgcaggctttcaagtttacgagttcgaatggtggcacttcgattttgatggctggcaacaataccgaattggcaatctccccttcgaagcgattcccaactga

SEQ ID NO: 48431 - protein, 802 aa, Rhodopirellula baltica SH 1
MNHNPLSRHFASRRFPAFQNWFAGIALALMASTSLHAGPPAASKTDDHDYRQLIEQLSQTIRSEMEQKQIPSFSIALVADGKVVSSAGFGFQDADKTTPASGKTVYRVGSISKLLTDVALMQLVEQGELDLDHPVQKVLPEFKIADAEHSEKITLRQLTQHRAGIVRESPVGNYFDPTEPNLKATVASLADTPPVYAPGSRTKYSNAGVSVIGLAVEEAAGVSHPEYVQQHVLEPLGMTHTSFEKNEALLEHTADGWMWGYDRPAFAAPEFLLGTGPAGNLYSSVEDLAQFSLFVMGQHPEKILEDASLNEMLQPGETSDGKPLPYGIGFRVSDFQGHRRVGHGGAVYGFSTQLEILPDENIAVIAASSLDGTNNWITRICNQALEGMLAVRNNQQLTPPVSTEPVPRSRARSLAGVYSSMPGDASRTVTVDWIGDRLLLWKGTFQREIRSRSDTGELVLDDRFGFGPRIQQDQTYLVIDDATYTRLSNAPPPEIRDEWRDLIGEYGWDHNTLYILERHGQLHALIEWFYYYPLTQVSQDRFAFPDHGLYHGEELIFNRDDSGEITEVIAAQVAFQKREVGTKAGETFKIKRELPVDKLRELADAAKPPHEGGNFRPSDLTELTSLDPSIELDIRYATTNNFMDTVFYQQPRAFAQRPAAEAAVKVHQELAKQNLGLLIYDAYRPWRVTKMFWDATPSEMKNFVANPAQGSRHNRGCALDLTLFDRTTQEVIPMVSGYDEFSARSFPLYPGGTQRERYYRGLLRRAMETAGFQVYEFEWWHFDFDGWQQYRIGNLPFEAIPN

SEQ ID NO: 48432 - DNA, 1149 bp, Rhodopirellula baltica SH 1
  CDS (1)..(1149)
gtgttcgtcaacccgaatagaatgtttcgtttggcatcgatttttgatttcggtgctcacaagtttttcggcaactgcgaaggcgagatcatgcgttggattttgggtgcattggtgatgagtttgttagccggaaatatggcggtcgatcaagctcaagcagacgatctcgaaatcccggcgatcacgcagtcaatgcaacagttcgtggcggacaaagaaatcgcgggagcggtcacgttggtggtcggcccggaatcggtgaagcatgtcagcgtggttgggacggccgacgtcgccgaggcaactccgttgaaacgagacactctgttttggatcgcttcgatgaccaagcccatcaccggggcttgcgtgttgatgctgcaagatgaaggcaaactgtcggtcgatgatccgatctccaagcatctgccgatgatgaaacatctgaagttggccgatggcacgcccgcgaatatcacgattcgacatctgatgacgcacacttccgggatgagcgaattgccgcgtgagagtgcttacacggatcccacgctggaggccgttgcgaaacgttacgcggaactgccagtgttgttcgaaccaggcagcgaatggcgatacagccaaaccggcatcaacaccgcggcgcgaattgtcgaagtggtctcgggaatgacctttgatcgcttcgtggaggagcgtgtttgtcagccgctcgggatgaaggacacggcgttttatctgaccccggaacagcacgagcgattgacgaaaacctaccgcgttgttgaaggagatggtgagaagccaaagcgtttggaagaagccacgatcagtgttctatccggtggcaccgcgatgaatcgcaatcgattccccgcagcgaacggtgggctgttttcgacggcggatgactacgccaagttctgccagatgttgttgcgagacggccgggtggacgacgagcaactgttgtccaaggccgctgtgcagcagatgcgaacgatctgcaccggtgatttgaaaaccggtttcactcctggcaacggatgggcaatcggttgctgcgtgattcgcgaaccgcagggtgtgaccaaggctctgacgccgggaacgtttggacacggaggtgcccatgggacgtag

SEQ ID NO: 48433 - protein, 382 aa, Rhodopirellula baltica SH 1
MFVNPNRMFRLASIFDFGAHKFFGNCEGEIMRWILGALVMSLLAGNMAVDQAQADDLEIPAITQSMQQFVADKEIAGAVTLVVGPESVKHVSVVGTADVAEATPLKRDTLFWIASMTKPITGACVLMLQDEGKLSVDDPISKHLPMMKHLKLADGTPANITIRHLMTHTSGMSELPRESAYTDPTLEAVAKRYAELPVLFEPGSEWRYSQTGINTAARIVEVVSGMTFDRFVEERVCQPLGMKDTAFYLTPEQHERLTKTYRVVEGDGEKPKRLEEATISVLSGGTAMNRNRFPAANGGLFSTADDYAKFCQMLLRDGRVDDEQLLSKAAVQQMRTICTGDLKTGFTPGNGWAIGCCVIREPQGVTKALTPGTFGHGGAHGT

SEQ ID NO: 48434 - DNA, 1317 bp, Chromobacterium violaceum ATCC 12472
  CDS (1)..(1317)
atgagaattctccccctgctaagcctcggcctgcccctgtttactaccctggcgcaggccgccgagcaaccggccgagtccccgatagaccgctacggccagcagattttcaagagcagcagggcagtcggcatgaccatggtggtgatagacaagcggcaggtccagatgcgtttctacggcgagacccgttccggcaaccgccaggctccgaacgcggactcgctggtgcgcatcgccagcatcagcaaggccatgaccggcgaagtgctgaccgcgctgacgctggacaagaaagtgaagctggacgacccgctgcagaaatacgcgccagccggcgtcaccctgccgccggcgggacagtcgatcaccctgctcaacctcgccacccataccagcggcgtgccgcgcgagatgccgggcgaaaagcccaaggacacgcccgtcttcgtctggcccaatgtccagcaacgctggagctggctgtccggcaccaagaacaagctcgcccccggccagcgcgcccagtattccaacctgggcttcgacctgctggccgatgcgctgtcccgcgccgccggcaaaccctatcccgtgctgttccgggaaaagatcaccgccccgctgggcatgaaggacaccaccttcacccccactcccgcccagtgcgcgcggctgatggaaggctacggcgccagcccctgcgtggacaccaccgcggcgataggcagcggcggcatctactccacgccgcgcgacatgcagcgctggctgcaggagctgctctacccgcagaacgaggcgaggcgccagttgcgcgaccagaccctgcgcatgcacttccagcgcgccgacctgaacagcctgcgcggcatggacgtggccggacaggccgaccagctgggcctggcctgggtaaggatggagcctggtccgaacgcgccggaaatcatccagaaaacggccggcggcggcggcttcctcggttacgcggcgctggcgccgcgcaacgacgtggcggtatgggtgggcctcacccgcagcggcggcactcactaccagagcctgagcaacggcgtcaacaagctggtggccgaactcagcggctacaagccgattgccgcgccgatgcccaagcccacgctggccaaaaccaaggccgcccgcggcaaggcggcgctcgcccaggccaagccggccgcgccgcgcgcgaaaaaggccgcgcggaaagccgccggccccaagactgccgccgcgaaagccggcgccaagaagaaagcccgcctggtcaagacctcggcacaccgggcgcagtga

SEQ ID NO: 48435 - protein, 438 aa, Chromobacterium violaceum ATCC 12472
MRILPLLSLGLPLFTTLAQAAEQPAESPIDRYGQQIFKSSRAVGMTMVVIDKRQVQMRFYGETRSGNRQAPNADSLVRIASISKAMTGEVLTALTLDKKVKLDDPLQKYAPAGVTLPPAGQSITLLNLATHTSGVPREMPGEKPKDTPVFVWPNVQQRWSWLSGTKNKLAPGQRAQYSNLGFDLLADALSRAAGKPYPVLFREKITAPLGMKDTTFTPTPAQCARLMEGYGASPCVDTTAAIGSGGIYSTPRDMQRWLQELLYPQNEARRQLRDQTLRMHFQRADLNSLRGMDVAGQADQLGLAWVRMEPGPNAPEIIQKTAGGGGFLGYAALAPRNDVAVWVGLTRSGGTHYQSLSNGVNKLVAELSGYKPIAAPMPKPTLAKTKAARGKAALAQAKPAAPRAKKAARKAAGPKTAAAKAGAKKKARLVKTSAHRAQ

SEQ ID NO: 48436 - DNA, 1095 bp, Gloeobacter violaceus PCC 7421
  CDS (1)..(1095)
atgaaaaaatggctgcccgttctgctgacattgctgctgctctgcacaatgaccattcctggccgggccgatgcgatcgacgattatgtccagaaccagatgcgcgagcagcgcattcctggtttgtcgctggcgatcgtgcagaacgaccgcctcgtcaaggccaaagggtacggcctggccaacgtcgaattgaacgtcccggtcgctcccgagagtgtctttcagtcgggctcggtgggcaagcagttcacggccaccgcggtgatgctgctggtggaagaaggcaaaatcaatctcgacgacaagatcggccgttatctggcgggagcgccgtccgcctggcgggggatcaccgtttgtcatctgctcacccacacctcgggcatcagagattacgagggcgagaacggaccggccatcgattttcgccgcgactacaccgacgaagaactggtcgcccgggccgccgccatgcccctcgattttgccccgggtgaaaagtggaagtacagcaacaccggctatgtactactggggatcattgtcaaaaatgcctcgggacagttctatggggatttgctcgacgaacgggtcttcaaacccctcggcatgcaggccacccgggtgatcaccgaggcggacatcgttgccaaccgcgccgccggctaccgcctggagaacgacgccctcaaaaatcaagcgtatgtttccccgtcgctcaatcggaccgccgacggctcgctctatctgacggtgctcgacatggtcaagtgggacgcagccctctacaccgaaaaactactcaaaaagtccagcctcgagcggatgtggacgccggtgacgctcaacgacggcaagacgtacccttatggctttggatgggcgctcggatcggtggccgggcgccgcctcatcgagcacgcagggcagtggcagggatttaccgcccacatcgcccgctacgtcgacgacaaactcaccgtcatcgtcctcaccaatctggcgcaagccaacccgtcgcccattgcccacgggatcgccggattgtacgttccaactctaggacaacctcaatcttccgccggccgttga

SEQ ID NO: 48437 - protein, 364 aa, Gloeobacter violaceus PCC 7421
MKKWLPVLLTLLLLCTMTIPGRADAIDDYVQNQMREQRIPGLSLAIVQNDRLVKAKGYGLANVELNVPVAPESVFQSGSVGKQFTATAVMLLVEEGKINLDDKIGRYLAGAPSAWRGITVCHLLTHTSGIRDYEGENGPAIDFRRDYTDEELVARAAAMPLDFAPGEKWKYSNTGYVLLGIIVKNASGQFYGDLLDERVFKPLGMQATRVITEADIVANRAAGYRLENDALKNQAYVSPSLNRTADGSLYLTVLDMVKWDAALYTEKLLKKSSLERMWTPVTLNDGKTYPYGFGWALGSVAGRRLIEHAGQWQGFTAHIARYVDDKLTVIVLTNLAQANPSPIAHGIAGLYVPTLGQPQSSAGR

SEQ ID NO: 48438 - DNA, 1158 bp, Photorhabdus luminescens subsp. laumondii TTO1
  CDS (1)..(1158)
atgacaaaacgattttcggtgctgactggcggattgctgcttaccgcttctctcggcgctcaagcctcgaataccgccgatcagacccgtctgacaaatactgttgataagaccatacactccctgatgcaggaatatgacattccaggaatggcgattgcagtgactttccacggtcaacattttttctatcaatacggtgacgcatcaaaagagagcaacacgccggtcaccaaagagacaatctttgaattaggctcggtcagcaaaacctttaccggcagcctgatttcttgggcgcaggtgacgggagccatttccttctccgataaggccagtcagcattttcaaccgcttgcaggtagcgcctttgacaacataaacttgctgaatattgccacctataccgcgggtggcctgccattacagttccctgatgagatcgacagcaataacaaaatggtggactggttccagcactggcagccaacgtacacgcccggaacctaccgccagtactctaatcccagtattggccttgcgggttatatcgttgcccaacgccttgaaaaaccttactcaaaactgatggaaaaccagatcctttcaccgcttggtctgcaccatacctggtttaacgtacccgcacaggagatgaaaaattatgcgttgggttattcaaaagagaataaaccgattcgcatcaaccccggtgtgctggatgaggaagcctatggtctgaaaaccagtgcacaggagctaattagcttcgtagatgcaaatatcgatccttcccgcgtaggtgacagcaagctggcacaggccattcgggcaactcataccggttattaccgggtgggggaaatgacgcaagggctgggctgggaactttatcactggcctgttacccttgagcaggtactgagcggcaactcggcgcagatcgcttatcaggccaacaaaaccacggaactagcgctaccagagccgccaacggatgcgctttttatcaataaaaccggttccaccaatggcttcggcacgtatgttgcgtttgtgccgcaagagcaaatgggcattgtgctgctggccaacaaaaattaccccaacgaggcgcgtattaaagcggcctggcaaatcctcaacgcgctgaaataa

SEQ ID NO: 48439 - protein, 385 aa, Photorhabdus luminescens subsp. laumondii TTO1
MTKRFSVLTGGLLLTASLGAQASNTADQTRLTNTVDKTIHSLMQEYDIPGMAIAVTFHGQHFFYQYGDASKESNTPVTKETIFELGSVSKTFTGSLISWAQVTGAISFSDKASQHFQPLAGSAFDNINLLNIATYTAGGLPLQFPDEIDSNNKMVDWFQHWQPTYTPGTYRQYSNPSIGLAGYIVAQRLEKPYSKLMENQILSPLGLHHTWFNVPAQEMKNYALGYSKENKPIRINPGVLDEEAYGLKTSAQELISFVDANIDPSRVGDSKLAQAIRATHTGYYRVGEMTQGLGWELYHWPVTLEQVLSGNSAQIAYQANKTTELALPEPPTDALFINKTGSTNGFGTYVAFVPQEQMGIVLLANKNYPNEARIKAAWQILNALK

SEQ ID NO: 48440 - DNA, 1218 bp, Photorhabdus luminescens subsp. laumondii TTO1
  CDS (1)..(1218)
atgaataaacagttttttaagatcttctccatttctgccatgatgttggctctcgcagcctgctcttcttcaaacaaaatatattcggcaaagtttctgcaaccgaagaaacaaccattgaaatgggaagtgttcgaaggaaatgcgagaactaaaaagctagcttcacagttggttgatcagtatgcacaggatattttcaacagcagtaatgcacaaggcatggcgatggtggtgattgataataatcagacggtttaccgcagtttcggtgaaacccgtccgggaaacggcatccgtccaaagcccgattcaatcatccgtattgcctcgctaactaagttgatgaccagtgagattatgatcaagctcgaagaggatgaggttctgcgttccaccgatccgttgcaagactatagttattatggcgtgaaagtgccccaatacagccctcttcaacccatccggttattccacttggcaagccataccagtggcttacctcgtgagcagccgggaggtagatgggggcgtcctgtttttgtttggcctacacaagccaatcgctggacctggttaaaaacagctcaattagactccgcaccaggcactacagcatcttattccaatctggcttacgatttattggcagatgcgctctctaaggctacgggtaagccatatacccgtttgttatacgataagatcaccggcccttattgcatgaaagacacgacactgacaccaaaccgttctcagtgtgctcgtttgatggaaagttataagccaagtccgtgtcttaacactgttgctgcggcaggcagtggtggaatctattcaacgccaaaagatatgcagcactggatgcagcaatttttatcatcagacagtcagttacgtaaacaaaccgcgagtcgcgaacaaggtatttattttaagcgttccgctctggcttcaattaaagggatggatgttgccggtcaggcagatggcgttggccttggttgggtttacatgaacgcccgcggcgatgtaccgggtatttatcagaaaaccggcggtggtggagggttcaatacgtatatggcaatgatccccgaacaaaatatcggggtgtttgtggtgatcactcgtaaacaacacagcctgttcagtagcgtaacaacgggggttaatcaactagtaactgcattgtcgaaaaatcaccatcaagcttga

SEQ ID NO: 48441 - protein, 405 aa, Photorhabdus luminescens subsp. laumondii TTO1
MNKQFFKIFSISAMMLALAACSSSNKIYSAKFLQPKKQPLKWEVFEGNARTKKLASQLVDQYAQDIFNSSNAQGMAMVVIDNNQTVYRSFGETRPGNGIRPKPDSIIRIASLTKLMTSEIMIKLEEDEVLRSTDPLQDYSYYGVKVPQYSPLQPIRLFHLASHTSGLPREQPGGRWGRPVFVWPTQANRWTWLKTAQLDSAPGTTASYSNLAYDLLADALSKATGKPYTRLLYDKITGPYCMKDTTLTPNRSQCARLMESYKPSPCLNTVAAAGSGGIYSTPKDMQHWMQQFLSSDSQLRKQTASREQGIYFKRSALASIKGMDVAGQADGVGLGWVYMNARGDVPGIYQKTGGGGGFNTYMAMIPEQNIGVFVVITRKQHSLFSSVTTGVNQLVTALSKNHHQA

SEQ ID NO: 48442 - DNA, 1281 bp, Rhodopseudomonas palustris CGA009
  CDS (1)..(1281)
atgctgcgtcgcgctaagcgatggttgatggcaggagcgctggccgcaatggccgcgaacccggcgatcgccgagaccaccttcgacctgccgccgagcgtgcagttctccgacaagaagctcgaacggatcgacgagttcttcaacaagatcatcgccgagggcaagatccccggtgcaattgtgtatatcgagcgccacggcaagccggtctatcacaagtacttcggcgttcgcgacgtcgccaccaaagagccgatgaccgacgacaccatcttccggctagcgtcgctgaccaagccgttcacggcattcgcggtgatgacgctggtcgacgacggcaagatcaagctcgacgatccggtctcgaaatacatcccggcgttcgccgacaccaaggtcggcgtcgagaagaagcgcgaggacggcgagaagtatctcgatttcgtcgcgccgaagcggccgatcctggtcagcgatctgttgctgcacacctcgggcatcacctacggcttctatggcgacagcttggtgcgcaagaccatcgcggcggccaagatctatgatggcgatccgagcaatgccgagttcgctgagcggatcgccaagttgccgctgcaggagcagcccggcacgctgtgggactacggcaattcctacgaggtgctcggccgggtgatcgaggtcgcctccggcaaatcgttctacgaataccagaaggagcggctgttcgatccgctcgggatgaaggacactcgctattatctggccaccgatgaacagaaggcgcggatggcgcagccgatgccgaacgacgccgatttccgggtcgggcggccgagccggccggacatcgtcaagaagtgggaatccggcggcggcggcctgacttcgacgccgtctgacgtgatccgcttcgtccgcatgctgcacaacaagggcgagctcgacggcaagcgttatctcagcgaagccgttttcaaggacatgaccaccgatcacatcgctccgaactccggcgtcgagcgcgactacttctatttcccgggtgacggctttggctacggctacggcctcggtgtccgcaccgacgccggcaacgccaagccgccgccgcccggctcgctcggcgaactgaagtgggacggcgcctcgggctgctacttcgtggtcgatccgaagctcgacatgttcttcgtgctgatggagcagaccccgtcgcatcgccagccgatccagcgcgagctgaagaagctggtgtacgaggcgctggacaactga

SEQ ID NO: 48443 - protein, 426 aa, Rhodopseudomonas palustris CGA009
MLRRAKRWLMAGALAAMAANPAIAETTFDLPPSVQFSDKKLERIDEFFNKIIAEGKIPGAIVYIERHGKPVYHKYFGVRDVATKEPMTDDTIFRLASLTKPFTAFAVMTLVDDGKIKLDDPVSKYIPAFADTKVGVEKKREDGEKYLDFVAPKRPILVSDLLLHTSGITYGFYGDSLVRKTIAAAKIYDGDPSNAEFAERIAKLPLQEQPGTLWDYGNSYEVLGRVIEVASGKSFYEYQKERLFDPLGMKDTRYYLATDEQKARMAQPMPNDADFRVGRPSRPDIVKKWESGGGGLTSTPSDVIRFVRMLHNKGELDGKRYLSEAVFKDMTTDHIAPNSGVERDYFYFPGDGFGYGYGLGVRTDAGNAKPPPPGSLGELKWDGASGCYFVVDPKLDMFFVLMEQTPSHRQPIQRELKKLVYEALDN

SEQ ID NO: 48444 - DNA, 1224 bp, Rhodopseudomonas palustris CGA009
  CDS (1)..(1224)
atgacagcgaccgccgccgcaccctccgctctccccccgcagaccccggctttgccggaagccaagcccgagaccctggggctgtcgccgcgccggctgcaggtgatgtcggacgccttcaagcgcgagatcgacaagggcaccatccccggcgtcactgtgctggtgtcgcgcaagggcaagatcggctggttcgaggcgctggggcggcaggcgcccggttcagacgcgccgatgcgccgcgacagcatcttccggatcttctcgatgaccaagccgatcgtctcggtcggcatcatgcagctggtcgaggacggccagatgctgctcgacgatccgctttcgaaatacattcccgaatttgagaataccaacgtcggcgtcgtccgcggcggtgagctcgaactggtgccgctgcaacgcccgatcaccatccaggatctgctgcgccacacctcgggtatcacctacgaccacaccggcgacggtccgatccacaagatgtaccgcgcctcgcgaatccgcagccgcaagatcaccaacgaagagcacgccactctggtcgcctcgatgccgctgctgtgtcagcccggcgcggcgtggaattacagccgatcgaccgacattctcggccgggtgatcgaagtggtcgccggcaagaccctcggcacgttcctgaccgaacgcatcctggcgccgctgcagatgagcgagaccggcttccacaccgcggccgacaacaagggccgcctcgccgaggcgttcccggccgatccgtggaccggcgatccggtggcgctgttcaatatgctggaaaagccggcgatggaatccggcggcggcggcctggtctcgaccacgatggactatgcgcgtttctgccagatgctgctcggcggcggcacgctggatggggcgcgcatcatcggccgcaagacgctggagctgatggcgagcaatcaccttgagccgcacatcccgccggacaactacatcctgccgccgggcaacggcttcggcctcggtttcgcggtccgcacccagccgggaatctcgcccttccccggctcggtcgggcagttctactggagcggcatcgccggcacgttcttctggatcgacccggccgagcagctattcgcggtattcatgtcgcagggaccggggcagcgcgaatacttccgcaccctggtgcgcgacctcgtgtacgcggcggtggagtag

SEQ ID NO: 48445 - protein, 407 aa, Rhodopseudomonas palustris CGA009
MTATAAAPSALPPQTPALPEAKPETLGLSPRRLQVMSDAFKREIDKGTIPGVTVLVSRKGKIGWFEALGRQAPGSDAPMRRDSIFRIFSMTKPIVSVGIMQLVEDGQMLLDDPLSKYIPEFENTNVGVVRGGELELVPLQRPITIQDLLRHTSGITYDHTGDGPIHKMYRASRIRSRKITNEEHATLVASMPLLCQPGAAWNYSRSTDILGRVIEVVAGKTLGTFLTERILAPLQMSETGFHTAADNKGRLAEAFPADPWTGDPVALFNMLEKPAMESGGGGLVSTTMDYARFCQMLLGGGTLDGARIIGRKTLELMASNHLEPHIPPDNYILPPGNGFGLGFAVRTQPGISPFPGSVGQFYWSGIAGTFFWIDPAEQLFAVFMSQGPGQREYFRTLVRDLVYAAVE

SEQ ID NO: 48446 - DNA, 1188 bp, Geobacter sulfurreducens PCA
  CDS (1)..(1188)
atgttgtcccgaaagatacttgtcatagccctgatacttttcggttcgctgacggtttttgccggtgattcaccgtatgcaccgccggcgggcggagaagccatcgggcggttgatggaaagggccatgcatgacggtctggtagcgggcgggatcgtgctcgtggggaaccgtcacggcacgatctacgagcacgtcttcggcaagcagtcgtccctgcccgattccccaccggtaacatcttccactattttcgacatcgcttccctcaccaaggtcatcgcaacgacccctgcagtcatgaggctggcggaggagggtcgactctccttggtcgatcccctggtacgctggttccccgaatttgcaggacacggcaaggacgatgtccttgtggtgcacctgttgacccacacctccggtctcgacgatttctccctgtcatctgccgatcccctgcaaagcgccatcagcggggtggccgcccagaagttgaaaggcgagccgggcaaccggttcaggtatgccgatatcaacttcatcctgctgggcgagctggtccggcgcgttaccggcagtactcttgaccgctatgcggcggatgcctttctccgccccttgggcatgaaggacaccgcattcctgcccggccccgcaattgctgagcggtgcgccgccaccctggacggctcggggggcccccacttcggcacggtgcaagaccccctggcgcgtctcctgggaggcgttgccggacatgcgggcctctttggtacggcgagcgatttggcactcttctgccggatgatcctcggcgaaggtgagctcaacggccggcgcgttctggaggagcgaacggtgcgccagatgacggccccctatttttcccgcgggggcaaggtgacgcgggggctcggctgggacatggcatccccgttttcatcgccccggggagagggattttccgaggaatcgttcggccacaccggctactcgggcggatcgatctggatcgatccgcggacggatacttacgtgatctttctctcggtccgccttgatcatcgccatacgaaggccttcagccagctgcggagcgatctgtcgacactggccttccggatgctctttccggaccttcgggagctggtggaaacggcatcctacggccctgttacgagccggtaa

SEQ ID NO: 48447 - protein, 395 aa, Geobacter sulfurreducens PCA
MLSRKILVIALILFGSLTVFAGDSPYAPPAGGEAIGRLMERAMHDGLVAGGIVLVGNRHGTIYEHVFGKQSSLPDSPPVTSSTIFDIASLTKVIATTPAVMRLAEEGRLSLVDPLVRWFPEFAGHGKDDVLVVHLLTHTSGLDDFSLSSADPLQSAISGVAAQKLKGEPGNRFRYADINFILLGELVRRVTGSTLDRYAADAFLRPLGMKDTAFLPGPAIAERCAATLDGSGGPHFGTVQDPLARLLGGVAGHAGLFGTASDLALFCRMILGEGELNGRRVLEERTVRQMTAPYFSRGGKVTRGLGWDMASPFSSPRGEGFSEESFGHTGYSGGSIWIDPRTDTYVIFLSVRLDHRHTKAFSQLRSDLSTLAFRMLFPDLRELVETASYGPVTSR

SEQ ID NO: 48448 - DNA, 1242 bp, Bacillus cereus ATCC 10987
  CDS (1)..(1242)
atggatcacgaaaaaaataatgcgaatgggaaatcacgtcggccaattgtatacataaaaagaacaatcattctcgtcttactattttcacttgtatatttcatgtatacaaaaattgttgcgcataataagaaagaagaaactttaaaagcagcagcagaaatgaagaaacaagaagagctaaaaaagaaagaagaaaaaaagaagcaagaagcaaaaaaacaaaaagagcaggaagaacaagtgaagcaagcacaagctgtggaaaagcctgctgagggaccacctcaagaaattaatgaaaacgctcaattagatcaatatttgcaaaaaacaggatttagcgggacagcggttattgtgaagaacggaaaggttcttttgaataaaggatacggtatggcgaacaaagaaaaacaagtaccgaataattcagagacaactttttatattggttctatttcaaaggcttttgtagcgactactattatgcaattaagagatcaaaataagttacatgtagaggatacgattgcgaagtatattccagatttccctcaaggtaatggtattcagttaaaacatttactaacacatacatcaggaattccagagtatgagcagggaacagaggatatctctcatgaagaattgataaaacgaataggaaaacaaaagcgtattggaagtccaggagagaaatggaagtattccgattctaactattcaatactcgcctatattgctgagaaggtaagcggacaaccgttagaagagtatattaaacaacatatttttgctactgctggtatgaaacattctggttttggtagagagctagaacaaacaagatttccatcgacaggttataaaatagtaaataacaatatgacaacacctaatattccaagtatgtcacaactttatggttgtggtgatatatatacaagtgcccatgatttatatttatttaatgaagcgctcttctctggaaagttgatttcaaaagaaagctacgatcaaatgtttacaggtggaaaaaaagattacgggtttggatggtatgtagacccgggaagttactcgaaccacggtgtaatgccaggctggaactgtttaaatggatttagtaaaaatggaagtgtatatgtcgttttattatctaacattcaaaacaatattaaatcctttggtaaagtgaataatgacatttatacgatgttacgaaatattgaagtgtaa

SEQ ID NO: 48449 - protein, 413 aa, Bacillus cereus ATCC 10987
MDHEKNNANGKSRRPIVYIKRTIILVLLFSLVYFMYTKIVAHNKKEETLKAAAEMKKQEELKKKEEKKKQEAKKQKEQEEQVKQAQAVEKPAEGPPQEINENAQLDQYLQKTGFSGTAVIVKNGKVLLNKGYGMANKEKQVPNNSETTFYIGSISKAFVATTIMQLRDQNKLHVEDTIAKYIPDFPQGNGIQLKHLLTHTSGIPEYEQGTEDISHEELIKRIGKQKRIGSPGEKWKYSDSNYSILAYIAEKVSGQPLEEYIKQHIFATAGMKHSGFGRELEQTRFPSTGYKIVNNNMTTPNIPSMSQLYGCGDIYTSAHDLYLFNEALFSGKLISKESYDQMFTGGKKDYGFGWYVDPGSYSNHGVMPGWNCLNGFSKNGSVYVVLLSNIQNNIKSFGKVNNDIYTMLRNIEV

SEQ ID NO: 48450 - DNA, 1449 bp, Bacillus cereus ATCC 10987
  CDS (1)..(1449)
atgaaaaagactattgtttttgtattaacgatatttatattattctcaggattcgcaacacaaagttatgcgttgtcagattcgaaatctgtggcaatacaagcattgctagatgatgcctgtcgtacgtcaggtgtgcctggaatgtcactctcaatacttgctgatggtgaagtgttctacttttcttctgggtatgcagatcttgaaaagggactgtctgcaagtgaaaatacactctatgagttggcctcggtgagtaaagcttttactggtatggggattttgctattggaagagcaagggctgctatcaatgactgaccctatccaaaaatatttaccttggtttacgttaaagtatcaaggcaaacctgttgatatgcaaaaccttacactaaataactttcttcaccataccagcggcctaacaaatattagacatactcaaaatattccacaaggtaatacgcctgatatgttgcaaaagactgtggaaacgctggtagatgcagaattggcgttctctcccggtgaacaatataactatggaaccgttaattatgacgtattgggtttggttattgagattgtatcacgacaaagctatgaagactttatgaaggaacaggtatttctacccttaggtcttcaccagacgtatgtttataaagaagatgcacaagccactggacagttagcacagggctaccgttcttccttttttataacaactccatttaacgctccggattatgctgggaataaacctgccggctatatcatttctaatacaaaagatatggcgcgttggatgggcatacagatgggtatcgtgcaggacatacccgaaatatttcacagggccatcgaaaaatcacataggggtgatatgtctgtttcagctgtcaatgatatgtattatgcggcaggttggtcggtaaacgccgaacaaacgtttatagaacacactgggggtaatccaaattttagtaccaaagtagccatactgccaaatgaaagaacagccatctgcttactgagcaacggcgcaaataccaatataaacctggtactacaagttaaaaatatattaaacggcaatctaactcagtcatatgagataagtggcacacagcttttggacatcattttgtcgtccaccacaattattctttgcctattagccgttctgttatttttcttaggattaagaaaagggaaaacgaatgagcagcagccaatgacaaaaaagagaacaatcgtaacaattattttcctaatcgctacgattgcccagtgtataatgttttttgccttcgattggtcaacgatacttatttggcaaacatatagtgttcttacagctttaatttcgtcaacattattaacagcaagcattacttggtttgtatatactcaccgattagatgcctcggtccgaaaataa

SEQ ID NO: 48451 - protein, 482 aa, Bacillus cereus ATCC 10987
MKKTIVFVLTIFILFSGFATQSYALSDSKSVAIQALLDDACRTSGVPGMSLSILADGEVFYFSSGYADLEKGLSASENTLYELASVSKAFTGMGILLLEEQGLLSMTDPIQKYLPWFTLKYQGKPVDMQNLTLNNFLHHTSGLTNIRHTQNIPQGNTPDMLQKTVETLVDAELAFSPGEQYNYGTVNYDVLGLVIEIVSRQSYEDFMKEQVFLPLGLHQTYVYKEDAQATGQLAQGYRSSFFITTPFNAPDYAGNKPAGYIISNTKDMARWMGIQMGIVQDIPEIFHRAIEKSHRGDMSVSAVNDMYYAAGWSVNAEQTFIEHTGGNPNFSTKVAILPNERTAICLLSNGANTNINLVLQVKNILNGNLTQSYEISGTQLLDIILSSTTIILCLLAVLLFFLGLRKGKTNEQQPMTKKRTIVTIIFLIATIAQCIMFFAFDWSTILIWQTYSVLTALISSTLLTASITWFVYTHRLDASVRK

SEQ ID NO: 48452 - DNA, 2025 bp, Mus musculus
  CDS (1)..(2025)
atgtcaaggaccccagtgcttcagacccacaggaacgtcaaagtttctcccaactcccacaatattaacatcagggtttcctgcgctgcaggccagaatcctcaaggagctggaatcttccatgccctaaggaagatgaagactcgggcccgccagcagccccatcttctgaaagggaagaagaaatggtttttgtgggccctcagtggcttcctcttcctgctctcagcgaccatgactggctgcttcctgtggcagctctacctccccaagctgcagactggttccttgaagccagaggtgcctccagccccggtgaagatgtgtccccggcaccctgagcttgtgcctcttgctcaccccctgccggtgctgaaggaggccttggagaaggtggatgggattctgcgcaaggcgatgttggccccaggcctggctgccatgtctgccctcgtcatccataatgacactgtgctctggactgggaacttcgggaggaagaatggctcagatccaaattctggaacccctaatgagtataccatgtaccggattgccagcatctccaagatcttccctgtgctgatgctgtatcgcctgtgggaggagggcatcgtggactccctggacgaccctctggagcgctatgccagcacattctccatcaacaaccctctgggcacagcccaaggccctggagcacagggcccaacgggggaatctgaagagatgggctccctcccaaggccgtcccctgtcactctccggaggatggccagtcagttgtcaggacttccccgaagactccggggcacttcactgctgtggaggggcagcacccaggaggctctgagcctgctcaaggatgatgtcctggtggctgacccaggaaccagatgccactacagcacgctggccttctctctcctagcccatgtgctggctgcgcacagggcacagggcgactatgagcgctgggtgtctgagcaggtgctggaaccgctggggatgagtgacaccggctttgcactgacaggaacagtgcgtgcacgtctggctgctggcttctatggcagcggcaggtccgccccgctctacgatctgggctggtaccggccatcgggccagatgtactcgacagctgcagacctggccaggcttgcggctgcgctcctgggtgcaggtccccgacggctgctacggcccgacagcctggccacattgctagcaccactacgcgcctgcgcccacggctactttgctagtgaaaccggtacaccctgggagttccacgagaggcgtggataccgcgtggcgcgcaaggatggcgacttggacggctatgccgccagcctggcgctcgtgccaccgctgcgcttgggatttgtgctgttgctagccgggcctcgccctcccacgcgcgacctggtggctgacgccctggatacgctgctgccagccctggagcgcgcattgcgagaggctgagcttgcccccgcgcccccgccccgcgcgcgcccgttcgctggctttttcaccttcgccaaccgcaccttctacgaggtgcgcgccgccgggccgcgtggcgagctgcgcttgcgccagtttgggccgcgcgtggaggcgctcgtgcccgccgccttccgatcgctcgccctgcgccacgtgcgcggccgcgtcttccagttgcacgtggcgcgcgagttcccgtgcgcgctgccgctcgccgacgcctggttgtctctggagtcccagcacggccagctggtgcggttctacccactggatcgccacgggttggcgccgggcttcgacgtaccgggcctcaacacctacggagtgctgcgcttgccacgcaggccagtgttcagctcccagctttctgtgtccgcaggctttctgtgtccgcaggctttctgtgtccgcaggctttctgtgtccgcaggctttctgtgtccgcaggctttctgtgtccgcaggctttctgtgtccgcaggcttccattgctttggggcaagtttctag

SEQ ID NO: 48453 - protein, 674 aa, Mus musculus
MSRTPVLQTHRNVKVSPNSHNINIRVSCAAGQNPQGAGIFHALRKMKTRARQQPHLLKGKKKWFLWALSGFLFLLSATMTGCFLWQLYLPKLQTGSLKPEVPPAPVKMCPRHPELVPLAHPLPVLKEALEKVDGILRKAMLAPGLAAMSALVIHNDTVLWTGNFGRKNGSDPNSGTPNEYTMYRIASISKIFPVLMLYRLWEEGIVDSLDDPLERYASTFSINNPLGTAQGPGAQGPTGESEEMGSLPRPSPVTLRRMASQLSGLPRRLRGTSLLWRGSTQEALSLLKDDVLVADPGTRCHYSTLAFSLLAHVLAAHRAQGDYERWVSEQVLEPLGMSDTGFALTGTVRARLAAGFYGSGRSAPLYDLGWYRPSGQMYSTAADLARLAAALLGAGPRRLLRPDSLATLLAPLRACAHGYFASETGTPWEFHERRGYRVARKDGDLDGYAASLALVPPLRLGFVLLLAGPRPPTRDLVADALDTLLPALERALREAELAPAPPPRARPFAGFFTFANRTFYEVRAAGPRGELRLRQFGPRVEALVPAAFRSLALRHVRGRVFQLHVAREFPCALPLADAWLSLESQHGQLVRFYPLDRHGLAPGFDVPGLNTYGVLRLPRRPVFSSQLSVSAGFLCPQAFCVRRLSVSAGFLCPQAFCVRRLSVSAGFHCFGASF

SEQ ID NO: 48454 - DNA, 1827 bp, Canis familiaris
  CDS (1)..(1827)
atggctcctgtcatggagggcaccataggagcagtggtggcttggctgatcagctataagccagccttgtttgggttcctattccttctgctgttgcttagcaactggctggtcaagcatgaactcaagcccaccccctcagagcccccacaggtgggccggcagccccgcctgctgaaagtgaaaaagaagtggctcttcccagcttcctgcagcttcttcttcctgttatctgtggttatgaccggctgcttcctatggcagtaccacctccccaagctgaagaccagttccttgggaccagaggtgacctctgcccctgtgagaatgtgtccccggcaccctgagcctgtgcccctggcccaccctctccctgtgttgaaggaggccctggaaaaggtggacaggatcctgcgtcaggcgctgtctgccccgggcctggctgccgtgtctgcagttgtcatccacaatgacactgtgctctggactgggaactttgggaagaagaatggctcagatccggcctctgggccccccaacgagtacaccatgtaccggatctccagcctctccaagatctttccggtcctcatgctataccggctttgggaggagggcattgtggcctccctagatgaccctctggagcgctacgtcagcaccttcaccatcaacaacccgctgggcatggcgtcagcccctggacaacagagcctgatggacgggctggaggaggtgggcccagccccaaggccttcaccggtcaccctccgaaggatggccagccagctctcagggctgcctagaaggctccggtccacttcactgctgtggaggggcagcacccaggaggccctgagcctgctcaaggatgatgtgctggtggcagacccgggaaccaggtgccactacagcacgctggccttctcgctcctggcccacgtcctggcagcgcacacggctcagggtgactaccagcgctgggtgtcggagaacgtgctggagccgctggggatggaggacacgggcttcgacctcacgccgcgcgtgcgcgcccgcctggcggccggcttctacggcagcgggcggcccgcgccgctctacgacctgggctggtaccggccgtcggggcagatgtactccacgcccgccgacctggccaagctggccatcgcgctcctgggcggcgcgccccagcggctgctgcggcccgacgcggccaaggccctgctggcgccgctgctggcctgcccgggcgcctacttcgccgacgagacgggcaccccgtgggagttccacgcgcagcggggctaccgcgtggcgcgcaaggacggcgacctggacggctacgcggcctccctctcgctcgtgccgccgctgcgcctgggcctcgtgctgctcctggccgggccgcggccccccgggcgcgacctggtggcgcgggcctacgacgcgctgctgcccgccctggagcgggcccttcgcgaggccgagccccggcccgccccgccgcccagcgcgcgccccttcgccggctacttcaccttcgccaacctgaccttctacgaggtgcgccccgggccggcgggcgagctgcgcctgcgccagttcgggccccgcgtggaggcgctcgtgccgcccgccttccgcaccctggcgctgcgccacctgcgcggccgcgtcttccagctgcacgcgcagcacggccagctcgtccgcttctaccccccggaccgccacgggctgtcccccggcttcgacgtgccgggcctcaacacctaccgggtgctgcggctgcagcgcaagcccgcgctccaggccccgtga

SEQ ID NO: 48455 - protein, 608 aa, Canis familiaris
MAPVMEGTIGAVVAWLISYKPALFGFLFLLLLLSNWLVKHELKPTPSEPPQVGRQPRLLKVKKKWLFPASCSFFFLLSVVMTGCFLWQYHLPKLKTSSLGPEVTSAPVRMCPRHPEPVPLAHPLPVLKEALEKVDRILRQALSAPGLAAVSAVVIHNDTVLWTGNFGKKNGSDPASGPPNEYTMYRISSLSKIFPVLMLYRLWEEGIVASLDDPLERYVSTFTINNPLGMASAPGQQSLMDGLEEVGPAPRPSPVTLRRMASQLSGLPRRLRSTSLLWRGSTQEALSLLKDDVLVADPGTRCHYSTLAFSLLAHVLAAHTAQGDYQRWVSENVLEPLGMEDTGFDLTPRVRARLAAGFYGSGRPAPLYDLGWYRPSGQMYSTPADLAKLAIALLGGAPQRLLRPDAAKALLAPLLACPGAYFADETGTPWEFHAQRGYRVARKDGDLDGYAASLSLVPPLRLGLVLLLAGPRPPGRDLVARAYDALLPALERALREAEPRPAPPPSARPFAGYFTFANLTFYEVRPGPAGELRLRQFGPRVEALVPPAFRTLALRHLRGRVFQLHAQHGQLVRFYPPDRHGLSPGFDVPGLNTYRVLRLQRKPALQAP

SEQ ID NO: 48456 - DNA, 1167 bp, Thermus thermophilus HB27
  CDS (1)..(1167)
atgaacctaaggaggcttgacgcctacttccggcgcctggtggaggagggcctcctccccggggccgtggtcctcgtggcccggggtggggaggtggtcttccagggggtctacgggtacctggacccggggcgggggcttcccatgcgggaggacgccctcttccgcctctactccatgaccaagccctgggtctccgccctggccctgagcttcgtggaggaggggaccctctccctcctggaccccgtggagaagtacctgccggagttttccgggctccgggtggggcgggaggtgggggaggggatcgtctacgagcccctgaagcgccccctcaccgtctacgacctcctccgccacactgcggggctcacctacggggtcttcttccgctccccggtgaagggcctttacctcgaggccggggtggaccggtttgacctgagccgggaggtctttttggagcgcctcgccgcgctgcctttgcgcttccagcccggggagacctttgagtacggcctcgccaccgacctcctcggccacctcctggaggctttggcggggcggagcctggcggagcttttggaggaacggcttttccgccccctgggcatgaaggactcgggcttccaggccaaggaccccgcccggctggcccagcccttccccaaggacccggagacgggccatagcctccgcctcctcccggtggaaacccccccgccccggtacgccggggggatggggggcgtgggcaccgcggcggactacctcgccttcctcgaggcccttcgcctggggcggggcgcgctttcccccaccatggcgggcttcatggtccaggaccacctgggaagcctctaccccgaggccctcaagcgggggcccgagtacctccccgggcccgggtacagcttcggcctcggggtggcggtgcgggtggagcccatgggctactccccgggcgccttaggggagtggacctgggcgggcttcggcgggaccttcttcttcgtggaccccctccaggagatcaccgccctctacctcgcccaggccccgaacctcctctccgtcctggagccggagaaggccctccactcccggcttggggccaggctccagcacgccttccgcaccctggtctacctgggcctggagtga

SEQ ID NO: 48457 - protein, 388 aa, Thermus thermophilus HB27
MNLRRLDAYFRRLVEEGLLPGAVVLVARGGEVVFQGVYGYLDPGRGLPMREDALFRLYSMTKPWVSALALSFVEEGTLSLLDPVEKYLPEFSGLRVGREVGEGIVYEPLKRPLTVYDLLRHTAGLTYGVFFRSPVKGLYLEAGVDRFDLSREVFLERLAALPLRFQPGETFEYGLATDLLGHLLEALAGRSLAELLEERLFRPLGMKDSGFQAKDPARLAQPFPKDPETGHSLRLLPVETPPPRYAGGMGGVGTAADYLAFLEALRLGRGALSPTMAGFMVQDHLGSLYPEALKRGPEYLPGPGYSFGLGVAVRVEPMGYSPGALGEWTWAGFGGTFFFVDPLQEITALYLAQAPNLLSVLEPEKALHSRLGARLQHAFRTLVYLGLE

SEQ ID NO: 48458 - DNA, 1266 bp, Bacillus anthracis str. Sterne
  CDS (1)..(1266)
ttggtgaataaggggaaaaaagcaatcatggatcaggaaaaaaataatgcgaatgggaaatcacgtcggccgattgtatacataaaaagaacaatcattctcgtcttactattttcacttgtatatttcatgtatacaaaaattgttacgcataataagaaagaagaaattttaaaagcggcagaaatgaagaagcaagaagagctaaaaaagaaagaagaaaaaaagaagcaagaagcacaaaaacaaaaagagcaggaagaacaagtgaagcaagcacaagctgcagaacagcctgctgagggaccacctcaagaaattaatgaaaacgctcaattagatcaatatttacaaaacataggatttagcgggacagcggttattgtgaagaacggaaaagttcttgtgaataaaggatatggtatggcgaataaagagaaacaagtaccgaataattcagagacaactttttatattggttctatttcaaaggcgtttgtagcgactgctattatgcaattaaaagatcaacataaattaaatgtagaggatacgattgcgaagtatattccagatttccctcaaggtaatagtattcagttaaaacatttattaacacatacatcaggaattccggagtacgagcagggagcagaggatatttctcatgaagaattgataaaacgaataggaaagcaaaagcgcattggaagtccaggagagaaatggaagtattccgattctaactattcgatacttgcctatattgctgagaaggtaagcggacaaccgttagaagagtatattaaacaacatatttttgcacctgctggtatgaaacattctggttttggtagagagctagaacaaacaagatttccatcgacaggttataaaatagtaaataacaatatgacaacacctaatattccaagtatgtcacaactatatggttgtggtgatatatatacaagtgcacatgatttatatttatttaatgaagcacttttctctggaaagttaatttcaaaagaaagctacgatcaaatgtttacaggcggaaaaaaagattacgggtttggatggtacgtagacccgggaagttattcgaatcacggtgtaatgccaggctggaattgcttgaatggatttagtaaaaacggaagtgtgtatgtcgttttattatctaacattcaaaataatattaaatcgtttggtaaagtgaacaacgacatttatacgatgttgcgaaatattgaagtgtaa

SEQ ID NO: 48459 - protein, 421 aa, Bacillus anthracis str. Sterne
MVNKGKKAIMDQEKNNANGKSRRPIVYIKRTIILVLLFSLVYFMYTKIVTHNKKEEILKAAEMKKQEELKKKEEKKKQEAQKQKEQEEQVKQAQAAEQPAEGPPQEINENAQLDQYLQNIGFSGTAVIVKNGKVLVNKGYGMANKEKQVPNNSETTFYIGSISKAFVATAIMQLKDQHKLNVEDTIAKYIPDFPQGNSIQLKHLLTHTSGIPEYEQGAEDISHEELIKRIGKQKRIGSPGEKWKYSDSNYSILAYIAEKVSGQPLEEYIKQHIFAPAGMKHSGFGRELEQTRFPSTGYKIVNNNMTTPNIPSMSQLYGCGDIYTSAHDLYLFNEALFSGKLISKESYDQMFTGGKKDYGFGWYVDPGSYSNHGVMPGWNCLNGFSKNGSVYVVLLSNIQNNIKSFGKVNNDIYTMLRNIEV

SEQ ID NO: 48460 - DNA, 1449 bp, Bacillus thuringiensis serovar konkukian str. 97-27
  CDS (1)..(1449)
atgaaaaagactattgtttttgtattaacgatatttatattattctcaggattcgcaacacaaagttatgcgttgtcagattcgaaatctgtggcaatacaagcattgctagatgatgcctgtcgtacgtcaggtgtgcctggaatgtcactctcaatacttgctgatggtgaagtgttctacttttcttctgggtatgcagatcttgaaaagggactgtctgcaagtgaaaatacactctatgagttggcctcgttgagtaaagcttttactggtatggggattttgctattggaagagcaagggctgctatcaatgactgaccctatccaaaaatatttaccttggtttacgttaaagtatcaaggtaaacctgttgatatgcaaaaccttacactaaataactttcttcaccataccagcggcctaacaaatattagacatactcaaaatattccacaaggtaatacgcctgatatgttgcaaaagactgtggaaacgctggtagatgcagaattggcgttctctcccggtgaacaatataactatggaaccattaattatgacgtattgggtttggttattgagattgtatcacgacaaagctatgaagactttatgaaggaacaggtatttctacccttaggtcttcaccagacgtatgtttataaagaagatgctcaagccactggacagttagcacaaggctaccgttcttccttttttataacaactccatttaacgctccggattatgctgggaataaacctgccggctatatcatttctaatacaaaagatatggcgcgttggatgggcatacagatgggtatcgtgcaggacatacccgaaatatttcacagggccatcgaaaaatcacataggggtgatatgtctgtttcggctgtcaatgatatgtattatgcggcaggttggtcggtaaacgccgaacaaacgtttatagaacacactgggggtaatccaaattttagtaccaaagtagccatactgccaaatgaaagaacagccatctgcttactgagcaacggcgcaaataccaatataaacctggtactacaagttaaaaatatattaaacggcaatctaactcagtcatatgagataagtggcacacagcttttggacatcattttgtcgtctaccacaattattctttgcctattagccgttctgttatttttcttaggattaagaaaagggaaaacgaatgagcagcagccaatgacaaaaaagagaacaatcgtaacaattattttcctaatcgctacgattgcccagtgtataatgttttttgccttcgattggtcaacgatacttatttggcaaacatatagtgttcttacagctttaatttcgtcaacattattaacagcaagcattacttggtttgtatatactcaccgattagatgcctcggtccgaaaataa

SEQ ID NO: 48461 - protein, 482 aa, Bacillus thuringiensis serovar konkukian str. 97-27
MKKTIVFVLTIFILFSGFATQSYALSDSKSVAIQALLDDACRTSGVPGMSLSILADGEVFYFSSGYADLEKGLSASENTLYELASLSKAFTGMGILLLEEQGLLSMTDPIQKYLPWFTLKYQGKPVDMQNLTLNNFLHHTSGLTNIRHTQNIPQGNTPDMLQKTVETLVDAELAFSPGEQYNYGTINYDVLGLVIEIVSRQSYEDFMKEQVFLPLGLHQTYVYKEDAQATGQLAQGYRSSFFITTPFNAPDYAGNKPAGYIISNTKDMARWMGIQMGIVQDIPEIFHRAIEKSHRGDMSVSAVNDMYYAAGWSVNAEQTFIEHTGGNPNFSTKVAILPNERTAICLLSNGANTNINLVLQVKNILNGNLTQSYEISGTQLLDIILSSTTIILCLLAVLLFFLGLRKGKTNEQQPMTKKRTIVTIIFLIATIAQCIMFFAFDWSTILIWQTYSVLTALISSTLLTASITWFVYTHRLDASVRK

SEQ ID NO: 48462 - DNA, 1266 bp, Bacillus thuringiensis serovar konkukian str. 97-27
  CDS (1)..(1266)
ttggtgaataaggggaaaaaagcaatcatggatcaggaaaaaaataatgcgaatgggaaatcacgtcggccgattgtatacataaaaagaacaatcattctcgtcttactattttcacttgtatatttcatgtatacaaaaattgttacgcataataagaaagaagaaattttaaaagcggcagaaatgaagaagcaagaagagctaaaaaagaaagaagaaaaaaagaagcaagaagcacaaaaacaaaaagagcaggaagaacaagtgaagcaagcacaagctgcagaacagcctgctgagggaccacctcaagaaattaatgaaaacgctcaattagatcaatatttacaaaacataggatttagcgggacagcggttattgtgaagaacggaaaagttcttgtgaataaaggatatggtatggcgaataaagagaaacaagtaccgaataattcagagacaactttttatattggttctatttcaaaggcgtttgtagcgactgctattatgcaattaaaagatcaacataaattaaatgtagaggatacgattacgaagtatattccagatttccctcaaggtaatagtattcagttaaaacatttattaacacatacatcaggaattccggagtacgagcagggaacagaggatatttctcatgaagaattgataaaacgaataggaaagcaaaagcgcattggaagtccaggagagaaatggaagtattccgattctaactattcgatacttgcctatattgctgagaaggtaagcggacaaccgttagaagagtatattaaacaacatatttttgcacctgctggtatgaaacattctggttttggtagagagctagaacaaacaagatttccatcgacaggttataaaatagtaaataacaatatgacaacacctaatattccaagtatgtcacaactatatggttgtggtgatatatatacaagtgcacatgatttatatttatttaatgaagcacttttctctggaaagttaatttcaaaagaaagctacgatcaaatgtttacaggcggaaaaaaagattacgggtttggatggtacgtagacccgggaagttattcgaatcacggtgtaatgccaggctggaattgcttgaatggatttagtaaaaacggaagtgtgtatgtcgttttattatctaacattcaaaacaatattaaatcgtttggtaaagtgaacaacgacatttatacgatgttgcgaaatattgaagtgtaa

SEQ ID NO: 48463 - protein, 421 aa, Bacillus thuringiensis serovar konkukian str. 97-27
MVNKGKKAIMDQEKNNANGKSRRPIVYIKRTIILVLLFSLVYFMYTKIVTHNKKEEILKAAEMKKQEELKKKEEKKKQEAQKQKEQEEQVKQAQAAEQPAEGPPQEINENAQLDQYLQNIGFSGTAVIVKNGKVLVNKGYGMANKEKQVPNNSETTFYIGSISKAFVATAIMQLKDQHKLNVEDTITKYIPDFPQGNSIQLKHLLTHTSGIPEYEQGTEDISHEELIKRIGKQKRIGSPGEKWKYSDSNYSILAYIAEKVSGQPLEEYIKQHIFAPAGMKHSGFGRELEQTRFPSTGYKIVNNNMTTPNIPSMSQLYGCGDIYTSAHDLYLFNEALFSGKLISKESYDQMFTGGKKDYGFGWYVDPGSYSNHGVMPGWNCLNGFSKNGSVYVVLLSNIQNNIKSFGKVNNDIYTMLRNIEV

SEQ ID NO: 48464 - DNA, 1497 bp, Staphylococcus aureus subsp. aureus MSSA476
  CDS (1)..(1497)
atgactactaaaaaactgtattttctatccatttctattatcattttagtcgccatttcaattgctatacatataacattaaatagcaatacgaagacacggttaaccaatgattcgcaacaacaaatagatacaattatcgagcatgatttacaaaagggacacattcctggagcatcaattttaatagtaaaaaatggcaaagtttttttaaataaaggttatggttatcaagatgttgataaaaaagtcaaagcttctcccacaacaaagtatgaaattgcttctaatacgaaagctttcacaggtcttgcaattttaaaattagctcaagaaggtcgattaaacttaaatgatgccgtatccaaacatgtgcctcattttaaaatgaactataatggtcaaaatgaaactattacgattaagcaacttttggctcaaacaagtggtatacctagtgatattacaagcgaagacgccgtaacaaataaaaataatcgtttaaatgatgtaacccgtgcaattatgggtgatgaattacatcataagcccggagaagaatttgaatactcaaatatgaactatgatttattaggtttaattatccaaaatgtcacaaagcaatcatatacgcaatatataacagaccattggcttaaaccacttcaaatgaaacacacgacatttaaacaaacaaattacaaatcaaaacatgatgctattggctacgaattacaaggttcgacacctgtcgtctctaaacctgaatttaacctttgggatacaccatcagcatatatgatgacatcaactgaagatttggaacattggataaaattccaacttaatccacctgataaatacaaatcattagttcaacaatcacataaaaatttatcatcaacaattggtgaacctaatgccaatgcatatgcttcgggctggtttaccaataatgatgaacatttagtgtttcattcaggaacgctcgataacttttcatcatttattttactaaatccaaaacaaaattatggaattgttgtgcttgcaaatctaaattcggaatatgtacccaaattagttgagcatcttaatacacaaattgtaaatcacaagcgatattcgacggttgcgtctatactcaatcaatataaagaccaatttaatattgttaccgttttgatgacaacacttattttattagcatttatattctcagcttatcgtgcttggcaaatgcgccatggtcaaattcttttgcgtagatcaaaacggattgctgtattgagttggctaactttatgtttatgtatcgctatagcgctcatattatatgcattaccatatctcattctcggtagcaataattggtcttttgtactgacttggctaccaatagaaattaaattagcactaatcacaacattaattgcattattcagtacattaattgtaattctgttattccttcatacaaagataacgaagacataa

SEQ ID NO: 48465 - protein, 498 aa, Staphylococcus aureus subsp. aureus MSSA476
MTTKKLYFLSISIIILVAISIAIHITLNSNTKTRLTNDSQQQIDTIIEHDLQKGHIPGASILIVKNGKVFLNKGYGYQDVDKKVKASPTTKYEIASNTKAFTGLAILKLAQEGRLNLNDAVSKHVPHFKMNYNGQNETITIKQLLAQTSGIPSDITSEDAVTNKNNRLNDVTRAIMGDELHHKPGEEFEYSNMNYDLLGLIIQNVTKQSYTQYITDHWLKPLQMKHTTFKQTNYKSKHDAIGYELQGSTPVVSKPEFNLWDTPSAYMMTSTEDLEHWIKFQLNPPDKYKSLVQQSHKNLSSTIGEPNANAYASGWFTNNDEHLVFHSGTLDNFSSFILLNPKQNYGIVVLANLNSEYVPKLVEHLNTQIVNHKRYSTVASILNQYKDQFNIVTVLMTTLILLAFIFSAYRAWQMRHGQILLRRSKRIAVLSWLTLCLCIAIALILYALPYLILGSNNWSFVLTWLPIEIKLALITTLIALFSTLIVILLFLHTKITKT

SEQ ID NO: 48466 - DNA, 1152 bp, Symbiobacterium thermophilum IAM 14863
  CDS (1)..(1152)
gtgaacgccgtaccgatcgtcgacgccctgcacgagacccgctggccccgcggcctgcgcgcggccgggcctgcggaggccgggttcgacccgcagcgcctggagcaggccatcgcgctcctggaagcggagatcgccgccgaacgcctgcccggggcggttgtggtcatcgcccgggacggaaaggtggccgtccaccgggccctcgggtgggcagccgtctacccggagcggcggccgatgcggccggagaccctcttcgacctggcctcgctcaccaaggtgatcgccacgctgccggcggtgctccggctgatcgagcggggcgacatccggctcgacgacccgcttcaccttttcttccccgagtaccagggcgaggggcgggaggagatccgcatccgtcacctgctcacccacaccgccggcctccagccgttcagccaggccttgcgggacccctcccggccccgggaggagctcatcgcccgcatcgccaccctgccgctcgaggcgcccccgggcacccggatcatctacagcgacctgggcttcatcctgctgggcgaactggtagccagggtcagcggccagccgctggagcggttcgtgcaggagcaggtccacgggcccctggggttcacggagaccggcttcctgcccacgggcgagcgcgctgcccgggctgcggccaccgagtaccgggagcggctgggccgctaccagtgcggcgaggtgcacgacgagacggccaccgccctcgggggcatcgccggccacgccgggctcttcagcacggcgcccgaggtggccgcctacggccagatgtggctcgacggcggcgccggggtgctctcgcccgcgatggtggcggcggccacccgtgaccagacgccgcacatccagggcccggagcaccggggcctcggctggatcgtcgcccgggaggactcggagtcgctgagctgcggcgacctcttcagccccggctccttcggccacaccgggttcacgggcaccagcctctgggtcgacccccaccggcggctggtggtggccctcctcaccaaccgggttcacttcggccgcactccgcacatcatccgcctgcgcccccggttccacaacgcggtggcagcggcgctgcggtag

SEQ ID NO: 48467 - protein, 383 aa, Symbiobacterium thermophilum IAM 14863
MNAVPIVDALHETRWPRGLRAAGPAEAGFDPQRLEQAIALLEAEIAAERLPGAVVVIARDGKVAVHRALGWAAVYPERRPMRPETLFDLASLTKVIATLPAVLRLIERGDIRLDDPLHLFFPEYQGEGREEIRIRHLLTHTAGLQPFSQALRDPSRPREELIARIATLPLEAPPGTRIIYSDLGFILLGELVARVSGQPLERFVQEQVHGPLGFTETGFLPTGERAARAAATEYRERLGRYQCGEVHDETATALGGIAGHAGLFSTAPEVAAYGQMWLDGGAGVLSPAMVAAATRDQTPHIQGPEHRGLGWIVAREDSESLSCGDLFSPGSFGHTGFTGTSLWVDPHRRLVVALLTNRVHFGRTPHIIRLRPRFHNAVAAALR

SEQ ID NO: 48468 - DNA, 1137 bp, Symbiobacterium thermophilum IAM 14863
  CDS (1)..(1137)
gtgactgacggcctgtacgagacccgctggcctccggggctgcatccggcgggccccgccgcggccggcttcgaccccgaccggctggaggcggccatccgcctgctggagcaggagatcgcggccgaaaggctgccaggggccgtggtggtcatcgcgcgggacggtgcggtggcggcccaccgggcgctgggatgggcggcggtctatccccggcgccggcccatgacccccgggaccctgtttgacctggcgtcgctgaccaaggtgatggccaccctgcccgcggtcctgcgcctgatggaaatgggcgagatccgactggacgacccccttcacctattcttccccgagtaccagggggacggccggcaggagatccgcatccgccacctgctcacccacacgtcgggcctgccggccgggagcctttccctccgggagcccgcggcgagccaggaggagcgcatcgcccggatcgcgcaggtcccgctggaggcgcccccgggcagccgcatcatctacagtgacctgggcttcatcctgctgggcgagctggtcgcccggttgagcgcccggccgctggagcggttcgtgcgggagcaggtccacgggccgctcggcctcgaggagacgggctacctcccggaaggcgaacgggcggccagcgccgcagccaccgagttccgggagcacctggggcgctaccagtgcggcgaggtgcacgaccagacggcgaccgccttgggaggcgtgtccggccacgcgggcctgttcggcacggcaccggaggtggcggcgtacggccagatgtggctggacggcggcagcggcgtcctttcgccggcctcggtcgccgccgccacccgggatcagacgccgcacatcgcgggggacgaacaccggggtctgggctggatcgtcgtgcacgaaggcgccgccttcctgagctgcggcgacctgttcagcgtcggctccttcggccacaccggcttcaccggcaccagcctctgggtggacccgcacaggcggctcgtggtcgccctcctgaccaaccgggtgcacttcggccgctcggaccacatccgccggctgcgccccctgttccacaacgccgtggcggcagcgctgaagtaa

SEQ ID NO: 48469 - protein, 378 aa, Symbiobacterium thermophilum IAM 14863
MTDGLYETRWPPGLHPAGPAAAGFDPDRLEAAIRLLEQEIAAERLPGAVVVIARDGAVAAHRALGWAAVYPRRRPMTPGTLFDLASLTKVMATLPAVLRLMEMGEIRLDDPLHLFFPEYQGDGRQEIRIRHLLTHTSGLPAGSLSLREPAASQEERIARIAQVPLEAPPGSRIIYSDLGFILLGELVARLSARPLERFVREQVHGPLGLEETGYLPEGERAASAAATEFREHLGRYQCGEVHDQTATALGGVSGHAGLFGTAPEVAAYGQMWLDGGSGVLSPASVAAATRDQTPHIAGDEHRGLGWIVVHEGAAFLSCGDLFSVGSFGHTGFTGTSLWVDPHRRLVVALLTNRVHFGRSDHIRRLRPLFHNAVAAALK

SEQ ID NO: 48470 - DNA, 2076 bp, Bacillus cereus ZK
  CDS (1)..(2076)
atggaaaataaattatctggagtgttagccgctaccttagctctaacgatgagcctaccaacaggagcgatagcgtcttctagcagtaagactccggttgtatctagccaagaagttgctagcaaagatttggagaagattgctgcagagaacgctgcactgctcacgaagtcctatgagacgactagtgtacagtatgcgctgattgataatggtaaacttattttgtcaggacagacaggcaagaatgacatagaggggaaagagccattaaccaaagatactctatacggaattggttcaaccagtaaagtatatacagctgcggctgttatgaaattagtagacgaaggacaagttgatttggatgcttctgttacccgctatattcctgagttcaaaatgaaagatgaacgatataaacgcattacaccgcgtatgctgttgaatcactcctcaggtttgcaaggttcgacgcttaataatgcatttttatttaaagataatgatgtttatgcccatgatatcttgttgcaacaattgtccaaccaaaacttgaaggcagaccctggcgcgttctcagtatactgtaatgacggttttacgctggctgagatcttggtagaaagagtcagcggtatgagttttactgaatttctacatcaaaagtttacagagccattaaaactgaatcatacgataacatcgcaagataaatgggaagatgaaaagcgggctggacagtattctccgacataccagggacagcttccaagtgaaatggtaaatgtgattggtacgggaggaatctcttctactgcagaagatgtggtgcgattctcacaaatatttatgggacagggaaaagaaatcctctctaataaagcagtcaagacgatggaacaagaagaatataaaaaaggaatgtggccgggagatagcggaaatgtgttcaactatggtcttggctgggatagtgtgaaactatacccattcagtgaatatgggataaaagcgttgactaagggtggggatacgatgctgcaacatgctacattggtcgtacttccagaacagaagatggcagcagctgtattgtcctccggcggctccagcatgacaaatcaactgttggcaaataaattactgctagctaggcttaaagagaaagggacaattaaggatataaaaccagataaatccttcggcaagcccgtcaaggctaaagtgcctcaagacgtggtaaaaaaagcaggattttatggaaatagctatagccatttcaaaatagaaattacgaagaagggagaactgtttttaccaactaaaccagaagaaaaatatgtatatacggcggatggaagctttataaatgagaagggcacttccaagcttaacttcgtcacagagaagaatggaaaagtttatttgagagagagcgcatatgaattatcgccgggattggggcaaaatgtgctgactcactatttagcccagaaattagaaaacaatgtgttaccgaagaaaacaggtgctgcatgggcgaagcgcgagggcggcaagttctacctcgttaacgaaaaatttaattctataaattatttaggacaacaaatacctcttaacacacaaattacgctcaaagatggctattgggacggcaaaaaaattacaggtccgaatacggcgacgcatcaaattcaaattcccgtgatgaatgggcgggatacaaaggaagcccatttctatacagaggatggtactgaatatatggagatgtccagctttttatacgtcagtgaatctaacgtaaaatcccttgatacaggtcacttatcgaaagttacattgcaaaaaagtgggcatgcgaaatggtttacgatcccgcaagaggcagcagggaaaatgatgaatgtggagttgccatcaggaagttcattcgcggtgtatgatgagaatggagtatgcgtcaattttaccgtcgttagtgacaataacaaagtgaaactaccagagaacggaacggttgtatttgctggcgcaccgaactcagaatttacagtcgcattgaactag

SEQ ID NO: 48471 - protein, 691 aa, Bacillus cereus ZK
MENKLSGVLAATLALTMSLPTGAIASSSSKTPVVSSQEVASKDLEKIAAENAALLTKSYETTSVQYALIDNGKLILSGQTGKNDIEGKEPLTKDTLYGIGSTSKVYTAAAVMKLVDEGQVDLDASVTRYIPEFKMKDERYKRITPRMLLNHSSGLQGSTLNNAFLFKDNDVYAHDILLQQLSNQNLKADPGAFSVYCNDGFTLAEILVERVSGMSFTEFLHQKFTEPLKLNHTITSQDKWEDEKRAGQYSPTYQGQLPSEMVNVIGTGGISSTAEDVVRFSQIFMGQGKEILSNKAVKTMEQEEYKKGMWPGDSGNVFNYGLGWDSVKLYPFSEYGIKALTKGGDTMLQHATLVVLPEQKMAAAVLSSGGSSMTNQLLANKLLLARLKEKGTIKDIKPDKSFGKPVKAKVPQDVVKKAGFYGNSYSHFKIEITKKGELFLPTKPEEKYVYTADGSFINEKGTSKLNFVTEKNGKVYLRESAYELSPGLGQNVLTHYLAQKLENNVLPKKTGAAWAKREGGKFYLVNEKFNSINYLGQQIPLNTQITLKDGYWDGKKITGPNTATHQIQIPVMNGRDTKEAHFYTEDGTEYMEMSSFLYVSESNVKSLDTGHLSKVTLQKSGHAKWFTIPQEAAGKMMNVELPSGSSFAVYDENGVCVNFTVVSDNNKVKLPENGTVVFAGAPNSEFTVALN

SEQ ID NO: 48472 - DNA, 1224 bp, Legionella pneumophila subsp. pneumophila str. Philadelphia 1
  CDS (1)..(1224)
atgctgagactaacaatctgtagaacgcaaacacggtttttgctttggagcccttacacaatcaggatagaatcgctacaagatgtcctgacgatgcaaaataaagaaaaaataattattatattttcccaaaagaaattaatcatgaaatcaaaatccattaatttatgcttttttttattcattctatactttggcagtccaattcttttggcacaaccgtccagggtggataatataattaatgaactggttcaaccaattattgagacacatcggactcctggcttagccattgccatttattataatggaaaggattattattataattttggatttgctgaccggaaaagtaagaaacccgtcactaaaaatactatttttgaattggcatcgattaccaaaatattcattagcactcttgtagccctggaagttcagaaaggaaaattgaatgtaacagattatgccgttcaatatacacctgaactttcaaaaaccaatggactaccaattgacagggttcaaattgtgcatctggcgacccacacagcaagctttcccaaacaaatggagcaatttggtgttaataaaggcaatataaaggctttctttgcccgtcttaaaacatggcgtcctccagtaaaaataggaactcaatataaatattccaatattggttttgggtatttgggatacgtattggaaaacgcctcaaacgaaactttacctaatctgttaaaatcgaatattaccaagccattgggaatgtcgcatactttttttaatgtaccagaaaacctcgctaactatgaagctcaaggttatcgacctaaaaataagccagcaccttattatagacctgccaattttctaggcggaggtgctttgcgctcttctgcagctgacatgctggtatttttaaaagcaaatttaggagttcaacctggcaccgcatcaccagaattactttctgcgatgcagtatgcccaacaaccattttttgaagtcaacccaaattttgttatgggattaggttggcaaagagtgaaaagagggaggcacattgtgatcactaaaaatggagcaaatcagggatttagcacctttattggtttttctcctgcgaaaaaactgggagtcgtcgtattaatcaatcaggcaaggggcaaggcaacctggctgggaaaccaaattcttaatagtttgcttaggttatag

SEQ ID NO: 48473 - protein, 407 aa, Legionella pneumophila subsp. pneumophila str. Philadelphia 1
MLRLTICRTQTRFLLWSPYTIRIESLQDVLTMQNKEKIIIIFSQKKLIMKSKSINLCFFLFILYFGSPILLAQPSRVDNIINELVQPIIETHRTPGLAIAIYYNGKDYYYNFGFADRKSKKPVTKNTIFELASITKIFISTLVALEVQKGKLNVTDYAVQYTPELSKTNGLPIDRVQIVHLATHTASFPKQMEQFGVNKGNIKAFFARLKTWRPPVKIGTQYKYSNIGFGYLGYVLENASNETLPNLLKSNITKPLGMSHTFFNVPENLANYEAQGYRPKNKPAPYYRPANFLGGGALRSSAADMLVFLKANLGVQPGTASPELLSAMQYAQQPFFEVNPNFVMGLGWQRVKRGRHIVITKNGANQGFSTFIGFSPAKKLGVVVLINQARGKATWLGNQILNSLLRL

SEQ ID NO: 48474 - DNA, 1884 bp, Bacteroides fragilis YCH46
  CDS (1)..(1884)
atggaaaacaaaatcaacttttctcctccctcaacaagagaggggaaaggtgtgaggtttttactcactaccttttcaatattgctttgtagtctgcaagctgtggcacaatctctgccacgtgtagctcccgaacaagtgggcatggactctcatcgcctgttacatgccgatgaagctattcaccgggcaatcgatcacaaagaaataccgggagccgtactcgctgtcatccgtcatggcaaaatggcttatctcaaggcttatggcaacaaacgaatctatcccaatgtagagccgatggaaataaacactgttttcgacatggcttcctgcagtaaatctatgtcaacagctgtttcggttatgattctggttgaacgaggacaacttcgtttgctcgatcgtgtcagcttttacctccccgacttccaggaatggcggggagaaaacggggagaagaaggatattcgtatcatagaccttatgacacatacttcaggtctccctccttatgcaccggtatccgaactgcaggaaaaatatggttctcccaaccccaaaggactgatggagtatatttccacttgcaaacgtgaatttaaacctcagacgaaatttcagtatagttgccttaattacatcactttgcaacatatcatcgaaaccattaccgggcaaagcttgcgagactttgcaaaagaaaatatcttcgatatactgggaatgcaatacacggattatctgcctaccatacaacagcaggacggaaagtggatcaatacggtggcctgtccctggatggaccggattgcacctaccgaaaaacaaaaagacggaagcgtactctgcgggcaagtacacgatccattggcacgtatcctgaacggagggatctccggcaatgcaggtatcttctctaatgcaaatgacattggcatcctcgcagccgctcttctcaacggaggcgaatacaatggtcaccgcatcctcagcccgctgggagtaaaaaccatgtgtacagttccccgtgagctaaccgcatttggccgtactcccggatgggatattttctctccctatgcctcaaacaagggtgatcttttcagtccgaatacctttggccatacaggatatacaggaacttccatcatcatcgatccggacaacgacacggccgtcattctgctggttaacgctgttcatccggaagaccggcatagcatagtccgtctccgttcgttagtagccaatgcagtagccgcctctatctgtcctcccgcacaggtatatacagatcattattacaaacgcttcctgcaatttgaaacagaaacacccatcagtcccaaagatattgtgatggtgggcaacagtctcacggaaaacggtgggaattggagcaagcgcctaaataaaaaaaacataagaaatcgggggatcatcggtgacgaagcattgggaatctgtcaacgtctttttcagatcttaccggggactcctcaaaaacttttcctaatggccggaatcaacgatgtgtcacacgacctgagcaccgatagtgtagtcactttgataaccaaagtcattgagaaaatccaaaccgaatcaccacgcaccaaactctatatacagagtcttctgcctatcaacgaatcgttcggacgatataaaacgatgatcgggaaaactgacctgatacccgaaattaaccgcaaacttgaagcacttgccaaagaaaagaaaataccttttatccacctctttccattatttacggagaaaaacagcaacgtgatgcgaaaagaactgactacggacggattacacctgacagaagaggggtatagaatctggagtaaagcactgaaacggtatctgtag

SEQ ID NO: 48475 - protein, 627 aa, Bacteroides fragilis YCH46
MENKINFSPPSTREGKGVRFLLTTFSILLCSLQAVAQSLPRVAPEQVGMDSHRLLHADEAIHRAIDHKEIPGAVLAVIRHGKMAYLKAYGNKRIYPNVEPMEINTVFDMASCSKSMSTAVSVMILVERGQLRLLDRVSFYLPDFQEWRGENGEKKDIRIIDLMTHTSGLPPYAPVSELQEKYGSPNPKGLMEYISTCKREFKPQTKFQYSCLNYITLQHIIETITGQSLRDFAKENIFDILGMQYTDYLPTIQQQDGKWINTVACPWMDRIAPTEKQKDGSVLCGQVHDPLARILNGGISGNAGIFSNANDIGILAAALLNGGEYNGHRILSPLGVKTMCTVPRELTAFGRTPGWDIFSPYASNKGDLFSPNTFGHTGYTGTSIIIDPDNDTAVILLVNAVHPEDRHSIVRLRSLVANAVAASICPPAQVYTDHYYKRFLQFETETPISPKDIVMVGNSLTENGGNWSKRLNKKNIRNRGIIGDEALGICQRLFQILPGTPQKLFLMAGINDVSHDLSTDSVVTLITKVIEKIQTESPRTKLYIQSLLPINESFGRYKTMIGKTDLIPEINRKLEALAKEKKIPFIHLFPLFTEKNSNVMRKELTTDGLHLTEEGYRIWSKALKRYL

SEQ ID NO: 48476 - DNA, 1638 bp, Nocardia farcinica IFM 10152
  CDS (1)..(1638)
gtgccgtgcaactcgtccgaggaggtgagggccgtgccgggtcgtcgacgcgtggccgtggggctgctggcgctggggctcgtcgtcggagcctgcgccgacgactccggcggtgacgcggcgacgaccagctcggcaccgcgatctccggccgcgacgggagagctaccgccgaacgaggtcgcgggggtggcgatcccggacggccaggtggaccgggcggtcggcgagctcgaccgcatcgcgggcgaactcatggacgccacgaagatccccggcatggcggtggccgtcgtgcacgacggaaaagtggtctacagcaaggggttcggcgtccgggacgtcacgaccgggcagccggtcggcccggacacggtgttccagctggcctcgctgtccaagccgatcggcgcgacggtggtggcgcgggaggtggccgcgggccgggtggcgtgggacacgccggtgcggcgactgtcgccggagttcaccctcgccgacccctacgtcggcgaccacgtcacggtgggggatctgtacgcgcatcgctcggggctgcccgaccacgccggtgatctgctggaggatctcggctacgaccgcgccgcgatcctggcgcggctgcggcagctgccgctggcgccgttccgcgattcctacgcctacaccaacttcggcctgacagcggcggcgtccgcggtcgcgcaggcggcgggcaccgactgggagacgttgtcgcagcgcgagatctacgaaccgctcgggatgacgtcgaccagttcgcgctacgccgatttcgtcgcccgcggcgaccgggcggtcggccacgttctcgtcgacggcgcctaccggcccgccgatccaccgcgccgaccggacgcgcagtcgcccgcgggcggggtcagctcgtcggcccgcgatatgacgcggtggctgaccatgatgctgggcgacggcagcgtcgagggtcgcgagatcgtgccgcctgcggcgctgctgcccgcggtctccccgcagatgatgtccgcgccgcccgcgaaccccgacgccagggcggggttctacggcttcggcttcaacgtcggcacctccccggcgggccgggtggtgctcagccattccggtgcgttcaatctcggcgccggcaccgcgttcacgatgatcccctcggccggggtcggcatcgtgacgctcaccaacgccgcgccgcgcggtgtcccggagacgctcaacgccgagttcgccgacctggtgcagttcggcgaggtgcgtgaggactggcgcggactctacaccgaagccttcgatcaactcgacgccccgaagggcgacctggtcggcaaggagccgccgcgggcgcccgcacccgcccgtcccctgaccgactacgcgggcacctacgccaacgcctactacggccccgccaccgtcgccgtccgcggcgacgagctgaccgtcaccctcggcccggccggtaccgtcgtgccgctgcggcactgggacggcgacaccttcgccttcaccccgtccggcgagggcgccgaccccggcacggtgtcgcaggcccggttcgacggcgaccggttgaccctcgagtactacgaccaggacggcatgggcaccttcacccgcggctga

SEQ ID NO: 48477 - protein, 545 aa, Nocardia farcinica IFM 10152
MPCNSSEEVRAVPGRRRVAVGLLALGLVVGACADDSGGDAATTSSAPRSPAATGELPPNEVAGVAIPDGQVDRAVGELDRIAGELMDATKIPGMAVAVVHDGKVVYSKGFGVRDVTTGQPVGPDTVFQLASLSKPIGATVVAREVAAGRVAWDTPVRRLSPEFTLADPYVGDHVTVGDLYAHRSGLPDHAGDLLEDLGYDRAAILARLRQLPLAPFRDSYAYTNFGLTAAASAVAQAAGTDWETLSQREIYEPLGMTSTSSRYADFVARGDRAVGHVLVDGAYRPADPPRRPDAQSPAGGVSSSARDMTRWLTMMLGDGSVEGREIVPPAALLPAVSPQMMSAPPANPDARAGFYGFGFNVGTSPAGRVVLSHSGAFNLGAGTAFTMIPSAGVGIVTLTNAAPRGVPETLNAEFADLVQFGEVREDWRGLYTEAFDQLDAPKGDLVGKEPPRAPAPARPLTDYAGTYANAYYGPATVAVRGDELTVTLGPAGTVVPLRHWDGDTFAFTPSGEGADPGTVSQARFDGDRLTLEYYDQDGMGTFTRG

SEQ ID NO: 48478 - DNA, 1080 bp, Legionella pneumophila str. Lens
  CDS (1)..(1080)
atgaaatcaaaatacattaacttatgctttttttcactcattttatggtttggcagtccaattcttttggcacaaccatccaggctggataatctaattaatcaactggttcaaccatttatttatgcacatcagactcccgggttagccattgccatttattataatggaaaggattattattataattttggatttgctgaccggaaaagtaagaagccagtgactaaaaatactatttttgaattggcatcgattaccaaaatattcattagcactcttatagcactggaagttcagaaaggaaaattgaatgtaacagattatgccgttcaatatacacctgaactttcaaaaaccaatggactaccaattgacagggttcaaattgtacatctggcgactcacacagcaagctttcccaaacaaatggagcaatttggtgttaataaaggcaatatacaggctttctttgcccatcttaaaacatggcgtcctccagtaaaaacaggaactcattataaatattccaatattggttttgggtatttgggatacatattggaaaacgcctcaaacgagactttacctaatctgttaaaatcgaatattaccaagccattgggaatgtcccatactttttttaatgtaccagaaagtctggctaactatgaagctcaaggttatcgacctaaaaacaagccagcaccttattatagacctgccaattttctaggtggaggtgctttgcgatcttctgcagctgacatgctggtatttttaaaagcaaatttaggaattcaacctggcaccacatcaccaacattgctttctgcaatgcagtatgcccaacaaccattttttgaagtcaacccaaattttgttatgggattaggttggcaaagagtgaaaagagggaggcagattgtgatcactaaaaatggagcaaatcagggatttagcacctttattggtttttcacctgcaaaaaaactgggagtcgtcgtattaatcaatcaggcaaggggcaaggcaaccttgctgggaaaccaaattcttaatagtctgcttagattatag

SEQ ID NO: 48479 - protein, 359 aa, Legionella pneumophila str. Lens
MKSKYINLCFFSLILWFGSPILLAQPSRLDNLINQLVQPFIYAHQTPGLAIAIYYNGKDYYYNFGFADRKSKKPVTKNTIFELASITKIFISTLIALEVQKGKLNVTDYAVQYTPELSKTNGLPIDRVQIVHLATHTASFPKQMEQFGVNKGNIQAFFAHLKTWRPPVKTGTHYKYSNIGFGYLGYILENASNETLPNLLKSNITKPLGMSHTFFNVPESLANYEAQGYRPKNKPAPYYRPANFLGGGALRSSAADMLVFLKANLGIQPGTTSPTLLSAMQYAQQPFFEVNPNFVMGLGWQRVKRGRQIVITKNGANQGFSTFIGFSPAKKLGVVVLINQARGKATLLGNQILNSLLRL

SEQ ID NO: 48480 - DNA, 1689 bp, Xanthomonas oryzae pv. oryzae KACC10331
  CDS (1)..(1689)
atgccgatgccaatggcgtgctggtgtcgccgcagccgttgtcgttggatggcgccagcggatcgatctgaccgaaaacctgagggcgatgcagtgaccttgaagcgatggctgagtgggggcgtgctgatggtggcaagcttggtggcgacaacgcacgcggccgaacttcccgccggcatgcagcagttcgacgtgcagatggagcgtgtgcgcaaacagttcgatgtgccaggtatcgcggtggccatcgtcaaggacggccaggtggtgctggagcgcggctacggcgtgcgcgagacaggcaagcccgcgccggtgcaggccgacaccttgtttgccattgcatccaacaccaaggccttcactgccgcatcgctgtcgatcctggccgacgaaggcaagctctcgctcgaggacaaggtcatcgaccatctgccgtggtttcgcatgtccgacccgtatgtgggcggcgaaatgcgcatccgcgatctgctggcgcaccgcagcggcctgagtctgggggcgggcgacctgttgttctggcccaccaccagctacaccaccgaagaagtcgtgcagcgcctggccaaggtgccgctgaagggcggttttcgcgaccgttatgcgtacgacaacatcctgtacgcggtcgcgcaaaaggtgatcgagcaggtctccggacagagttacgaggcgtttctgcagcaacgtattttcgccccggtgggcatgcgcggcacgcgcttcaacgccgaccatctgcaggctggcgatcacgctgcagtggggcatgccaagtacgacttcaccgagttgcgcacggtggcgccgctgacctggtccaacaactccggtgccggcggcatttattccagtgcgcacgacatggcgctatggatgaacgtgcaactggccggcggcatcctgcccgatggcaaacccttgttcagcgccaagcgtcagcacgagatgtggtcgatgatcacgccgattccgatcggtgaggtgcagttgcccgagtttgccgcggcacggccgaacttcgccggttacggcgagggctggagcttgagcgattaccgtggccatcgcatggtgtggcataccggtggctggcccggcatggtgtcgcgcctcacgctgctgccggatcagaaactgggcgtggtggtgttgaccaaccaggaagtgggcgccgcattcaacgcagtgaccttccaggtgctggatgcgttcttgcgggtgccgcccaccgattggacggccgcttacgccaaactggtggaaaaggccgacagcgatgccgatgccagctggaagaagcaccaggacgcacgtgcggcgcggtccaccccgtcgttgccgctgcgcagttacgcggccacctaccgcgacccgtggtacggcgatgtggtgattgtccaggacggcaagcggctgcggctgcagttcgccaagaccgcccaactcgtgggcacgctggagcattggcagcacgacagcttcatcgtgcgctgggacgaccgctccttgaatgccgatgccttcgtcaatttcttgctgacgccggatggcgcggtgcgcgagatgcgcatggagccgatttcgccgctgaccgatttcagcttcgatttccaggatctggtgctgacgccggtgccgaccgaaaccgctgcgggcaagtga

SEQ ID NO: 48481 - protein, 562 aa, Xanthomonas oryzae pv. oryzae KACC10331
MPMPMACWCRRSRCRWMAPADRSDRKPEGDAVTLKRWLSGGVLMVASLVATTHAAELPAGMQQFDVQMERVRKQFDVPGIAVAIVKDGQVVLERGYGVRETGKPAPVQADTLFAIASNTKAFTAASLSILADEGKLSLEDKVIDHLPWFRMSDPYVGGEMRIRDLLAHRSGLSLGAGDLLFWPTTSYTTEEVVQRLAKVPLKGGFRDRYAYDNILYAVAQKVIEQVSGQSYEAFLQQRIFAPVGMRGTRFNADHLQAGDHAAVGHAKYDFTELRTVAPLTWSNNSGAGGIYSSAHDMALWMNVQLAGGILPDGKPLFSAKRQHEMWSMITPIPIGEVQLPEFAAARPNFAGYGEGWSLSDYRGHRMVWHTGGWPGMVSRLTLLPDQKLGVVVLTNQEVGAAFNAVTFQVLDAFLRVPPTDWTAAYAKLVEKADSDADASWKKHQDARAARSTPSLPLRSYAATYRDPWYGDVVIVQDGKRLRLQFAKTAQLVGTLEHWQHDSFIVRWDDRSLNADAFVNFLLTPDGAVREMRMEPISPLTDFSFDFQDLVLTPVPTETAAGK

SEQ ID NO: 48482 - DNA, 1467 bp, Xanthomonas oryzae pv. oryzae KACC10331
  CDS (1)..(1467)
atgatgcccattcatcttccggcagtttgtgctattgcaaagcgcggcgctagaatccccggaggcagcggaacaggcgggacaaccatgacagaaatgcgcacgcgccgacggttccgaccgttggccatcgggctgttcggggcattattgcctctggctctctcttccaccgcgcagacacccgcgcctaccgccgctgcgctgcagccggccagggttgcgcagtcgtccaccgcaccgctgccctatcgcacctcgctgccggccaaccaagtgttggcacctgctgccggcttcgacgtggcggcattcgaatcgatggcggaccagttgacctacggcaaccgcgtgcccggcatggcgatggccatcgtgcagggcggcaaggtgctcagcgcgcgcggctatggcgttaccgacgtcaatcatccgcagccggtcgatggccacaccgtgtttcgtttggcatcgctgtccaaggccttcgccggcaccatggccggcctgctggtcaacgatggcgtgctgcgctgggacagcaaggtggtcgactacgtgccgggcttccagctcagcgatggcgccgcaacgcgccagctcaccgtcgccgaagtgctcagccatcgcgtcggcctgactcgtaatgcctacgaccgcgatatcgaatccaacgtcgactactactcgctcagccacaaactcgcggtcgcaccgctgcgctgcgcgccgggcgattgctacgcatatcagaacgtggccttcagcctggtgggcgatgtagtgttcgccgcgtcaggcagcttctacgagcaattggtggaacgccgcatcttcaagccgctgggcatgaacgatgcgagcctgggtctggccggcatccaggccagtccgcactgggcacgcccgcacgtgcgcagccgcaatggctgggtgtcgctgacgcccaagccgacctattaccgtctggcgcccgctgcgggcgtcaacgccagcgccagcgatatggcgcagtggctgctcgcacacaccggtcatcgcaccgacgtgctgcctgcaccgctgctggcgaccctgcacgcgccagtgatctccacgccgggcgaaatgcgttccggctggcgccacgagcgtgtggatgcggcgagctacgcgctgggctggcgtgtgttcgactacgccggtcatcaggtggtgttccatgccggtgcggtgcagggctaccgcggcttggtggcgctgctgccagagcgcgatctgggaattgcgatcctgtggaacggcgagagtggcctgccctcaggcatgctgccgactatcctggaccgcgcactgggcttgccggcgaagcgttggttggacatcgatgtggacggcgacttcggcagcgagaacatgctggcagagaagcccgacccggctggcaagggcgcgtcttccagcaagtcggtggcatcaccgcgctga

SEQ ID NO: 48483 - protein, 488 aa, Xanthomonas oryzae pv. oryzae KACC10331
MMPIHLPAVCAIAKRGARIPGGSGTGGTTMTEMRTRRRFRPLAIGLFGALLPLALSSTAQTPAPTAAALQPARVAQSSTAPLPYRTSLPANQVLAPAAGFDVAAFESMADQLTYGNRVPGMAMAIVQGGKVLSARGYGVTDVNHPQPVDGHTVFRLASLSKAFAGTMAGLLVNDGVLRWDSKVVDYVPGFQLSDGAATRQLTVAEVLSHRVGLTRNAYDRDIESNVDYYSLSHKLAVAPLRCAPGDCYAYQNVAFSLVGDVVFAASGSFYEQLVERRIFKPLGMNDASLGLAGIQASPHWARPHVRSRNGWVSLTPKPTYYRLAPAAGVNASASDMAQWLLAHTGHRTDVLPAPLLATLHAPVISTPGEMRSGWRHERVDAASYALGWRVFDYAGHQVVFHAGAVQGYRGLVALLPERDLGIAILWNGESGLPSGMLPTILDRALGLPAKRWLDIDVDGDFGSENMLAEKPDPAGKGASSSKSVASPR

SEQ ID NO: 48484 - DNA, 1230 bp, Salmonella enterica subsp. enterica serovar Choleraesuis
  CDS (1)..(1230)
ttgtcaacacggtgcaaatcaaacacactgattgcatctgacgggcccggacacctttttgcttttaattacggaactgatttcatgatgaaaaaatcgttatgctgcgctctgctgctgacagcctctttctccacatttgctgccgcaaaaacagaacaacagattgccgatatcgttaatcgcaccatcaccccgttgatgcaggagcaggctattccgggtatggccgttgccgttatctaccagggaaaaccctattatttcacctggggtaaagccgatatcgccaataaccacccagtcacgcagcaaacgctgtttgagctaggatcggttagtaagacgtttaacggcgtgttgggcggcgatgctatcgcccgcggcgaaattaagctcagcgatccggtcacgaaatactggccagaactgacaggcaaacagtggcagggtatccgcctgctgcacttagccacctatacggcaggcggcctaccgctgcagatccccgatgacgttagggataaagccgcattactgcatttttatcaaaactggcagccgcaatggactccgggcgctaagcgactttacgctaactccagcattggtctgtttggcgcgctggcggtgaaaccctcaggaatgagttacgaagaggcaatgaccagacgcgtcctgcaaccattaaaactggcgcatacctggattacggttccgcagaacgaacaaaaagattatgcctggggctatcgcgaagggaagcccgtacacgtttctccgggacaacttgacgccgaagcctatggcgtgaaatccagcgttattgatatggcccgctgggttcaggccaacatggatgccagccacgttcaggagaaaacgctccagcagggcattgcgcttgcgcagtctcgctactggcgtattggcgatatgtaccagggattaggctgggagatgctgaactggccgctgaaagctgattcgatcatcaacggcagcgacagcaaagtggcattggcagcgcttcccgccgttgaggtaaacccgcccgcccccgcagtgaaagcctcatgggtgcataaaacgggctccactggtggatttggcagctacgtagccttcgttccagaaaaaaaccttggcatcgtgatgctggcaaacaaaagctatcctaaccctgtccgtgtcgaggcggcctggcgcattcttgaaaagctgcaataa

SEQ ID NO: 48485 - protein, 409 aa, Salmonella enterica subsp. enterica serovar Choleraesuis
MSTRCKSNTLIASDGPGHLFAFNYGTDFMMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 48486 - DNA, 1143 bp, Rhodobacter sphaeroides 2.4.1
  CDS (1)..(1143)
atgaagcacctttcccccctctccatcctgctcatggtgggcgcgctgacgcccgcgcttgcgcaagacaccacgccgtcgttcgagagcgccgccgccgcggccttcgagagcgtcatcgaggagcatgacattcccggtctggtggtgggcgtgacccacggcggacggcacagtttctatcagacaggcttggcctcacgggaagatcagcagccggtaacccctgacacgctttttgagctcggttcgatcagcaagatcttcaacgtgacgctggcggccttggcagaggagcggggcgcgctgtcgctcgatgcgccggtcgccgactatcttccctccctgcgaggttctcctgcaggagagctgacgctgatcgatctggcgacgcaccataccggcggcctcccgttgcaggtgccggacgaagttgcagatgtagatcgcctggtcgactggctacggagttggcgaccgcccgagcccggtacgcgcagctattccaacatcagcatcggcctattggggcacatcaccgcgggcgtgctgggcatgagctatgctgatgcgtcccagacggttatcttcccggcgctcggattgaagagcacgtggatcgacgtccccaccgatgcgatgggacgctacgccttcggctatgaccgcaagacagacgcgccaacccgggttacgcccggcgtgctggacgatgaagcgtacggggtaaaatcctccgctcgcgacatgctgacgctgctcgacctcgagcttggaaccggcactgcctcgcccgaagttcaaacggcggtggccaccacgcaggagggccggttccagacccgcctgtacacgcaggccatgatatgggaggcctatccttggcctgtcgacccagagcgtctggtggaggggaacgggtatgacttcatcctccagcctcagcctgtggacgaggtggacacgacacccgatcggagggtcatcctgaacaagacaggttccacgaacggcttcggtgggtacatcgcgatcgtgccaagcgaggatctgggcgtcgtcgtccttgccaaccgcaactaccccaacgaggcgcgggttcgagccacttacgacctgatcactcacatcttggccgaataa

SEQ ID NO: 48487 - protein, 380 aa, Rhodobacter sphaeroides 2.4.1
MKHLSPLSILLMVGALTPALAQDTTPSFESAAAAAFESVIEEHDIPGLVVGVTHGGRHSFYQTGLASREDQQPVTPDTLFELGSISKIFNVTLAALAEERGALSLDAPVADYLPSLRGSPAGELTLIDLATHHTGGLPLQVPDEVADVDRLVDWLRSWRPPEPGTRSYSNISIGLLGHITAGVLGMSYADASQTVIFPALGLKSTWIDVPTDAMGRYAFGYDRKTDAPTRVTPGVLDDEAYGVKSSARDMLTLLDLELGTGTASPEVQTAVATTQEGRFQTRLYTQAMIWEAYPWPVDPERLVEGNGYDFILQPQPVDEVDTTPDRRVILNKTGSTNGFGGYIAIVPSEDLGVVVLANRNYPNEARVRATYDLITHILAE

SEQ ID NO: 48488 - DNA, 1071 bp, Nostoc punctiforme PCC 73102
  CDS (1)..(1071)
atgaggtcaattgtgattgacgactatatccgagccgcaatgactcaaaaccagattcctggactttctgtagccgtggtgcaggaaggtgaagctgttttagttaagggctatgggctggcgaatatagaacactctgtttcagcgaatgaacacacaatttatgaagttgcgtctgttggtaaaactttcacggctacagccgtaatgatgctggtagaacaagggataatttcgctagatgatgcgatgcctgcggcggtaaactacgcagactatctcgatcatctacccctgacatggcaaaatgtcacaattcaacatattctgtctcatcagtctggaattcctagctataccgatgccccaaactactgggaaattacccatcttaatttatcgaaatctgaaattttggctctagttactcacctacccctcaagttccaaccgggtgagtttagcgcctatgacaacacaggctactatctactgggtttgatcctagaaaaggtaactggacaatcttatggagatttgttgcaagagcgcatttttactcctttgggaatgaatgcaaccgtaatgaactatcccagcgacatagtgtcacaccgcgctgctggctatcgcttgctaaacagcaaactcgttaacaaaccttactacagtccttcagttacttattctgctggaggtcaactttccagtatagaagatatggtgaagtgggaacaggcgctttgtagtgcaactctgctaaagcaatcaaccctagataaaatgtggactcctcgttttcccaatcagggcgatgattgggaaaagttgagatatattgcaggtttaggttggtgggtattgaattacggcgatcgccgagtagttggtcataatggttcgatactaggatttgcaagtaacattacccgctttattgatgacaaaattaccgtgattttactttgcaatctcgataaaatttcccgaccagatgcgatcgctaagaaaattgctgaatactactatcctgcccttaaggaagtaattattcagcctccgttaggataa

SEQ ID NO: 48489 - protein, 356 aa, Nostoc punctiforme PCC 73102
MRSIVIDDYIRAAMTQNQIPGLSVAVVQEGEAVLVKGYGLANIEHSVSANEHTIYEVASVGKTFTATAVMMLVEQGIISLDDAMPAAVNYADYLDHLPLTWQNVTIQHILSHQSGIPSYTDAPNYWEITHLNLSKSEILALVTHLPLKFQPGEFSAYDNTGYYLLGLILEKVTGQSYGDLLQERIFTPLGMNATVMNYPSDIVSHRAAGYRLLNSKLVNKPYYSPSVTYSAGGQLSSIEDMVKWEQALCSATLLKQSTLDKMWTPRFPNQGDDWEKLRYIAGLGWWVLNYGDRRVVGHNGSILGFASNITRFIDDKITVILLCNLDKISRPDAIAKKIAEYYYPALKEVIIQPPLG

SEQ ID NO: 48490 - DNA, 1194 bp, Pseudomonas aeruginosa UCBPP-PA14
  CDS (1)..(1194)
atgcgcgataccagattcccctgcctgtgcggcatcgccgcttccacactgctgttcgccaccaccccggccattgccgatgaggccccggcggatcgcctgaaggcactggtcgacgccgccgtacaaccggtgatgaaggccaatgacattccgggcctgaccgtagccatcagcctgaaaggagaaccgcattacttcagctatgggctggcctcgaaagaggacggccgccgggtgacgccggagaccctgttcgagatcggctcggtgagcaagaccttcaccgccaccctcgccggctatgccctggcccaggacaagatgcgcctcgacgaccgcgccagccagcactggccggcgctgcagggcagccgcttcgacggcatcagcctgctcgacctcgcgacctataccgccggcggcttgccgctgcagttccccgactcggtgcagaaggaccgggcacagatccgcgactactaccgccagtggcagccgacctacgcgccgggcagccagcgcctctattccaacccgagcatcggcctgttcggctatctcgccgcgcgcagcctgggccagccgttcgaacggctcatggagcagcaattgttcccggcactgggcctcgaacagacccacctcgacgtgcccgaggcggcgctggcgcagtacgcccagggctacggcaaggacgaccgcccgctacgggtcggtcccggcccgctggatgccgaaggctacggggtgaagaccagcgcggccgacctgctgcgcttcgtcgatgccaacctgcatccggagcgcctggacaggccctgggcgcaggcgctcgatgccacccatcgcggttactacaaggtcggcgacatgacccagggcctgggctgggaagcctacgactggccgatctccctgaagcgcctgcaggccggcaactcgacgccgatggcgctgcaaccacacaggatcgccaggctgcccgcgccacaggcgctggagggccagcgcctgctgaacaagaccggctccaccaacggcttcggcgcctacgtggcgttcgtcccgggccgcgacctgggcctggtgatcctggccaaccgcaactatcccaatgccgagcgggtgaagatcgcctacgccatcctcagcggcctggagcagcaggccaaggtgccgctgaagcgctga

SEQ ID NO: 48491 - protein, 397 aa, Pseudomonas aeruginosa UCBPP-PA14
MRDTRFPCLCGIAASTLLFATTPAIADEAPADRLKALVDAAVQPVMKANDIPGLTVAISLKGEPHYFSYGLASKEDGRRVTPETLFEIGSVSKTFTATLAGYALAQDKMRLDDRASQHWPALQGSRFDGISLLDLATYTAGGLPLQFPDSVQKDRAQIRDYYRQWQPTYAPGSQRLYSNPSIGLFGYLAARSLGQPFERLMEQQLFPALGLEQTHLDVPEAALAQYAQGYGKDDRPLRVGPGPLDAEGYGVKTSAADLLRFVDANLHPERLDRPWAQALDATHRGYYKVGDMTQGLGWEAYDWPISLKRLQAGNSTPMALQPHRIARLPAPQALEGQRLLNKTGSTNGFGAYVAFVPGRDLGLVILANRNYPNAERVKIAYAILSGLEQQAKVPLKR

SEQ ID NO: 48492 - DNA, 1182 bp, Rickettsia sibirica 246
  CDS (1)..(1182)
atgatgcgtagatattttttattgttgcttttttttattactaattgtattgattgttttgcagatatacagcaaaggatcaatgaagcagaaaaagaatatatcagtaatagatttttaaatgccgtttttatgtttgccgatgattataaacctttattaaccggtgctaaaggaatttttgctttaaatggtgagcaattaaaagcaaatgaaatgatgcctattgcttctgctacaaagccttttacagcagcgggaatcttaaaattacaagaacaggcattattaaatattaacgataaaatttataaatatcttgatccggaaatgtggggtggaaaagtgccggattgggcatataaaatatctatccataatttattaacgcatagtagcggtattgctgaatattttagttttgttaaacttgatttaaatatgcctaagaaagagattcacaagaaaatattacaatttgtttcttctaagcctttagaaatatctatagggaaaaaatttaaatatagtaatactaattttgttatactcggtatgattatagaaaaggtggctaaaaaagatttagctaactttttttatgatgaattttttaaaccgcttaatatgaaatctactagttttgtttcatatagtgaggccgctagaatccaaaaaaacgttattagttctaattatccggtaagatattttttaacgcctaataatagtaataaacctatatttactcctgtaactgctgattttttagcagttccttgtgctgacggtggtataatatcaacaccggttgatcttattagatggtatagggcattaaatgaggagaaaattctttctaagaagtcgtataaacttatgactactaaatattttttagcacaagatatagaagggcgtaagtcttatatgggttacggtatttttcttactgatcttgattctaagcgtttaatgattcattatacgggaaaggcccttggaatacaaagtgaagcaggatatgttttgcctgataatctttattttgctatactcagtaatactatgataaaaattcctgaagaagacaaagataaaattgacatgaaaaatcctttaaatcaacttggaataatttattttagagatgcaataataggggcagctataaaaaattaa

SEQ ID NO: 48493 - protein, 393 aa, Rickettsia sibirica 246
MMRRYFLLLLFFITNCIDCFADIQQRINEAEKEYISNRFLNAVFMFADDYKPLLTGAKGIFALNGEQLKANEMMPIASATKPFTAAGILKLQEQALLNINDKIYKYLDPEMWGGKVPDWAYKISIHNLLTHSSGIAEYFSFVKLDLNMPKKEIHKKILQFVSSKPLEISIGKKFKYSNTNFVILGMIIEKVAKKDLANFFYDEFFKPLNMKSTSFVSYSEAARIQKNVISSNYPVRYFLTPNNSNKPIFTPVTADFLAVPCADGGIISTPVDLIRWYRALNEEKILSKKSYKLMTTKYFLAQDIEGRKSYMGYGIFLTDLDSKRLMIHYTGKALGIQSEAGYVLPDNLYFAILSNTMIKIPEEDKDKIDMKNPLNQLGIIYFRDAIIGAAIKN

SEQ ID NO: 48494 - DNA, 1614 bp, Anabaena variabilis ATCC 29413
  CDS (1)..(1614)
atgacactcccatcaccaaataaagtcgatgaattattttccgaatgggataaaccaggctctcctggttttgctttagccatcaccaaagatggtgagactgtctataagcgcggctatggtatcgctgacttagaacacaacataaagatttttccaaattcggtctttgatattgcctcaacgtccaagcagtttacagcgatgtgcattgctttacttgcacgaaaggggaaactttctttagatgacgagatccaaatctacatttcagagatacccagatatgagtatcccattactgtgcggcatctgattcaccacacaagcggcattcgtgattacctaaccctgatggggttggcaggaatgcaatgtgagaatgactatcctgataacgaaatcattggtttaatagctcgtcaaaaagaattgaacttcaagccaggagaggagcatttgtacagcaactcaggatattttcttttggcagaaattgtcaaacgtgtctccggagaatctcttgcggtttttgctgataagcatattttcagtccccttgggatgaagacaactcactttcacgatgatttcacaaggattgtcaggaatagagcgattggctactctgtgagggacgaaggtagctttcggattgatatgtctattcttgatgtagtgggtgacggtggtatctataccacagttgaggatctatgtatctgggatcagaatttttaccaaaacaaattaggaggatatgggcaagacctgatcgaagaaatcattacacctggaagattgaatagcggcgaagtgatagattatgcctttggtttagttatagggcattaccgaggattagaaaccatcagtcacagtggcggatggatgggttacagatcacagatgcttcgattccccaaacagagattctctgtaatttgcttgtcaaatttgggcagcgctgaaccaccagagcttgccagaaaagtcgcagatatttacttagttgatgactttactgagcaaagcatagaatctgtaagtcgccaaacccaaataagagaaattccatcggttgatttagagagcaagactggcttttatcaaaacctaaaaacaggaaccgtttgggagttattggtaaaggatggaaaattaatcgtggaatttgccggaatgagctttacacttgctcctgtgagttcaagtcattttgtcataatggatattccttctaatcccgatgttgaatttgaagagtcaggtttagatgaaccctctcatctttacgtttgtgtggatggcaaaccacgggaggttttccaacggttggactttgctcctcctgattctgaacagttgatggattttacaggagagtattattgccaagagttagatgtcacctacagaatcactatagaagacggagagttgctgctaaatcgaagaaattctcttcgagaaaccctcaagccaattaacaaagatttactggaaggtacggacatcactttgcagtttgtccgtgatgactttcatcaagctgttggattcaatatgagcgcaggatatggaagtgtcagaaacattcaatttgtgaaataa

SEQ ID NO: 48495 - protein, 537 aa, Anabaena variabilis ATCC 29413
MTLPSPNKVDELFSEWDKPGSPGFALAITKDGETVYKRGYGIADLEHNIKIFPNSVFDIASTSKQFTAMCIALLARKGKLSLDDEIQIYISEIPRYEYPITVRHLIHHTSGIRDYLTLMGLAGMQCENDYPDNEIIGLIARQKELNFKPGEEHLYSNSGYFLLAEIVKRVSGESLAVFADKHIFSPLGMKTTHFHDDFTRIVRNRAIGYSVRDEGSFRIDMSILDVVGDGGIYTTVEDLCIWDQNFYQNKLGGYGQDLIEEIITPGRLNSGEVIDYAFGLVIGHYRGLETISHSGGWMGYRSQMLRFPKQRFSVICLSNLGSAEPPELARKVADIYLVDDFTEQSIESVSRQTQIREIPSVDLESKTGFYQNLKTGTVWELLVKDGKLIVEFAGMSFTLAPVSSSHFVIMDIPSNPDVEFEESGLDEPSHLYVCVDGKPREVFQRLDFAPPDSEQLMDFTGEYYCQELDVTYRITIEDGELLLNRRNSLRETLKPINKDLLEGTDITLQFVRDDFHQAVGFNMSAGYGSVRNIQFVK

SEQ ID NO: 48496 - DNA, 1233 bp, Ralstonia eutropha JMP134
  CDS (1)..(1233)
atgtcgcgcgagcggcttgcgcgcattgaacgtttcatcgacgaatcctatgtcgcgaatggcaagctgcccggcgcgctggtccaggtatggcgccgcggcgaactggcgctgaactctgtccttggcgtcgctgaccgggaacggcaggtgccgctggccgaggattcgatcttccgcatctattcgatgaccaagcccgtgacttccgtcgcgatcatgatgctggtcgagcaatgcaagatcgcgctggatgacccggtcagcaagtacatcccggcatgggagaaactgggcgttcacgcaggcggcttcatggagagcttccagacgaagcccgccgcgcgaccgatgctggtggtcgacctgctgcgccacacctcgggcctgacctacggcttccagcagaacaccaacgtcgacgcggcttaccgcaagctgaagctgggcgagcttgccaccgaaggcacgctcgacgaaatgatcgacaagctggcggggctgccgctcgaattctcgccgggcgaggcctggaactactcggtgtcgaccgacgtgcttggctacctggtcggcaaggtcagcggcattccgttcgataccttcctgaaggaacgtatcttcgagccgctgggtatggtggacacgggcttccatgtgccggaagacaaggtggcgcgcttttgcgcgtgctatgcgatcggtgtgctcggttcgaaggtcatatcgaacaaggggcccatgctgcaggacgacccgcgcgccagtccgtacctgaagccgcctagcttcatttcgggcggtggcgggctcgtgtcgaccgccgcggactacatgcgcttcgcgcgcatgctgctgcaaggcggagaactcgacggcgtgaggctgctcgggcccaagacgctgaaactgatgaccgccaaccacctgcccggcggagtggacctgccggccatgtcacgctcgatgttcagcgaagcgacctatgacggcgtggggtttggcctgggctttgccaccaccgtaacgcccgcgtccacgctgattcccggcagcgcgggtgatttcttctggggtggtgcagcaagcactttcttctgggtggacccgcaggaggatcttatcggtctcttcctgacccagttgttgccctcttcggcatatcccgtgcgacgccaactgcgcacgctcgtctacagcgccatcacggagccgggggctgcgccgcgctga

SEQ ID NO: 48497 - protein, 410 aa, Ralstonia eutropha JMP134
MSRERLARIERFIDESYVANGKLPGALVQVWRRGELALNSVLGVADRERQVPLAEDSIFRIYSMTKPVTSVAIMMLVEQCKIALDDPVSKYIPAWEKLGVHAGGFMESFQTKPAARPMLVVDLLRHTSGLTYGFQQNTNVDAAYRKLKLGELATEGTLDEMIDKLAGLPLEFSPGEAWNYSVSTDVLGYLVGKVSGIPFDTFLKERIFEPLGMVDTGFHVPEDKVARFCACYAIGVLGSKVISNKGPMLQDDPRASPYLKPPSFISGGGGLVSTAADYMRFARMLLQGGELDGVRLLGPKTLKLMTANHLPGGVDLPAMSRSMFSEATYDGVGFGLGFATTVTPASTLIPGSAGDFFWGGAASTFFWVDPQEDLIGLFLTQLLPSSAYPVRRQLRTLVYSAITEPGAAPR

SEQ ID NO: 48498 - DNA, 1575 bp, Rubrobacter xylanophilus DSM 9941
  CDS (1)..(1575)
ttgccggagtacaccgcgcagatagacggtgacgtggaggccgggctcgagttctacggcgagtaccaggcgtaccccggagccgtcgtgctcgcggccaggaacggcgtcatcgccaggcacgacgcctacggctacgcgctaaagtacgccgacgacgagaccctgctgcccgaggaggagtgggtccccatgcagagggacaccatcttcgacctggcctccatctccaagctcttcacctccatcgccgcggtgcagctcgtcgagcggggcaagctcgacctggacgcgccggtggccagctacatcccaaagttcgcgcagaacggcaaagaagatgttacggtgcagcagcttctcgcgcacacctccgggctcccggcgtggctcccgctctacagccgctacgacacgccggaggagaggctccaggccgtctacgccgtcgagccggaggctccggccggaacccaataccgctacagcgacctgaacatgatcacgctcggcgaactcgtcgagctgctctcgggccagacgctggacgttttcgtggcgcagaacataacggaacctttgggcatgagagacaccggctacagcccgccatcttccaagctcgaccgcatcgcggccaccgagtaccagccctggacgaaccggggtatgatccggggcagcgtccacgacgagaacgcctggtccctcggcggtgtggccggtcacgccggcgtcttcggcacggcgcgcgacctcgccgtactcgcccagaccatcctgaacggcggcagctacggtggatctcgcatcctcaagccgcagagcgtccgggaactcctcaccaaccacaaccgggagttccccggcaacgaccacggcctgggcttcgagctctaccagcaccggtacatggacgccatggcgacgccttccaccgccggacacacgggctacaccggcacctcgctggtcatcgacccgctggaccgctctttcgccatcctcctgaccaaccgggtgcaccccagccgcgtgaccgtgagcaccaacccctaccggcgggcggtagcgcgcgacgtggcccgcgccgtggcggtccgcatccccggcaaggaggccgcctggttctccgggctcggggacggtctgaaccggaccctagatctcccgctccatctgccggcgggcaagaaagatcttgagttcgacctctggtacgacaccgagccggagtccgactacggcgcggtcgagatctcgaccgacggcggcgagagctggcggccggtctcggggaccatctccggcaggggtggtttccgcgagacggtggagggcaggttcaccggctggtccggcagggtgtggcacaaggctcgcttcgacctgggcccgtacgaaggtccggccatcctgcgcttccggtacgccaccgacgcctgctgcggcgggcggggcgtctacgtccacggggtccgggtacggggcggcggaacaaccgtcttcgacggccggcggccgggggaccggaggctctggcggccggacggctgggtcccgagcggggactga

SEQ ID NO: 48499 - protein, 524 aa, Rubrobacter xylanophilus DSM 9941
MPEYTAQIDGDVEAGLEFYGEYQAYPGAVVLAARNGVIARHDAYGYALKYADDETLLPEEEWVPMQRDTIFDLASISKLFTSIAAVQLVERGKLDLDAPVASYIPKFAQNGKEDVTVQQLLAHTSGLPAWLPLYSRYDTPEERLQAVYAVEPEAPAGTQYRYSDLNMITLGELVELLSGQTLDVFVAQNITEPLGMRDTGYSPPSSKLDRIAATEYQPWTNRGMIRGSVHDENAWSLGGVAGHAGVFGTARDLAVLAQTILNGGSYGGSRILKPQSVRELLTNHNREFPGNDHGLGFELYQHRYMDAMATPSTAGHTGYTGTSLVIDPLDRSFAILLTNRVHPSRVTVSTNPYRRAVARDVARAVAVRIPGKEAAWFSGLGDGLNRTLDLPLHLPAGKKDLEFDLWYDTEPESDYGAVEISTDGGESWRPVSGTISGRGGFRETVEGRFTGWSGRVWHKARFDLGPYEGPAILRFRYATDACCGGRGVYVHGVRVRGGGTTVFDGRRPGDRRLWRPDGWVPSGD

SEQ ID NO: 48500 - DNA, 1170 bp, Burkholderia cepacia R18194
  CDS (1)..(1170)
atgcgattcaacgcgacacgcttcgccgcgaccctgttcgtcgccgcgtgcgccaccgccacggccggccgcgcggccgccgccacccaggacgacctccacgacaccgtcacccgctacatcgcgccgctgatgaagcagtacgcgattcccggcatggcgatcggcatcgtcgccgacggcaagccctacgtgttcgactacggcgtgatgtcgacgcaaaccggcaagcccgtcaacggcgacacgctgttcgaaatcggctccgtcagcaagacgctgaccgcgacactcgcggccgacgcgcaggagggcggcgaactgtcgctggccgacccggcgggcaagtacctgcccgcggtgcagggcaagccgttcggcgtcgtgacgctgctcaatctcggcacgcacacgccgggcggcatgccgctgcaggtgccggacagcattcgcgacgacgcgggcctgatccgctatctcgatgcgtggcggcccgcgtatgcgccgggcacgtatcgcacgtattcgaacgtcgcgatcgggatgctcgggtggctcaccgcgaaggcgatgcacaaggatttcgcggtgctgatggagcagcggctctttcccgcgctcgggatgacgcgcacgtacatcaacgtgccggaagcacgccaggccgactatgcacagggctatacgcaggacggcaagccgatccggatgacgggcggcatgctgtggcagccggcgtacggcgtgcggaccacggcggccgacctgctgcgcttcgtgcaggcgaacatgggactgatcgaaaccgcaccgcgcctgcagcgcgcgctcgagcgcacgcacaccggctatttccgcgcggggccgctgacgcaggacctgatctgggagcagtatccgtatccggtcgcgctgccgacgctgatcgaaggcaactcgatgaagatgctgcgtaacggggtagtggccaccgcgatcaagccgccgctcgcgccgagcgcggatacgtggatcaacaagaccggctcgaccaacggcttcagtacctatgtcgcgttcgtccccgcgaaacggatcgcgatcgtgatgctcgcgaaccgcagctatccgaacgaggatcgcgtgaaggccgcgtacgggatcctcggggcgctcgacggccgacggtaa

SEQ ID NO: 48501 - protein, 389 aa, Burkholderia cepacia R18194
MRFNATRFAATLFVAACATATAGRAAAATQDDLHDTVTRYIAPLMKQYAIPGMAIGIVADGKPYVFDYGVMSTQTGKPVNGDTLFEIGSVSKTLTATLAADAQEGGELSLADPAGKYLPAVQGKPFGVVTLLNLGTHTPGGMPLQVPDSIRDDAGLIRYLDAWRPAYAPGTYRTYSNVAIGMLGWLTAKAMHKDFAVLMEQRLFPALGMTRTYINVPEARQADYAQGYTQDGKPIRMTGGMLWQPAYGVRTTAADLLRFVQANMGLIETAPRLQRALERTHTGYFRAGPLTQDLIWEQYPYPVALPTLIEGNSMKMLRNGVVATAIKPPLAPSADTWINKTGSTNGFSTYVAFVPAKRIAIVMLANRSYPNEDRVKAAYGILGALDGRR

SEQ ID NO: 48502 - DNA, 1008 bp, Listeria monocytogenes str. 1/2a F6854
  CDS (1)..(1008)
atgttctacaaaacgaagcaatcactagatcaactcgtccaaaacggctccactccaggaatcagttatcaaattaaaacgaaccacctggaagaaaataacatcatgggattaaaatccgtttttccagaagcagaaattttgccaagaacaacagaaaacatttatgatatcgcttctttgaccaaagttattgctacgactactcgtattttgcaactcatcgaacaacaaagattccaattaaacgaccctattcaaatgtatttgccagatttccggtacaataatgttacgattatgcatttactcacacatagctctgggctcgcgcaaaatatccctaacttttccatgaacacaccagaagacgttatgcgttatgtgtatgccacacctcaaattaatgctcccggaacatcggtcacatacgccgatgcaaattttcttttactcggttatttgattagcaaaatagacggcaattatgaaacatctattcaaaataatattttagaacccctgagtatgacagatacaagttttcatcccgcaaataaaaaacaagttatcccaaccgaacttgatcaaacgcgcggtttaattcaaggtgaggtacatgatttcaaggcttggactgccaaatcaggcacgggacatgctggtctttttagtacgctaagtgatctttctaaattccgggatgcgctcatgttacaactcggtgctccaattctttctgaaaaaacatggcaactcatgcaaataaatcatacccctggtctaaatagaagtcgcgggctaggctgggatctccgcggtgagtccgtcttatatcacaccgggttcactgggactttcatggtgcttgatttaaaacgccaagccagcttaattgtcctttctaaccgcgtccacccaagccgagctaacccaaatttcgttgataaacgtgacagcattgtcgatacttttatagaagaagtttcaaacacaaaggaagtttag

SEQ ID NO: 48503 - protein, 335 aa, Listeria monocytogenes str. 1/2a F6854
MFYKTKQSLDQLVQNGSTPGISYQIKTNHLEENNIMGLKSVFPEAEILPRTTENIYDIASLTKVIATTTRILQLIEQQRFQLNDPIQMYLPDFRYNNVTIMHLLTHSSGLAQNIPNFSMNTPEDVMRYVYATPQINAPGTSVTYADANFLLLGYLISKIDGNYETSIQNNILEPLSMTDTSFHPANKKQVIPTELDQTRGLIQGEVHDFKAWTAKSGTGHAGLFSTLSDLSKFRDALMLQLGAPILSEKTWQLMQINHTPGLNRSRGLGWDLRGESVLYHTGFTGTFMVLDLKRQASLIVLSNRVHPSRANPNFVDKRDSIVDTFIEEVSNTKEV

SEQ ID NO: 48504 - DNA, 1242 bp, Bacillus cereus G9241
  CDS (1)..(1242)
atggatcacgaaaaaaataatgcgaatgggaaatcacggcggccgattgtatacataaaaagaacaatcattctcgtcttactattttcactggtatatttcatgtatacaaaaattgttgcgcataataagaaagaagaaactttaaaagcagcagcagaaatgaagaaacaagaagagctaaaaaagaaagaagaaaaaaagaagcaagaagcaaaaaaacaaatagagcaggaagaacaagtgaagcaagcacaagctttggaaaagcctgctgagggaccacctcaagaaattaatgaaaacgctcaattagatcaatatttacaaaaaacaggatttagcgggacagcggttattgtgaagaacggaaaggttcttttgaataaaggatacggtatggcgaacaaagagaaacaagtaccgaataattcagagacaactttttatattggttctatttcaaaggcttttgtagcgactgctattatgcaattaaaagatcaacataaattaaacgtagaagatacggttgcgaagtatattccagatttccctcaaggcaatggtattcagttaaaacatttactaacacatacatcaggaattccagagtatgagcagggaacagaggatatttctcatgaagaattgataaaacgaataggaaagcaaaagcgtattggaagtccaggagagaaatggaagtattctgattcgaattattcgatactcgcctatatcgctgagaaggtaagtggacaaccgttagaagagtatattaaacaacatatttttgctactgcgggtatgaatcattccggtttcggtaaagcgttagagcaaacaagattcccgtcaacgggttataaaatagtaaataataatatgacaacacctaatattccaagtatgtcacaactatatggttgtggtgatatatatacgagtgctcaggatttatatttatttaatgaagcacttttctctggaaagttaatttcaaaagagagctatgatcaaatgtttacggccgtgaaaaaggattacggatttggttggtatgtagacccgggaagttattcgaatcacggtgtaatgccaggctggaactgtttaaatggatttagtaaaaatggaagtgtgtatgtcgttttattatctaacattcaaaacaacataaaatcatttggtaaagtgaataacgacatttatacgatgttgcgaaatattgaagtgtaa

SEQ ID NO: 48505 - protein, 413 aa, Bacillus cereus G9241
MDHEKNNANGKSRRPIVYIKRTIILVLLFSLVYFMYTKIVAHNKKEETLKAAAEMKKQEELKKKEEKKKQEAKKQIEQEEQVKQAQALEKPAEGPPQEINENAQLDQYLQKTGFSGTAVIVKNGKVLLNKGYGMANKEKQVPNNSETTFYIGSISKAFVATAIMQLKDQHKLNVEDTVAKYIPDFPQGNGIQLKHLLTHTSGIPEYEQGTEDISHEELIKRIGKQKRIGSPGEKWKYSDSNYSILAYIAEKVSGQPLEEYIKQHIFATAGMNHSGFGKALEQTRFPSTGYKIVNNNMTTPNIPSMSQLYGCGDIYTSAQDLYLFNEALFSGKLISKESYDQMFTAVKKDYGFGWYVDPGSYSNHGVMPGWNCLNGFSKNGSVYVVLLSNIQNNIKSFGKVNNDIYTMLRNIEV

SEQ ID NO: 48506 - DNA, 1440 bp, Rubrivivax gelatinosus PM1
  CDS (1)..(1440)
ttgctgctggcagcagctgtgctggccttcttcacatcggccgcgcagccgcagccgcagacttcagccgcgtcgaccttcgagacagacactgagctgcaggccgcgacacggctcttctccgcttggctggaaggccacatggcccagcgcggcacgccgggtgtcatggtcggcgtcgtgcatgaccagcagctggtctggcacaaaggcttcggctttgccgatgtcgcgtctcagcggcccatgaccgcgcagacccgcttccgcatggcctcgcactccaagatgctcaccgccatcgccgtcatgcaactgcgtgaagagggccggctgcggctggacgacccggtggcccagcacctgccgtggttcaagctgaagccggcgggcgacgacgacgggcctgtcacgatcgaacagctgctgtcgcacagctcgggcttgccgcgcgaagccagcgaccactggacctcgctgcagttccccagccgcagcgagttgcaggcgctgatggcgcagagacagtcgaccttcgcgccgcaggtgcgctggaagtactcgaatctggcctacggcgtggccggccaggtggtggagcagctcagcggacaaccgttcgccagctacgcgcaggcccacatcctgggcccgctgggcatgcaggactccagctacgaccaggacgtgccgggcctggccacgccctacggccggcgcctgccggacggcacgcgtgtgagcttccccttcgtcgatgcgcgtggcctggctgctgccaccggcctgacctcgacgctcgacgacatggtgaagttcgtctcggcccagttccggcgcggcccgcgtggcggcacgcagatcatcagcagcggctccctccgtgagatgcaccgcgtgcggtccgtggacgagaattggtccgttggcaccggcctgggctttctgaccacgcgcatcaacaacaagagctacgtcggccacggcggcggctaccccggctacacgacgcagacgctgttccaccttggcgacaagctcggcgtcatcgtgctcaccaacagcgccgattcgggcgtgaacgacatcgcccgccaggcgattgcggcctttggcccgccggtggcgaaagtcgccgccgcaggcgcgaccacccccgcctgggacccggcctgggcgcgtttccagggcatgtaccgcagccgcggcggcgacacctttgtggtcatgctgaacaagcggctggtgctgctgggcgcgtcggcggcgggcatcgatgccgccacccggctggagccgctcggcaacggccacttccggctcgacagcgccacaggggggccgccggtcggcgaggtggtgtactttcaggagggcagcggcaagcccatgcgcatggtcgtgggcgacaacacgtcggagcgcatcgcggcgccttag

SEQ ID NO: 48507 - protein, 479 aa, Rubrivivax gelatinosus PM1
MLLAAAVLAFFTSAAQPQPQTSAASTFETDTELQAATRLFSAWLEGHMAQRGTPGVMVGVVHDQQLVWHKGFGFADVASQRPMTAQTRFRMASHSKMLTAIAVMQLREEGRLRLDDPVAQHLPWFKLKPAGDDDGPVTIEQLLSHSSGLPREASDHWTSLQFPSRSELQALMAQRQSTFAPQVRWKYSNLAYGVAGQVVEQLSGQPFASYAQAHILGPLGMQDSSYDQDVPGLATPYGRRLPDGTRVSFPFVDARGLAAATGLTSTLDDMVKFVSAQFRRGPRGGTQIISSGSLREMHRVRSVDENWSVGTGLGFLTTRINNKSYVGHGGGYPGYTTQTLFHLGDKLGVIVLTNSADSGVNDIARQAIAAFGPPVAKVAAAGATTPAWDPAWARFQGMYRSRGGDTFVVMLNKRLVLLGASAAGIDAATRLEPLGNGHFRLDSATGGPPVGEVVYFQEGSGKPMRMVVGDNTSERIAAP

SEQ ID NO: 48508 - DNA, 1188 bp, Rubrivivax gelatinosus PM1
  CDS (1)..(1188)
atgacgcagcactccctccagcaggccgccgacgcggttctcgacagcaccgtcggccgcgccggtggcgcacccggcgtcgtcgcgatggcgaccgatgcgcgcggcaacctctacgagggcgccgccggcagtcgcgagctcggcagcgaccggcccatgacggtggacaccgtgatgtgcctgttctcctgcaccaaggcgctcaccggcgcgatggtgatgcagctggtggaggaaggcctcgtcggcctcgacgatgcggcgtcgcggtacgtgccggacatcgccgcgatccaggtctacgacggcctcgatgccgacggccagccgaagacgcgcccgccgcgccgcgccatcacgctgaacgacctgatgctgcacaccgccggcttcggctacgagttcttcagccccgaagacctggcctaccgtcaggcgaagaacatcccgaccctcatcgccaacacctacgaggccatccagtcggtgctgctgttcgatccgggcgagcgctggaactacggctgcaacatcgactggctgggcaaggtggtcgaggccgtgcgtggcaagcggctcggcgaagtgatggccgagcgtttgttcgcaccgctgggcatgaacgacaccgcgttcgtcatcacgccctcgatgatgcagcggcgcgcttcgctgcacatgcgcgccgccgacggcaagctcacgccggtgcccgacctggtgctgccgcagccgcccgagatggacatgggcggccacggcctgtacggcacggtcggcgattacatgaagttcatccgcatgctgctcaacgacggcgacggcgcgaacggccgcgtgctgcgcgccgagatcgtgcagcgcatgtcgcagaacgggctgggcgcactgaagagcggcggctgggtgacgaccaatcccgcgctgtcgaactccggcgagttcttccccggcctgtcgaagtcctgggcctacaccttcatggtcaacgacgaggacacccccaccggccgaccggccgggtcgctgatgtgggccggcctcggcaatctctactactggatcgaccgcaagaaccgcatcggcgggttctggggcacgcagatcctgcccttccaggacgtggcgtcctatccgggcttcgtcgatttcgagagcgcggtctaccgcacgctgcggcgctag

SEQ ID NO: 48509 - protein, 395 aa, Rubrivivax gelatinosus PM1
MTQHSLQQAADAVLDSTVGRAGGAPGVVAMATDARGNLYEGAAGSRELGSDRPMTVDTVMCLFSCTKALTGAMVMQLVEEGLVGLDDAASRYVPDIAAIQVYDGLDADGQPKTRPPRRAITLNDLMLHTAGFGYEFFSPEDLAYRQAKNIPTLIANTYEAIQSVLLFDPGERWNYGCNIDWLGKVVEAVRGKRLGEVMAERLFAPLGMNDTAFVITPSMMQRRASLHMRAADGKLTPVPDLVLPQPPEMDMGGHGLYGTVGDYMKFIRMLLNDGDGANGRVLRAEIVQRMSQNGLGALKSGGWVTTNPALSNSGEFFPGLSKSWAYTFMVNDEDTPTGRPAGSLMWAGLGNLYYWIDRKNRIGGFWGTQILPFQDVASYPGFVDFESAVYRTLRR

SEQ ID NO: 48510 - DNA, 1233 bp, Ralstonia metallidurans CH34
  CDS (1)..(1233)
atgtcccgggagcggctggggcggatcgatcgtttcatcaatgaagcgtatatcgccaacggcaagctaccgtgcgcgctgacccaggtgtggcggcgtggcgagctggtgttgaactcggtgctgggccaggccgaccgcgagcggcaggtgccgctggccgaggactcgatcttccgcatctactcgatgaccaagccgatcacctcggtggcgatcatgatgctgctcgaggaatgcaagatcgcgcttgacgatccggtcagcaagtacattcccgcatgggaaaacctcggcgtcttcaccggcggcttcatggagagcttccagacgcgcgcgccagcacgaccgatgcaggtggtcgacctgctgcgccacacctctggactgacctacggcttccagcagaacaccaatgtcgatgccgcctatcgcaggctgaagctgggcgacatcgccacggacggcacgctcgacgacatgatcgagaagctggccacgctgccgctagagttctcgccgggcgaggcctggaactactcggtatcgaccgacgtgctgggctacctggtcggcaagatcagcggcatgccgttcgagaccttcctgaaggaacgcatcttcgatccgctgggcatggtcgataccgcgttccacgtacccgaggacaaggtatcgcgcttctgcgcgtgctacgccatcggcgcgctgggttcgaaggtcatttcgccgcgtgggccgatgctccaggacgatcctctggccagcacctacctgaagccgcccagctttgtctcgggtggcggtggtctggtgtcgacggcggcggactacatgtgcttcgcacgcatgttgctgcagggtggcgaactcgatggcgcgcgcctgctgagtccgaagaccctggcgctgatgaccgccaaccatctgccgggcggtgtggatctgccgcgcatgtcccgctcgatgttcagcgaggccacctacgaaggcgtcggattcggactcggcttcgccacgacgctcacgccagccaccacgctgattcccggcagcgccggagacttcttctggggcggcgcggccagcaccttcttctgggtcgatcctgaggaagacctgatcggcctcttcctgacccagctcctgccgtcgtcggcctatcccgtgcgccgccaattgcgcacgatggtctacagcgcgatcacggagccgggcgccggtgcgcgctga

SEQ ID NO: 48511 - protein, 410 aa, Ralstonia metallidurans CH34
MSRERLGRIDRFINEAYIANGKLPCALTQVWRRGELVLNSVLGQADRERQVPLAEDSIFRIYSMTKPITSVAIMMLLEECKIALDDPVSKYIPAWENLGVFTGGFMESFQTRAPARPMQVVDLLRHTSGLTYGFQQNTNVDAAYRRLKLGDIATDGTLDDMIEKLATLPLEFSPGEAWNYSVSTDVLGYLVGKISGMPFETFLKERIFDPLGMVDTAFHVPEDKVSRFCACYAIGALGSKVISPRGPMLQDDPLASTYLKPPSFVSGGGGLVSTAADYMCFARMLLQGGELDGARLLSPKTLALMTANHLPGGVDLPRMSRSMFSEATYEGVGFGLGFATTLTPATTLIPGSAGDFFWGGAASTFFWVDPEEDLIGLFLTQLLPSSAYPVRRQLRTMVYSAITEPGAGAR

SEQ ID NO: 48512 - DNA, 1176 bp, Burkholderia fungorum LB400
  CDS (1)..(1176)
atgaagttcaaagcccagagccttacggcgaccgtcgtctttgccttgtgcgcgaccgcatcgatgagtcgcgcagccgacgccacgcaagacggcatccaacgcacggtcgatgcggcgatccgcccgctcatggcgaaagacggtattcacggcatggcggtcggcatcgtcgccgggggcaaggcttatgtgtacaactacggcgtggcatcggcggaaaccggcaagcccgtgacacgcgacacgcttttcgagctcggctcgatcagcaagactttcacagcgacgctggcttcgtatgcgcaggtgagcggcaatctctcgctgtcggatacgactggcaagtatctgcctgtgcttcagggcagccagttcggcaacgtgaagctgatcaatctgggcacgcacacgccgggcggtctgccgttgcaggtgcccgacgagatccacgacaacgacgaactcatgcagtatttcaaggcatggcggcccagttgcgtgccgggcgcgtgccggacttataccaatcccggcatcggcacgctcggtctgatcacggcaaaaagcatgggcgaggatttcacgccgttgatggaacagcgcatgtttcccgcgctgggattgaagaacagctatatcgacgttccagaagcgcggataccggattacgcgcaaggctacaagaaggacggtgcgccgatccgcatggcgcccggtgtgctatccgccgaagcctacggcgtgaagtccaccgccgccgacatgacgcgcttcatgcaggccaacatgaatctgctcccgctcgacgcgaagttgcagcgcgcgatcatgcagacgcacaccggttacttcaaggcaggcgtgttgacccaggatctgatctgggagcaatacgcgtatccggtagcgttgaagacgttgctggcgggcaattcgtcggcgatggccttgaaggcgacgcccgcggtcgagatcaagccgccgctcgcccctcggcaggatgtgtggatcaacaagaccggttcgaccaatgggttcggcgcgtatgtggctttcgttccggagaagcagttgggcattgtcatgctcgcaaacaagaacttcccgaacgatgagcgcgtgagcgtggcttataaaattctgacggcgctcgccggcgcgggcgttcaatag

SEQ ID NO: 48513 - protein, 391 aa, Burkholderia fungorum LB400
MKFKAQSLTATVVFALCATASMSRAADATQDGIQRTVDAAIRPLMAKDGIHGMAVGIVAGGKAYVYNYGVASAETGKPVTRDTLFELGSISKTFTATLASYAQVSGNLSLSDTTGKYLPVLQGSQFGNVKLINLGTHTPGGLPLQVPDEIHDNDELMQYFKAWRPSCVPGACRTYTNPGIGTLGLITAKSMGEDFTPLMEQRMFPALGLKNSYIDVPEARIPDYAQGYKKDGAPIRMAPGVLSAEAYGVKSTAADMTRFMQANMNLLPLDAKLQRAIMQTHTGYFKAGVLTQDLIWEQYAYPVALKTLLAGNSSAMALKATPAVEIKPPLAPRQDVWINKTGSTNGFGAYVAFVPEKQLGIVMLANKNFPNDERVSVAYKILTALAGAGVQ

SEQ ID NO: 48514 - DNA, 1767 bp, Geobacter metallireducens GS-15
  CDS (1)..(1767)
atggccgcgattgcggttgtctttgtgctcgccggctgctctacaatgccgaagaagccggacagtctgacacggggagattacggttacacgaaggagtacgtctcctggctgatcaaaaaggagatgcgggaaaacgacgtgaccggtctcagcatcgccctggtggacgatcagcgggttgtctgggcacagggtttcggcgttgccgatgaggcgaacaaggtgccggccacaccggatacgatttaccgggtcggctccatctccaagctgttcacggccaccgcggtcttgcagttggcggaacagggcaaaatggacatcgacaagccgctgtcgacctacctgcccgaattctccgttaagagccgcttccccgatgccggcccgatcactccccgcaccctcatgacccaccattccggcctcccttcagacttcctgaaagggatgtggacgaataaccccgaacctatttccaacgtggttaatctgctgaaggatgagtacgcgcagtatccccccaatttcgtcttctcctactccaacctcggtgtttccctcctgggcaatgcggtggagcgaatagccggccgaccgtatgcctcccagattgatgagacggtgcttcaccctctggggatggccagttcgtcattctctacccattccgacgtagcgtcccgcctggccaagggataccggaacgggaaggagatcggggaaccgcagctgcgggacatcccggccggcgggctccacaccaatgttctggatctttcccgcttcatggagatggtctttgccggggggaaggccggcgaacggcggatactcaaggaggaaacgcttgcggagatgctcagcccgcagaatgacggggtgccccttgaccatgacttccacatcgggctcgggtggctgctgactgacgtcggcatcgaaaatgccggcaaggttgcctggcatgacggcgccaccctactctaccgcagccagatggtcatccttcctgaacagaagctgggggtcgtggtgctgtccaactcagccacggctgcttccgtggtgcacaaggtggcgaccgaggctctaaaactcgccatggaggccaaggcaggcatccggcagccggagcgaagcaagccggttgagcgcgaggcggacttgtcccctgaagaacggcaaaaactggcgggcgcctacgtcactcccttcggaactgtcaaagtaatcgaatccggcactacgctgcggacggagttcttcggcaaaaccttcagcgtcgttccccgcaatgatggccggatgggactccggtacagacttttgggagtcatcccgataagtctgggagatctggactatctcgggttctccacgtcgacggtttcaggccataacgttctcctggccacggcagcggggaagagcatgctggtcggcgagaagatggagccggtgctggtctctgaacaatggcaacggagggtgggggcctacgagatcgctaaccccggggacgacaccatgctggttgacgacattcgcctgcggtacgaagacggcttccttcgggtcgactacgccctcccgctgttcttcgacgggaagctcaacgtatcgctgcagcctctctccgacacggaggcggtgatccgtggcctgggtcgggggatgggggaaacgatccgtgtagttgcggtcaacggcgaggagatgctccagtattcaggatatctgctcaaaaagaagcgagagtaa

SEQ ID NO: 48515 - protein, 588 aa, Geobacter metallireducens GS-15
MAAIAVVFVLAGCSTMPKKPDSLTRGDYGYTKEYVSWLIKKEMRENDVTGLSIALVDDQRVVWAQGFGVADEANKVPATPDTIYRVGSISKLFTATAVLQLAEQGKMDIDKPLSTYLPEFSVKSRFPDAGPITPRTLMTHHSGLPSDFLKGMWTNNPEPISNVVNLLKDEYAQYPPNFVFSYSNLGVSLLGNAVERIAGRPYASQIDETVLHPLGMASSSFSTHSDVASRLAKGYRNGKEIGEPQLRDIPAGGLHTNVLDLSRFMEMVFAGGKAGERRILKEETLAEMLSPQNDGVPLDHDFHIGLGWLLTDVGIENAGKVAWHDGATLLYRSQMVILPEQKLGVVVLSNSATAASVVHKVATEALKLAMEAKAGIRQPERSKPVEREADLSPEERQKLAGAYVTPFGTVKVIESGTTLRTEFFGKTFSVVPRNDGRMGLRYRLLGVIPISLGDLDYLGFSTSTVSGHNVLLATAAGKSMLVGEKMEPVLVSEQWQRRVGAYEIANPGDDTMLVDDIRLRYEDGFLRVDYALPLFFDGKLNVSLQPLSDTEAVIRGLGRGMGETIRVVAVNGEEMLQYSGYLLKKKRE

SEQ ID NO: 48516 - DNA, 1296 bp, Trichodesmium erythraeum IMS101
  CDS (1)..(1296)
atgatattaactcaaaagcctttactaaagactataatctttgcatttgtttatcttagcttaattccttttgccaaagctttgcctgtagctaaaactcccgaagaaattggactttcttcatctaaactagaagcaattacagaagaactggagctacttgtaaataccaggcaaattgctggaggagtactcacagtaatcagaaatggtaaagtaggttatcgtaaaacagtaggcttcagaaacttagaaaccgaagagttaatacaagtgaatgatatctttcggattgcttctatgaccaagattataactggttttgcagcttatcttttaaaacaagataacttgattgattttaatgatccggtctctaaatacattgagagttatgggagtctgaaagtgttgattcctggaaaatctggagaagcaagtgatttcactacagttactgctaaaaaccaaattactattcagcatttactaaaccacacttctggattaaaagcaggaatttccaatagcatctctggtaactctgcaacaattggtgaagcaatggagaaacttgtaaatattcccttgcaatttgaaccaggaagtgcttttctctacagtaacttaaactcggatttattaggctatttaatagaagtagtatcagagcagacactagctgagttttttgaagctagaatttttcaaccactagagatgaaggatacttctttttttgtccgtgaagaaaaattagaccgtctcaccactgtatatactcctaagaataataatttgaaacctcttgttaacaatgctgacgtttttaaacagacctatttctctggaggaggaggtttatattctactattaacgactattctcgttttctccaaatgcttctctcacaaggccagttaattagcaaagatggtcaaacagtaattcaggtggctgacgcaaaaacagtagaagaatttctttcaattaaacccgaagatttagaaattaacccattttttcaacaattattaggtggggctagctatcgtttcactaatggtatggccgttaagtcagcacctagtgaaacagtagcttcaataggtgccttcaaatggttcggtgcctacagtacttattattttgttgatccaaaaaaagagttgattggtatattaatgacacaaattccatttgctccatttctattgcaaactaacttgataaataaatttgaatctcttatttacaattcgctttgtaataattgtcaagatgtagaaccttag

SEQ ID NO: 48517 - protein, 431 aa, Trichodesmium erythraeum IMS101
MILTQKPLLKTIIFAFVYLSLIPFAKALPVAKTPEEIGLSSSKLEAITEELELLVNTRQIAGGVLTVIRNGKVGYRKTVGFRNLETEELIQVNDIFRIASMTKIITGFAAYLLKQDNLIDFNDPVSKYIESYGSLKVLIPGKSGEASDFTTVTAKNQITIQHLLNHTSGLKAGISNSISGNSATIGEAMEKLVNIPLQFEPGSAFLYSNLNSDLLGYLIEVVSEQTLAEFFEARIFQPLEMKDTSFFVREEKLDRLTTVYTPKNNNLKPLVNNADVFKQTYFSGGGGLYSTINDYSRFLQMLLSQGQLISKDGQTVIQVADAKTVEEFLSIKPEDLEINPFFQQLLGGASYRFTNGMAVKSAPSETVASIGAFKWFGAYSTYYFVDPKKELIGILMTQIPFAPFLLQTNLINKFESLIYNSLCNNCQDVEP

SEQ ID NO: 48518 - DNA, 1194 bp, Rickettsia akari str. Hartford
  CDS (1)..(1194)
atggaagttatgattcgtagatattttgtattgctgctttttttaattactaatagtattggttgttttgcagatatacagcaaagaatcaatgcagcagaaaaagaatatatgagtaatagatttttaaatgctgtttttatgtttgccgatgattataaacctttattcaccggtgctaaaggaatttttgctttaaacggtgagcaattaaaagcaaatgaaatgatgcccattgcttctgctacaaaaccttttacagcagcaggaattttaaaattacaagaacaggaattattaaatattaatgataaaatctataaatatcttgatccggacatgtggggtggaaaagtaccagattgggcatataaaatatctattcataatttattaacgcatagtagcggtattgctgaatattttagttttgttaaacttgatttaaatatgcctcagaaagagattcacaagaaaatattacaatttgtttcttctaaacctttagaaatatctatagggacaaaatttaaatatagtaatactaattttgttatactcggtatgattatcgaaaaagtagctaaaaaagatttaggtgactttttttatgatgaattttttaaacctcttggcatgaaatctactagttttgcttcatatagtgatgctgctagaattcagaaaaatgttgttagtgctaattatccggtaagatattttttaacgcctaataatagtaataaacctatatttactcctgtaattgctgagtttttagcagttccttgtggagatggagggatcatatcaaccccaaacgatctagttaaatggtatagggcattaaatgaggggacaattctttctaagaagtcgtataaacttatgactactaaatattttttagcaaaagatacagaagggcgtaagtcttatatgggttacggtatttttcttacggatcttgattctaagcatttaatgattcattatacgggaaaagcccttggcatacaaagtgaagcaggatatgttttgcctgataatctttattttgctatacttagtaatactatgattaaaattcctgaagaagaaaaagataaaattgacatgaaaaatcctttaaatcaacttggaataatttatttcagagatgcaataatagaggcagctataaaaaatgattaa

SEQ ID NO: 48519 - protein, 397 aa, Rickettsia akari str. Hartford
MEVMIRRYFVLLLFLITNSIGCFADIQQRINAAEKEYMSNRFLNAVFMFADDYKPLFTGAKGIFALNGEQLKANEMMPIASATKPFTAAGILKLQEQELLNINDKIYKYLDPDMWGGKVPDWAYKISIHNLLTHSSGIAEYFSFVKLDLNMPQKEIHKKILQFVSSKPLEISIGTKFKYSNTNFVILGMIIEKVAKKDLGDFFYDEFFKPLGMKSTSFASYSDAARIQKNVVSANYPVRYFLTPNNSNKPIFTPVIAEFLAVPCGDGGIISTPNDLVKWYRALNEGTILSKKSYKLMTTKYFLAKDTEGRKSYMGYGIFLTDLDSKHLMIHYTGKALGIQSEAGYVLPDNLYFAILSNTMIKIPEEEKDKIDMKNPLNQLGIIYFRDAIIEAAIKND

SEQ ID NO: 48520 - DNA, 1179 bp, Chloroflexus aurantiacus
  CDS (1)..(1179)
atgcgcagattactcgtgctgttcagtattcttcttatcggtatagtgaccgcatgcgcccggcgtgaagcggtactctcttcctgggcaccggtggggccgcagccgaccattctacctagtgttacgccagaagggccggcagtggcaactacgccgctggttgccgtgatggagccggtacggcctacaccgacaccggctctggttgatattgctgggcagattgacgaatatctgcgcaatcttaccgaacagggtcagtttcggggcgcagttttagttgctacgcaggaacgtattctggtggcacgtggctacggcctggcaaatgccgagcgtaaccttcccaacacggcccagacccgtttccgcattgcatcgatctcgaaaccaattaccgcagtagcgattttacagttgcaggcggcagggaagctggtcgtcgatgagtcggtttgtcaatacctgcccgattgcccgacggcgtggcaggcagttacgctccatcatctgttgacgcacacgtcgggaatacccaactataccgattttgctaactttgccgaggtagagctatcaccggtgacaccacggcaactgatggaacgtttccgtaatctcccgctcgattttgtgccggggagtgcgtaccgttacagcaactccaactatgtcgttctgggcctgattatcgaagcggttagtggtcagccctacgctgattacattcgcgacaatatctttgtgccggcaggcatgatcaatagcggctacgacaccggtgatgcttcagtactcaacggcacggtggggtatctggggccgggcatcgagcggtctattcccattgataccagtaatctttacagcgccggcggtctctactcgacggttgaagacctctaccgatttgtgcaagcgcttaatagtgggcagcttctgccggcgaacgaacttgcgaagatgtatacgccgaaccggagcaactatgggtacggttggaagattgaagatcgcaacgggcgtcgggtgatctaccatcccggcttcatatctggcgctgttacacacctcgcctactatcctgagcgtcaaagtgtcgttgttgtcctgagcaatatggaacgcaccaatgctgatgccattgccgcaaccattggtgcgctcctaccgtga

SEQ ID NO: 48521 - protein, 392 aa, Chloroflexus aurantiacus
MRRLLVLFSILLIGIVTACARREAVLSSWAPVGPQPTILPSVTPEGPAVATTPLVAVMEPVRPTPTPALVDIAGQIDEYLRNLTEQGQFRGAVLVATQERILVARGYGLANAERNLPNTAQTRFRIASISKPITAVAILQLQAAGKLVVDESVCQYLPDCPTAWQAVTLHHLLTHTSGIPNYTDFANFAEVELSPVTPRQLMERFRNLPLDFVPGSAYRYSNSNYVVLGLIIEAVSGQPYADYIRDNIFVPAGMINSGYDTGDASVLNGTVGYLGPGIERSIPIDTSNLYSAGGLYSTVEDLYRFVQALNSGQLLPANELAKMYTPNRSNYGYGWKIEDRNGRRVIYHPGFISGAVTHLAYYPERQSVVVVLSNMERTNADAIAATIGALLP

SEQ ID NO: 48522 - DNA, 1137 bp, Serratia marcescens
  CDS (1)..(1137)
atgacgaaaatgaaccgcctggcggccgcgctgatcgccgcactgatcttgccgaccgcgcaggccgcgcagcagcaggatatcgacgccgttattcagccgctgatgaaaaaatatggcgtaccgggcatggcgatcgccgtgtcggtcgacggcaaacagcagatttacccgtatggcgtcgcctcgaagcagaccggcaaaccgatcaccgagcagacgctgttcgaagtgggctcgctgagcaaaacctttaccgcgacgctggcggtctatgcgcagcagcagggcaagctgtcgttcaacgatccggccagccgctatctgcccgagctgcgcggcagcgccttcgacggcgtcagcctgctgaatctggcgacgcatacctccggcctgccgctgttcgtgccggacgacgtcaccaacgacgcccagctgatggcctactaccgggcctggcagccgaaacacccggcgggcagctaccgcgtctattccaacctcggcatcgtcatgctgggcatgatcgccgccaagagcctcgaccagccgtttatccaggcgatggaacaggggatgctgccggcgctgggcatgagccacacctacgttcaggtgccggcggcgcagatggctaactatgcgcagggttacagcaaggacgataagccggtgcgggtcaatcccggcccgctggacgccaaatcttacggcatcaagtccaacgctcgcgatctgattcgctatctggacgccaacctgcagcaggtgaaggtggcgcacgcgtggcgcgacgcgctggccgcgacgcacgtcgggtattacaaggcgggcgcgttcacgcaggatctgatgtgggagaactacccgtatccggtgaaactgtcgcgtttgattgaaggcaacaacgccgggatgatcatgaacggcacgccggccaccgccatcacgccaccgcagccggaattgcgcgccggctggtataacaaaaccggctccaccggcggcttctccacctacgcggtatttatcccggcgaaaaatatcgccgtggtgatgctggccaacaagtggttcccgaacgacgatcgcgtcgaggcggcttaccacatcgtccaggcgctggagaagcgctga

SEQ ID NO: 48523 - protein, 378 aa, Serratia marcescens
MTKMNRLAAALIAALILPTAQAAQQQDIDAVIQPLMKKYGVPGMAIAVSVDGKQQIYPYGVASKQTGKPITEQTLFEVGSLSKTFTATLAVYAQQQGKLSFNDPASRYLPELRGSAFDGVSLLNLATHTSGLPLFVPDDVTNDAQLMAYYRAWQPKHPAGSYRVYSNLGIVMLGMIAAKSLDQPFIQAMEQGMLPALGMSHTYVQVPAAQMANYAQGYSKDDKPVRVNPGPLDAKSYGIKSNARDLIRYLDANLQQVKVAHAWRDALAATHVGYYKAGAFTQDLMWENYPYPVKLSRLIEGNNAGMIMNGTPATAITPPQPELRAGWYNKTGSTGGFSTYAVFIPAKNIAVVMLANKWFPNDDRVEAAYHIVQALEKR

SEQ ID NO: 48524 - DNA, 1137 bp, Serratia marcescens
  CDS (1)..(1137)
atgacgaaaatgaaccgcctggcggccgcgctgatcgccgcactgatcttgccgaccgcgcacgccgcgcagcagcaggatatcgacgccgttattcagccgctgatgaaaaaatatggcgtgccgggcatggcgatcgccgtgtcggtcgacggcaaacagcagatttacccgtatggcgtcgcctcgaagcagaccggcaaaccgatcaccgagcagacgctgttcgaagtgggctcgctgagcaaaaccttcaccgcgacgctggcggtctatgcgcagcagcagggcaagctgtcgttcaacgatccggccagccgctacctgcccgagctgcgcggcagcgccttcgacggcgtcagcctgctgaatctggcgacgcatacctccggcctgccgctgttcgtgccggacgacgtgaccgacaacgcccaactgatggcctactaccgggcctggcagccgaaacatccggcgggcagctaccgcgtctattccaacctcggcatcggcatgctgggcatgatcgccgccaagagcctcgaccagccgtttacccaggcgatggagcaggggatgctgccggcgttgggcatgcgccacacctacgttcaggtgccggcggcgcagatggccaactatgcgcagggctacaacaaggacgataagccggtgcgggtcaatcccggcccgctggacgccgagtcttacggcatcaagtccaacgctcgcgatctgattcgctatctggacgccaacctgcagcaggtgaaggtcgcgcacgcgtggcgcgaggcgctgaccgcgacgcacgtcggttattacaaggcgggcgcgttcacgcaggatctgatgtgggagaactacccgtacccggtgaaattgtctcgtttgatcgagggcaacaacgccgggatgatcatgaacggcacgccggctaccgccatcacgccgccgcagccggaattgcgcgccggctggtataacaaaaccggctctaccggcggtttctccacctacgcggtgtttatcccggcgaagaatatcgccgtggtgatgctggccaacaaatggttcccgaacgacgatcgggtcgaggcggcttaccgcatcgtgcaagcgttggataagcgctga

SEQ ID NO: 48525 - protein, 378 aa, Serratia marcescens
MTKMNRLAAALIAALILPTAHAAQQQDIDAVIQPLMKKYGVPGMAIAVSVDGKQQIYPYGVASKQTGKPITEQTLFEVGSLSKTFTATLAVYAQQQGKLSFNDPASRYLPELRGSAFDGVSLLNLATHTSGLPLFVPDDVTDNAQLMAYYRAWQPKHPAGSYRVYSNLGIGMLGMIAAKSLDQPFTQAMEQGMLPALGMRHTYVQVPAAQMANYAQGYNKDDKPVRVNPGPLDAESYGIKSNARDLIRYLDANLQQVKVAHAWREALTATHVGYYKAGAFTQDLMWENYPYPVKLSRLIEGNNAGMIMNGTPATAITPPQPELRAGWYNKTGSTGGFSTYAVFIPAKNIAVVMLANKWFPNDDRVEAAYRIVQALDKR

SEQ ID NO: 48526 - DNA, 1146 bp, Escherichia coli
  CDS (1)..(1146)
atgatgaaaaaatcgttatgctgcgctctgctgctgacagcctctttctccacatttgctgccgcaaaaacagaacaacagattgccgatatcgttaaccgcaccatcaccccgttgatgcaggagcaggctattccgggtatggccgttgccgttatctaccagggaaaaccctattatttcacctggggtaaagccgatatcgccaataaccacccagtcacgcagcaaacgctgtttgagctaggatcggttagtaagacgtttaacggcgtgttgggcggcgactgtatggcccgcggcgaaattaagctcagcgatccggtcacgaaatactggccagaactgacaggcaaagagtggcagggtatccgcctgctgcacttagccacctatacggcaggcggcctaccgctgcagatccccgatgacgttagggataaagccgcattactgcatttttatcaaaactggctgccgcaatggactccgggcgctaagcgactttacgctaactccagcattggtctgtttggcgcgctggcggtgaaaccctcaggaatgagttacgaagaggcaatgaccagacgcgtcctgcaaccattaaaactggcgcatacctggattacggttccgcagaacgaacaaaaagattatgccttgggctatcgcgaagggaagcccgtacacgtttctccgggacgacttgacgccgaagcctatggcgtgaaatccagcgttattgatatggcccgctgggttcaggccaacatggatgccagccacgttcaggagaaaacgctccagcagggcattgcgcttgcgcagtctcgctactggcgtattggcgatatgtaccagggattaggctgggagatgctgaactggccgctgaaagctgattcgatcatcaacggcagcgacagcaaagtggcattggcagcgcttcccgccgttgaggtaaacccgcccgcccccgcagtgaaagcctcatgggtgcataaaacgggctcctctggtggatttggcagctacgtagccttcgttccagaaaaaaaccttggcatcgtgatgctggcaaacaaaagctatcctaaccctgtccgtgtcgagggggcctggcgcattcttgaaaagctgcaataa

SEQ ID NO: 48527 - protein, 381 aa, Escherichia coli
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDCMARGEIKLSDPVTKYWPELTGKEWQGIRLLHLATYTAGGLPLQIPDDVRDKAALLHFYQNWLPQWTPGAKRLYANSSIGLFGALAVKPSGMSYEEAMTRRVLQPLKLAHTWITVPQNEQKDYALGYREGKPVHVSPGRLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSSGGFGSYVAFVPEKNLGIVMLANKSYPNPVRVEGAWRILEKLQ

SEQ ID NO: 48528 - DNA, 1140 bp, Salmonella enteritidis
  CDS (1)..(1140)
atgaaaaaatcgttatctgcaacactgatttccgctctgctggcgttttccgccccggggttttctgccgctgataatgtcgcggcggtggtggacagcaccattaaaccgctgatggcacagcaggatattcccgggatggcggttgccgtctccgtaaagggtaagccctattatttcaattatggttttgccgatattcaggcaaaacagccggtcactgaaaatacactatttgagctcggatctgtaagtaaaactttcacaggtgtgctgggtgcggtttctgtggcgaaaaaagagatggcgctgaatgatccggcggcaaaataccagccggagctggctctgccgcagtggaaggggatcacattgctggatctggctacctataccgcaggcggactgccgttacaggtgccggatgcggtaaaaagccgtgcggatctgctgaatttctatcagcagtggcagccgtcccggaaaccgggcgatatgcgtctgtatgcaaacagcagtatcggcctgtttggtgctctgaccgcaaacgcggcggggatgccgtatgagcagttgctgactgcacggatcctggcaccgctggggttatctcacacctttattactgtgccggaaagtgcgcaaagccagtatgcgtacggttataaaaacaaaaaaccggtccgcgtgtcgccgggacagcttgatgcggaatcttacggcgtgaaatccgcctcaaaagatatgctgcgctgggcggaaatgaatatggagccgtcacgggccggtaatgcggatctggaaatggcaatgtatctcgcccagacccgctactataaaaccgccgcgattaaccaggggctgggctgggaaatgtatgactggccgcagcagaaagatatgatcattaacggtgtgaccaacgaggtcgcattgcagccgcatccggtaacagacaaccaggttcagccgtataaccgtgcttcctgggtgcataaaacgggcgcaacaactggtttcggcgcctatgtcgcctttattccggaaaaacaggtggcgattgtgattctggcgaataaaaactacccgaataccgaaagagtcaaagctgcacaggctattttgagtgcactggaataa

SEQ ID NO: 48529 - protein, 379 aa, Salmonella enteritidis
MKKSLSATLISALLAFSAPGFSAADNVAAVVDSTIKPLMAQQDIPGMAVAVSVKGKPYYFNYGFADIQAKQPVTENTLFELGSVSKTFTGVLGAVSVAKKEMALNDPAAKYQPELALPQWKGITLLDLATYTAGGLPLQVPDAVKSRADLLNFYQQWQPSRKPGDMRLYANSSIGLFGALTANAAGMPYEQLLTARILAPLGLSHTFITVPESAQSQYAYGYKNKKPVRVSPGQLDAESYGVKSASKDMLRWAEMNMEPSRAGNADLEMAMYLAQTRYYKTAAINQGLGWEMYDWPQQKDMIINGVTNEVALQPHPVTDNQVQPYNRASWVHKTGATTGFGAYVAFIPEKQVAIVILANKNYPNTERVKAAQAILSALE

SEQ ID NO: 48530 - DNA, 1146 bp, Enterobacter cloacae
  CDS (1)..(1146)
atgatgataaaatccctttgctgcgccctgctgctgggcctctcttgctctgctctcgccgcgccagtatcagaaaaacagctggcggaggtggtcgcgaatacggttaccccgctgatgaaagcccagtctgttccaggcatggcggtggccgttatttatcagggaaaatcgcactattacacgtttggcaaggccgatatcgcggcgaataaacccgttacgcctcagaccctgttcgagctgggttctataagtaaaaccttcaccggcgttttaggtggggatgccattgctcgcggtgaaatttcgctggacgatccggtgaccagatactggccacagctgacgggcaagcagtggcagggtattcgtatgctggatctcgccacctacaccgctggcggcctgccgctacaggtaccggatgaggtcacggataacgcctccctgctgcgcttttatcaaaactggcagccgcagtggaagcctggcacaacgcgtctttacgccaacgccagcatcggtctttttggtgcgctggcggtcaaaccttctggcatgccctatgagcaggccatgacgacgcgggtccttaagccgctcaagctggaccatacctggattaacgttccgaaagcggaagaggcgcattacgcctggggctatcgtgacggtaaagcggtgcgcgtttcgccgggaatgctggatgcacaagcctatggcgtgaaaaccaacgtgcaggatatggcgaactgggtcatggcaaacatggcgccggagaaggttgccgatgcctcacttaagcagggcatcgcgctggcgcagtcgcgctactggcgtatcgggtcaatgtatcagggtctgggctgggagatgctcaactggcccgtggaggccaacacggtggtcgaaggcagcgacagtaaggtagcgctggcgccgttacccgaggcagaagtgaatccaccggctcccccggtcaaagcgtcctgggtccataaaacgggttctaccggcgggtttggcagctacgtggcctttattcctgaaaagcagatcggtattgtgatgctcgcgaataaaagctatccgaacccggcacgcgttgaggcggcataccatatcctcgaggcgctacagtaa

SEQ ID NO: 48531 - protein, 381 aa, Enterobacter cloacae
MMIKSLCCALLLGLSCSALAAPVSEKQLAEVVANTVTPLMKAQSVPGMAVAVIYQGKSHYYTFGKADIAANKPVTPQTLFELGSISKTFTGVLGGDAIARGEISLDDPVTRYWPQLTGKQWQGIRMLDLATYTAGGLPLQVPDEVTDNASLLRFYQNWQPQWKPGTTRLYANASIGLFGALAVKPSGMPYEQAMTTRVLKPLKLDHTWINVPKAEEAHYAWGYRDGKAVRVSPGMLDAQAYGVKTNVQDMANWVMANMAPEKVADASLKQGIALAQSRYWRIGSMYQGLGWEMLNWPVEANTVVEGSDSKVALAPLPEAEVNPPAPPVKASWVHKTGSTGGFGSYVAFIPEKQIGIVMLANKSYPNPARVEAAYHILEALQ

SEQ ID NO: 48532 - DNA, 1146 bp, Enterobacter cloacae
  CDS (1)..(1146)
atgaagacaaaatccctttgctgtgccctgctgctcagcacctcctgctctgttctcgccgcgccgatgtcagagaaacagctgtctgacgtggtggaacgtaccgttacccccctgatgaaagcgcaagccattccgggcatggcggtagcggtgatttatcagggtcagccgcactactttaccttcggaaaggccgatgttgcggcgaacaaacctgtcaccccgcaaaccctgtttgagctgggctctataagtaaaaccttcaccggcgtattaggtggcgatgcgattgcgcgcggagaaatatcgctgggcgaccccgtgacaaagtactggcccgagctaacaggcaagcagtggcagggtattcgcatgttggatctggcgacctacaccgcgggtggcctgccgctacaggtgccggatgaggtcacggataacgcctccctgctgcgtttctatcaacactggcaaccgcagtggaaaccaggcacaacgcgtctttatgcgaacgccagcatcgggctttttggcgccctcgcggttaaaccctccggtatgagctttgaacaggccatgacgaagcgggtcttcaagccactcaaactggaccatacatggattaacgttccgaaagaagaagaggcgcattacgcctggggataccgtgatggtaaagcaatccacgtttcaccgggaatgctggatgccgaagcgtatggtgtcaaaaccaacataacggatatggcgagctggctgaaggccaacatgaaccctgacgcccttccggattcaacgttgaaacagggtattgccctggcacagtctcgctactggcgcgtgggtgccatgtatcagggtctgggctgggagatgctcaactggccggtagaggccaaaaccgtcgtggagggcagcgataacaaggtggctcttgcaccgttaccggtggcagaagtgaaccctccagctccgccagtaaaagcatcatggatacataaaacaggctcgacgggtggattcggcagctatgtcgcatttattcctgaaaaggaactcggcattgttatgctggcgaacaagagctacccgaacccggcgcgcgtggaagcggcataccgtattctgagcgctctgcagtaa

SEQ ID NO: 48533 - protein, 381 aa, Enterobacter cloacae
MKTKSLCCALLLSTSCSVLAAPMSEKQLSDVVERTVTPLMKAQAIPGMAVAVIYQGQPHYFTFGKADVAANKPVTPQTLFELGSISKTFTGVLGGDAIARGEISLGDPVTKYWPELTGKQWQGIRMLDLATYTAGGLPLQVPDEVTDNASLLRFYQHWQPQWKPGTTRLYANASIGLFGALAVKPSGMSFEQAMTKRVFKPLKLDHTWINVPKEEEAHYAWGYRDGKAIHVSPGMLDAEAYGVKTNITDMASWLKANMNPDALPDSTLKQGIALAQSRYWRVGAMYQGLGWEMLNWPVEAKTVVEGSDNKVALAPLPVAEVNPPAPPVKASWIHKTGSTGGFGSYVAFIPEKELGIVMLANKSYPNPARVEAAYRILSALQ

SEQ ID NO: 48534 - DNA, 1146 bp, Citrobacter freundii
  CDS (1)..(1146)
atgatgaaaaaatcgttatgctgtgtgctgctactgacagcatctttctcaacgcttgccgcctcgaaaacagaacaacagattaccgatatcgttaatcgcaccatcacaccactgatgaaagaacaagcgattccgggtatggccgtggcaatcatctaccagggaaaatcgtattattttacctggggtaaagctgatattgccaataatcgccctgttacacagcaaacgctgtttgaactcggatcggtcagtaaaaccttcaatggtgtgctgggtggcgacgctatcgctcgcggtgaaatcaaacttaacgatccagtcacccgatactggcccgaactgacaggcaaacagtggcagggtatcagcttgctgcacctggccacttacacagcaggtggcctgccgcttcaaatacccgacgaagtgactgataaagccgcattgctgcacttctatcaaaactggcagccacaatgggctccgggagctaagcgtctctacgccaactccagtattggcctgtttggcgcactggctgtaaaaccttcgggaatgggttatgaagaggcgatgatcaaccgcatcctacaaccattaaaactaaagcatacctggattactgttcctcagagtgagcaaaaggattacgcatggggctatcgcgaaggcaagcccgtgcatgtttctccgggtcaacttgatgccgaagcgtatggtgtaaaatccagtattatggatatggctcgctgggttcaggtcaatatggacgccagccacgtgcaggagaaaaccctccaacagggcatcgagcttgcgcagtcacgttactggcgtattggtgagatgtaccagggattaggctgggagatgctgaactggccagtgaaagccgacatagttatcaacggcagcgacagcaaaatcgctttggctgcgcttccggccgttgaggtaaacccacccgcacctgtagtaaaagcctcgtgggtacataaaacgggttcgactggcggatttggtagctatgttgccttcatcccggaaaaaaatcttggcatcgtgatgctggcaaacaaaagttatcctaaccctgcccgcgtagatgcggcctggcgcatcctcgaaaaactgcaataa

SEQ ID NO: 48535 - protein, 381 aa, Citrobacter freundii
MMKKSLCCVLLLTASFSTLAASKTEQQITDIVNRTITPLMKEQAIPGMAVAIIYQGKSYYFTWGKADIANNRPVTQQTLFELGSVSKTFNGVLGGDAIARGEIKLNDPVTRYWPELTGKQWQGISLLHLATYTAGGLPLQIPDEVTDKAALLHFYQNWQPQWAPGAKRLYANSSIGLFGALAVKPSGMGYEEAMINRILQPLKLKHTWITVPQSEQKDYAWGYREGKPVHVSPGQLDAEAYGVKSSIMDMARWVQVNMDASHVQEKTLQQGIELAQSRYWRIGEMYQGLGWEMLNWPVKADIVINGSDSKIALAALPAVEVNPPAPVVKASWVHKTGSTGGFGSYVAFIPEKNLGIVMLANKSYPNPARVDAAWRILEKLQ

SEQ ID NO: 48536 - DNA, 1146 bp, Klebsiella pneumoniae
  CDS (1)..(1146)
atgatgatgactaaatccctttgctgcgccctgctgctcagcacctcctgctcggtattggctaccccgatgtcagaaaaacagctggctgaggtggtggaacggaccgttacgccgctgatgaaagcgcaggccattccgggtatggcggtggcggtgatttatgagggtcagccgcactacttcaccttcggtaaagccgatgttgcggcgaacaaacctgtcactccacaaaccttgttcgaactgggttctataagtaaaaccttcaccggcgtactcggtggcgatgccattgctcgcggtgaaatatcgctgggcgatccggtgacaaaatactggcctgagctgacaggcaagcagtggcaggggatccgcatgctggatctggcaacctataccgcaggaggtttgccgttacaggtaccggatgaggtcaaggataacgcctctctgttgcgcttttatcaaaactggcagccgcagtggaagccgggcaccacgcgtctttacgccaatgccagcatcggtctttttggcgcgctggcggtcaaaccttccggcatgagctatgagcaggccataacgacgcgggtctttaagccgctcaagctggaccatacgtggattaacgttccgaaagcggaagaggcgcattacgcctggggataccgcgacggtaaagcagtacacgtttcgccaggaatgctggacgctgaagcctatggcgtaaaaaccaacgtgcaggatatggcaagctgggtgatggtcaacatgaagccggactcccttcaggataattcactcaggaaaggccttaccctggcgcagtctcgctactggcgcgtgggggccatgtatcaggggttaggctgggaaatgcttaactggccggtcgatgccaaaaccgtggttgaaggtagcgacaataaggttgcactggcaccgctgcctgcgagagaagtgaatccaccagcgcccccggtcaacgcatcctgggtccataaaacaggctctaccggcgggtttggcagctacgtggcatttattcctgaaaagcagctcggtattgtgatgctggcaaataaaagctatccgaacccggcacgcgttgaggcggcataccgtattttgagcgcgctgtag

SEQ ID NO: 48537 - protein, 381 aa, Klebsiella pneumoniae
MMMTKSLCCALLLSTSCSVLATPMSEKQLAEVVERTVTPLMKAQAIPGMAVAVIYEGQPHYFTFGKADVAANKPVTPQTLFELGSISKTFTGVLGGDAIARGEISLGDPVTKYWPELTGKQWQGIRMLDLATYTAGGLPLQVPDEVKDNASLLRFYQNWQPQWKPGTTRLYANASIGLFGALAVKPSGMSYEQAITTRVFKPLKLDHTWINVPKAEEAHYAWGYRDGKAVHVSPGMLDAEAYGVKTNVQDMASWVMVNMKPDSLQDNSLRKGLTLAQSRYWRVGAMYQGLGWEMLNWPVDAKTVVEGSDNKVALAPLPAREVNPPAPPVNASWVHKTGSTGGFGSYVAFIPEKQLGIVMLANKSYPNPARVEAAYRILSAL

SEQ ID NO: 48538 - DNA, 1146 bp, Klebsiella pneumoniae
  CDS (1)..(1146)
atgatgaaaaaatcgttatgctgcgctctgctgctgacagcctctttctccacatttgctgccgcaaaaacagaacaacagattgccgatatcgttaatcgcaccatcaccccgttgatgcaggagcaggctattccgggtatggccgttgccgttatctaccagggaaaaccctattatttcacctggggtaaagccgatatcgccaataaccacccagtcacgcagcaaacgctgtttgagctaggatcggttagtaagacgtttaacggcgtgttgggcggcgactgtatcgcccgcggcgaaattaagctcagcgatccggtcacgaaatactggccagaactgacaggcaaacagtggcagggtatccgcctgctgcacttagccacctatacggcaggcggcctaccgctgcagatccccgatgacgttagggataaagccgcattactgcatttttatcaaaactggcagccgcaatggactccgggcgctaagcgactttacgctaactccagcattggtctgtttggcgcgctggcggtgaaaccttcaggaatgagttacgaagaggcaatgaccagacgcgtcctgcaaccattaaaactggcgcatacctggattacggttccagagaacgaacaaaaagattatgcctggggctatcgcgaagggaagcccgtacacgtttctccgggacaacttgacgccgaagcctatggcgtgaaatccagcgttattgatatggcccgctgggttcaggccaacatggatgccagccacgttcaggagaaaacgctccagcagggcattgcgcttgcacagtctcgctactggcgtattggcgatatgtaccagggattaggctgggagatgctgaactggccgctgaaagctgattcgatcatcaacggcagcgacagcaaagtggcattggcagcgcttcccgccgttgaggtaaacccgcccgcccccgcagtgaaagcctcatgggtgcataaaacgggctccactggtggatttggcagctacgtagccttcgttccagaaaaaaaccttggcatcgtgatgctggcaaacaaaagctatcctaaccctgtccgtgtcgaggcggcctggcgcattcttgaaaagctgcaataa

SEQ ID NO: 48539 - protein, 381 aa, Klebsiella pneumoniae
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDCIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPENEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 48540 - DNA, 1146 bp, Klebsiella pneumoniae
  CDS (1)..(1146)
atgatgaaaaaatcgttatgctccgctctgctgctgacagcctctttctccacatttgctgccgcaaaaacagaacaacagattgccgatatcgttaaccgcaccatcaccccgttgatgcaggagcaggctattccgggtatggccgttgccgttatctaccaggggaaaccctattatttcacctggggtaaagccgatatcgccaataaccacccagtcacgcagcaaacgctgtttgagctaggatcggttagtaagacgtttaacggcgtgttgggcggcgactgtatcgcccgcggcgaaattaagctcagcgatccggtcacgaaatactggccagaactgacaggcaaaaagtggcagggtatccgcctgctgcacttagccacctatacggcaggcggcctaccgctgcagatccccgatgacgttagggataaagccgcattactgcatttttatcaaaactggcagccgcaatggactccgggcgctaagcgactttacgctaactccagcattggtctgtttggcgcgctggcggtgaaaccttcaggaatgagttacgaagaggcaatgaccagacgcgtcctgcaaccattaaaactggcgcatacctggattacggttccgcagaacgaacaaaaagattatgcctggggctatcgcgaagggaagcccgtacacgtttctccgggacgacttgacgccgaagcctatggcgtgaaatccagcgttattgatatggcccgctgggttcaggccaacatggatgccagccacgttcaggagaaaacgctccagcagggcattgcgcttgcgcagtctcgctactggcgtattggcgatatgtaccagggattaggctgggagatgctgaactggccgctgaaagctgattcgatcatcaacggcagcgacagcaaagtggcattggcagcgcttcccgccgttgaggtaaacccgcccgcccccgcagtgaaagcctcatgggtgcataaaacgggctccactggtggatttggcagctacgtagccttcgttccagaaaaaaaccttggcatcgtgatgctggcaaacaaaagctatcctaaccctgtccgtgtcgaggcggcctggcgcattcttgaaaagctgcaataa

SEQ ID NO: 48541 - protein, 381 aa, Klebsiella pneumoniae
MMKKSLCSALLLTASFSTFAAAKTEQQIADIVNRTITPLMQEQAIPGMAVAVIYQGKPYYFTWGKADIANNHPVTQQTLFELGSVSKTFNGVLGGDCIARGEIKLSDPVTKYWPELTGKKWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGRLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 48542 - DNA, 1146 bp, Escherichia coli
  CDS (1)..(1146)
atgatgaaaaaatcgttatgctgcgctctgctgctgacagcctctttctccacatttgctgccgcaaaaacagaacaacagattgccgatatcgttaatcgcaccatcaccccgttgatgcaggagcaggctattccgggtatggccgttgccgttatctaccagggaaaaccctattatttcacctggggtaaagccgatatcgccaataaccacccagtcacgcagcaaacgctgtttgagctaggatcggttagtaagacgtttaacggcgtgttgggccgcgatgctatcgcgcgcggcgaaattaagctcagcgatccggtcacgaaatactggccagaactgacaggcaaacagtggcagggtatccgcctgctgcacttagccacctatacggcaggcggcctaccgctgcagatccccgatgacgttagggataaagccgcattactgcatttttatcaaaactggcagccgcaatggactccgggcgctaagcgactttacgctaactccagcattggtctgtttggcgcgctggcggtgaaaccctcaggaatgagttacgaagaggcaatgaccagacgcgtcctgcaaccattaaaactggcgcatacctggattacggttccgcagaacgaacaaaaagattatgcctgggcgtatcgcgaagggaagcccgtacacgtttctccgggacaacttgacgccgaagcctatggcgtgaaatccagcgttattgatatggcccgctgggttcaggccaacatggatgccagccacgttcaggagaaaacgctccagcagggcattgcgcttgcgcagtctcgctactggcgtattggcgatatgtaccagggattaggctgggagatgctgaactggccgctgaaagctgattcgatcatcaacggcagcgacacgaaagtggcattggcagccgttcccgccgttgaggtaaacccgcccgcccccgcagtgaaagcctcatgggtgcataaaacgggctccactggtggatttggcagctacgtagccttcgttccagaaaaaaaccttggcatcgtgatcgtggcaaacaaaagctatcctaaccctgtccgtgtcgaggcggcctggcgcattcttgaaaagctgcaataa

SEQ ID NO: 48543 - protein, 381 aa, Escherichia coli
MMKKSLCCALLLTASFSTFAAAKTEQQIADIVNRTITPLMQEQAIPGMAVAVIYQGKPYYFTWGKADIANNHPVTQQTLFELGSVSKTFNGVLGRDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWAYREGKPVHVSPGQLDAEAYGVKSSVIDMARWVQANMDASHVQEKTLQQGIALAQSRYWRIGDMYQGLGWEMLNWPLKADSIINGSDTKVALAAVPAVEVNPPAPAVKASWVHKTGSTGGFGSYVAFVPEKNLGIVIVANKSYPNPVRVEAAWRILEKLQ

SEQ ID NO: 48544 - DNA, 1134 bp, Escherichia coli
  CDS (1)..(1134)
atgttcaaaacgacgctctgcgccttattaattaccgcctcttgctccacatttgctgcccctcaacaaatcaacgatattgtgcatcgcacaattaccccgcttatagagcaacaaaagatccccggtatggcggtggcggtaatttatcagggtaaaccttattactttacctggggctatgcggacatcgccaaaaagcagcccgtcacacagcaaacgttgtttgagttaggttcggtcagcaaaacatttacgggcgtgcttggtggcgacgctattgctcgaggggaaatcaagttaagcgatcccacaacaaaatactggcctgaacttaccgctaaacagtggaatgggatcacactattacatctcgcaacctacactgctggcggcctgccattgcaggtgccggatgaggtgaaatcctcaagcgacttgctgcgcttctatcaaaactggcagcctacatgggcgccaggaacacaacgtctgtatgccaactccagtatcggtttgttcggcgcactggctgtgaagccgtctggtttgagttttgagcaggcgatgcaaacacgtgtcttccagccactcaaactcaaccatacgtggattaatgtacctcccccagaagaaaagaattacgcctggggatatcgcgaaggtaaggcagtgcatgtttcgccaggggcgttagatgctgaagcttatggtgtgaagtcgaccattgaagatatggcccgctgggtacgaagcaatatgaatccccgtgatatcaacgacaaaacacttcagcaagggatacaactggcacaatctcgctactggcaaaccggcgatatgtatcagggcctgggctgggaaatgctggactggccggtaaatcctgacagcatcattaacggcagtggcaataaaattgcactggcagcacaccctgtaaaagcgattacgcccccaactcctgcagtacgcgcatcatgggtacataaaacaggggcaaccggcggatttggtagctatgtcgcgtttattccagaaaaagagctgggtatagtgatgctggctaacaaaaactatcccaatccagcgagattcgccgccgcctggcagattctcaacgctctacagtaa

SEQ ID NO: 48545 - protein, 377 aa, Escherichia coli
MFKTTLCALLITASCSTFAAPQQINDIVHRTITPLIEQQKIPGMAVAVIYQGKPYYFTWGYADIAKKQPVTQQTLFELGSVSKTFTGVLGGDAIARGEIKLSDPTTKYWPELTAKQWNGITLLHLATYTAGGLPLQVPDEVKSSSDLLRFYQNWQPTWAPGTQRLYANSSIGLFGALAVKPSGLSFEQAMQTRVFQPLKLNHTWINVPPPEEKNYAWGYREGKAVHVSPGALDAEAYGVKSTIEDMARWVRSNMNPRDINDKTLQQGIQLAQSRYWQTGDMYQGLGWEMLDWPVNPDSIINGSGNKIALAAHPVKAITPPTPAVRASWVHKTGATGGFGSYVAFIPEKELGIVMLANKNYPNPARFAAAWQILNALQ

SEQ ID NO: 48546 - DNA, 1137 bp, Serratia marcescens
  CDS (1)..(1137)
atgacgaaaatgaaccgcctggcggccgcgctgatcgccgcactgatcttgccgaccgcgcaggccgcgcagcagcaggatatcgacgccgttattcagccgctgatgaaaaaatatggcgtaccgggcatggcgatcgccgtgtcggtcgacggcaaacagcagatttacccgtatggcgtcgcctcgaagcagaccggcaaaccgatcaccgaggagacgctgttcgaagtgggctcgctgagcaaaacctttaccgcgacgctggcggtctatgcgcagcagcagggcaagctgtcgttcaacgatccggccagccgctatctgcccgagctgcgcggcagcgccttcgacggcgtcagcctgctgaatctggcgacgcatacctccggcctgccgctgttcgtgccggacgacgtcactaacgacgcccagctgatggcctactaccgggcctggcagccgaaacacccggcgggcagctaccgtgtctattccaacctcggcatcggcatgctgggcatgatcgccgccaagagcctcgaccagccgtttatccaggcgatggaacaggggatgctgccggcgctgggcatgagccacacctacgttcaggtgccggcggcgcagatggctaactatgcgcagggttacagcaaggacgataagccggtgcgggtcaaccccggcccgctggatgccgagtcttacggcatcaagtccaacgctcgcgatctgattcgctatctggacgccaacctgcagcaggtgaaggtggcgcagccgtggcgcgacgcgctggccgcgacgcacgtcgggtattacaaggcgggcgcgttcacgcaggatctgatgtgggagaactacccgtatccggtgaaactgtcgcgtttgattgaaggcaacaacgccgggatgatcatgaaaggcacgccggccaccgccatcacgccgccgcagccggaattgcgcgccggctggtataacaaaaccggctccaccggcggcttctccacctacgcggtatttatcccggcgaaaaatatcgccgtggtgatgctggccaacaagtggttcccgaacgacgatcgcgtcgaggcggcttaccacatcgtccaggcgctggagaagcgctga

SEQ ID NO: 48547 - protein, 378 aa, Serratia marcescens
MTKMNRLAAALIAALILPTAQAAQQQDIDAVIQPLMKKYGVPGMAIAVSVDGKQQIYPYGVASKQTGKPITEETLFEVGSLSKTFTATLAVYAQQQGKLSFNDPASRYLPELRGSAFDGVSLLNLATHTSGLPLFVPDDVTNDAQLMAYYRAWQPKHPAGSYRVYSNLGIGMLGMIAAKSLDQPFIQAMEQGMLPALGMSHTYVQVPAAQMANYAQGYSKDDKPVRVNPGPLDAESYGIKSNARDLIRYLDANLQQVKVAQPWRDALAATHVGYYKAGAFTQDLMWENYPYPVKLSRLIEGNNAGMIMKGTPATAITPPQPELRAGWYNKTGSTGGFSTYAVFIPAKNIAVVMLANKWFPNDDRVEAAYHIVQALEKR

SEQ ID NO: 48548 - DNA, 1146 bp, Enterobacter cloacae
  CDS (1)..(1146)
atgatgaaaaaatccctttgctgcgccctgctgctgggcctctcttgctctgctctcgccgcgccagtatcagaaaaacagctggcggaggtggtcgcgaatacggttaccccgctgatgaaagcccagtctgttccaggcatggcggtggccgttatttatcagggaaaatcgcactattacacgtttggcaaggccgatatcgcggcgaataaacccgttacgcctcagaccctgttcgagctgggttctataagtaaaaccttcaccggcgttttaggtggggatgccattgctcgcggtgaaatttcgctggacgatccggtgaccagatactggccacagctgacaggcaagcagtggcagggtattcgtatgctggatctcgccacctacaccgctggcggcctgccgctacaggtaccggatgaggtcacggataacgcctccctgctgcgcttttatcaaaactggcagccgcagtggaagcctggcacaacgcgtctttacgccaacgccagcatcggtctttttggcgcgctggcggtcaaaccttctggcatgccctatgagcaggccatgacgacgcgggtccttaagccgctcaagctggaccatacctggattaacgttccgaaagcggaagaggcgcattacgcctggggctatcgtgacggtaaagcggtgcgcgtttcgccgggaatgctggatgcacaagcctatggcgtgaaaaccaacgtgcaggatatggcgaactgggtcatggcaaacatggcgccggagaaggttgccgatgcctcacttaagcagggcatcgcgctggcgcagtcgcgctactggcgtatcgggtcaatgtatcagggtctgggctgggagatgctcaactggcccgtggaggccaacacggtggtcgaaggcagcgacagtaaggtagcgctggcgccattacccgtggcagaagtgaatccaccggctcccccggtcaaagcgtcctgggtccataaaacgggttctaccggcgggtttggcagctacgtggcctttattcctgaaaagcagatcggtattgtgatgctcgcgaataaaagctatccgaacccggcacgcgttgaggcggcataccatatcctcgaggcgctacagtaa

SEQ ID NO: 48549 - protein, 381 aa, Enterobacter cloacae
MMKKSLCCALLLGLSCSALAAPVSEKQLAEVVANTVTPLMKAQSVPGMAVAVIYQGKSHYYTFGKADIAANKPVTPQTLFELGSISKTFTGVLGGDAIARGEISLDDPVTRYWPQLTGKQWQGIRMLDLATYTAGGLPLQVPDEVTDNASLLRFYQNWQPQWKPGTTRLYANASIGLFGALAVKPSGMPYEQAMTTRVLKPLKLDHTWINVPKAEEAHYAWGYRDGKAVRVSPGMLDAQAYGVKTNVQDMANWVMANMAPEKVADASLKQGIALAQSRYWRIGSMYQGLGWEMLNWPVEANTVVEGSDSKVALAPLPVAEVNPPAPPVKASWVHKTGSTGGFGSYVAFIPEKQIGIVMLANKSYPNPARVEAAYHILEALQ

SEQ ID NO: 48550 - DNA, 1140 bp, Morganella morganii subsp
  CDS (1)..(1140)
atgaaaaaatcgttatctgcaacactgatttctgccctgctggcgttttccgccccggggttttctgccgctgataatgtcgcggcggtggtggacagcaccattaaaccgctgatggcacagcaggacattcccgggatggcggttgccgtctctgtaaagggaaaaccttattacttcaactatggttttgcggatgtgcaggcaaaacagccggtcactgaaaatacactatttgagctcggatctgtaagtaaaactttcacaggtgtgctgggtgcggtttccgtggcgaaaaaagagatgacgctgaatgacccggcggaaaaataccagccggagctggctctgccgcagtggaaggggatcacactgctggatctggccacttataccgcaggcgggctgccgttacaggtgccggatgcggtgaaaagccgtgcggatctgctgcacttctatcagcagtggcagccgtcatggaaaccgggcgatatgcgtctgtatgcaaacagcagtatcggcctgtttggtgctctgaccgccaacgcggcggggatgccgtatgagcagttgctgaccgcgcggatcctggcaccgctgggattatctcacacctttattaccgtgccggaaagcgcgcaaagtcagtatgcgtacggttataaaaacaaaaaaccggtccgcgtgtcaccgggacagcttgatgcggaatcttacggcgtgaaatccgcctcaaaagatatgctgcgctgggcggaaatgaatatggagccgtcacggaccggtaatgccgatctggaaatggcaatgtatctcgcccagacccgttactataaaaccgccgcgattaatcaggggctgggctgggaaatgtatgactggccgcagcagaaagatatgatcattaacggcgtgaccaacgaggtcgcattgcagccgcacccggtaacagacaaccaggttcagccgtataaccgtgcttcctgggtgcataaaacgggggcaacaactggtttcggcgcctatgtcgcctttattccggaaaaacaggtggcgattgtgattctggcgaataaaaactacccgaataccgaaagagtcaaagccgcacaggctattttgagtgcactggaataa

SEQ ID NO: 48551 - protein, 379 aa, Morganella morganii subsp
MKKSLSATLISALLAFSAPGFSAADNVAAVVDSTIKPLMAQQDIPGMAVAVSVKGKPYYFNYGFADVQAKQPVTENTLFELGSVSKTFTGVLGAVSVAKKEMTLNDPAEKYQPELALPQWKGITLLDLATYTAGGLPLQVPDAVKSRADLLHFYQQWQPSWKPGDMRLYANSSIGLFGALTANAAGMPYEQLLTARILAPLGLSHTFITVPESAQSQYAYGYKNKKPVRVSPGQLDAESYGVKSASKDMLRWAEMNMEPSRTGNADLEMAMYLAQTRYYKTAAINQGLGWEMYDWPQQKDMIINGVTNEVALQPHPVTDNQVQPYNRASWVHKTGATTGFGAYVAFIPEKQVAIVILANKNYPNTERVKAAQAILSALE

SEQ ID NO: 48552 - DNA, 1146 bp, Escherichia coli
  CDS (1)..(1146)
atgatgaaaaaatcgttatgctgcgctctgctgctgacagcctctttctccacgtttgcctccgccaaaacagaacaacagattgccgatatcgttaatcgcaccatcaccccgttgatgcaggagcaggctattccgggtatggccgttgccattatctaccagggaaaaccctattatttcacctggggtaaagccgatatcgccaataaccacccagtcacgcagcaaacgctgtttgagctagggtcggtcagtaagacgtttaacggcgtgttgggcggcgatgctatcgcccgcggcgaaattaagctcagcgatccggtcacgaaatactggccagaactgacaggcaaacagtggcagggtatcagcctgctgcacttagccacctatacggcaggcggcctaccgctgcagatccccgatgacgttactgataaagccgcattactgcgtttttatcaaaactggcagccgcaatgggccccgggcgctaagcgtctttacgctaactccagcattggtctgtttggcgcgctggcggtgaaaccctcaggaatgagttacgaagaggcaatgaccagacgcgtcctgcaaccattaaaactggcgcatacctggattacagttccgcagaacgaacaaaaagattatgcctggggctatcgcgaagggaaacctgtacacgtttctccgggacaacttgacgccgaagcctatggcgtgaaatccaacgttaccgatatggcacgctgggttcaggtcaacatggacgccagccgcgttcaggagaaaacgctccagcagggcattgcgcttgcgcagtctcgctactggcgtattggcgatatgtaccagggattaggctgggagatgctgaactggccgctgaaagctgattcgatcatcaacggtagcgacagcaaagtggcattggcagcgcttcccgccgttgaggtaaacccgcccgccccggcagtgaaagcctcatgggtgcataaaacgggatccactggaggatttggcagctacgtagccttcgttccagaaaaaaaccttggcatcgtgatgctggcaaacaaaagctatcctaaccctgtccgtgtcgaggcggcctggcgcattcttgaaaagctgcaataa

SEQ ID NO: 48553 - protein, 381 aa, Escherichia coli
MMKKSLCCALLLTASFSTFASAKTEQQIADIVNRTITPLMQEQAIPGMAVAIIYQGKPYYFTWGKADIANNHPVTQQTLFELGSVSKTFNGVLGGDAIARGEIKLSDPVTKYWPELTGKQWQGISLLHLATYTAGGLPLQIPDDVTDKAALLRFYQNWQPQWAPGAKRLYANSSIGLFGALAVKPSGMSYEEAMTRRVLQPLKLAHTWITVPQNEQKDYAWGYREGKPVHVSPGQLDAEAYGVKSNVTDMARWVQVNMDASRVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 48554 - DNA, 1146 bp, Enterobacter cloacae
  CDS (1)..(1146)
atgatgacaaaatccctaagctgtgccctgctgctcagcgtcgccagcgctgcattcgccgcaccgatgtccgaaacacagctggctgaggtggtggaacgtaccgttacgccgctgatgaacgcgcaggccattccgggtatggcggtggcggtaatttatcagggtcagccacactactttaccttcggtaaagccgatgttgcggcgaacaaacccgtcaccccgcaaaccctgtttgagctgggctctataagtaaaaccttcaccggcgtactgggcggcgatgccattgcccggggtgaaatagcgctgggcgatccggtagcaaaatactggcctgagctcacgggcaagcagtggcagggcattcgcatgctggatctggcaacctataccgcaggcggtctgccgttacaggtgccggatgaggtcacggataccgcctctctgctgcgcttttatcaaaactggcagccgcagtggaagccgggcaccacgcgtctttacgctaacgccagcatcggtctttttggtgcgctggcggttaaaccttccggcatgagctatgagcaggccatgacgacgcgggtctttaaacccctcaagctggaccatacctggattaacgtcccgaaagcggaagaggcgcattacgcctggggataccgtgagggtaaagcggtccacgtttcgccagggatgctggacgcggaagcctatggcgtaaaaactaacgtgaaggatatggcgagctgggtgatagccaacatgaagccggattctcttcaggctccctcactcaagcaaggcattgctctggcgcagtctcgctactggcgcgtgggggctatgtatcaggggttaggctgggagatgctcaactggccggtcgatgccaaaaccgtcgtcggaggcagtgataacaaggtggcgctggcaccattgcccgtggcagaagtgaatccacccgcgccgccggtcaaggcctcctgggtccataaaacaggctcgacgggcgggtttggcagctacgtggcatttattcctgaaaagcagctcggcattgtgatgctggcgaataaaagctatccgaacccggcacgcgttgaggcggcataccatatcctcgacgcgctacagtaa

SEQ ID NO: 48555 - protein, 381 aa, Enterobacter cloacae
MMTKSLSCALLLSVASAAFAAPMSETQLAEVVERTVTPLMNAQAIPGMAVAVIYQGQPHYFTFGKADVAANKPVTPQTLFELGSISKTFTGVLGGDAIARGEIALGDPVAKYWPELTGKQWQGIRMLDLATYTAGGLPLQVPDEVTDTASLLRFYQNWQPQWKPGTTRLYANASIGLFGALAVKPSGMSYEQAMTTRVFKPLKLDHTWINVPKAEEAHYAWGYREGKAVHVSPGMLDAEAYGVKTNVKDMASWVIANMKPDSLQAPSLKQGIALAQSRYWRVGAMYQGLGWEMLNWPVDAKTVVGGSDNKVALAPLPVAEVNPPAPPVKASWVHKTGSTGGFGSYVAFIPEKQLGIVMLANKSYPNPARVEAAYHILDALQ

SEQ ID NO: 48556 - DNA, 1146 bp, Enterobacter aerogenes
  CDS (1)..(1146)
atgatgaaaaaatcccttacaggcgtactgctgctgggcgcctcattttcgacgtttgccgcgccgcaaacggcagagcagctgcgcgaactggtcaatcagaccatcaccccgttaatgaaagaacaggcgataccgggcatggcggtggcggtgatctatcacggcaaaccctactatttcacctggggccaggccgatgttgccgggcagcgtccggtgacgcgacagacgttgtttgagctgggctctgttagtaagactttcaccggcgtgctgggcggcgatgcggtggcgcgcggcgaaattaagctcagcgatccggcgcagaagtactggccgcagctcaccggccagcagtggcaggagatctcgctgctgcatctcgccacctataccgcaggcggtctgccgctgcaggttccggacgaggtgacggatgaagcggcattactgcgttactatcagaactggcaaccgcagtgggcgccgggtagtaaacggctgtacgccaatgccagcattggcctgttcggcgcgctggcggtgaaaccttccggcatgggctttgaacaggcgatgagccagcgggttttgcagccgttaaaactgagccacacctggattaacgtaccgcccgcccagagcaaggactatgcctggggttatcgtgacggtaaagcggtacatgtttcgccggggcagctggacgctgaggcttacggcgtgaagtcgagcattgaagatatggcgcactgggtgctggcgaatatgaaccgcgagacggtgcaggataaaaacctgcggcaggggatccagctggcgcagtcgcgctactggcgggctggggagatgtatcaggggctcggctgggagatgctgaactggccggtgtcgcccgaggtgctgattaacggcagcgataataaggttgcgcctgccgcgacgccggtaacggcggtcaagccgcccgcgccgccggtgaaagcctcctgggtacataaaaccggttccaccggcggattcggcagttacgtggcttttattccgcaacaggatctcggcatcgtgatgctggcgaataaaagctaccccaacacggagcgggtgaaggcggcgtatcatattcttcaggcgctgcagtaa

SEQ ID NO: 48557 - protein, 381 aa, Enterobacter aerogenes
MMKKSLTGVLLLGASFSTFAAPQTAEQLRELVNQTITPLMKEQAIPGMAVAVIYHGKPYYFTWGQADVAGQRPVTRQTLFELGSVSKTFTGVLGGDAVARGEIKLSDPAQKYWPQLTGQQWQEISLLHLATYTAGGLPLQVPDEVTDEAALLRYYQNWQPQWAPGSKRLYANASIGLFGALAVKPSGMGFEQAMSQRVLQPLKLSHTWINVPPAQSKDYAWGYRDGKAVHVSPGQLDAEAYGVKSSIEDMAHWVLANMNRETVQDKNLRQGIQLAQSRYWRAGEMYQGLGWEMLNWPVSPEVLINGSDNKVAPAATPVTAVKPPAPPVKASWVHKTGSTGGFGSYVAFIPQQDLGIVMLANKSYPNTERVKAAYHILQALQ

SEQ ID NO: 48558 - DNA, 1146 bp, Enterobacter aerogenes
  CDS (1)..(1146)
atgatgaaaaaatcccttacaggcgtactgctgctgggcgcctcattttcgacgtttgccgcgccgcaaacggcagagcagctgcgcgaactggtcaatcagaccatcaccccgttaatgaaagaacaggcgataccgggcatggcggtggcggtgatctatcacggcaaaccctactatttcacctggggccaggccgatgttgccgggcagcgtccggtgacgcgacagacgttgtttgagctgggctctgttagtaagactttcaccggcgtgctgggcggcgatgcggtggcgcgcggcgaaattaagctcagcgatccggcgcagaagtactggccgcagctcaccggccagcagtggcaggagatctcgctgctgcatctcgccacctataccgcaggcggtctgccgctgcaggttccggacgaggtgacggatgaagcggcattactgcgttactatcagaactggcaaccgcagtgggcgccgggtagtaaacggctgtacgccaatgccagtattggcctgttcggcgagctggcggtgaaaccttccggcatgagttttgaacaggcgatgagccagcgggtattgcagccgttaaaactgagccacacctggattaacgtaccgcccgcccagagcaaggactatgcctggggttatcgtgacggtaaagcggtacatgtttcgccgggacagctggacgctgaggcttacggcgtgaagtcgagcattgaggatatggcgcactgggtgctggcgaatatgaaccgcgagacggtgcaggataaaaacctgcggcaggggatccagctggcgcagtcgcgctactggcgggttggagagatgtatcaggggctcggctgggagatgctgaactggccggtgtcggccgaggtgctgattaacggcagcgataataaggtggcgctcgccgcgacgccggtaacggcggtcaatccgcccgcgccgccggtgaaggcctcctgggtacataagaccggctccaccggcggattcggcagctacgtggcctttatcccgcaacaggatctcggcatcgtgatgttggcgaacaaaagctaccccaacccggagcgggtgaaggctgcgtatcatattcttgaggcgctgcagtaa

SEQ ID NO: 48559 - protein, 381 aa, Enterobacter aerogenes
MMKKSLTGVLLLGASFSTFAAPQTAEQLRELVNQTITPLMKEQAIPGMAVAVIYHGKPYYFTWGQADVAGQRPVTRQTLFELGSVSKTFTGVLGGDAVARGEIKLSDPAQKYWPQLTGQQWQEISLLHLATYTAGGLPLQVPDEVTDEAALLRYYQNWQPQWAPGSKRLYANASIGLFGELAVKPSGMSFEQAMSQRVLQPLKLSHTWINVPPAQSKDYAWGYRDGKAVHVSPGQLDAEAYGVKSSIEDMAHWVLANMNRETVQDKNLRQGIQLAQSRYWRVGEMYQGLGWEMLNWPVSAEVLINGSDNKVALAATPVTAVNPPAPPVKASWVHKTGSTGGFGSYVAFIPQQDLGIVMLANKSYPNPERVKAAYHILEALQ

SEQ ID NO: 48560 - DNA, 1146 bp, Enterobacter aerogenes
  CDS (1)..(1146)
atgatgaaaaaatcccttacaggcgtactgctgctgggcgcctcattttcgacttttgccgcgccgcaaacggcggagcagctgcgcgaactggtcaatcagaccatcacgccgttaatgaaagaacaggcgataccgggcatggcggtggcggtgatctatcacggcaaaccctactatttcacttggggccaggccgatgttgccgggcagcgtccggtaacgcgacagacgttgtttgagcttggctctgttagtaagactttcaccggcgtgctgggcggcgatgcggtggcgcgcggtgaaattaagctcagcgatccggcgcagaagtactggccgcagctcaccggcaagcagtggcagggtatctctctgctgcatctcgccacctataccgcaggcggtctgccgctgcaggttccggacgaggtgacggatgaagcagcattactgcgttactatcagaactggcaaccgcagtgggcgccgggtagtaaacgcctgtacgccaatgccagcattggcctgttcggcgcgctggcggtgaaaccttccggcatgagctttgaacaggcgatgagccagcgggtattgcagccgttaaaactgagccacacctggattaacataccgcccgcccagagcaaggactatgcctggggttatcgtgacggtaaagcggtacatgtttcgccgggacagctggacgcagaggcttacggcgtgaagtcgagcattgaggatatggcgcactgggtgctggcgaatatgaacagcgaggcggtgcagaataaaaatctgcggcaggggattcaactggcgcagtcgcgctactggcgtgccggaggaatgtatcaggggctcggctgggagatgctgaactggccggtgtcggccgaggtagtaattaacggcagcgataataaggtagcgcttgcagcgacgccggtaacggcggtcaagccgcccgcgccgccggtgaaggcctcctgggtgcataagaccggctccaccggcggattcggcagctacgtggcctttatcccgcaacaggatctcggcatcgtgatgttggcgaacaaaagctaccccaacccggagcgggtgaaggcggcgtatcatattcttgaggcgctgcagtaa

SEQ ID NO: 48561 - protein, 381 aa, Enterobacter aerogenes
MMKKSLTGVLLLGASFSTFAAPQTAEQLRELVNQTITPLMKEQAIPGMAVAVIYHGKPYYFTWGQADVAGQRPVTRQTLFELGSVSKTFTGVLGGDAVARGEIKLSDPAQKYWPQLTGKQWQGISLLHLATYTAGGLPLQVPDEVTDEAALLRYYQNWQPQWAPGSKRLYANASIGLFGALAVKPSGMSFEQAMSQRVLQPLKLSHTWINIPPAQSKDYAWGYRDGKAVHVSPGQLDAEAYGVKSSIEDMAHWVLANMNSEAVQNKNLRQGIQLAQSRYWRAGGMYQGLGWEMLNWPVSAEVVINGSDNKVALAATPVTAVKPPAPPVKASWVHKTGSTGGFGSYVAFIPQQDLGIVMLANKSYPNPERVKAAYHILEALQ

SEQ ID NO: 48562 - DNA, 1146 bp, Enterobacter aerogenes
  CDS (1)..(1146)
atgatgaaaaaatcccttacaggcgtactgctgctgggcgcctcattttcgacttttgccgcgccgcaaacggcggagcagcttcgcgaactggtcaatcagaccatcacgccgttaatgaaagaacaggcgataccgggcatggcggtggcggtgatctatcacggcaaaccctattatttcacctggggccaggccgatgttgccgggcagcgtccggtgacgcgacagacgttgtttgagctgggctctgttagtaagactttcaccggcgtgctgggcggcgatgcggtggcgcgcggtgaaattaagctcagcgatccggcgcagaagtactggccgcagctcaccggccagcagtggcaggggatctcgctgctgcatctcgccacctataccgcaggcggtctgccgctgaaggttccggacgaggtgacggatgaagcggcattactgcgttactatcagaactggcaaccgcagtgggcgccgggtagtaaacggctgtacgccaatgccagcattggcctgttcggcgcgctggcggtgaaaccttccggcatgagctttgaacaggcgatgagccagcgggttttgcagccgttaaaactgagccacacctggattaacgtaccgcccgcccagagcaaggactacgcctggggttatcgtgacggtaaagcggtacatgtttcgccggggcagctggacgctgaggcttacggcgtgaagtcgagcattgaggatatggcgcactgggtgctggcgaatatgaacagcgaagcggtgcaggataaaaatctgcggcaggggatccagctggcgcagtcgcgctattggcgggctggggagatgtatcaggggctcggctgggagatgctgaactggccggtgccggccgaggtagtaattaacggcagcgataataaggtagcgcttgccgcgacgccggtaacggcggtcaatccgcccgcgccgtcggtgaaagcctcctgggtacataaaaccggctccaccggcggattcggcagctacgtggcttttatcccgcaacaggatctcggtatcgtgatgctggcgaataaaagctaccccaacccggagcgggtgaaggctgcgtatcatattcttgaggcgctgcagtaa

SEQ ID NO: 48563 - protein, 381 aa, Enterobacter aerogenes
MMKKSLTGVLLLGASFSTFAAPQTAEQLRELVNQTITPLMKEQAIPGMAVAVIYHGKPYYFTWGQADVAGQRPVTRQTLFELGSVSKTFTGVLGGDAVARGEIKLSDPAQKYWPQLTGQQWQGISLLHLATYTAGGLPLKVPDEVTDEAALLRYYQNWQPQWAPGSKRLYANASIGLFGALAVKPSGMSFEQAMSQRVLQPLKLSHTWINVPPAQSKDYAWGYRDGKAVHVSPGQLDAEAYGVKSSIEDMAHWVLANMNSEAVQDKNLRQGIQLAQSRYWRAGEMYQGLGWEMLNWPVPAEVVINGSDNKVALAATPVTAVNPPAPSVKASWVHKTGSTGGFGSYVAFIPQQDLGIVMLANKSYPNPERVKAAYHILEALQ

SEQ ID NO: 48564 - DNA, 1146 bp, Citrobacter freundii
  CDS (1)..(1146)
atgatgaaaaaatcgatatgctgcgcactgctgctgacagcctctttctccacgtttgctgccgcaaaaacagaacaacaaattgccgatatcgttaaccgcaccatcacaccactgatgcaggagcaggctattccgggtatggccgtggcgattatctacgaggggaaaccttattactttacctggggtaaagccgatatcgccaataaccacccagtcacgcagcaaacgctgtttgagctagggtcggtcagtaagacgtttaacggcgtgttgggcggcgacgctatcgcccgcggcgaaattaagctcagcgatccggtcacgaaatactggccagaactgacaggcaaacagtggcggggtatcagcctgctgcacttagccacctatacagcgggtggcctgccgctgcagatccccgatgacgttacggataaagccgaattactgcgcttttatcaaaactggcaaccacaatggactccgggcgctaagcgtctttacgctaactccagcattggtctgtttggtgcgctggtggtaaaacattcaggtatgagctacgaagaggcaatgaccagacgcgtcctgcaaccattaaaactggcgcatacctggattacggttccgcaaagcgaacaaaaagattatgcctggggctatcgcgaagggaagcctgtacacgtttctccggggcaacttgacgccgaagcctatggcgtgaaatccagcgttatcgatatggcccgctgggttcaggccaacatggacgccagcctcgttcaggagaaaacgctccagcagggcattgagcttgcgcagtctcgctactggcgtattggtgatatgtaccagggattaggctgggagatgctgaactggccgctgaaagctgattcgatcatcaacggcagcgacagcaaagtggcattggcagcgcttcccgccgttgaggtaaacccgccagcacctgccgtgaaagcctcatgggtgcataaaacaggatccacaggcggatttggcagctacgttgccttcgttccagaaaaaaaccttggcatcgtaatgttggcaaacaaaagctaccccaacccggctcgcgtcgaggcggcctggcgcattcttgaaaaactgcaataa

SEQ ID NO: 48565 - protein, 381 aa, Citrobacter freundii
MMKKSICCALLLTASFSTFAAAKTEQQIADIVNRTITPLMQEQAIPGMAVAIIYEGKPYYFTWGKADIANNHPVTQQTLFELGSVSKTFNGVLGGDAIARGEIKLSDPVTKYWPELTGKQWRGISLLHLATYTAGGLPLQIPDDVTDKAELLRFYQNWQPQWTPGAKRLYANSSIGLFGALVVKHSGMSYEEAMTRRVLQPLKLAHTWITVPQSEQKDYAWGYREGKPVHVSPGQLDAEAYGVKSSVIDMARWVQANMDASLVQEKTLQQGIELAQSRYWRIGDMYQGLGWEMLNWPLKADSIINGSDSKVALAALPAVEVNPPAPAVKASWVHKTGSTGGFGSYVAFVPEKNLGIVMLANKSYPNPARVEAAWRILEKLQ

SEQ ID NO: 48566 - DNA, 1194 bp, Pseudomonas aeruginosa
  CDS (1)..(1194)
atgcgcgataccagattcccctgcctgtgcggcatcgccgcttccacactgctgttcgccaccaccccggccattgccggcgaggccccggcggatcgcctgaaggcactggtcgacgccgccgtacaaccggtgatgaaggccaatgacattccgggcctggccgtagccatcagcctgaaaggagaaccgcattacttcagctatgggctggcctcgaaagaggacggccgccgggtgacgccggagaccctgttcgagatcggctcggtgagcaagaccttcaccgccaccctcgccggctatgccctggcccaggacaagatgcgcctcgacgaccgcgccagccagcactggccggcgctgcagggcagccgcttcgacggcatcagcctgctcgacctcgcgacctataccgccggcggcttgccgctgcagttccccgactcggtgcagaaggaccaggcacagatccgcgactactaccgccagtggcagccgacctacgcgccgggcagccagcgcctctattccaacccgagcatcggcctgttcggctatctcgccgcgcgcagcctgggccagccgttcgaacggctcatggagcagcaattgttcccggcactgggcctcgaacagacccacctcgacgtgcccgaggcggcgctggcgcagtacgcccagggctacggcaaggacgaccgcccgctacgggtcggtcccggcccgctggatgccgaaggctacggggtgaagaccagcgcggccgacctgctgcgcttcgtcgatgccaacctgcatccggagcgcctggacaggccctgggcgcaggcgctcgatgccacccatcgcggttactacaaggtcggcgacatgacccagggcctgggctgggaagcctacgactggccgatctccctgaagcgcctgcaggccggcaactcgacgccgatggcgctgcaaccgcacaggatcgccaggctgcccgcgccacaggcgctggagggccagcgcctgctgaacaagaccggttccaccaacggcttcggcgcctacgtggcgttcgtcccgggccgcgacctgggactggtgatcctggccaaccgcaactatcccaatgccgagcgggtgaagatcgcctacgccatcctcagcggcctggagcagcagggcaaggtgccgctgaagcgctga

SEQ ID NO: 48567 - protein, 397 aa, Pseudomonas aeruginosa
MRDTRFPCLCGIAASTLLFATTPAIAGEAPADRLKALVDAAVQPVMKANDIPGLAVAISLKGEPHYFSYGLASKEDGRRVTPETLFEIGSVSKTFTATLAGYALAQDKMRLDDRASQHWPALQGSRFDGISLLDLATYTAGGLPLQFPDSVQKDQAQIRDYYRQWQPTYAPGSQRLYSNPSIGLFGYLAARSLGQPFERLMEQQLFPALGLEQTHLDVPEAALAQYAQGYGKDDRPLRVGPGPLDAEGYGVKTSAADLLRFVDANLHPERLDRPWAQALDATHRGYYKVGDMTQGLGWEAYDWPISLKRLQAGNSTPMALQPHRIARLPAPQALEGQRLLNKTGSTNGFGAYVAFVPGRDLGLVILANRNYPNAERVKIAYAILSGLEQQGKVPLKR

SEQ ID NO: 48568 - DNA, 1146 bp, Citrobacter braakii
  CDS (1)..(1146)
atgatgaaaaaatcgatatgctgcgcgctgctgctgacagcttctttctccacgtttgccgccgcaaaaacagaacaacaaattgccgatatcgttaaccgcaccatcacaccgctgatgcaggagcaggcaattccgggcatggccgttgcgattatctatcaggggaaaccttattactttacctggggtaaagccgatatcgccaataaccgtccagtcactcaacaaacgctgtttgaactcggttcggtcagtaaaacgttcaacggcgtgctgggcggcgatgctatcgcccgcggcgaaattaagctcagcgatccggtcacgcattactggcctgaactgactggtaagcagtggcagggtatcagcctgctgcacttagccacctacacggcaggcggcctgccgcttcaggttccggacgacgttacggataaagccgcgttactacgcttttatcaaaactggcagccgcaatgggccccaggcgctaaacgtctttatgctaactccagcattggtctgtttggtgccctggcggtcaaaccctcaggcatgagctacgaagaggcgatgaccaaacgcgtcctgcgccccttaaaactggcgcatacctggattacggttccgcagagcgaacaaaaagattatgcctggggttatcgcgaaggaaagccagtgcatgtatcccctggccaacttgatgccgaagcctacggggtgaaatcgagcgttatcgatatgacccgttgggttcaggcccacatgaatgccagcaaggttcaggagaaaacgctccagcaggcaatcgagcttgcgcagtcacgttactggcgtgttggcgatatgtaccagggcctgggctgggagatgctgaactggccggtgaaagccgactcgataattagcggtagcgacagcaaagtggcactggcagcgcttcctgccgttgaggtaaacccgcccgcgcctgccgtgaaagcctcatgggtgcataaaacgggctccactggcggattcggcagctacgttgctttcgttccagaaaaaaaccttggcatcgtgatgctggcaaacaagagctacccaaaccctgttcgcgtcgaggccgcctggcgcattcttgaaaaactgcagtaa

SEQ ID NO: 48569 - protein, 381 aa, Citrobacter braakii
MMKKSICCALLLTASFSTFAAAKTEQQIADIVNRTITPLMQEQAIPGMAVAIIYQGKPYYFTWGKADIANNRPVTQQTLFELGSVSKTFNGVLGGDAIARGEIKLSDPVTHYWPELTGKQWQGISLLHLATYTAGGLPLQVPDDVTDKAALLRFYQNWQPQWAPGAKRLYANSSIGLFGALAVKPSGMSYEEAMTKRVLRPLKLAHTWITVPQSEQKDYAWGYREGKPVHVSPGQLDAEAYGVKSSVIDMTRWVQAHMNASKVQEKTLQQAIELAQSRYWRVGDMYQGLGWEMLNWPVKADSIISGSDSKVALAALPAVEVNPPAPAVKASWVHKTGSTGGFGSYVAFVPEKNLGIVMLANKSYPNPVRVEAAWRILEKLQ

SEQ ID NO: 48570 - DNA, 1146 bp, Citrobacter murliniae
  CDS (1)..(1146)
atgatgaaaaaatcgttatgctgtgtgctgctactgacagcatctttctcaacgcttgccgcctcgaaaacagaacaacagattaccgatatcgttaatcgcaccatcacaccactgatgaaagaacaagcgattccgggtatggccgtggcaatcatctaccagggaaaaccgtattattttacctggggtaaagctgatattgccaataatcgccctgttacacagcaaacgctgtttgaactcggatcggtcagtaaaaccttcaatggtgtgctgggtggcgacgctatcgctcgcggtgaaatcaaacttaacgatccagtcacccgatactggcccgaactgacaggcaaacagtggcagggtatcagcttgctgcacctggccacttacacagcaggtggcctgccgcttcaaatacccgacgaagtgactgataaggccgcattgctgcacttctatcaaaactggcagccacaatgggctccgggggctaagcgtctctacgccaactccagtattggcctgtttggtgcactggctgtaaaaccttcgggaatgggttatgaagaggcgatgaccaaccgcatcctacaaccattaaaactaaagcatacctggattactgttcctcagagtgagcaaaaggattacgcatggggctatcgcgaaggcaagcccgtgcatgtttctccgggtcaacttgatgccgaagcgtatggtgtaaaatccagtattatggatatggctcgctgggttcaggtcaatatggacgccagccacgtgcaggagaaaaccctccaacagggcatcgagcttgcgcagtcacgttactggcgtattggcgagatgtaccaggggttaggctgggagatgctgaactggccagtgaaagccgacatagttatcaacggcagcgacagcaaaatcgctttggctgcgcttccggccgttgaggtaaacccacccgcacctgtagtaaaagcctcgtgggtacataaaacgggttcgactggcggatttggtagctatgttgccttcatcccggaaaaaaatcttggcatcgtgatgctggcaaacaaaagttatcctaaccctgcccgcgtagatgcggcctggcgcatcctcgaaaaactgcaataa

SEQ ID NO: 48571 - protein, 381 aa, Citrobacter murliniae
MMKKSLCCVLLLTASFSTLAASKTEQQITDIVNRTITPLMKEQAIPGMAVAIIYQGKPYYFTWGKADIANNRPVTQQTLFELGSVSKTFNGVLGGDAIARGEIKLNDPVTRYWPELTGKQWQGISLLHLATYTAGGLPLQIPDEVTDKAALLHFYQNWQPQWAPGAKRLYANSSIGLFGALAVKPSGMGYEEAMTNRILQPLKLKHTWITVPQSEQKDYAWGYREGKPVHVSPGQLDAEAYGVKSSIMDMARWVQVNMDASHVQEKTLQQGIELAQSRYWRIGEMYQGLGWEMLNWPVKADIVINGSDSKIALAALPAVEVNPPAPVVKASWVHKTGSTGGFGSYVAFIPEKNLGIVMLANKSYPNPARVDAAWRILEKLQ

SEQ ID NO: 48572 - DNA, 1146 bp, Enterobacter asburiae
  CDS (1)..(1146)
atgatgactaaatccctttgctgcgccctgctgctcagcacctcctgctcggtattggctgcaccgatgtcagaaaaacagctggctgaggtggtggaacggaccgttacgccgctgatgaaagcgcaggccattccgggtatggcggtggcggtgatttatcagggccagccgcactactttaccttcggtaaagccgatgttgcggcgaacaaacctgtcaccccacaaaccttgttcgaactgggttctataagtaaaacctttaccggcgtactgggtggcgatgccattgctcggggtgaaatatcgctgggcgatccggtgacaaaatactggcctgagctgacgggcaagcagtggcaggggatccgcatgctggatctggcaacctataccgcaggcggtctgccgttacaggtaccggatgaggtcgcggataacgcctctctgctgcgcttttatcaaaactggcagccgcagtggaagccgggtaccacgcgtctttacgccaataccagcatcggcctttttggcgcgctggcggtcaaaccttccggcatgagctatgaacaggccataacgacgcgggtctttaagccgctcaagctggaccatacgtggattaacgttccgaaagcggaagaggcgcattacgcctggggataccgcgacggtaaagcggtacacgtttcgccaggcatgctggacgctgaagcctatggcgtaaaaaccaacgtgcaggatatggcaagctgggtgatggtcaacatgaagccggactcccttcaggataattcactcaggcaaggcattgccctggcgcagtctcgctactggcgcgtaggggccatgtatcaggggttaggctgggaaatgcttaactggccggtcgatgccaaaaccgtggttgaaggtagcgacaataaggtggcactggcaccgctgcccgcaagagaagtgaatcctccggcgcctccggtcaacgcgtcctgggtccataaaacaggctctaccggcgggtttggcagctacgtggcctttattcctgaaaagcagctcggcattgtgatgctggcgaataaaagctatcccaacccagcacgcgttgaggcggcttaccgtattttgagcgcgctgcagtaa

SEQ ID NO: 48573 - protein, 381 aa, Enterobacter asburiae
MMTKSLCCALLLSTSCSVLAAPMSEKQLAEVVERTVTPLMKAQAIPGMAVAVIYQGQPHYFTFGKADVAANKPVTPQTLFELGSISKTFTGVLGGDAIARGEISLGDPVTKYWPELTGKQWQGIRMLDLATYTAGGLPLQVPDEVADNASLLRFYQNWQPQWKPGTTRLYANTSIGLFGALAVKPSGMSYEQAITTRVFKPLKLDHTWINVPKAEEAHYAWGYRDGKAVHVSPGMLDAEAYGVKTNVQDMASWVMVNMKPDSLQDNSLRQGIALAQSRYWRVGAMYQGLGWEMLNWPVDAKTVVEGSDNKVALAPLPAREVNPPAPPVNASWVHKTGSTGGFGSYVAFIPEKQLGIVMLANKSYPNPARVEAAYRILSALQ

SEQ ID NO: 48574 - DNA, 1152 bp, Buttiauxella sp
  CDS (1)..(1152)
atgatgaaaaaaacactctgctgcgcgctggttctgagcgcctccttctccgcctttgccgcccaaaaaacattgagtgacaaacagttagaagacgtcgtcaatcaaacgcttaaaccgatgatcacagcgcaggctattcccggcatggcagtggcggtgatttatcagggcaagccgcactactttacctacggcgtggccgacattgcgaaaaagcagccggtgacaacgcagacgatttttgagctgggctccgtgagtaaaactttcaccggcgtgctgggcggcgatatcgtggcgcgcggggaagtgaagctgagtgacccggcgacgaaatactggccagagctgacgggcaagcagtggcagggcatcacgctgctggatctggcgacctacaccgccggtggcttgccgttgcaggtgccggatgaggttgataatcaggccgcgctgctgaagttttaccagaactggcagccggcctgggcaccgggcacgcgtcgtcagtacgccaactcgagcattggcctgtttggtgcgctggcggtgaaaccgtccgggatgacgtttaacgatgcgatgcgccagcgcgttctgcaaccgctgaacctgaaacatacctggctcaccgttccggccagtgaagaaaatcattacgcctggggctatcgtgatggcaaagccatgcacgttgggccgggcatgctggataccgaagcctacggcgtcaaatccaccatcgaagatatggcgagctgggtgcaatacaacatgaacccgcagcaggtaaaacagccgacgctgcaaaaagggctggagcttgcgcagtcgcgctactggcgcagcggcagtatgtatcagggcttaggctgggaaatgctgaactggccggttgcggcggcgaccgtcattaacggcagcgataacaaagtggcgctggcggcttcgcccgtgacggccattgaaccgccggttgcgccggtaaaagcctctctggtgcataaaaccgggtcgaccaacggcttcggcgcgtacgtggcgttcattcctgaaaaacagatcggcatcgtgatgctggccaacaaaatgtacccgaataccgagcgggtcaaagcggcaaacacccttcttaacacgctgcaataa

SEQ ID NO: 48575 - protein, 383 aa, Buttiauxella sp
MMKKTLCCALVLSASFSAFAAQKTLSDKQLEDVVNQTLKPMITAQAIPGMAVAVIYQGKPHYFTYGVADIAKKQPVTTQTIFELGSVSKTFTGVLGGDIVARGEVKLSDPATKYWPELTGKQWQGITLLDLATYTAGGLPLQVPDEVDNQAALLKFYQNWQPAWAPGTRRQYANSSIGLFGALAVKPSGMTFNDAMRQRVLQPLNLKHTWLTVPASEENHYAWGYRDGKAMHVGPGMLDTEAYGVKSTIEDMASWVQYNMNPQQVKQPTLQKGLELAQSRYWRSGSMYQGLGWEMLNWPVAAATVINGSDNKVALAASPVTAIEPPVAPVKASLVHKTGSTNGFGAYVAFIPEKQIGIVMLANKMYPNTERVKAANTLLNTLQ

SEQ ID NO: 48576 - DNA, 1803 bp, Neurospora crassa
  CDS (1)..(1803)
atgaggttcattctcttcctcctagcgggcgtcacccacctcgctctttccaccgccaaacaaaactgccccctctacggcccgctcttccccaaaccaaccaacctgctccaaaatgcagccatccaagcggccgcaaaatccttagacgagatcttcctcaagtacatcgaccacgacaacaccacaggcgcagaccacttctcgtacgcagtcgaggtgttttcagggagcgaagacacaccgctatggtcgcactactggaccgcgccgaacctgggggtgttcaactcgacgggcgtcagcagagtcgatacccatacagtctttaggataggcagtattaccaagatctttacggtgttggcatttctggcgacggtgggtgatcgagtgtggaatgatccggtcacaaagtacctaccggagctggcaaggttggcggagaagacgccgggtgggtcgatgatggtgccggattgggaggaggtgacgttgggaagtttggctagtcagacgagtgggctgatgcgggactggttcccgcctctcccactcgaagaatttccgccatgtggtaccctccctacctgcaacagggaccagctatttgctggattggggaagttacctccttcgttcccgacatcgtcgacgccagcctactcggacattagctttgccctccttggttatgttgccgagcgcatcaccggaaagcctttcaagactctcgtgcaggattcagtgttgacgccattgaatctcacgcatacgttcacgtcggcgccggatgactcgctgggaattattccgggaaatcgacactcgacgtcatgggcgtttgacttggcggaggaagctgcaacaggaaatatgtatacctcggcgggtgacatgtcctcgctcggccgcgcaatcatgcgctcagcactgctcaaacctgccgtaacccgtcggtggctgaagccatctgtgttcacatcggacccaaagtcagctgttggcatgccatggggtatccgacaacttgacataggctccaaccagtccttccagataacccacgccttcaacaaactcggctctctgggagcctacacctccctcctcgccatcatccccgacctcgacattggcttctccatcctcgccgccggcgatccgcctcctggcttagcaatgtatatcgccgacactttaacaatcacttacctctcaacgatgacgtacgtcgctcgtaccgaggccggccggatgttcagcggtcagtaccggtatatgggtaacatcacggttgctgtccctaattcccctcctacaaactcctccaactcaaccccacccaagtacaccaatggcactataatcgaaagaaaaaggttgaattcctccctcacaatctccacctccccctccactcctggcctcatcctcgagaactggatctccaactcaaccgatatgtccttctatgccgtggccatcgggtctaacatcacggacgagtacctggacaagatcaaaccatccgttcgtctttacccagcgggcttctctgagattttaccagatggaaagggtaagagagtcgctttcaaggccgtcttcgaagacttgagtctgcccgaacggaaaccggggctgcaaatgggtacggactgtgcgacatgggttggtgtgacgggggtggtttatgccagtcggccgttggatttatttaccttcgaactggatggggaagggaaggtgaagggggtggagaatggagcgttgagggtttggttggataaagttgggtga

SEQ ID NO: 48577 - protein, 600 aa, Neurospora crassa
MRFILFLLAGVTHLALSTAKQNCPLYGPLFPKPTNLLQNAAIQAAAKSLDEIFLKYIDHDNTTGADHFSYAVEVFSGSEDTPLWSHYWTAPNLGVFNSTGVSRVDTHTVFRIGSITKIFTVLAFLATVGDRVWNDPVTKYLPELARLAEKTPGGSMMVPDWEEVTLGSLASQTSGLMRDWFPPLPLEEFPPCGTLPTCNRDQLFAGLGKLPPSFPTSSTPAYSDISFALLGYVAERITGKPFKTLVQDSVLTPLNLTHTFTSAPDDSLGIIPGNRHSTSWAFDLAEEAATGNMYTSAGDMSSLGRAIMRSALLKPAVTRRWLKPSVFTSDPKSAVGMPWGIRQLDIGSNQSFQITHAFNKLGSLGAYTSLLAIIPDLDIGFSILAAGDPPPGLAMYIADTLTITYLSTMTYVARTEAGRMFSGQYRYMGNITVAVPNSPPTNSSNSTPPKYTNGTIIERKRLNSSLTISTSPSTPGLILENWISNSTDMSFYAVAIGSNITDEYLDKIKPSVRLYPAGFSEILPDGKGKRVAFKAVFEDLSLPERKPGLQMGTDCATWVGVTGVVYASRPLDLFTFELDGEGKVKGVENGALRVWLDKVG

SEQ ID NO: 48578 - DNA, 1146 bp, Citrobacter freundii
  CDS (1)..(1146)
atgatgaaaaaatcgatatgctgcgcactgctgctgacagcctctttctccacgtttgctgccgcaaaaacagaacaacaaattgccgatatcgttaaccgcaccatcacaccactgatgcaggagcaggctattccgggtatggccgtggcgattatctacgaggggaaaccttattactttacctggggtaaagccgatatcgccaataaccacccagtcacgcagcaaacgctgtttgagctagggtcggtcagtaagacgtttaacggcgtgttgggcggcgacgctatcgcccgcggcgaaattaagctcagcgatccggtcacgaaatactggccagaactgacaggcaaacagtggcggggtatcagcctgctgcacttagccacctatacagcgggtggcctgccgctgcagatccccgatgacgttacggataaagccgaattactgcgcttttatcaaaactggcaaccacaatggactccgggcgctaagcgtctttacgctaactccagcattggtctgtttggtgcgctggtggtaaaaccttcaggtatgagctacgaagaggcaatgaccagacgcgtcctgcaaccattaaaactggcgcatacctggattacggttccgcaaagcgaacaaaaaaattatgcctggggctatcgcgaagggaagcctgtacacgtttctccgggacaacttgacgccgaagcctatggcgtgaaatccagcgttatcgatatggcccgctgggttcaggccaacatggacgccagccacgttcaggagaaaacgctccagcagggcattgagcttgcgcagtctcgctactggcgtattggtgatatgtaccagggattaggctgggagatgctgaactggccgctgaaagctgattcgatcatcaacggcagcgacagcaaagtggcattggcagcgcttcccgccgttgaggtaaacccgccagcacctgccgtgaaagcctcatgggtgcataaaacaggatccacaggcggatttggcagctacgttgccttcgttccagaaaaaaaccttggcatagtgatgctggcaaacaaaagctatcctaaccctgtccgcgtcgaggcggcctggcgcattcttgaaaaactgcaataa

SEQ ID NO: 48579 - protein, 381 aa, Citrobacter freundii
MMKKSICCALLLTASFSTFAAAKTEQQIADIVNRTITPLMQEQAIPGMAVAIIYEGKPYYFTWGKADIANNHPVTQQTLFELGSVSKTFNGVLGGDAIARGEIKLSDPVTKYWPELTGKQWRGISLLHLATYTAGGLPLQIPDDVTDKAELLRFYQNWQPQWTPGAKRLYANSSIGLFGALVVKPSGMSYEEAMTRRVLQPLKLAHTWITVPQSEQKNYAWGYREGKPVHVSPGQLDAEAYGVKSSVIDMARWVQANMDASHVQEKTLQQGIELAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 48580 - DNA, 1137 bp, Serratia marcescens
  CDS (1)..(1137)
atgacgaaaatgaaccgcctggcggcagcgctgatcgccgcactgatcttgccgaccgcgcaggccgcgcagcagcaggatatcgacgccgttattcagccgctgatgaaaaaatatggcgtaccgggcatggcgatcgccgtgtcggtcgacggcaaacagcagatttacccatatggcgtcgcctcgaagcagaccggcaaaccgatcaccgaggagacgctgttcgaagtgggctcgctgagcaaaacctttaccgcgacgctggcggtctatgcgcagcagcagggcaagctgtcgttcaatgatccggccagccgctacctgcccgagctgcgcggcagcgccttcgacggcgtcagcctgctgaatctggcgacgcatacctccggcctgccgctgttcgtgccggacgacgtcaccaacaacgcccagctgatggcctactaccgggcctggcagccgaaacacccggcgggcagctaccgggtctattccaacctcggcatcggcatgctgggcatgatcgccgccaagagcctcgaccagccgtttatccaggcgatggaacaggggatgctgccggcgctgggcatgagccacacctacgttcaggtgccggcggcgcagatggctaactatgcgcagggttacagcaaggacgataagccggtgcgggtcaatcccggcccgctggacgccgaatcttacggcatcaagtccaacgctcgcgatctgattcgctatctggacgccaacctgcagcaggtgaaggtggcgcagccgtggcgcgacgcgctggccgcgacgcacgtcgggtattacaaggcgggcgcgttcacgcaggatctgatgtgggagaactacccgtatccagtgaaactgtcgcgtttgattgaaggcaacaacgccgggatgatcatgaacggcacgccagccaccgccatcacgccgccgcagccggaattgcgcgccggctggtataacaaaaccggctccaccggcggcttctccacctacgcggtatttatcccggcgaaaaatattgccgtggtgatgctggccaacaagtggttcccgaacgacgatcgcgtcgaggcggcttaccacatcgtccaggcgctggagaagcgctga

SEQ ID NO: 48581 - protein, 378 aa, Serratia marcescens
MTKMNRLAAALIAALILPTAQAAQQQDIDAVIQPLMKKYGVPGMAIAVSVDGKQQIYPYGVASKQTGKPITEETLFEVGSLSKTFTATLAVYAQQQGKLSFNDPASRYLPELRGSAFDGVSLLNLATHTSGLPLFVPDDVTNNAQLMAYYRAWQPKHPAGSYRVYSNLGIGMLGMIAAKSLDQPFIQAMEQGMLPALGMSHTYVQVPAAQMANYAQGYSKDDKPVRVNPGPLDAESYGIKSNARDLIRYLDANLQQVKVAQPWRDALAATHVGYYKAGAFTQDLMWENYPYPVKLSRLIEGNNAGMIMNGTPATAITPPQPELRAGWYNKTGSTGGFSTYAVFIPAKNIAVVMLANKWFPNDDRVEAAYHIVQALEKR

SEQ ID NO: 48582 - DNA, 1140 bp, Klebsiella pneumoniae
  CDS (1)..(1140)
atgaaaaaatcgttatctgcaacactgatttccgctctgctggcgttttccgccccggggttttctgccgctgataatgtcgcggcggtggtggacagcaccattaaaccgctgatggcacagcaggatattcccgggatggcggttgccgtctctgtaaagggcaagccctattatttcaattatggttttgccgatgttcaggcaaaacagccggtcactgaaaatacactatttgagctgggatctgtaagtaaaactttcacaggtgtgctgggtgcggtttctgtggcgaaaaaagagatgatgttgaatgacccggcagaaaaataccagccggagctggctctgccgcagtggaaggggatcacactgctggatctggccacctacaccacaggcgggctgccgttacaggtgccggatgcggtgaaaaaccgtgcggaactgctgcacttctatcagcagtggcagccgtcccggaaaccgggcgatatgcgtctgtatgcaaacagcagtatcggcctgtttggtgctctgaccgccaacgcagcggggatgccgtatgagcagttgctgaccgcgcggatcctggcaccgctgggattatctcacacctttattaccgtgccggaaagcgcgcaaagccagtatgcgtacggctataaaaacaaaaaaccggtccgcgtgtcgccgggacagcttgatgcggagtcttacggcgtgaaatccgcctcaaaagatatgctgcgctgggcggaaatgaatatggagccgtcacgggccggtaatgcggatctggaaatggcaatgtatcttgcacagacccgctactataaaaccgccgcgattaaccaggggctgggctgggagatgtatgactggccgcagcagaaagatatgatcattaacggcgtgaccaacgaggtcgcactgcagccgcacccggtaacagacaaccaggttcagccgtataaccgtgcttcctgggtgcataaaacgggggcaacaactggtttcggcgcctatgtggcctttattccggaaaaacaggtggcgattgtgattctggcgaataaaaactacccgaataccgaaagagtcaaagccgcacaggctattttgagtgcgctggaataa

SEQ ID NO: 48583 - protein, 379 aa, Klebsiella pneumoniae
MKKSLSATLISALLAFSAPGFSAADNVAAVVDSTIKPLMAQQDIPGMAVAVSVKGKPYYFNYGFADVQAKQPVTENTLFELGSVSKTFTGVLGAVSVAKKEMMLNDPAEKYQPELALPQWKGITLLDLATYTTGGLPLQVPDAVKNRAELLHFYQQWQPSRKPGDMRLYANSSIGLFGALTANAAGMPYEQLLTARILAPLGLSHTFITVPESAQSQYAYGYKNKKPVRVSPGQLDAESYGVKSASKDMLRWAEMNMEPSRAGNADLEMAMYLAQTRYYKTAAINQGLGWEMYDWPQQKDMIINGVTNEVALQPHPVTDNQVQPYNRASWVHKTGATTGFGAYVAFIPEKQVAIVILANKNYPNTERVKAAQAILSALE

SEQ ID NO: 48584 - DNA, 1128 bp, Enterobacter cloacae
  CDS (1)..(1128)
atgatgaaaaaatccctttgctgcgccctgctgctcggcatttcttgctctgctctcgccacgccagtgtcagaaaaacagctggcggaggtggtcgcgaatacggttaccccgctgatgaaagcccagtctgttccaggcatggcggtggccgttatttatcagggaaaaccgcactattacacgtttggcaaggccgatatcgcggcgaataaacccgttacgcctcagaccctgttcgagctgggttctataagtaaaaccttcaccggcgttttaggtggggatgccattgctcgcggtgaaatttcgctggacgatccggtgaccagatactggccacagctgacgggcaagcaatggcagggtattcgtatgctggatctcgccacctacaccgctggcggcctgccgctacaggtaccggatgaggtcacggataacgcctccctgctgcgcttttatcaaaactggcagccgcagtggaagcctggcacaacgcgtctttacgccaacgccagcatcggtctttttggtgcgctggcggtcaaaccttctggcatgccctatgagcaggccatgacgacgcgggtccttaagccgctcaagctggaccatacctggattaacgtgccgaaagcggaagaggcgcattacgcctggggctatcgtgacggtaaagcggtgcgcgtttcgccgggtatgctggatgcacaagcctatggcgtgaaaaccaacgtgcaggatatggcgaactgggtcatggcaaacatggcgccggagaacgttgctgatgcctcacttaagcagggcatcgcgctggcgcagtcgcgctactggcgtatcgggtcaatgtatcagggtctgggctgggagatgctcaactggcccgtggaggccaacacggtggtcgagggcagcgacccgttgcccgtggtagaagtgaatccaccggctcccccggtcaaagcgtcctgggtccataaaacgggctctactggcgggtttggcagctacgtggcctttattcctgaaaagcagatcggtattgtgatgctcgcgaatacaagctatccgaacccggcacgcgttgaggcggcataccatatcctcgaggcgctacagtaa

SEQ ID NO: 48585 - protein, 375 aa, Enterobacter cloacae
MMKKSLCCALLLGISCSALATPVSEKQLAEVVANTVTPLMKAQSVPGMAVAVIYQGKPHYYTFGKADIAANKPVTPQTLFELGSISKTFTGVLGGDAIARGEISLDDPVTRYWPQLTGKQWQGIRMLDLATYTAGGLPLQVPDEVTDNASLLRFYQNWQPQWKPGTTRLYANASIGLFGALAVKPSGMPYEQAMTTRVLKPLKLDHTWINVPKAEEAHYAWGYRDGKAVRVSPGMLDAQAYGVKTNVQDMANWVMANMAPENVADASLKQGIALAQSRYWRIGSMYQGLGWEMLNWPVEANTVVEGSDPLPVVEVNPPAPPVKASWVHKTGSTGGFGSYVAFIPEKQIGIVMLANTSYPNPARVEAAYHILEALQ

SEQ ID NO: 48586 - DNA, 1137 bp, Serratia marcescens
  CDS (1)..(1137)
atgacgaaaatgaaccgcctggcggccgcgctgatcgccgcactgatcctgccgaccgcgcacgccgcgcagcagcaggatatcgacgccgttattcagccgctgatgaaaaaatatggcgtgccgggcatggcgatcgccgtgtcggtcgacggcaaacagcagatttacccgtatggcgttgcctcgaagcagaccggcaaaccgatcaccgagcagacgctgttcgaagtgggctcgctgagcaaaaccttcaccgcgacgctggcggtctatgcgcagcagcagggcaaactgtcgtttaaagacccggccagccgctacctgcccgagctgcgcggcagcgccttcgacggcgtcagcctgctgaatctggcgacgcatacctccggtttgccgctgttcgtgccggacgacgtaaccgacaacgcacaactgatggcgtactaccgggcctggcagccgaaacacccggcgggcagctaccgcgtctattccaacctcggcatcggcatgctgggcatgatcgccgccaagagcctcgaccagccgtttatccaggcgatggaacaggggatgctgccggcgttgggcatgagccacacctacgttcaggtgccggcggcgcagatggccaactatgcgcagggctacagcaaggacgataaaccggtgcgggtcaatcccggcccgctggacgccgagtcttacggcatcaagtccaacgcccgcgatctgattcgctatctggacgccaacctgcagcaggtgaaggtggcgcaaccgtggcgcgaggcgctggccgccacgcacgtcggttattacaaggcgggtgcgttcacgcaggatctgatgtgggagaactacccgtatccggtgaagctgtcgcgtttggttgaaggcaacaacgccgggatgatcatgaacggcacgccggccaccgccatcacgccgccgcagccggaattgcgcgccggctggtataacaaaaccggctctaccggcggtttctccacctacgcggtgtttatcccggcgaagaatatcgccgtggtgatgttggccaacaagtggttcccgaatgacgatcgcgtcgaggcggcttaccacatcatccaggcgctggagaagcactga

SEQ ID NO: 48587 - protein, 378 aa, Serratia marcescens
MTKMNRLAAALIAALILPTAHAAQQQDIDAVIQPLMKKYGVPGMAIAVSVDGKQQIYPYGVASKQTGKPITEQTLFEVGSLSKTFTATLAVYAQQQGKLSFKDPASRYLPELRGSAFDGVSLLNLATHTSGLPLFVPDDVTDNAQLMAYYRAWQPKHPAGSYRVYSNLGIGMLGMIAAKSLDQPFIQAMEQGMLPALGMSHTYVQVPAAQMANYAQGYSKDDKPVRVNPGPLDAESYGIKSNARDLIRYLDANLQQVKVAQPWREALAATHVGYYKAGAFTQDLMWENYPYPVKLSRLVEGNNAGMIMNGTPATAITPPQPELRAGWYNKTGSTGGFSTYAVFIPAKNIAVVMLANKWFPNDDRVEAAYHIIQALEKH

SEQ ID NO: 48588 - DNA, 1146 bp, Escherichia coli
  CDS (1)..(1146)
atgatgaaaaaatcgttatgctgcgctctgctgctgacagcctctttctccacatttgctgccgcaaaaacagaacaacagattgccgatatcgttaatcgcaccatcaccccgttgatgcaggagcaggctattccgggtatggccgttgccgttatctaccagggaaaaccctattatttcacctggggtaaagccgatatcgccaataaccacccagtcacgcagcaaacgctgtttgagctaggatcggttagtaagacgtttaacggcgtgttgggcggcgatgctatcgcccgcggcgaaattaagctcagcgatccggtcacgaaatactggccagaactgacaggcaaacagtggcagggtatccgcctgctgcacttagccacctatacggcaggcggcctaccgctgcagatccccgatgacgttagggataaagccgcattactgcatttttatcaaaactggcagccgcaatggactccgggcgctaagcgactttacgctaactccagcattggtctgtttggcgcgctggcggtgaaaccctcaggaatgagttacgaagaggcaatgaccagacgcgtcctgcaaccattaaaactggcgcatacctggattacggttccgcagaacgaacaaaaagattatgccttgggctatcgcgaagggaagcccgtacacgtttctccgggacaacttgacgccgaagcctatggcgtgaaatccagcgttattgatatggcccgctgggttcaggccaacatggatgccagccacgttcaggagaaaacgctccagcagggcattgcgcttgcgcagtctcgctactggcgtattggcgatatgtaccagggattaggctgggagatgctgaactggccgctgaaagctgattcgatcatcaacggcagcgacagcaaagtggcattggcagcgcttcccgccgttgaggtaaacccgcccgcccccgcagtgaaagcctcatgggtgcataaaacgggctccactggtggatttggcagctacgtagccttcgttccagaaaaaaaccttggcatcgtgatgctggcaaacaaaagctatcctaaccctgtccgtgtcgaggcggcctggcgcattcttgaaaagctgcaataa

SEQ ID NO: 48589 - protein, 381 aa, Escherichia coli
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKLSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYALGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 48590 - DNA, 1134 bp, Escherichia coli
  CDS (1)..(1134)
atgttcaaaacgacgctctgcgccttattaattaccgcctcttgctccacatttgctgcccctcaacaaatcaacgatattgtgcatcgcacaattaccccgcttatagagcaacaaaagatccccggtatggcggtggcggtaatttatcagggtaaaccttattactttacctggggctatgcggacatcgccaaaaagcagcccgtcacacagcaaacgttgtttgagttaggttcggtcagcaaaacatttacgggcgtgcttggtggcgacgctattgctcgaggggaaatcaagttaagcgatcccgcaacaaaatactggcctgaacttaccgctaaacagtggaatgggatcacactattacatcttgcgacctacaccgctggcggcctgccattgcaggtgccggatgaagtgaaatcctcaagcgacttgctgcgcttctatcaaaactggcagcctgcatgggctccaggaacacaacgtctgtatgccaactccagtatcggtttgttcggcgcactggctgtgaagccgtctggtttgagttttgagcaggcgatgcaaactcgtgtcttccagccactcaaactcaaccatacgtggattaatgtacctcccccagaagaaaagaattacgcctggggatatcgcgaaggtaaggcagtgcatgtttcgccaggggcgttagatgctgaagcttatggtgtgaagtcgaccattgaagatatggcccgctgggtacgaagcaatatgaatccccgtgatatcaacgacaaaacacttcagcaagggatacaactggcacaatctcgctactggcaaaccggcgatatgtatcagggcctgggctgggaaatgctggactggccggtaaatcctgacagcatcattaacggcaatggcaataaaattgcactggcagcacaccctgtaaaagcgattacgcccccaactcctgcagtacgcgcatcatgggtacataaaacaggggcaaccggcggatttggtagctatgtcgcgtttattccagaaaaagagctgggtatagtgatgctggctaacaaaaactatcccaatccagcgagagtcgccgccgcctggcagattctcaacgctctacagtaa

SEQ ID NO: 48591 - protein, 377 aa, Escherichia coli
MFKTTLCALLITASCSTFAAPQQINDIVHRTITPLIEQQKIPGMAVAVIYQGKPYYFTWGYADIAKKQPVTQQTLFELGSVSKTFTGVLGGDAIARGEIKLSDPATKYWPELTAKQWNGITLLHLATYTAGGLPLQVPDEVKSSSDLLRFYQNWQPAWAPGTQRLYANSSIGLFGALAVKPSGLSFEQAMQTRVFQPLKLNHTWINVPPPEEKNYAWGYREGKAVHVSPGALDAEAYGVKSTIEDMARWVRSNMNPRDINDKTLQQGIQLAQSRYWQTGDMYQGLGWEMLDWPVNPDSIINGNGNKIALAAHPVKAITPPTPAVRASWVHKTGATGGFGSYVAFIPEKELGIVMLANKNYPNPARVAAAWQILNALQ

SEQ ID NO: 48592 - DNA, 1134 bp, Escherichia coli
  CDS (1)..(1134)
atgttcaaaacgacgctctgcgccttattaattaccgcctcttgctccacatttgctgcccctcaacaaatcaacgatattgtgcatcgcacaattaccccgcttatagagcaacaaaagatccccggtatggcggtggcggtaatttatcagggtaaaccttattactttacctggggctatgcggacatcgccaaaaagcagcccgtcacacagcaaacgttgtttgagttaggttcggtcagcaaaacatttacgggcgtgcttggtggcgaggctattgctcgaggggaaatcaagttaagcgatcccacaacaaaatactggcctgaacttaccgctaaacagtggaatgggatcacactattacatctcgcaacctacactgctggcggcctgccattgcaggtgccggatgaggtgaaatcctcaagcgacttgctgcgcttctatcaaaactggcagcctgcatgggcgccaggaacacaacgtctgtatgccaactccagtatcggtttgttcggcgcactggctgtgaagccgtctggtttgagttttgagcaggcgatgcaaacacgtgtcttccagccactcaaactcaaccatacgtggattaatgtaccgcccgcagaagaaaagaattacgcctggggatatcgcgaaggcaaggcagttcatgtttcgccaggggcgttagatgctgaagcttatggtgtgaagtcgaccattgaagatatggcctgctgggtacgaagcaatatgaatccccgtgatatcaacgacaaaacacttcagcaagggatacaactggcacaatctcgctactggcaaaccggcgatatgtatcagggcctgggctgggaaatgctggactggccggtaaatcctgacagcatcattaacggcagtggcaataaaattgtactggcagcacaccccgtaaaagcgattacgcccccaactcctgcagtacgcgcatcatgggtacataaaacagggtcaaccggcggatttggtagctatgtcgcgtttattccagaaaaagagctgggtatagtgatgctggctaacaaaaactatcccaatccagcgagagtcgccgccgcctggcagattctcaacgctctacaataa

SEQ ID NO: 48593 - protein, 377 aa, Escherichia coli
MFKTTLCALLITASCSTFAAPQQINDIVHRTITPLIEQQKIPGMAVAVIYQGKPYYFTWGYADIAKKQPVTQQTLFELGSVSKTFTGVLGGEAIARGEIKLSDPTTKYWPELTAKQWNGITLLHLATYTAGGLPLQVPDEVKSSSDLLRFYQNWQPAWAPGTQRLYANSSIGLFGALAVKPSGLSFEQAMQTRVFQPLKLNHTWINVPPAEEKNYAWGYREGKAVHVSPGALDAEAYGVKSTIEDMACWVRSNMNPRDINDKTLQQGIQLAQSRYWQTGDMYQGLGWEMLDWPVNPDSIINGSGNKIVLAAHPVKAITPPTPAVRASWVHKTGSTGGFGSYVAFIPEKELGIVMLANKNYPNPARVAAAWQILNALQ

SEQ ID NO: 48594 - DNA, 1146 bp, Klebsiella pneumoniae
  CDS (1)..(1146)
atgatgacaaaatccctaagctgtgccctgctgctcagcgtcgccagttctgcattcgccgcaccgatgtccgaaaaacagctggctgaggtggtggaacgtaccgttacgccgctgatgaacgcgcaggccattccgggtatggcggtggcggtaatttatcagggtcagccacactactttaccttcggtaaagccgatgttgcggcgaacaaacccgtcaccccgcaaaccctgtttgagctgggctctataagtaaaaccttcaccggcgtactgggcggcgatgccattgcccggggtgaaatagcgctgggcgatccggtagcaaaatactggcctgagctcacgggcaagcagtggcagggcattcgcatgctggatctggcaacctataccgcaggcggtctgccgttacaggtgccggatgaggtcacggataccgcctctctgctgcgcttttatcaaaactggcagccgcagtggaagccgggcaccacgcgtctttacgctaacgccagcatcggtctttttggtgcgctggcggttaaaccttccggcatgagctatgagcaggccatgacgacgcgggtctttaaacccctcaagctggaccatacctggattaacgtcccgaaagcggaagaggcgcatttcgcctggggataccgtgagggtaaagcggtccacgtttcgccagggatgctggacgcggaagcctatggcgtaaaaactaacgtgaaggatatggcgagctggctgatagccaacatgaagccggattctcttcaggctccctcactcaagcaaggcattgctctggcgcagtctcgctactggcgcgtgggggctatgtatcaggggttaggctgggagatgctcaactggccggtcgatgccaaaaccgtcgtcggaggcagtgataacaaggtggcgctggcaccattgcccgtggcagaagtgaatccacccgcgccgccggtcaaggcctcctgggtccataaaacaggctcgacgggcgggtttggcagctacgtggcatttattcctgaaaagcagctcggcattgtgatgctggcgaataaaagctatccgaacccggcacgcgttgaggcggcataccgtatcctcgacgcgctgcagtaa

SEQ ID NO: 48595 - protein, 381 aa, Klebsiella pneumoniae
MMTKSLSCALLLSVASSAFAAPMSEKQLAEVVERTVTPLMNAQAIPGMAVAVIYQGQPHYFTFGKADVAANKPVTPQTLFELGSISKTFTGVLGGDAIARGEIALGDPVAKYWPELTGKQWQGIRMLDLATYTAGGLPLQVPDEVTDTASLLRFYQNWQPQWKPGTTRLYANASIGLFGALAVKPSGMSYEQAMTTRVFKPLKLDHTWINVPKAEEAHFAWGYREGKAVHVSPGMLDAEAYGVKTNVKDMASWLIANMKPDSLQAPSLKQGIALAQSRYWRVGAMYQGLGWEMLNWPVDAKTVVGGSDNKVALAPLPVAEVNPPAPPVKASWVHKTGSTGGFGSYVAFIPEKQLGIVMLANKSYPNPARVEAAYRILDALQ

SEQ ID NO: 48596 - DNA, 1146 bp, Klebsiella oxytoca
  CDS (1)..(1146)
atgatgaaaaaatcgttatgctgcgctctgctgctgacagcctctttctccacatttgctgccgcaaaaacagaacaacagattgccgatatcgttaatcgcaccatcaccccgttgatgcaggagcaggctattccgggtatggccgttgccgttatctaccagggaaaaccctattatttcacctggggtaaagccgatatcgccaataaccacccagtcacgcagcaaacgctgtttgagctaggatcggttagtaagacgtttaacggcgtgttgggcggcgatgctatcgcccgcggcgaaattaagttcagcgatccggtcacgaaatactggccagaactgacaggcaaacagtggcagggtatccgcctgctgcacttagccacttatacggcaggcggcctaccgctgcagatccccgatgacgttagggataaagccgcattactgcatttttatcaaaactggcagccgcaatggactccgggcgctaagcgactttacgctaactccagcattggtctgtttggcgcgctggcggtgaaaccctcaggaatgagttacgaagaggcaatgaccagacgcgtcctgcaaccattaaaactggcgcatacctggattacggttccgcagaacgaacaaaaagattatgcctggggctatcgcgaagggaagcccgtacacgtttctccgggacaacttgacgccgaagcctatggcgtgaaatccagcgttattgatatggcccgctgggttcaggccaacatggatgccagccacgttcaggagaaaacgctccagcagggcattgcgcttgcgcagtctcgctactggcgtattggcgatatgtaccagggattaggctgggagatgctgaactggccgctgaaagctgattcgatcatcaacggcagcgacagcaaagtggcattggcagcgcttcccgccgttgaggtaaacccgcccgcccccgcagtgaaagcctcatgggtgcataaaacgggctccactggtggatttggcagctacgtagccttcgttccagaaaaaaaccttggcatcgtgatgctggcaaacaaaagctatcctaaccctgtccgtgtcgaggcggcctggcgcattcttgaaaagctgcaataa

SEQ ID NO: 48597 - protein, 381 aa, Klebsiella oxytoca
MMKKSLCCALLLTASFSTFAAAKTEQQIADIVNRTITPLMQEQAIPGMAVAVIYQGKPYYFTWGKADIANNHPVTQQTLFELGSVSKTFNGVLGGDAIARGEIKFSDPVTKYWPELTGKQWQGIRLLHLATYTAGGLPLQIPDDVRDKAALLHFYQNWQPQWTPGAKRLYANSSIGLFGALAVKPSGMSYEEAMTRRVLQPLKLAHTWITVPQNEQKDYAWGYREGKPVHVSPGQLDAEAYGVKSSVIDMARWVQANMDASHVQEKTLQQGIALAQSRYWRIGDMYQGLGWEMLNWPLKADSIINGSDSKVALAALPAVEVNPPAPAVKASWVHKTGSTGGFGSYVAFVPEKNLGIVMLANKSYPNPVRVEAAWRILEKLQ

SEQ ID NO: 48598 - DNA, 1146 bp, Citrobacter freundii
  CDS (1)..(1146)
atgatgaaaaaatcgatatgctgcgcgctgctgctgacagcctctttctccacgtttgctgccgcaaaaacagaacaacaaattgccgatatcgttaaccgcaccatcacaccactgatgcaggagcaggctattccgggtatggccgtggcgattatctacgaggggaaaccttattactttacctggggtaaagccgatatcgccaataaccacccagtcacgcagcaaacgctgtttgagctagggtcggtcagtaagacgtttaacggcgtgttgggcggcgaccgtatcgcccgcggcgaaattaagctcagcgatccggtcacgaaatactggccagaactgacaggcaaacagtggcggggtatcagcctgctgcacttagccacctatacagcgggtggcctgccgctgcagatccccggtgacgttacggataaagccgaattactgcgcttttatcaaaactggcaaccacaatggactccgggcgctaagcgtctttacgctaactccagcattggtctgtttggtgcgctggcggtgaaatcttcaggtatgagctacgaagaggcaatgaccagacgcgtcctgcaaccattaaaactggcgcatacctggattacggttccgcaaagcgaacaaaaaaactatgcctggggctatctcgaagggaagcctgtgcacgtttctccgggacaacttgacgccgaagcctatggcgtgaaatccagcgttatcgatatggcccgctgggttcaggccaacatggacgccagccacgttcaggagaaaacgctccagcagggcattgagcttgcgcagtctcgctactggcgtattggtgatatgtaccagggattaggctgggagatgctgaactggccgctgaaagctgattcgatcatcaacggcagcgacagcaaagtggcattggcagcgcttcccgccgttgaggtaaacccgccagcacctgccgtgaaagcctcatgggtgcataaaacaggatccacaggcggatttggcagctacgttgctttcgttccagaaaaaaaccttggcatcgtaatgttggcaaacaaaagctaccccaacccggctcgcgtcgaggcggcctggcgcattcttgaaaaactgcaataa

SEQ ID NO: 48599 - protein, 381 aa, Citrobacter freundii
MMKKSICCALLLTASFSTFAAAKTEQQIADIVNRTITPLMQEQAIPGMAVAIIYEGKPYYFTWGKADIANNHPVTQQTLFELGSVSKTFNGVLGGDRIARGEIKLSDPVTKYWPELTGKQWRGISLLHLATYTAGGLPLQIPGDVTDKAELLRFYQNWQPQWTPGAKRLYANSSIGLFGALAVKSSGMSYEEAMTRRVLQPLKLAHTWITVPQSEQKNYAWGYLEGKPVHVSPGQLDAEAYGVKSSVIDMARWVQANMDASHVQEKTLQQGIELAQSRYWRIGDMYQGLGWEMLNWPLKADSIINGSDSKVALAALPAVEVNPPAPAVKASWVHKTGSTGGFGSYVAFVPEKNLGIVMLANKSYPNPARVEAAWRILEKLQ

SEQ ID NO: 48600 - DNA, 1140 bp, Morganella morganii
  CDS (1)..(1140)
atgaaaaaatcgttatctgcaacactgatttccgctctgctggcgttttccgccccggggttttctgccgctgataatgtcgcggcggtggtggacagcaccattaaaccgctgatggcacagcaggatattcccgggatggcggttgccgtctccgtaaagggtaagccctattatttcaattacggttttgccgatgttcaggcaaaacagcctgtcactgaaaatacactatttgagctcggatctgtaagtaaaactttcacaggtgtgctgggtgcggtttccgtggcgaaaaaagagatgacgttgaatgacccggcagaaaaataccagccggagctggctctgccgcagtggaaggggatcacactgctggatctggctacctacaccgcaggcgggctgccgttacaggtgccggatgcggtgaaaagccgtgcggatctgctgcatttctatcagcagtggcagccgtcccggaaaccgggcgatatgcgtctgtatgcaaacagcagtatcggcctgtttggtgctctgaccgccaacgcggcggggatgccgtatgagcagttgctgactgcacggatcctggcaccgctggggttatctcacacctttattactgtgccggaaagtgcgcaaagccagtatgcgtacggttataaaaacaaaaaaccggtccgcgtgtcgccgggacagcttgatgcggaatcttacggtgtgaaatccgcctcaaaagatatgctgcgctgggcggaaatgaatatggagccgtcacgggccggtaatgcggatctggaaatggcaatgtatctcgcccagacccgctactataaaaccgccgcgattaatcagggtctgggctgggaaatgtacgactggccgcagcagaaagatatgatcattaacggcgtgacaaacgaggtcgcattgcagccgcacccggtaacagacaaccaggttcagccgtataaccgtgcttcctgggtgcataaaacgggggcaacaacgggtttcggcgcctatgtggcctttattccggaaaaacaggtggcgattgtgattctggcgaataaaaactacccgaataccgaaagagtcaaagccgcacaggctattttgagtgcactggaataa

SEQ ID NO: 48601 - protein, 379 aa, Morganella morganii [sequence omitted]

SEQ ID NO: 48602 - DNA, 1194 bp, Pseudomonas aeruginosa
  CDS (1)..(1194)
atgcgcgataccagattcccctgcctgtgcggcatcgccgcttccacactgctgttcgccaccaccccggccattgccggcgaggccccggcggatcgcctgaaggcactggtcgacgccgccgtacaaccggtgatgaaggccaatgacattccgggcctggccgtagccatcagcctgaaaggagaaccgcattacttcagctatgggctggcctcgaaagaggacggccgccgggtgacgccggagaccctgttcgagatcggctcggtgagcaagaccttcaccgccaccctcgccggctatgccctgacccaggacaagatgcgcctcgacgaccgcgccagccagcactggccggcactgcagggcagccgcttcgacggcatcagcctgctcgacctcgcgacctataccgccggcggcttgccgctgcagttccccgactcggtgcagaaggaccaggcacagatccgcgactactaccgccagtggcagccgacctacgcgccgggcagccagcgcctctattccaacccgagcatcggcctgttcggctatctcgccgcgcgcagcctgggccagccgttcgaacggctcatggagcagcaagtgttcccggcactgggcctcgaacagacccacctcgacgtgcccgaggcggcgctggcgcagtacgcccagggctatggcaaggacgaccgcccgctacgggtcggtcccggcccgctggatgccgaaggctacggggtgaagaccagcgcggccgacctgctgcgcttcgtcgatgccaacctgcatccggagcgcctggacaggccctgggcgcaggcgctcgatgccacccatcgcggttactacaaggtcggcgacatgacccagggcctgggctgggaagcctacgactggccgatctccctgaagcgcctgcaggccggcaactcgacgccgatggcgctgcaaccgcacaggatcgccaggctgcccgcgccacaggcgctggagggccagcgcctgctgaacaagaccggttccaccaacggcttcggcgcctacgtggcgttcgtcccgggccgcgacctgggcctggtgatcctggccaaccgcaactatcccaatgccgagcgggtgaagatcgcctacgccatcctcagcggcctggagcagcagggcaaggtgccgctgaagcgctga

SEQ ID NO: 48603 - protein, 397 aa, Pseudomonas aeruginosa
MRDTRFPCLCGIAASTLLFATTPAIAGEAPADRLKALVDAAVQPVMKANDIPGLAVAISLKGEPHYFSYGLASKEDGRRVTPETLFEIGSVSKTFTATLAGYALTQDKMRLDDRASQHWPALQGSRFDGISLLDLATYTAGGLPLQFPDSVQKDQAQIRDYYRQWQPTYAPGSQRLYSNPSIGLFGYLAARSLGQPFERLMEQQVFPALGLEQTHLDVPEAALAQYAQGYGKDDRPLRVGPGPLDAEGYGVKTSAADLLRFVDANLHPERLDRPWAQALDATHRGYYKVGDMTQGLGWEAYDWPISLKRLQAGNSTPMALQPHRIARLPAPQALEGQRLLNKTGSTNGFGAYVAFVPGRDLGLVILANRNYPNAERVKIAYAILSGLEQQGKVPLKR

SEQ ID NO: 48604 - DNA, 1167 bp, Yersinia enterocolitica
  CDS (1)..(1167)
atgatgaaaaagtctataatcaataccttgatctttacttctatcgcaactttcccactttataccttggcacaaaccaaacttacggagctgcaggttgcgactatcgtcaataacaccctgacgccgttgctcgaaaaacagggtattcccggtatggccgtcgcagtattttatgacggaaagccgcaattctttaactatggtatggcggatataaaagcaggtcgtccggtaaccgaaaatacactgtttgaactcggttcagtgagtaagacctttaccggcgtcgccggagaatatgccatgcagaccggtattatgaaccttaatgatcccgtgacggaatatgctcccgaactaacgggcagccagtggaaagatgtgaaaatgctgcatctggcgacgtacactgcgggtggacttcctctgcaactccccgattcggtgactgaccagaaatcattgtggcaatattatcaacaatggcagccacagtgggcacctggggtgatgcgtaattattctaatgccagcattgggctattcggtgcgctggcggtgaaaagaagccagttaacatttgaaaactatatgaaggaatatgtgttccaacctttaaaactggatcatacctttatcactatccccgaatccatgcagtcaaattatgcgtggggatataaagatggtcaaccagtgcgcgttaccttgggtatgctgggtgaggaagcctatggagtgaaatccacctcgcaagatatggtgagatttatgcaggccaatatggacccagaaagcttacctgccggtaacgataagctaaaagaagcgattatcgcatctcaatcacgttatttccaggcaggagatatgttccagggcttgggatgggaaatgtatagctggcctatcaatccacagggggtgattgccgatagtggcaatgatattgcgttaaaaccacgtaaggttgaggcattggtacctgcacaacctgctgtgcgagcatcctgggttcataagaccggtgcaaccaatggctttggcgcttatattgtattcatcccagaggagaaggttggcatagtgatgttagcgaacaagaattaccctaatccagtccgcgtacaagcagcatacgatattcttcaagcattgcgttga

SEQ ID NO: 48605 - protein, 388 aa, Yersinia enterocolitica
MMKKSIINTLIFTSIATFPLYTLAQTKLTELQVATIVNNTLTPLLEKQGIPGMAVAVFYDGKPQFFNYGMADIKAGRPVTENTLFELGSVSKTFTGVAGEYAMQTGIMNLNDPVTEYAPELTGSQWKDVKMLHLATYTAGGLPLQLPDSVTDQKSLWQYYQQWQPQWAPGVMRNYSNASIGLFGALAVKRSQLTFENYMKEYVFQPLKLDHTFITIPESMQSNYAWGYKDGQPVRVTLGMLGEEAYGVKSTSQDMVRFMQANMDPESLPAGNDKLKEAIIASQSRYFQAGDMFQGLGWEMYSWPINPQGVIADSGNDIALKPRKVEALVPAQPAVRASWVHKTGATNGFGAYIVFIPEEKVGIVMLANKNYPNPVRVQAAYDILQALR

SEQ ID NO: 48606 - DNA, 26 bp, Primer
atgaaacgtagtctgcttttttctgc

SEQ ID NO: 48607 - DNA, 23 bp, Primer
ttaggacgcggggataaccaacg

SEQ ID NO: 48608 - protein, 266 aa, consensus
  MISC_FEATURE (1)..(266): consensus for the disclosure of xaa see table XV
GXXXXXXXXXXXXXXXXXXXXXXXTXXXXXSXXKXXXXXXXXXXXXXXXXXXXXDXXXXXXPXXXXXXXXXXXXXXXXXXXXXXXXXXXXXXXXXXXXXXXLXXXXXGXXXXXXXXXXXXXXXXXXXXXXXXXXXXXXXXXXXXXXXXXXXXXXPGXXXXXYXXXXXXXXXXXXXXXXXXXXXXXXXXXXXXXXPLXXXXTXXXXXXXXXXXXXXXXXXXXXXXXXXXXXXXXXXXXXXXXXXXXXXXXXXXXXXXXXGXXXXXXD

SEQ ID NO: 48609 - protein, 84 aa, consensus
  MISC_FEATURE (1)..(84): consensus for the disclosure of xaa see table XV
XXXXXXSXXKXXXXXXXXXXXXXXXXXXXXXXXXXXXXXXXXXXXXXXXXXXXXXXXXXXXXXXXXXXXXXXXXXXXXXXXXXX

SEQ ID NO: 48610 - protein, 109 aa, consensus
  MISC_FEATURE (1)..(109): consensus for the disclosure of xaa see table XV
YXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 48611 - DNA, 1248 bp, Escherichia coli; identical to SEQ ID NO: 44655
  CDS (1)..(1248)

SEQ ID NO: 48612 - protein, 415 aa, Escherichia coli; identical to SEQ ID NO: 44656

SEQ ID NO: 48613 - DNA, 1239 bp, Vibrio cholerae O1 biovar eltor str. N16961; identical to SEQ ID NO: 44657
  CDS (1)..(1239)

SEQ ID NO: 48614 - protein, 412 aa, Vibrio cholerae O1 biovar eltor str. N16961; identical to SEQ ID NO: 44658

SEQ ID NO: 48615 - DNA, 1329 bp, Pseudomonas aeruginosa PAO1; identical to SEQ ID NO: 44659
  CDS (1)..(1329)

SEQ ID NO: 48616 - protein, 442 aa, Pseudomonas aeruginosa PAO1; identical to SEQ ID NO: 44660

SEQ ID NO: 48617 - DNA, 1248 bp, Salmonella typhimurium LT2; identical to SEQ ID NO: 44661
  CDS (1)..(1248)

SEQ ID NO: 48618 - protein, 415 aa, Salmonella typhimurium LT2; identical to SEQ ID NO: 44662

SEQ ID NO: 48619 - DNA, 1227 bp, Brucella melitensis 16M; identical to SEQ ID NO: 44663
  CDS (1)..(1227)

SEQ ID NO: 48620 - protein, 408 aa, Brucella melitensis 16M; identical to SEQ ID NO: 44664

SEQ ID NO: 48621 - DNA, 1248 bp, Chlorobium tepidum TLS; identical to SEQ ID NO: 44665
  CDS (1)..(1248)

SEQ ID NO: 48622 - protein, 415 aa, Chlorobium tepidum TLS; identical to SEQ ID NO: 44666

SEQ ID NO: 48623 - DNA, 1248 bp, Yersinia pestis KIM; identical to SEQ ID NO: 44667
  CDS (1)..(1248)

SEQ ID NO: 48624 - protein, 415 aa, Yersinia pestis KIM; identical to SEQ ID NO: 44668

SEQ ID NO: 48625 - DNA, 1032 bp, Shigella flexneri 2a str. 301; identical to SEQ ID NO: 44669
  CDS (1)..(1032)

SEQ ID NO: 48626 - protein, 343 aa, Shigella flexneri 2a str. 301; identical to SEQ ID NO: 44670

SEQ ID NO: 48627 - DNA, 1179 bp, Shewanella oneidensis MR-1; identical to SEQ ID NO: 44671
  CDS (1)..(1179)

SEQ ID NO: 48628 - protein, 392 aa, Shewanella oneidensis MR-1; identical to SEQ ID NO: 44672

SEQ ID NO: 48629 - DNA, 1302 bp, Pseudomonas putida KT2440; identical to SEQ ID NO: 44673
  CDS (1)..(1302)

SEQ ID NO: 48630 - protein, 433 aa, Pseudomonas putida KT2440; identical to SEQ ID NO: 44674

SEQ ID NO: 48631 - DNA, 1311 bp, Pseudomonas syringae pv. tomato str. DC3000; identical to SEQ ID NO: 44675
  CDS (1)..(1311)

SEQ ID NO: 48632 - protein, 436 aa, Pseudomonas syringae pv. tomato str. DC3000; identical to SEQ ID NO: 44676

SEQ ID NO: 48633 - DNA, 1098 bp, Vibrio parahaemolyticus RIMD 2210633; identical to SEQ ID NO: 44677
  CDS (1)..(1098)

SEQ ID NO: 48634 - protein, 365 aa, Vibrio parahaemolyticus RIMD 2210633; identical to SEQ ID NO: 44678

SEQ ID NO: 48635 - DNA, 1176 bp, Bacteroides thetaiotaomicron VPI-5482; identical to SEQ ID NO: 44679
  CDS (1)..(1176)

SEQ ID NO: 48636 - protein, 391 aa, Bacteroides thetaiotaomicron VPI-5482; identical to SEQ ID NO: 44680

SEQ ID NO: 48637 - DNA, 1332 bp, Bacteroides thetaiotaomicron VPI-5482; identical to SEQ ID NO: 44681
  CDS (1)..(1332)

SEQ ID NO: 48638 - protein, 443 aa, Bacteroides thetaiotaomicron VPI-5482; identical to SEQ ID NO: 44682

SEQ ID NO: 48639 - DNA, 1152 bp, Coxiella burnetii RSA 493; identical to SEQ ID NO: 44683
  CDS (1)..(1152)

SEQ ID NO: 48640 - protein, 383 aa, Coxiella burnetii RSA 493; identical to SEQ ID NO: 44684

SEQ ID NO: 48641 - DNA, 1347 bp, Bordetella bronchiseptica RB50; identical to SEQ ID NO: 44685
  CDS (1)..(1347)

SEQ ID NO: 48642 - protein, 448 aa, Bordetella bronchiseptica RB50; identical to SEQ ID NO: 44686

SEQ ID NO: 48643 - DNA, 1104 bp, Vibrio vulnificus YJ016; identical to SEQ ID NO: 44687
  CDS (1)..(1104)

SEQ ID NO: 48644 - protein, 367 aa, Vibrio vulnificus YJ016; identical to SEQ ID NO: 44688

SEQ ID NO: 48645 - DNA, 1863 bp, Rhodopseudomonas palustris CGA009; identical to SEQ ID NO: 44689
  CDS (1)..(1863)

SEQ ID NO: 48646 - protein, 620 aa, Rhodopseudomonas palustris CGA009; identical to SEQ ID NO: 44690

SEQ ID NO: 48647 - DNA, 1221 bp, Treponema denticola ATCC 35405; identical to SEQ ID NO: 44691
  CDS (1)..(1221)

SEQ ID NO: 48648 - protein, 406 aa, Treponema denticola ATCC 35405; identical to SEQ ID NO: 44692

SEQ ID NO: 48649 - DNA, 1218 bp, Bartonella henselae str. Houston-1; identical to SEQ ID NO: 44693
  CDS (1)..(1218)

SEQ ID NO: 48650 - protein, 405 aa, Bartonella henselae str. Houston-1; identical to SEQ ID NO: 44694

SEQ ID NO: 48651 - DNA, 1281 bp, Acinetobacter sp. ADP1; identical to SEQ ID NO: 44695
  CDS (1)..(1281)

SEQ ID NO: 48652 - protein, 426 aa, Acinetobacter sp. ADP1; identical to SEQ ID NO: 44696

SEQ ID NO: 48653 - DNA, 1275 bp, Erwinia carotovora subsp. atroseptica SCRI1043; identical to SEQ ID NO: 44697
  CDS (1)..(1275)

SEQ ID NO: 48654 - protein, 424 aa, Erwinia carotovora subsp. atroseptica SCRI1043; identical to SEQ ID NO: 44698

SEQ ID NO: 48655 - DNA, 1251 bp, Desulfotalea psychrophila LSv54; identical to SEQ ID NO: 44699
  CDS (1)..(1251)

SEQ ID NO: 48656 - protein, 416 aa, Desulfotalea psychrophila LSv54; identical to SEQ ID NO: 44700

SEQ ID NO: 48657 - DNA, 1167 bp, Rickettsia typhi str. Wilmington; identical to SEQ ID NO: 44701
  CDS (1)..(1167)

SEQ ID NO: 48658 - protein, 388 aa, Rickettsia typhi str. Wilmington; identical to SEQ ID NO: 44702

SEQ ID NO: 48659 - DNA, 1248 bp, Bacteroides fragilis YCH46; identical to SEQ ID NO: 44703
  CDS (1)..(1248)

SEQ ID NO: 48660 - protein, 415 aa, Bacteroides fragilis YCH46; identical to SEQ ID NO: 44704

SEQ ID NO: 48661 - DNA, 1170 bp, Bacteroides fragilis YCH46; identical to SEQ ID NO: 44705
  CDS (1)..(1170)

SEQ ID NO: 48662 - protein, 389 aa, Bacteroides fragilis YCH46; identical to SEQ ID NO: 44706

SEQ ID NO: 48663 - DNA, 1098 bp, Photobacterium profundum SS9; identical to SEQ ID NO: 44707
  CDS (1)..(1098)

SEQ ID NO: 48664 - protein, 365 aa, Photobacterium profundum SS9; identical to SEQ ID NO: 44708

SEQ ID NO: 48665 - DNA, 1272 bp, Idiomarina loihiensis L2TR; identical to SEQ ID NO: 44709
  CDS (1)..(1272)

SEQ ID NO: 48666 - protein, 423 aa, Idiomarina loihiensis L2TR; identical to SEQ ID NO: 44710

SEQ ID NO: 48667 - DNA, 1236 bp, Idiomarina loihiensis L2TR; identical to SEQ ID NO: 44711
  CDS (1)..(1236)

SEQ ID NO: 48668 - protein, 411 aa, Idiomarina loihiensis L2TR; identical to SEQ ID NO: 44712

SEQ ID NO: 48669 - DNA, 1257 bp, Azoarcus sp. EbN1; identical to SEQ ID NO: 44713
  CDS (1)..(1257)

SEQ ID NO: 48670 - protein, 418 aa, Azoarcus sp. EbN1; identical to SEQ ID NO: 44714

SEQ ID NO: 48671 - DNA, 1191 bp, Francisella tularensis subsp. tularensis Schu 4; identical to SEQ ID NO: 44715
  CDS (1)..(1191)

SEQ ID NO: 48672 - protein, 396 aa, Francisella tularensis subsp. tularensis Schu 4; identical to SEQ ID NO: 44716

SEQ ID NO: 48673 - DNA, 1332 bp, Xylella fastidiosa Ann-1; identical to SEQ ID NO: 44717
  CDS (1)..(1332)

SEQ ID NO: 48674 - protein, 443 aa, Xylella fastidiosa Ann-1; identical to SEQ ID NO: 44718

SEQ ID NO: 48675 - DNA, 1152 bp, Rickettsia sibirica 246; identical to SEQ ID NO: 44719
  CDS (1)..(1152)

SEQ ID NO: 48676 - protein, 383 aa, Rickettsia sibirica 246; identical to SEQ ID NO: 44720

SEQ ID NO: 48677 - DNA, 1953 bp, Psychrobacter sp. 273-4; identical to SEQ ID NO: 44721
  CDS (1)..(1953)

SEQ ID NO: 48678 - protein, 650 aa, Psychrobacter sp. 273-4; identical to SEQ ID NO: 44722

SEQ ID NO: 48679 - DNA, 1104 bp, Crocosphaera watsonii WH 8501; identical to SEQ ID NO: 44723
  CDS (1)..(1104)

SEQ ID NO: 48680 - protein, 367 aa, Crocosphaera watsonii WH 8501; identical to SEQ ID NO: 44724

SEQ ID NO: 48681 - DNA, 1251 bp, Burkholderia cepacia R18194; identical to SEQ ID NO: 44725
  CDS (1)..(1251)

SEQ ID NO: 48682 - protein, 416 aa, Burkholderia cepacia R18194; identical to SEQ ID NO: 44726

SEQ ID NO: 48683 - DNA, 1344 bp, Ralstonia metallidurans CH34; identical to SEQ ID NO: 44727
  CDS (1)..(1344)

SEQ ID NO: 48684 - protein, 447 aa, Ralstonia metallidurans CH34; identical to SEQ ID NO: 44728

SEQ ID NO: 48685 - DNA, 1110 bp, Microbulbifer degradans 2-40; identical to SEQ ID NO: 44729
  CDS (1)..(1110)

SEQ ID NO: 48686 - protein, 369 aa, Microbulbifer degradans 2-40; identical to SEQ ID NO: 44730

SEQ ID NO: 48687 - DNA, 1155 bp, Rickettsia akari str. Hartford; identical to SEQ ID NO: 44731
  CDS (1)..(1155)

SEQ ID NO: 48688 - protein, 384 aa, Rickettsia akari str. Hartford; identical to SEQ ID NO: 44732

SEQ ID NO: 48689 - DNA, 1188 bp, Methylobacillus flagellatus KT; identical to SEQ ID NO: 44733
  CDS (1)..(1188)

SEQ ID NO: 48690 - protein, 395 aa, Methylobacillus flagellatus KT; identical to SEQ ID NO: 44734

SEQ ID NO: 48691 - DNA, 25 bp, Primer
atgcaggatttaatatcccaggttg

SEQ ID NO: 48692 - DNA, 23 bp, Primer
ttactgcttaaatgcacccgcca

SEQ ID NO: 48693 - protein, 220 aa, consensus; identical to SEQ ID NO: 44737
  MISC_FEATURE (1)..(220): consensus for the disclosure of xaa see table XV

SEQ ID NO: 48694 - protein, 112 aa, consensus; identical to SEQ ID NO: 44738
  MISC_FEATURE (1)..(112): consensus for the disclosure of xaa see table XV

SEQ ID NO: 48695 - protein, 68 aa, consensus; identical to SEQ ID NO: 44739
  MISC_FEATURE (1)..(68): consensus for the disclosure of xaa see table XV

SEQ ID NO: 48696 - DNA, 258 bp, Escherichia coli; identical to SEQ ID NO: 44740
  CDS (1)..(258)

SEQ ID NO: 48697 - protein, 85 aa, Escherichia coli; identical to SEQ ID NO: 44741

SEQ ID NO: 48698 - DNA, 264 bp, Vibrio fischeri ES114; identical to SEQ ID NO: 44742
  CDS (1)..(264)

SEQ ID NO: 48699 - protein, 87 aa, Vibrio fischeri ES114; identical to SEQ ID NO: 44743

SEQ ID NO: 48700 - DNA, 288 bp, Vibrio fischeri ES114; identical to SEQ ID NO: 44744
  CDS (1)..(288)

SEQ ID NO: 48701 - protein, 95 aa, Vibrio fischeri ES114; identical to SEQ ID NO: 44745

SEQ ID NO: 48702 - DNA, 318 bp, Danio rerio; identical to SEQ ID NO: 44746
  CDS (1)..(318)

SEQ ID NO: 48703 - protein, 105 aa, Danio rerio; identical to SEQ ID NO: 44747

SEQ ID NO: 48704 - DNA, 393 bp, Arabidopsis thaliana; identical to SEQ ID NO: 6900
  CDS (1)..(393)

SEQ ID NO: 48705 - protein, 130 aa, Arabidopsis thaliana; identical to SEQ ID NO: 6901

SEQ ID NO: 48706 - DNA, 264 bp, Pasteurella multocida subsp. multocida str. Pm70; identical to SEQ ID NO: 44750
  CDS (1)..(264)

SEQ ID NO: 48707 - protein, 87 aa, Pasteurella multocida subsp. multocida str. Pm70; identical to SEQ ID NO: 44751

SEQ ID NO: 48708 - DNA, 309 bp, Rickettsia conorii str. Malish 7; identical to SEQ ID NO: 44752
  CDS (1)..(309)

SEQ ID NO: 48709 - protein, 102 aa, Rickettsia conorii str. Malish 7; identical to SEQ ID NO: 44753

SEQ ID NO: 48710 - DNA, 252 bp, Escherichia coli K12; identical to SEQ ID NO: 44754
  CDS (1)..(252)

SEQ ID NO: 48711 - protein, 83 aa, Escherichia coli K12; identical to SEQ ID NO: 44755

SEQ ID NO: 48712 - DNA, 255 bp, Caulobacter crescentus CB15; identical to SEQ ID NO: 44756
  CDS (1)..(255)

SEQ ID NO: 48713 - protein, 84 aa, Caulobacter crescentus CB15; identical to SEQ ID NO: 44757

SEQ ID NO: 48714 - DNA, 252 bp, Salmonella typhimurium LT2; identical to SEQ ID NO: 44758
  CDS (1)..(252)

SEQ ID NO: 48715 - protein, 83 aa, Salmonella typhimurium LT2; identical to SEQ ID NO: 44759

SEQ ID NO: 48716 - DNA, 258 bp, Ralstonia solanacearum GMI1000; identical to SEQ ID NO: 44760
  CDS (1)..(258)

SEQ ID NO: 48717 - protein, 85 aa, Ralstonia solanacearum GMI1000; identical to SEQ ID NO: 44761

SEQ ID NO: 48718 - DNA, 246 bp, Salmonella enterica subsp. enterica serovar Typhi str. CT18; identical to SEQ ID NO: 44762
  CDS (1)..(246)

SEQ ID NO: 48719 - protein, 81 aa, Salmonella enterica subsp. enterica serovar Typhi str. CT18; identical to SEQ ID NO: 44763

SEQ ID NO: 48720 - DNA, 264 bp, Yersinia pestis KIM; identical to SEQ ID NO: 44764
  CDS (1)..(264)

SEQ ID NO: 48721 - protein, 87 aa, Yersinia pestis KIM; identical to SEQ ID NO: 44765

SEQ ID NO: 48722 - DNA, 267 bp, Brucella suis 1330; identical to SEQ ID NO: 44766
  CDS (1)..(267)

SEQ ID NO: 48723 - protein, 88 aa, Brucella suis 1330; identical to SEQ ID NO: 44767

SEQ ID NO: 48724 - DNA, 252 bp, Shigella flexneri 2a str. 301; identical to SEQ ID NO: 44768
  CDS (1)..(252)

SEQ ID NO: 48725 - protein, 83 aa, Shigella flexneri 2a str. 301; identical to SEQ ID NO: 44769

SEQ ID NO: 48726 - DNA, 261 bp, Shewanella oneidensis MR-1; identical to SEQ ID NO: 44770
  CDS (1)..(261)

SEQ ID NO: 48727 - protein, 86 aa, Shewanella oneidensis MR-1; identical to SEQ ID NO: 44771

SEQ ID NO: 48728 - DNA, 255 bp, Pseudomonas putida KT2440; identical to SEQ ID NO: 44772
  CDS (1)..(255)

SEQ ID NO: 48729 - protein, 84 aa, Pseudomonas putida KT2440; identical to SEQ ID NO: 44773

SEQ ID NO: 48730 - DNA, 252 bp, Pseudomonas syringae pv. tomato str. DC3000; identical to SEQ ID NO: 44774
  CDS (1)..(252)

SEQ ID NO: 48731 - protein, 83 aa, Pseudomonas syringae pv. tomato str. DC3000; identical to SEQ ID NO: 44775

SEQ ID NO: 48732 - DNA, 258 bp, Nitrosomonas europaea ATCC 19718; identical to SEQ ID NO: 44776
  CDS (1)..(258)

SEQ ID NO: 48733 - protein, 85 aa, Nitrosomonas europaea ATCC 19718; identical to SEQ ID NO: 44777

SEQ ID NO: 48734 - DNA, 234 bp, Wigglesworthia glossinidia endosymbiont of Glossina brevipalpis; identical to SEQ ID NO: 44778
  CDS (1)..(234)

SEQ ID NO: 48735 - protein, 77 aa, Wigglesworthia glossinidia endosymbiont of Glossina brevipalpis; identical to SEQ ID NO: 44779

SEQ ID NO: 48736 - DNA, 264 bp, Haemophilus ducreyi 35000HP; identical to SEQ ID NO: 44780
  CDS (1)..(264)

SEQ ID NO: 48737 - protein, 87 aa, Haemophilus ducreyi 35000HP; identical to SEQ ID NO: 44781

SEQ ID NO: 48738 - DNA, 1803 bp, Danio rerio; identical to SEQ ID NO: 44782
  CDS (1)..(1803)

SEQ ID NO: 48739 - protein, 600 aa, Danio rerio; identical to SEQ ID NO: 44783

SEQ ID NO: 48740 - DNA, 261 bp, Photorhabdus luminescens subsp. laumondii TTO1; identical to SEQ ID NO: 44784
  CDS (1)..(261)

SEQ ID NO: 48741 - protein, 86 aa, Photorhabdus luminescens subsp. laumondii TTO1; identical to SEQ ID NO: 44785

SEQ ID NO: 48742 - DNA, 264 bp, Vibrio vulnificus YJ016; identical to SEQ ID NO: 44786
  CDS (1)..(264)

SEQ ID NO: 48743 - protein, 87 aa, Vibrio vulnificus YJ016; identical to SEQ ID NO: 44787

SEQ ID NO: 48744 - DNA, 339 bp, Wolbachia endosymbiont of Drosophila melanogaster; identical to SEQ ID NO: 44788
  CDS (1)..(339)

SEQ ID NO: 48745 - protein, 112 aa, Wolbachia endosymbiont of Drosophila melanogaster; identical to SEQ ID NO: 44789

SEQ ID NO: 48746 - DNA, 330 bp, Neurospora crassa; identical to SEQ ID NO: 6934
  CDS (1)..(330)

SEQ ID NO: 48747 - protein, 109 aa, Neurospora crassa; identical to SEQ ID NO: 6935

SEQ ID NO: 48748 - DNA, 309 bp, Magnaporthe grisea 70-15; identical to SEQ ID NO: 44792
  CDS (1)..(309)

SEQ ID NO: 48749 - protein, 102 aa, Magnaporthe grisea 70-15; identical to SEQ ID NO: 44793

SEQ ID NO: 48750 - DNA, 321 bp, Gibberella zeae PH-1; identical to SEQ ID NO: 44794
  CDS (1)..(321)

SEQ ID NO: 48751 - protein, 106 aa, Gibberella zeae PH-1; identical to SEQ ID NO: 44795

SEQ ID NO: 48752 - DNA, 309 bp, Ustilago maydis 521; identical to SEQ ID NO: 44796
  CDS (1)..(309)

SEQ ID NO: 48753 - protein, 102 aa, Ustilago maydis 521; identical to SEQ ID NO: 44797

SEQ ID NO: 48754 - DNA, 309 bp, Aspergillus nidulans FGSC A4; identical to SEQ ID NO: 44798
  CDS (1)..(309)

SEQ ID NO: 48755 - protein, 102 aa, Aspergillus nidulans FGSC A4; identical to SEQ ID NO: 44799

SEQ ID NO: 48756 - DNA, 342 bp, Debaryomyces hansenii CBS767; identical to SEQ ID NO: 44800
  CDS (1)..(342)

SEQ ID NO: 48757 - protein, 113 aa, Debaryomyces hansenii CBS767; identical to SEQ ID NO: 44801

SEQ ID NO: 48758 - DNA, 258 bp, Bartonella quintana str. Toulouse; identical to SEQ ID NO: 44802
  CDS (1)..(258)

SEQ ID NO: 48759 - protein, 85 aa, Bartonella quintana str. Toulouse; identical to SEQ ID NO: 44803

SEQ ID NO: 48760 - DNA, 258 bp, Acinetobacter sp. ADP1; identical to SEQ ID NO: 44804
  CDS (1)..(258)

SEQ ID NO: 48761 - protein, 85 aa, Acinetobacter sp. ADP1; identical to SEQ ID NO: 44805

SEQ ID NO: 48762 - DNA, 267 bp, Erwinia carotovora subsp. atroseptica SCRI1043; identical to SEQ ID NO: 44806
  CDS (1)..(267)

SEQ ID NO: 48763 - protein, 88 aa, Erwinia carotovora subsp. atroseptica SCRI1043; identical to SEQ ID NO: 44807

SEQ ID NO: 48764 - DNA, 315 bp, Rickettsia typhi str. Wilmington; identical to SEQ ID NO: 44808
  CDS (1)..(315)

SEQ ID NO: 48765 - protein, 104 aa, Rickettsia typhi str. Wilmington; identical to SEQ ID NO: 44809

SEQ ID NO: 48766 - DNA, 264 bp, Mannheimia succiniciproducens MBEL55E; identical to SEQ ID NO: 44810
  CDS (1)..(264)

SEQ ID NO: 48767 - protein, 87 aa, Mannheimia succiniciproducens MBEL55E; identical to SEQ ID NO: 44811

SEQ ID NO: 48768 - DNA, 255 bp, Legionella pneumophila subsp. pneumophila str. Philadelphia 1; identical to SEQ ID NO: 44812
  CDS (1)..(255)

SEQ ID NO: 48769 - protein, 84 aa, Legionella pneumophila subsp. pneumophila str. Philadelphia 1; identical to SEQ ID NO: 44813

SEQ ID NO: 48770 - DNA, 255 bp, Legionella pneumophila str. Lens; identical to SEQ ID NO: 44814
  CDS (1)..(255)

SEQ ID NO: 48771 - protein, 84 aa, Legionella pneumophila str. Lens; identical to SEQ ID NO: 44815

SEQ ID NO: 48772 - DNA, 279 bp, Photobacterium profundum SS9; identical to SEQ ID NO: 44816
  CDS (1)..(279)

SEQ ID NO: 48773 - protein, 92 aa, Photobacterium profundum SS9; identical to SEQ ID NO: 44817

SEQ ID NO: 48774 - DNA, 243 bp, Anaplasma marginale str. St. Maries; identical to SEQ ID NO: 44818
  CDS (1)..(243)

SEQ ID NO: 48775 - protein, 80 aa, Anaplasma marginale str. St. Maries; identical to SEQ ID NO: 44819

SEQ ID NO: 48776 - DNA, 267 bp, Idiomarina loihiensis L2TR; identical to SEQ ID NO: 44820
  CDS (1)..(267)

SEQ ID NO: 48777 - protein, 88 aa, Idiomarina loihiensis L2TR; identical to SEQ ID NO: 44821

SEQ ID NO: 48778 - DNA, 261 bp, Francisella tularensis subsp. tularensis Schu 4; identical to SEQ ID NO: 44822
  CDS (1)..(261)

SEQ ID NO: 48779 - protein, 86 aa, Francisella tularensis subsp. tularensis Schu 4; identical to SEQ ID NO: 44823

SEQ ID NO: 48780 - DNA, 264 bp, Synechococcus elongatus PCC 6301; identical to SEQ ID NO: 44824
  CDS (1)..(264)

SEQ ID NO: 48781 - protein, 87 aa, Synechococcus elongatus PCC 6301; identical to SEQ ID NO: 44825

SEQ ID NO: 48782 - DNA, 288 bp, Ehrlichia ruminantium str. Welgevonden; identical to SEQ ID NO: 44826
  CDS (1)..(288)

SEQ ID NO: 48783 - protein, 95 aa, Ehrlichia ruminantium str. Welgevonden; identical to SEQ ID NO: 44827

SEQ ID NO: 48784 - DNA, 255 bp, Azotobacter vinelandii; identical to SEQ ID NO: 44828
  CDS (1)..(255)

SEQ ID NO: 48785 - protein, 84 aa, Azotobacter vinelandii; identical to SEQ ID NO: 44829

SEQ ID NO: 48786 - DNA, 252 bp, Pseudomonas syringae pv. syringae B728a; identical to SEQ ID NO: 44830
  CDS (1)..(252)

SEQ ID NO: 48787 - protein, 83 aa, Pseudomonas syringae pv. syringae B728a; identical to SEQ ID NO: 44831

SEQ ID NO: 48788 - DNA, 264 bp, Actinobacillus pleuropneumoniae serovar 1 str. 4074; identical to SEQ ID NO: 44832
  CDS (1)..(264)

SEQ ID NO: 48789 - protein, 87 aa, Actinobacillus pleuropneumoniae serovar 1 str. 4074; identical to SEQ ID NO: 44833

SEQ ID NO: 48790 - DNA, 258 bp, Ralstonia eutropha JMP134; identical to SEQ ID NO: 44834
  CDS (1)..(258)

SEQ ID NO: 48791 - protein, 85 aa, Ralstonia eutropha JMP134; identical to SEQ ID NO: 44835

SEQ ID NO: 48792 - DNA, 246 bp, Ehrlichia canis str. Jake; identical to SEQ ID NO: 44836
  CDS (1)..(246)

SEQ ID NO: 48793 - protein, 81 aa, Ehrlichia canis str. Jake; identical to SEQ ID NO: 44837

SEQ ID NO: 48794 - DNA, 261 bp, Burkholderia cepacia R1808; identical to SEQ ID NO: 44838
  CDS (1)..(261)

SEQ ID NO: 48795 - protein, 86 aa, Burkholderia cepacia R1808; identical to SEQ ID NO: 44839

SEQ ID NO: 48796 - DNA, 267 bp, Rhodospirillum rubrum; identical to SEQ ID NO: 44840
  CDS (1)..(267)

SEQ ID NO: 48797 - protein, 88 aa, Rhodospirillum rubrum; identical to SEQ ID NO: 44841

SEQ ID NO: 48798 - DNA, 258 bp, Ralstonia metallidurans CH34; identical to SEQ ID NO: 44842
  CDS (1)..(258)

SEQ ID NO: 48799 - protein, 85 aa, Ralstonia metallidurans CH34; identical to SEQ ID NO: 44843

SEQ ID NO: 48800 - DNA, 243 bp, Novosphingobium aromaticivorans DSM 12444; identical to SEQ ID NO: 44844
  CDS (1)..(243)

SEQ ID NO: 48801 - protein, 80 aa, Novosphingobium aromaticivorans DSM 12444; identical to SEQ ID NO: 44845

SEQ ID NO: 48802 - DNA, 261 bp, Trichodesmium erythraeum IMS101; identical to SEQ ID NO: 44846
  CDS (1)..(261)

SEQ ID NO: 48803 - protein, 86 aa, Trichodesmium erythraeum IMS101; identical to SEQ ID NO: 44847

SEQ ID NO: 48804 - DNA, 294 bp, Rickettsia akari str. Hartford; identical to SEQ ID NO: 44848
  CDS (1)..(294)

SEQ ID NO: 48805 - protein, 97 aa, Rickettsia akari str. Hartford; identical to SEQ ID NO: 44849

SEQ ID NO: 48806 - DNA, 315 bp, Fritillaria agrestis; identical to SEQ ID NO: 44850
  CDS (1)..(315)

SEQ ID NO: 48807 - protein, 104 aa, Fritillaria agrestis; identical to SEQ ID NO: 6937

SEQ ID NO: 48808 - DNA, 411 bp, Oryza sativa; identical to SEQ ID NO: 44852
  CDS (1)..(411)

SEQ ID NO: 48809 - protein, 136 aa, Oryza sativa; identical to SEQ ID NO: 44853

SEQ ID NO: 48810 - DNA, 420 bp, Populus tremula x Populus tremuloides; identical to SEQ ID NO: 6960
  CDS (1)..(420)

SEQ ID NO: 48811 - protein, 139 aa, Populus tremula x Populus tremuloides; identical to SEQ ID NO: 6961

SEQ ID NO: 48812 - DNA, 342 bp, Deschampsia antarctica; identical to SEQ ID NO: 44856
  CDS (1)..(342)

SEQ ID NO: 48813 - protein, 113 aa, Deschampsia antarctica; identical to SEQ ID NO: 6967

SEQ ID NO: 48814 - DNA, 264 bp, Salmonella typhimurium; identical to SEQ ID NO: 44858
  CDS (1)..(264)

SEQ ID NO: 48815 - protein, 87 aa, Salmonella typhimurium; identical to SEQ ID NO: 44859

SEQ ID NO: 48816 - DNA, 306 bp, Schizosaccharomyces pombe; identical to SEQ ID NO: 44860
  CDS (1)..(306)

SEQ ID NO: 48817 - protein, 101 aa, Schizosaccharomyces pombe; identical to SEQ ID NO: 6925

SEQ ID NO: 48818 - DNA, 264 bp, Haemophilus influenzae; identical to SEQ ID NO: 44862
  CDS (1)..(264)

SEQ ID NO: 48819 - protein, 87 aa, Haemophilus influenzae; identical to SEQ ID NO: 44863

SEQ ID NO: 48820 - DNA, 255 bp, Pseudomonas aeruginosa; identical to SEQ ID NO: 44864
  CDS (1)..(255)

SEQ ID NO: 48821 - protein, 84 aa, Pseudomonas aeruginosa; identical to SEQ ID NO: 44865

SEQ ID NO: 48822 - DNA, 288 bp, Rickettsia prowazekii; identical to SEQ ID NO: 44866
  CDS (1)..(288)

SEQ ID NO: 48823 - protein, 95 aa, Rickettsia prowazekii; identical to SEQ ID NO: 44867

SEQ ID NO: 48824 - DNA, 264 bp, Vibrio cholerae; identical to SEQ ID NO: 44868
  CDS (1)..(264)

SEQ ID NO: 48825 - protein, 87 aa, Vibrio cholerae; identical to SEQ ID NO: 44869

SEQ ID NO: 48826 - DNA, 25 bp, Primer
atgcaaaccgttatttttggtcgtt

SEQ ID NO: 48827 - DNA, 25 bp, Primer
ttaggcgtccagattttctttcacc

SEQ ID NO: 48828 - protein, 64 aa, consensus; identical to SEQ ID NO: 44872
  MISC_FEATURE (1)..(64): consensus for the disclosure of xaa see table XV

SEQ ID NO: 48829 - protein, 73 aa, consensus; identical to SEQ ID NO: 44873
  MISC_FEATURE (1)..(73): consensus for the disclosure of xaa see table XV

SEQ ID NO: 48830 - DNA, 3369 bp, Escherichia coli; identical to SEQ ID NO: 45459
  CDS (1)..(3369)

SEQ ID NO: 48831 - protein, 1122 aa, Escherichia coli; identical to SEQ ID NO: 45460

SEQ ID NO: 48832 - DNA, 3375 bp, Pasteurella multocida subsp. multocida str. Pm70; identical to SEQ ID NO: 45461
  CDS (1)..(3375)

SEQ ID NO: 48833 - protein, 1124 aa, Pasteurella multocida subsp. multocida str. Pm70; identical to SEQ ID NO: 45462

SEQ ID NO: 48834 - DNA, 3366 bp, Xylella fastidiosa 9a5c; identical to SEQ ID NO: 45463
  CDS (1)..(3366)

SEQ ID NO: 48835 - protein, 1121 aa, Xylella fastidiosa 9a5c; identical to SEQ ID NO: 45464

SEQ ID NO: 48836 - DNA, 3372 bp, Yersinia pestis CO92; identical to SEQ ID NO: 45465
  CDS (1)..(3372)

SEQ ID NO: 48837 - protein, 1123 aa, Yersinia pestis CO92; identical to SEQ ID NO: 45466

SEQ ID NO: 48838 - DNA, 3405 bp, Xanthomonas campestris pv. campestris str. ATCC 33913; identical to SEQ ID NO: 45467
  CDS (1)..(3405)

SEQ ID NO: 48839 - protein, 1134 aa, Xanthomonas campestris pv. campestris str. ATCC 33913; identical to SEQ ID NO: 45468

SEQ ID NO: 48840 - DNA, 3198 bp, Chlorobium tepidum TLS; identical to SEQ ID NO: 45469
  CDS (1)..(3198)

SEQ ID NO: 48841 - protein, 1065 aa, Chlorobium tepidum TLS; identical to SEQ ID NO: 45470

SEQ ID NO: 48842 - DNA, 3501 bp, Oceanobacillus iheyensis HTE831; identical to SEQ ID NO: 45471
  CDS (1)..(3501)

SEQ ID NO: 48843 - protein, 1166 aa, Oceanobacillus iheyensis HTE831; identical to SEQ ID NO: 45472

SEQ ID NO: 48844 - DNA, 3813 bp, Shewanella oneidensis MR-1; identical to SEQ ID NO: 45473
  CDS (1)..(3813)

SEQ ID NO: 48845 - protein, 1270 aa, Shewanella oneidensis MR-1; identical to SEQ ID NO: 45474

SEQ ID NO: 48846 - DNA, 3483 bp, Pseudomonas putida KT2440; identical to SEQ ID NO: 45475
  CDS (1)..(3483)

SEQ ID NO: 48847 - protein, 1160 aa, Pseudomonas putida KT2440; identical to SEQ ID NO: 45476

SEQ ID NO: 48848 - DNA, 3489 bp, Vibrio vulnificus CMCP6; identical to SEQ ID NO: 45477
  CDS (1)..(3489)

SEQ ID NO: 48849 - protein, 1162 aa, Vibrio vulnificus CMCP6; identical to SEQ ID NO: 45478

SEQ ID NO: 48850 - DNA, 3477 bp, Pseudomonas syringae pv. tomato str. DC3000; identical to SEQ ID NO: 45479
  CDS (1)..(3477)

SEQ ID NO: 48851 - protein, 1158 aa, Pseudomonas syringae pv. tomato str. DC3000; identical to SEQ ID NO: 45480

SEQ ID NO: 48852 - DNA, 3492 bp, Vibrio parahaemolyticus RIMD 2210633; identical to SEQ ID NO: 45481
  CDS (1)..(3492)

SEQ ID NO: 48853 - protein, 1163 aa, Vibrio parahaemolyticus RIMD 2210633; identical to SEQ ID NO: 45482

SEQ ID NO: 48854 - DNA, 3372 bp, Salmonella enterica subsp. enterica serovar Typhi Ty2; identical to SEQ ID NO: 45483
  CDS (1)..(3372)

SEQ ID NO: 48855 - protein, 1123 aa, Salmonella enterica subsp. enterica serovar Typhi Ty2; identical to SEQ ID NO: 45484

SEQ ID NO: 48856 - DNA, 3294 bp, Mycobacterium bovis AF2122/97; identical to SEQ ID NO: 45485
  CDS (1)..(3294)

SEQ ID NO: 48857 - protein, 1097 aa, Mycobacterium bovis AF2122/97; identical to SEQ ID NO: 45486

SEQ ID NO: 48858 - DNA, 3342 bp, Haemophilus ducreyi 35000HP; identical to SEQ ID NO: 45487
  CDS (1)..(3342)

SEQ ID NO: 48859 - protein, 1113 aa, Haemophilus ducreyi 35000HP; identical to SEQ ID NO: 45488

SEQ ID NO: 48860 - DNA, 3312 bp, Prochlorococcus marinus subsp. marinus str. CCMP1375; identical to SEQ ID NO: 45489
  CDS (1)..(3312)

SEQ ID NO: 48861 - protein, 1103 aa, Prochlorococcus marinus subsp. marinus str. CCMP1375; identical to SEQ ID NO: 45490

SEQ ID NO: 48862 - DNA, 3420 bp, Candidatus Blochmannia floridanus; identical to SEQ ID NO: 45491
  CDS (1)..(3420)

SEQ ID NO: 48863 - protein, 1139 aa, Candidatus Blochmannia floridanus; identical to SEQ ID NO: 45492

SEQ ID NO: 48864 - DNA, 3174 bp, Prochlorococcus marinus subsp. pastoris str. CCMP1986; identical to SEQ ID NO: 45493
  CDS (1)..(3174)

SEQ ID NO: 48865 - protein, 1057 aa, Prochlorococcus marinus subsp. pastoris str. CCMP1986; identical to SEQ ID NO: 45494

SEQ ID NO: 48866 - DNA, 3198 bp, Chromobacterium violaceum ATCC 12472; identical to SEQ ID NO: 45495
  CDS (1)..(3198)

SEQ ID NO: 48867 - protein, 1065 aa, Chromobacterium violaceum ATCC 12472; identical to SEQ ID NO: 45496

SEQ ID NO: 48868 - DNA, 3390 bp, Photorhabdus luminescens subsp. laumondii TTO1; identical to SEQ ID NO: 45497
  CDS (1)..(3390)

SEQ ID NO: 48869 - protein, 1129 aa, Photorhabdus luminescens subsp. laumondii TTO1; identical to SEQ ID NO: 45498

SEQ ID NO: 48870 - DNA, 3291 bp, Mycobacterium avium subsp. paratuberculosis str. k10; identical to SEQ ID NO: 45499
  CDS (1)..(3291)

SEQ ID NO: 48871 - protein, 1096 aa, Mycobacterium avium subsp. paratuberculosis str. k10; identical to SEQ ID NO: 45500

SEQ ID NO: 48872 - DNA, 3399 bp, Leptospira interrogans serovar Copenhageni str. Fiocruz L1-130; identical to SEQ ID NO: 45501
  CDS (1)..(3399)

SEQ ID NO: 48873 - protein, 1132 aa, Leptospira interrogans serovar Copenhageni str. Fiocruz L1-130; identical to SEQ ID NO: 45502

SEQ ID NO: 48874 - DNA, 3588 bp, Parachlamydia sp. UWE25; identical to SEQ ID NO: 45503
  CDS (1)..(3588)

SEQ ID NO: 48875 - protein, 1195 aa, Parachlamydia sp. UWE25; identical to SEQ ID NO: 45504

SEQ ID NO: 48876 - DNA, 3666 bp, Acinetobacter sp. ADP1; identical to SEQ ID NO: 45505
  CDS (1)..(3666)

SEQ ID NO: 48877 - protein, 1221 aa, Acinetobacter sp. ADP1; identical to SEQ ID NO: 45506

SEQ ID NO: 48878 - DNA, 3399 bp, Erwinia carotovora subsp. atroseptica SCRI1043; identical to SEQ ID NO: 45507
  CDS (1)..(3399)

SEQ ID NO: 48879 - protein, 1132 aa, Erwinia carotovora subsp. atroseptica SCRI1043; identical to SEQ ID NO: 45508

SEQ ID NO: 48880 - DNA, 3150 bp, Propionibacterium acnes KPA171202; identical to SEQ ID NO: 45509
  CDS (1)..(3150)

SEQ ID NO: 48881 - protein, 1049 aa, Propionibacterium acnes KPA171202; identical to SEQ ID NO: 45510

SEQ ID NO: 48882 - DNA, 3171 bp, Desulfotalea psychrophila LSv54; identical to SEQ ID NO: 45511
  CDS (1)..(3171)

SEQ ID NO: 48883 - protein, 1056 aa, Desulfotalea psychrophila LSv54; identical to SEQ ID NO: 45512

SEQ ID NO: 48884 - DNA, 3504 bp, Mannheimia succiniciproducens MBEL55E; identical to SEQ ID NO: 45513
  CDS (1)..(3504)

SEQ ID NO: 48885 - protein, 1167 aa, Mannheimia succiniciproducens MBEL55E; identical to SEQ ID NO: 45514

SEQ ID NO: 48886 - DNA, 3345 bp, Burkholderia pseudomallei K96243; identical to SEQ ID NO: 45515
  CDS (1)..(3345)

SEQ ID NO: 48887 - protein, 1114 aa, Burkholderia pseudomallei K96243; identical to SEQ ID NO: 45516

SEQ ID NO: 48888 - DNA, 3417 bp, Methylococcus capsulatus str. Bath; identical to SEQ ID NO: 45517
  CDS (1)..(3417)

SEQ ID NO: 48889 - protein, 1138 aa, Methylococcus capsulatus str. Bath; identical to SEQ ID NO: 45518

SEQ ID NO: 48890 - DNA, 3339 bp, Nocardia farcinica IFM 10152; identical to SEQ ID NO: 45519
  CDS (1)..(3339)

SEQ ID NO: 48891 - protein, 1112 aa, Nocardia farcinica IFM 10152; identical to SEQ ID NO: 45520

SEQ ID NO: 48892 - DNA, 3480 bp, Photobacterium profundum SS9; identical to SEQ ID NO: 45521
  CDS (1)..(3480)

SEQ ID NO: 48893 - protein, 1159 aa, Photobacterium profundum SS9; identical to SEQ ID NO: 45522

SEQ ID NO: 48894 - DNA, 3468 bp, Idiomarina loihiensis L2TR; identical to SEQ ID NO: 45523
  CDS (1)..(3468)

SEQ ID NO: 48895 - protein, 1155 aa, Idiomarina loihiensis L2TR; identical to SEQ ID NO: 45524

SEQ ID NO: 48896 - DNA, 3369 bp, Azoarcus sp. EbN1; identical to SEQ ID NO: 45525
  CDS (1)..(3369)

SEQ ID NO: 48897 - protein, 1122 aa, Azoarcus sp. EbN1; identical to SEQ ID NO: 45526

SEQ ID NO: 48898 - DNA, 3240 bp, Francisella tularensis subsp. tularensis Schu 4; identical to SEQ ID NO: 45527
  CDS (1)..(3240)

SEQ ID NO: 48899 - protein, 1079 aa, Francisella tularensis subsp. tularensis Schu 4; identical to SEQ ID NO: 45528

SEQ ID NO: 48900 - DNA, 3507 bp, Azotobacter vinelandii; identical to SEQ ID NO: 45529
  CDS (1)..(3507)

SEQ ID NO: 48901 - protein, 1168 aa, Azotobacter vinelandii; identical to SEQ ID NO: 45530

SEQ ID NO: 48902 - DNA, 3435 bp, Haemophilus somnus 2336; identical to SEQ ID NO: 45531
  CDS (1)..(3435)

SEQ ID NO: 48903 - protein, 1144 aa, Haemophilus somnus 2336; identical to SEQ ID NO: 45532

SEQ ID NO: 48904 - DNA, 3345 bp, Actinobacillus pleuropneumoniae serovar 1 str. 4074; identical to SEQ ID NO: 45533
  CDS (1)..(3345)

SEQ ID NO: 48905 - protein, 1114 aa, Actinobacillus pleuropneumoniae serovar 1 str. 4074; identical to SEQ ID NO: 45534

SEQ ID NO: 48906 - DNA, 4539 bp, Psychrobacter sp. 273-4; identical to SEQ ID NO: 45535
  CDS (1)..(4539)

SEQ ID NO: 48907 - protein, 1512 aa, Psychrobacter sp. 273-4; identical to SEQ ID NO: 45536

SEQ ID NO: 48908 - DNA, 3381 bp, Haemophilus influenzae R2866; identical to SEQ ID NO: 45537
  CDS (1)..(3381)

SEQ ID NO: 48909 - protein, 1126 aa, Haemophilus influenzae R2866; identical to SEQ ID NO: 45538

SEQ ID NO: 48910 - DNA, 3339 bp, Burkholderia cepacia R18194; identical to SEQ ID NO: 45539
  CDS (1)..(3339)

SEQ ID NO: 48911 - protein, 1112 aa, Burkholderia cepacia R18194; identical to SEQ ID NO: 45540

SEQ ID NO: 48912 - DNA, 3603 bp, Burkholderia cepacia R1808; identical to SEQ ID NO: 45541
  CDS (1)..(3603)

SEQ ID NO: 48913 - protein, 1200 aa, Burkholderia cepacia R1808; identical to SEQ ID NO: 45542

SEQ ID NO: 48914 - DNA, 3453 bp, Pseudomonas fluorescens PfO-1; identical to SEQ ID NO: 45543
  CDS (1)..(3453)

SEQ ID NO: 48915 - protein, 1150 aa, Pseudomonas fluorescens PfO-1; identical to SEQ ID NO: 45544

SEQ ID NO: 48916 - DNA, 3384 bp, Burkholderia fungorum LB400; identical to SEQ ID NO: 45545
  CDS (1)..(3384)

SEQ ID NO: 48917 - protein, 1127 aa, Burkholderia fungorum LB400; identical to SEQ ID NO: 45546

SEQ ID NO: 48918 - DNA, 3183 bp, Geobacter metallireducens GS-15; identical to SEQ ID NO: 45547
  CDS (1)..(3183)

SEQ ID NO: 48919 - protein, 1060 aa, Geobacter metallireducens GS-15; identical to SEQ ID NO: 45548

SEQ ID NO: 48920 - DNA, 3195 bp, Geobacter sulfurreducens; identical to SEQ ID NO: 45549
  CDS (1)..(3195)

SEQ ID NO: 48921 - protein, 1064 aa, Geobacter sulfurreducens; identical to SEQ ID NO: 45550

SEQ ID NO: 48922 - DNA, 3450 bp, Pseudomonas syringae; identical to SEQ ID NO: 45551
  CDS (1)..(3450)

SEQ ID NO: 48923 - protein, 1149 aa, Pseudomonas syringae; identical to SEQ ID NO: 45552

SEQ ID NO: 48924 - DNA, 3258 bp, Mycobacterium smegmatis; identical to SEQ ID NO: 45553
  CDS (1)..(3258)

SEQ ID NO: 48925 - protein, 1085 aa, Mycobacterium smegmatis; identical to SEQ ID NO: 45554

SEQ ID NO: 48926 - DNA, 3213 bp, Buchnera aphidicola; identical to SEQ ID NO: 45555
  CDS (1)..(3213)

SEQ ID NO: 48927 - protein, 1070 aa, Buchnera aphidicola; identical to SEQ ID NO: 45556

SEQ ID NO: 48928 - DNA, 3186 bp, Buchnera aphidicola; identical to SEQ ID NO: 45557
  CDS (1)..(3186)

SEQ ID NO: 48929 - protein, 1061 aa, Buchnera aphidicola; identical to SEQ ID NO: 45558

SEQ ID NO: 48930 - DNA, 3336 bp, Buchnera aphidicola; identical to SEQ ID NO: 45559
  CDS (1)..(3336)

SEQ ID NO: 48931 - protein, 1111 aa, Buchnera aphidicola; identical to SEQ ID NO: 45560

SEQ ID NO: 48932 - DNA, 25 bp, Primer
atgttaagggtctaccattccaatc

SEQ ID NO: 48933 - DNA, 26 bp, Primer
ttatgactgattaaagcgaaacagcg

SEQ ID NO: 48934 - protein, 1491 aa, consensus; identical to SEQ ID NO: 45563
  MISC_FEATURE (1)..(1491): consensus for the disclosure of xaa see table XV

SEQ ID NO: 48935 - protein, 64 aa, consensus; identical to SEQ ID NO: 45564
  MISC_FEATURE (1)..(64): consensus for the disclosure of xaa see table XV

SEQ ID NO: 48936 - protein, 105 aa, consensus; identical to SEQ ID NO: 45565
  MISC_FEATURE (1)..(105): consensus for the disclosure of xaa see table XV

SEQ ID NO: 48937 - DNA, 336 bp, Escherichia coli
  CDS (1)..(336)
atgcccgctaatgctcgctctcacgctgtactgaccactgaatcaaaggtcacgatacgcggacaaacaactatccccgcgccagtgcgtgaggccttaaaactgaagccaggccaggacagcattcattacgaaattctgcctggtgggcaagtatttatgtgccgactgggagatgaacaggaggatcatactatgaatgcatttttgcgttttctggatgcagatatccagaacaacccgcaaaaaactcgtccattcaacattcaacaaggaaagaaacttgtcgctggcatggacgtcaacattgatgatgagattggcgacgacgaataa

SEQ ID NO: 48938 - protein, 111 aa, Escherichia coli
MPANARSHAVLTTESKVTIRGQTTIPAPVREALKLKPGQDSIHYEILPGGQVFMCRLGDEQEDHTMNAFLRFLDADIQNNPQKTRPFNIQQGKKLVAGMDVNIDDEIGDDE

SEQ ID NO: 48939 - DNA, 333 bp, Synechocystis sp. PCC 6803
  CDS (1)..(333)
atggcgggaatattatccccatgttcagaatctaccctgacggatcgctatcagaccacagtgcctgacccggttcgcaaagccttggggttgaataagcgagataaaatttgctacaccattgaagccgatggcagagtgtggattgccagggctgaacaggcagaaaatgatccggtgctggggaaatttttggattttttggcacaggatatggataaaaatcctcagcatatacaagcggtcagttctgagttggttgatcgtctgcaatcgctagtctccgatgttgatgtagatctagatgcgccattgctggacgaggatgaatag

SEQ ID NO: 48940 - protein, 110 aa, Synechocystis sp. PCC 6803
MAGILSPCSESTLTDRYQTTVPDPVRKALGLNKRDKICYTIEADGRVWIARAEQAENDPVLGKFLDFLAQDMDKNPQHIQAVSSELVDRLQSLVSDVDVDLDAPLLDEDE

SEQ ID NO: 48941 - DNA, 390 bp, Pseudomonas putida KT2440
  CDS (1)..(390)
ttgacaaggcaatgcaatcgcattaccttgagttgtatcgctgtcacccacaggacattactcatggctgccaccttcgacgtcgagtccacgctgaccgatcgctatcaaaccactgttcccgaaacggtgcggcgcgccttgggcttgaaaaaacgtgacaagatccattactcgattcgccccgacggtggggtgatactcacccgcgcagaggcaaccgaggacgatccggtactgggcaaatttctggatttcctggcacacgatatcgctaccaaccctcaacggctgcaggttgtcgatgctggcctcatcgcgcgcctcgacaagcttgtcggcgacgcggaggtcgacctggatcaacctctgtcggcggacgatgaatga

SEQ ID NO: 48942 - protein, 129 aa, Pseudomonas putida KT2440
MTRQCNRITLSCIAVTHRTLLMAATFDVESTLTDRYQTTVPETVRRALGLKKRDKIHYSIRPDGGVILTRAEATEDDPVLGKFLDFLAHDIATNPQRLQVVDAGLIARLDKLVGDAEVDLDQPLSADDE

SEQ ID NO: 48943 - DNA, 336 bp, Escherichia coli CFT073
  CDS (1)..(336)
atgcccgctaatgctcgctctaacgctgtactgaccactgaatcaaaggtcactatacgcggacaaacaactatccccgcgccagtgcgtgaggccttaaaactgaagcctggcctggacagcattcattacgaaattctgcctggtgggcaagtatttatgtgccgactgggagatgaacaggaggatcatactatgaatgcatttttgcgttttctggatgcagatatccagaacaacccgcaaaaaactcgtccattcgacattcaacaaggaaagaaacttgtcgctggcatggacgtcaacattgacgatgagattggcgacgacgaataa

SEQ ID NO: 48944 - protein, 111 aa, Escherichia coli CFT073
MPANARSNAVLTTESKVTIRGQTTIPAPVREALKLKPGLDSIHYEILPGGQVFMCRLGDEQEDHTMNAFLRFLDADIQNNPQKTRPFDIQQGKKLVAGMDVNIDDEIGDDE

SEQ ID NO: 48945 - DNA, 363 bp, Bradyrhizobium japonicum USDA 110
  CDS (1)..(363)
atgacgacgcaaggagccgctatggccaagaccgccgaaatcctcgagatccccgcgaccatcacagaccgcggccagacgaccgtgcccgccgccatccgcaaaatgctggccctgggaaagcgcgaccaggtcgtgtttcgggggctcgctgacggcaccgttgtgatcgcgaagaagcagttgagcgccgaccacggcgatccggtgatcggcacgttcctcgcgttcctggcccgcgacatggggagcgagccagcccggatccggccggtgccgaagtcgctggtcgcgcgcggcaagggcttggtcaagggtgttaaggtcgatctcgacgcggcgctgccggaagacgatacgtga

SEQ ID NO: 48946 - protein, 120 aa, Bradyrhizobium japonicum USDA 110
MTTQGAAMAKTAEILEIPATITDRGQTTVPAAIRKMLALGKRDQVVFRGLADGTVVIAKKQLSADHGDPVIGTFLAFLARDMGSEPARIRPVPKSLVARGKGLVKGVKVDLDAALPEDDT

SEQ ID NO: 48947 - DNA, 327 bp, Ruegeria sp. PR1b
  CDS (1)..(327)
atgacagcgctcgcacatgatgtctcgaaactcacggatcggtatcagacgaccgtgccggcgggtgtgcgcaagcagctcaagctgggcaagggcgaccagattcgctactgcaccgagccgagtggcagggtctatatcgagcccgtgcgcagcgacgatgaagatcccgtgctcggagcctttctcgattttgtcgaggcagatatcaaggcgcatccggaccgcattcgggcgttcgatggggctttgcatgaccgtcttgcagcactggtcggagacgttggcgtcgatctcgatgcgccgctatcgctcgaggatgaatga

SEQ ID NO: 48948 - protein, 108 aa, Ruegeria sp. PR1b
MTALAHDVSKLTDRYQTTVPAGVRKQLKLGKGDQIRYCTEPSGRVYIEPVRSDDEDPVLGAFLDFVEADIKAHPDRIRAFDGALHDRLAALVGDVGVDLDAPLSLEDE

SEQ ID NO: 48949 - DNA, 330 bp, Nitrosomonas europaea ATCC 19718
  CDS (1)..(330)
atgccaaccacccttgaaatcgaatccacgttgaccgaccgttaccagaccacagtgcctgaatccgtacgtcgcgcccttcaacttggtaagcgcgacaagattcactacaccatccgccccggcggcgaagtagtactgacccgtgctgaaccccctgaaggtgatgatccggtgatcggacagttcctgaccttcctggccctggacattgcaagccaccctgagcgcctgcaggctgtagatgccagcctcgtccagcatctgcaatctctggtcggtggcattcaagtcgatctcaatgctgctctgtcggtggatgatgcatga

SEQ ID NO: 48950 - protein, 109 aa, Nitrosomonas europaea ATCC 19718
MPTTLEIESTLTDRYQTTVPESVRRALQLGKRDKIHYTIRPGGEVVLTRAEPPEGDDPVIGQFLTFLALDIASHPERLQAVDASLVQHLQSLVGGIQVDLNAALSVDDA

SEQ ID NO: 48951 - DNA, 351 bp, Photorhabdus luminescens subsp. laumondii TTO1
  CDS (1)..(351)
atgcacgcattaccaaatgttgagttcgaggttggtgcagaatccaagcttaccagtcgcagccagacaaccatcccaacatctgtccgtaaagcgcttaagttaaaaccaggtcatgacagtatcgcatataagattttatcttctggtgatgtacttatcagccgtaaaaatagtgaagaagaaaaagatcttgtcatggaatcatttctggactttctggcaaaagacattcggagacatccgggacaagtacaacaattagatgaacaactcattaaccaggcgaagtcacttatcgctggaatagacatagatctgagcaacccattatctgctgacgatgagtaa

SEQ ID NO: 48952 - protein, 116 aa, Photorhabdus luminescens subsp. laumondii TTO1
MHALPNVEFEVGAESKLTSRSQTTIPTSVRKALKLKPGHDSIAYKILSSGDVLISRKNSEEEKDLVMESFLDFLAKDIRRHPGQVQQLDEQLINQAKSLIAGIDIDLSNPLSADDE

SEQ ID NO: 48953 - DNA, 318 bp, Pseudomonas aeruginosa
  CDS (1)..(318)
atgcctgagatccatgaaatcgccacgctgacctccaagggtcagattacgctgcccaagcccatccggcaggtgctgggtgtggacaccggcgcaaaggtggcttttgatctgcgcgcaggcgaagtcattgtgtcccgagcggacgctgagcatgaagacccggcgatcggagccttcctgggcctgttggaagcggacatccgggccggccggcatgtccaggcgctgccggaggatcttgcgcgggctatgctggcgaacgcgggccgggtggtgaatctcgatgaggatatcgaaggcgacgtggcgttgtga

SEQ ID NO: 48954 - protein, 105 aa, Pseudomonas aeruginosa
MPEIHEIATLTSKGQITLPKPIRQVLGVDTGAKVAFDLRAGEVIVSRADAEHEDPAIGAFLGLLEADIRAGRHVQALPEDLARAMLANAGRVVNLDEDIEGDVAL

SEQ ID NO: 48955 - DNA, 20 bp, Primer
atgcccgctaatgctcgctc

SEQ ID NO: 48956 - DNA, 24 bp, Primer
ttattcgtcgtcgccaatctcatc

SEQ ID NO: 48957 - protein, 89 aa, consensus
  MISC_FEATURE (1)..(89): consensus for the disclosure of xaa see table XV
TXRXQTTXPXXXRXXLXLXXXXDXXXXXXXXXGXVXXXXXXXXXXXXDXXXXXFLXFLXXDXXXXPXXXXXXXXXXXXXXXXLXXXXXV

SEQ ID NO: 48958 - protein, 102 aa, consensus
  MISC_FEATURE (1)..(102): consensus for the disclosure of xaa see table XV
XXXTXXXQXTXPXXXRXXLXXXXXXXXXXXXXXXXGXVXXXXXXXXXXXXDXXXXXFLXXXXXDXXXXXXXXXXXXXXXXXXXXXXXXXXXXXXXXXXXXXX

SEQ ID NO: 48959 - DNA, 927 bp, Escherichia coli K12; identical to SEQ ID NO: 27377
  CDS (1)..(927)

SEQ ID NO: 48960 - protein, 308 aa, Escherichia coli K12; identical to SEQ ID NO: 27378

SEQ ID NO: 48961 - DNA, 1017 bp, Archaeoglobus fulgidus; identical to SEQ ID NO: 27379
  CDS (1)..(1017)

SEQ ID NO: 48962 - protein, 338 aa, Archaeoglobus fulgidus; identical to SEQ ID NO: 27380

SEQ ID NO: 48963 - DNA, 894 bp, Archaeoglobus fulgidus; identical to SEQ ID NO: 27381
  CDS (1)..(894)

SEQ ID NO: 48964 - protein, 297 aa, Archaeoglobus fulgidus; identical to SEQ ID NO: 27382

SEQ ID NO: 48965 - DNA, 1278 bp, Pseudomonas aeruginosa; identical to SEQ ID NO: 27383
  CDS (1)..(1278)

SEQ ID NO: 48966 - protein, 425 aa, Pseudomonas aeruginosa; identical to SEQ ID NO: 27384

SEQ ID NO: 48967 - DNA, 957 bp, Streptococcus pneumoniae; identical to SEQ ID NO: 27385
  CDS (1)..(957)

SEQ ID NO: 48968 - protein, 318 aa, Streptococcus pneumoniae; identical to SEQ ID NO: 27386

SEQ ID NO: 48969 - DNA, 999 bp, Brucella melitensis; identical to SEQ ID NO: 27387
  CDS (1)..(999)

SEQ ID NO: 48970 - protein, 332 aa, Brucella melitensis; identical to SEQ ID NO: 27388

SEQ ID NO: 48971 - DNA, 942 bp, Agrobacterium tumefaciens; identical to SEQ ID NO: 27389
  CDS (1)..(942)

SEQ ID NO: 48972 - protein, 313 aa, Agrobacterium tumefaciens; identical to SEQ ID NO: 27390

SEQ ID NO: 48973 - DNA, 897 bp, Agrobacterium tumefaciens; identical to SEQ ID NO: 27391
  CDS (1)..(897)

SEQ ID NO: 48974 - protein, 298 aa, Agrobacterium tumefaciens; identical to SEQ ID NO: 27392

SEQ ID NO: 48975 - DNA, 1035 bp, Agrobacterium tumefaciens; identical to SEQ ID NO: 27393
  CDS (1)..(1035)

SEQ ID NO: 48976 - protein, 344 aa, Agrobacterium tumefaciens; identical to SEQ ID NO: 27394

SEQ ID NO: 48977 - DNA, 864 bp, Brucella melitensis; identical to SEQ ID NO: 27395
  CDS (1)..(864)

SEQ ID NO: 48978 - protein, 287 aa, Brucella melitensis; identical to SEQ ID NO: 27396

SEQ ID NO: 48979 - DNA, 924 bp, Brucella melitensis; identical to SEQ ID NO: 27397
  CDS (1)..(924)

SEQ ID NO: 48980 - protein, 307 aa, Brucella melitensis; identical to SEQ ID NO: 27398

SEQ ID NO: 48981 - DNA, 927 bp, Yersinia pestis; identical to SEQ ID NO: 27399
  CDS (1)..(927)

SEQ ID NO: 48982 - protein, 308 aa, Yersinia pestis; identical to SEQ ID NO: 27400

SEQ ID NO: 48983 - DNA, 867 bp, Nostoc sp. PCC 7120; identical to SEQ ID NO: 27401
  CDS (1)..(867)

SEQ ID NO: 48984 - protein, 288 aa, Nostoc sp. PCC 7120; identical to SEQ ID NO: 27402

SEQ ID NO: 48985 - DNA, 951 bp, Nostoc sp. PCC 7120; identical to SEQ ID NO: 27403
  CDS (1)..(951)

SEQ ID NO: 48986 - protein, 316 aa, Nostoc sp. PCC 7120; identical to SEQ ID NO: 27404

SEQ ID NO: 48987 - DNA, 903 bp, Agrobacterium tumefaciens; identical to SEQ ID NO: 27405
  CDS (1)..(903)

SEQ ID NO: 48988 - protein, 300 aa, Agrobacterium tumefaciens; identical to SEQ ID NO: 27406

SEQ ID NO: 48989 - DNA, 924 bp, Pseudomonas aeruginosa; identical to SEQ ID NO: 27407
  CDS (1)..(924)

SEQ ID NO: 48990 - protein, 307 aa, Pseudomonas aeruginosa; identical to SEQ ID NO: 27408

SEQ ID NO: 48991 - DNA, 798 bp, Aeropyrum pernix; identical to SEQ ID NO: 27409
  CDS (1)..(798)

SEQ ID NO: 48992 - protein, 265 aa, Aeropyrum pernix; identical to SEQ ID NO: 27410

SEQ ID NO: 48993 - DNA, 885 bp, Aeropyrum pernix; identical to SEQ ID NO: 27411
  CDS (1)..(885)

SEQ ID NO: 48994 - protein, 294 aa, Aeropyrum pernix; identical to SEQ ID NO: 27412

SEQ ID NO: 48995 - DNA, 1065 bp, Aeropyrum pernix; identical to SEQ ID NO: 27413
  CDS (1)..(1065)

SEQ ID NO: 48996 - protein, 354 aa, Aeropyrum pernix; identical to SEQ ID NO: 27414

SEQ ID NO: 48997 - DNA, 1047 bp, Deinococcus radiodurans; identical to SEQ ID NO: 27415
  CDS (1)..(1047)

SEQ ID NO: 48998 - protein, 348 aa, Deinococcus radiodurans; identical to SEQ ID NO: 27416

SEQ ID NO: 48999 - DNA, 918 bp, Pseudomonas aeruginosa; identical to SEQ ID NO: 27417
  CDS (4)..(918)

SEQ ID NO: 49000 - protein, 304 aa, Pseudomonas aeruginosa; identical to SEQ ID NO: 27418

SEQ ID NO: 49001 - DNA, 954 bp, Pseudomonas aeruginosa; identical to SEQ ID NO: 27419
  CDS (1)..(954)

SEQ ID NO: 49002 - protein, 317 aa, Pseudomonas aeruginosa; identical to SEQ ID NO: 27420

SEQ ID NO: 49003 - DNA, 894 bp, Bacillus halodurans; identical to SEQ ID NO: 27421
  CDS (1)..(894)

SEQ ID NO: 49004 - protein, 297 aa, Bacillus halodurans; identical to SEQ ID NO: 27422

SEQ ID NO: 49005 - DNA, 1254 bp, Pseudomonas aeruginosa; identical to SEQ ID NO: 27423
  CDS (1)..(1254)

SEQ ID NO: 49006 - protein, 417 aa, Pseudomonas aeruginosa; identical to SEQ ID NO: 27424

SEQ ID NO: 49007 - DNA, 936 bp, Agrobacterium tumefaciens; identical to SEQ ID NO: 27425
  CDS (1)..(936)

SEQ ID NO: 49008 - protein, 311 aa, Agrobacterium tumefaciens; identical to SEQ ID NO: 27426

SEQ ID NO: 49009 - DNA, 948 bp, Methanococcus jannaschii; identical to SEQ ID NO: 27427
  CDS (1)..(948)

SEQ ID NO: 49010 - protein, 315 aa, Methanococcus jannaschii; identical to SEQ ID NO: 27428

SEQ ID NO: 49011 - DNA, 900 bp, Thermotoga maritima; identical to SEQ ID NO: 27429
  CDS (1)..(900)

SEQ ID NO: 49012 - protein, 299 aa, Thermotoga maritima; identical to SEQ ID NO: 27430

SEQ ID NO: 49013 - DNA, 1614 bp, Sinorhizobium meliloti; identical to SEQ ID NO: 27431
  CDS (1)..(1614)

SEQ ID NO: 49014 - protein, 537 aa, Sinorhizobium meliloti; identical to SEQ ID NO: 27432

SEQ ID NO: 49015 - DNA, 1080 bp, Thermotoga maritima; identical to SEQ ID NO: 27433
  CDS (1)..(1080)

SEQ ID NO: 49016 - protein, 359 aa, Thermotoga maritima; identical to SEQ ID NO: 27434

SEQ ID NO: 49017 - DNA, 858 bp, Deinococcus radiodurans; identical to SEQ ID NO: 27435
  CDS (1)..(858)

SEQ ID NO: 49018 - protein, 285 aa, Deinococcus radiodurans; identical to SEQ ID NO: 27436

SEQ ID NO: 49019 - DNA, 1053 bp, Campylobacter jejuni; identical to SEQ ID NO: 27437
  CDS (1)..(1053)

SEQ ID NO: 49020 - protein, 350 aa, Campylobacter jejuni; identical to SEQ ID NO: 27438

SEQ ID NO: 49021 - DNA, 918 bp, Sulfolobus solfataricus; identical to SEQ ID NO: 27439
  CDS (1)..(918)

SEQ ID NO: 49022 - protein, 305 aa, Sulfolobus solfataricus; identical to SEQ ID NO: 27440

SEQ ID NO: 49023 - DNA, 1050 bp, Deinococcus radiodurans; identical to SEQ ID NO: 27441
  CDS (1)..(1050)

SEQ ID NO: 49024 - protein, 349 aa, Deinococcus radiodurans; identical to SEQ ID NO: 27442

SEQ ID NO: 49025 - DNA, 903 bp, Deinococcus radiodurans; identical to SEQ ID NO: 27443
  CDS (1)..(903)

SEQ ID NO: 49026 - protein, 300 aa, Deinococcus radiodurans; identical to SEQ ID NO: 27444

SEQ ID NO: 49027 - DNA, 897 bp, Campylobacter jejuni; identical to SEQ ID NO: 27445
  CDS (1)..(897)

SEQ ID NO: 49028 - protein, 298 aa, Campylobacter jejuni; identical to SEQ ID NO: 27446

SEQ ID NO: 49029 - DNA, 939 bp, Archaeoglobus fulgidus; identical to SEQ ID NO: 27447
  CDS (1)..(939)

SEQ ID NO: 49030 - protein, 312 aa, Archaeoglobus fulgidus; identical to SEQ ID NO: 27448

SEQ ID NO: 49031 - DNA, 1071 bp, Deinococcus radiodurans; identical to SEQ ID NO: 27449
  CDS (1)..(1071)

SEQ ID NO: 49032 - protein, 356 aa, Deinococcus radiodurans; identical to SEQ ID NO: 27450

SEQ ID NO: 49033 - DNA, 864 bp, Sinorhizobium meliloti; identical to SEQ ID NO: 27451
  CDS (1)..(864)

SEQ ID NO: 49034 - protein, 287 aa, Sinorhizobium meliloti; identical to SEQ ID NO: 27452

SEQ ID NO: 49035 - DNA, 855 bp, Archaeoglobus fulgidus; identical to SEQ ID NO: 27453
  CDS (1)..(855)

SEQ ID NO: 49036 - protein, 284 aa, Archaeoglobus fulgidus; identical to SEQ ID NO: 27454

SEQ ID NO: 49037 - DNA, 972 bp, Archaeoglobus fulgidus; identical to SEQ ID NO: 27455
  CDS (1)..(972)

SEQ ID NO: 49038 - protein, 323 aa, Archaeoglobus fulgidus; identical to SEQ ID NO: 27456

SEQ ID NO: 49039 - DNA, 870 bp, Streptococcus pneumoniae; identical to SEQ ID NO: 27457
  CDS (1)..(870)

SEQ ID NO: 49040 - protein, 289 aa, Streptococcus pneumoniae; identical to SEQ ID NO: 27458

SEQ ID NO: 49041 - DNA, 888 bp, Agrobacterium tumefaciens; identical to SEQ ID NO: 27459
  CDS (1)..(888)

SEQ ID NO: 49042 - protein, 295 aa, Agrobacterium tumefaciens; identical to SEQ ID NO: 27460

SEQ ID NO: 49043 - DNA, 1278 bp, Escherichia coli; identical to SEQ ID NO: 27461
  CDS (1)..(1278)

SEQ ID NO: 49044 - protein, 425 aa, Escherichia coli; identical to SEQ ID NO: 27462

SEQ ID NO: 49045 - DNA, 861 bp, Synechocystis sp; identical to SEQ ID NO: 27463
  CDS (1)..(861)

SEQ ID NO: 49046 - protein, 286 aa, Synechocystis sp; identical to SEQ ID NO: 27464

SEQ ID NO: 49047 - DNA, 1167 bp, Synechocystis sp; identical to SEQ ID NO: 27465
  CDS (1)..(1167)

SEQ ID NO: 49048 - protein, 388 aa, Synechocystis sp; identical to SEQ ID NO: 27466

SEQ ID NO: 49049 - DNA, 1233 bp, Synechocystis sp; identical to SEQ ID NO: 27467
  CDS (1)..(1233)

SEQ ID NO: 49050 - protein, 410 aa, Synechocystis sp; identical to SEQ ID NO: 27468

SEQ ID NO: 49051 - DNA, 933 bp, Streptomyces coelicolor; identical to SEQ ID NO: 27469
  CDS (1)..(933)

SEQ ID NO: 49052 - protein, 310 aa, Streptomyces coelicolor; identical to SEQ ID NO: 27470

SEQ ID NO: 49053 - DNA, 861 bp, Rhodopseudomonas palustris; identical to SEQ ID NO: 27471
  CDS (1)..(861)

SEQ ID NO: 49054 - protein, 286 aa, Rhodopseudomonas palustris; identical to SEQ ID NO: 27472

SEQ ID NO: 49055 - DNA, 918 bp, Methylophilus methylotrophus; identical to SEQ ID NO: 27473
  CDS (1)..(918)

SEQ ID NO: 49056 - protein, 305 aa, Methylophilus methylotrophus; identical to SEQ ID NO: 27474

SEQ ID NO: 49057 - DNA, 1845 bp, Pseudomonas aeruginosa; identical to SEQ ID NO: 27475
  CDS (1)..(1845)

SEQ ID NO: 49058 - protein, 614 aa, Pseudomonas aeruginosa; identical to SEQ ID NO: 27476

SEQ ID NO: 49059 - DNA, 1860 bp, Symbiobacterium thermophilum; identical to SEQ ID NO: 27477
  CDS (1)..(1860)

SEQ ID NO: 49060 - protein, 619 aa, Symbiobacterium thermophilum; identical to SEQ ID NO: 27478

SEQ ID NO: 49061 - DNA, 1050 bp, Symbiobacterium thermophilum; identical to SEQ ID NO: 27479
  CDS (1)..(1050)

SEQ ID NO: 49062 - protein, 349 aa, Symbiobacterium thermophilum; identical to SEQ ID NO: 27480

SEQ ID NO: 49063 - DNA, 870 bp, Symbiobacterium thermophilum; identical to SEQ ID NO: 27481
  CDS (1)..(870)

SEQ ID NO: 49064 - protein, 289 aa, Symbiobacterium thermophilum; identical to SEQ ID NO: 27482

SEQ ID NO: 49065 - DNA, 1026 bp, Symbiobacterium thermophilum; identical to SEQ ID NO: 27483
  CDS (1)..(1026)

SEQ ID NO: 49066 - protein, 341 aa, Symbiobacterium thermophilum; identical to SEQ ID NO: 27484

SEQ ID NO: 49067 - DNA, 1068 bp, Desulfotalea psychrophila; identical to SEQ ID NO: 27485
  CDS (1)..(1068)

SEQ ID NO: 49068 - protein, 355 aa, Desulfotalea psychrophila; identical to SEQ ID NO: 27486

SEQ ID NO: 49069 - DNA, 891 bp, Desulfotalea psychrophila; identical to SEQ ID NO: 27487
  CDS (1)..(891)

SEQ ID NO: 49070 - protein, 296 aa, Desulfotalea psychrophila; identical to SEQ ID NO: 27488

SEQ ID NO: 49071 - DNA, 882 bp, Acinetobacter sp; identical to SEQ ID NO: 27489
  CDS (1)..(882)

SEQ ID NO: 49072 - protein, 293 aa, Acinetobacter sp; identical to SEQ ID NO: 27490

SEQ ID NO: 49073 - DNA, 1647 bp, Acinetobacter sp; identical to SEQ ID NO: 27491
  CDS (1)..(1647)

SEQ ID NO: 49074 - protein, 548 aa, Acinetobacter sp; identical to SEQ ID NO: 27492

SEQ ID NO: 49075 - DNA, 1059 bp, Bartonella quintana; identical to SEQ ID NO: 27493
  CDS (1)..(1059)

SEQ ID NO: 49076 - protein, 352 aa, Bartonella quintana; identical to SEQ ID NO: 27494

SEQ ID NO: 49077 - DNA, 1065 bp, Bartonella quintana; identical to SEQ ID NO: 27495
  CDS (1)..(1065)

SEQ ID NO: 49078 - protein, 354 aa, Bartonella quintana; identical to SEQ ID NO: 27496

SEQ ID NO: 49079 - DNA, 1065 bp, Bartonella henselae; identical to SEQ ID NO: 27497
  CDS (1)..(1065)

SEQ ID NO: 49080 - protein, 354 aa, Bartonella henselae; identical to SEQ ID NO: 27498

SEQ ID NO: 49081 - DNA, 1059 bp, Bartonella henselae; identical to SEQ ID NO: 27499
  CDS (1)..(1059)

SEQ ID NO: 49082 - protein, 352 aa, Bartonella henselae; identical to SEQ ID NO: 27500

SEQ ID NO: 49083 - DNA, 861 bp, Bacillus thuringiensis; identical to SEQ ID NO: 27501
  CDS (1)..(861)

SEQ ID NO: 49084 - protein, 286 aa, Bacillus thuringiensis; identical to SEQ ID NO: 27502

SEQ ID NO: 49085 - DNA, 972 bp, Bdellovibrio bacteriovorus; identical to SEQ ID NO: 27503
  CDS (1)..(972)

SEQ ID NO: 49086 - protein, 323 aa, Bdellovibrio bacteriovorus; identical to SEQ ID NO: 27504

SEQ ID NO: 49087 - DNA, 903 bp, Bdellovibrio bacteriovorus; identical to SEQ ID NO: 27505
  CDS (1)..(903)

SEQ ID NO: 49088 - protein, 300 aa, Bdellovibrio bacteriovorus; identical to SEQ ID NO: 27506

SEQ ID NO: 49089 - DNA, 1068 bp, Rhodopseudomonas palustris; identical to SEQ ID NO: 27507
  CDS (1)..(1068)

SEQ ID NO: 49090 - protein, 355 aa, Rhodopseudomonas palustris; identical to SEQ ID NO: 27508

SEQ ID NO: 49091 - DNA, 939 bp, Rhodopseudomonas palustris; identical to SEQ ID NO: 27509
  CDS (1)..(939)

SEQ ID NO: 49092 - protein, 312 aa, Rhodopseudomonas palustris; identical to SEQ ID NO: 27510

SEQ ID NO: 49093 - DNA, 948 bp, Rhodopseudomonas palustris; identical to SEQ ID NO: 27511
  CDS (1)..(948)

SEQ ID NO: 49094 - protein, 315 aa, Rhodopseudomonas palustris; identical to SEQ ID NO: 27512

SEQ ID NO: 49095 - DNA, 948 bp, Rhodopseudomonas palustris; identical to SEQ ID NO: 27513
  CDS (1)..(948)

SEQ ID NO: 49096 - protein, 315 aa, Rhodopseudomonas palustris; identical to SEQ ID NO: 27514

SEQ ID NO: 49097 - DNA, 873 bp, Rhodopseudomonas palustris; identical to SEQ ID NO: 27515
  CDS (1)..(873)

SEQ ID NO: 49098 - protein, 290 aa, Rhodopseudomonas palustris; identical to SEQ ID NO: 27516

SEQ ID NO: 49099 - DNA, 918 bp, Rhodopseudomonas palustris; identical to SEQ ID NO: 27517
  CDS (1)..(918)

SEQ ID NO: 49100 - protein, 305 aa, Rhodopseudomonas palustris; identical to SEQ ID NO: 27518

SEQ ID NO: 49101 - DNA, 1614 bp, Rhodopseudomonas palustris; identical to SEQ ID NO: 27519
  CDS (1)..(1614)

SEQ ID NO: 49102 - protein, 537 aa, Rhodopseudomonas palustris; identical to SEQ ID NO: 27520

SEQ ID NO: 49103 - DNA, 1008 bp, Rhodopseudomonas palustris; identical to SEQ ID NO: 27521
  CDS (1)..(1008)

SEQ ID NO: 49104 - protein, 335 aa, Rhodopseudomonas palustris; identical to SEQ ID NO: 27522

SEQ ID NO: 49105 - DNA, 873 bp, Rhodopseudomonas palustris; identical to SEQ ID NO: 27523
  CDS (1)..(873)

SEQ ID NO: 49106 - protein, 290 aa, Rhodopseudomonas palustris; identical to SEQ ID NO: 27524

SEQ ID NO: 49107 - DNA, 876 bp, Rhodopseudomonas palustris; identical to SEQ ID NO: 27525
  CDS (1)..(876)

SEQ ID NO: 49108 - protein, 291 aa, Rhodopseudomonas palustris; identical to SEQ ID NO: 27526

SEQ ID NO: 49109 - DNA, 1041 bp, Rhodopseudomonas palustris; identical to SEQ ID NO: 27527
  CDS (1)..(1041)

SEQ ID NO: 49110 - protein, 346 aa, Rhodopseudomonas palustris; identical to SEQ ID NO: 27528

SEQ ID NO: 49111 - DNA, 1773 bp, Rhodopseudomonas palustris; identical to SEQ ID NO: 27529
  CDS (1)..(1773)

SEQ ID NO: 49112 - protein, 590 aa, Rhodopseudomonas palustris; identical to SEQ ID NO: 27530

SEQ ID NO: 49113 - DNA, 834 bp, Rhodopseudomonas palustris; identical to SEQ ID NO: 27531
  CDS (1)..(834)

SEQ ID NO: 49114 - protein, 277 aa, Rhodopseudomonas palustris; identical to SEQ ID NO: 27532

SEQ ID NO: 49115 - DNA, 876 bp, Rhodopseudomonas palustris; identical to SEQ ID NO: 27533
  CDS (1)..(876)

SEQ ID NO: 49116 - protein, 291 aa, Rhodopseudomonas palustris; identical to SEQ ID NO: 27534

SEQ ID NO: 49117 - DNA, 876 bp, Rhodopseudomonas palustris; identical to SEQ ID NO: 27535
  CDS (1)..(876)

SEQ ID NO: 49118 - protein, 291 aa, Rhodopseudomonas palustris; identical to SEQ ID NO: 27536

SEQ ID NO: 49119 - DNA, 864 bp, Rhodopseudomonas palustris; identical to SEQ ID NO: 27537
  CDS (1)..(864)

SEQ ID NO: 49120 - protein, 287 aa, Rhodopseudomonas palustris; identical to SEQ ID NO: 27538

SEQ ID NO: 49121 - DNA, 927 bp, Rhodopseudomonas palustris; identical to SEQ ID NO: 27539
  CDS (1)..(927)

SEQ ID NO: 49122 - protein, 308 aa, Rhodopseudomonas palustris; identical to SEQ ID NO: 27540

SEQ ID NO: 49123 - DNA, 873 bp, Rhodopseudomonas palustris; identical to SEQ ID NO: 27541
  CDS (1)..(873)

SEQ ID NO: 49124 - protein, 290 aa, Rhodopseudomonas palustris; identical to SEQ ID NO: 27542

SEQ ID NO: 49125 - DNA, 867 bp, Rhodopseudomonas palustris; identical to SEQ ID NO: 27543
  CDS (1)..(867)

SEQ ID NO: 49126 - protein, 288 aa, Rhodopseudomonas palustris; identical to SEQ ID NO: 27544

SEQ ID NO: 49127 - DNA, 870 bp, uncultured bacterium 582; identical to SEQ ID NO: 27545
  CDS (1)..(870)

SEQ ID NO: 49128 - protein, 289 aa, uncultured bacterium 582; identical to SEQ ID NO: 27546

SEQ ID NO: 49129 - DNA, 1254 bp, symbiont bacterium of Paederus fuscipes; identical to SEQ ID NO: 27547
  CDS (1)..(1254)

SEQ ID NO: 49130 - protein, 417 aa, symbiont bacterium of Paederus fuscipes; identical to SEQ ID NO: 27548

SEQ ID NO: 49131 - DNA, 879 bp, Alcaligenes eutrophus; identical to SEQ ID NO: 27549
  CDS (1)..(879)

SEQ ID NO: 49132 - protein, 292 aa, Alcaligenes eutrophus; identical to SEQ ID NO: 27550

SEQ ID NO: 49133 - DNA, 882 bp, Rhizobium sp; identical to SEQ ID NO: 27551
  CDS (1)..(882)

SEQ ID NO: 49134 - protein, 293 aa, Rhizobium sp; identical to SEQ ID NO: 27552

SEQ ID NO: 49135 - DNA, 921 bp, Desulfovibrio vulgaris; identical to SEQ ID NO: 27553
  CDS (1)..(921)

SEQ ID NO: 49136 - protein, 306 aa, Desulfovibrio vulgaris; identical to SEQ ID NO: 27554

SEQ ID NO: 49137 - DNA, 906 bp, Desulfovibrio vulgaris; identical to SEQ ID NO: 27555
  CDS (1)..(906)

SEQ ID NO: 49138 - protein, 301 aa, Desulfovibrio vulgaris; identical to SEQ ID NO: 27556

SEQ ID NO: 49139 - DNA, 1224 bp, Desulfovibrio vulgaris; identical to SEQ ID NO: 27557
  CDS (1)..(1224)

SEQ ID NO: 49140 - protein, 407 aa, Desulfovibrio vulgaris; identical to SEQ ID NO: 27558

SEQ ID NO: 49141 - DNA, 909 bp, Desulfovibrio vulgaris; identical to SEQ ID NO: 27559
  CDS (1)..(909)

SEQ ID NO: 49142 - protein, 302 aa, Desulfovibrio vulgaris; identical to SEQ ID NO: 27560

SEQ ID NO: 49143 - DNA, 969 bp, Thermus thermophilus; identical to SEQ ID NO: 27561
  CDS (1)..(969)

SEQ ID NO: 49144 - protein, 322 aa, Thermus thermophilus; identical to SEQ ID NO: 27562

SEQ ID NO: 49145 - DNA, 978 bp, Thermus thermophilus; identical to SEQ ID NO: 27563
  CDS (1)..(978)

SEQ ID NO: 49146 - protein, 325 aa, Thermus thermophilus; identical to SEQ ID NO: 27564

SEQ ID NO: 49147 - DNA, 858 bp, Thermus thermophilus; identical to SEQ ID NO: 27565
  CDS (1)..(858)

SEQ ID NO: 49148 - protein, 285 aa, Thermus thermophilus; identical to SEQ ID NO: 27566

SEQ ID NO: 49149 - DNA, 876 bp, Thermus thermophilus; identical to SEQ ID NO: 27567
  CDS (1)..(876)

SEQ ID NO: 49150 - protein, 291 aa, Thermus thermophilus; identical to SEQ ID NO: 27568

SEQ ID NO: 49151 - DNA, 1068 bp, Thermus thermophilus; identical to SEQ ID NO: 27569
  CDS (1)..(1068)

SEQ ID NO: 49152 - protein, 355 aa, Thermus thermophilus; identical to SEQ ID NO: 27570

SEQ ID NO: 49153 - DNA, 894 bp, Thermus thermophilus; identical to SEQ ID NO: 27571
  CDS (1)..(894)

SEQ ID NO: 49154 - protein, 297 aa, Thermus thermophilus; identical to SEQ ID NO: 27572

SEQ ID NO: 49155 - DNA, 861 bp, Bacillus cereus; identical to SEQ ID NO: 27573
  CDS (1)..(861)

SEQ ID NO: 49156 - protein, 286 aa, Bacillus cereus; identical to SEQ ID NO: 27574

SEQ ID NO: 49157 - DNA, 900 bp, Treponema denticola; identical to SEQ ID NO: 27575
  CDS (1)..(900)

SEQ ID NO: 49158 - protein, 299 aa, Treponema denticola; identical to SEQ ID NO: 27576

SEQ ID NO: 49159 - DNA, 1020 bp, Treponema denticola; identical to SEQ ID NO: 27577
  CDS (1)..(1020)

SEQ ID NO: 49160 - protein, 339 aa, Treponema denticola; identical to SEQ ID NO: 27578

SEQ ID NO: 49161 - DNA, 885 bp, Geobacter sulfurreducens; identical to SEQ ID NO: 27579
  CDS (1)..(885)

SEQ ID NO: 49162 - protein, 294 aa, Geobacter sulfurreducens; identical to SEQ ID NO: 27580

SEQ ID NO: 49163 - DNA, 1158 bp, Agrobacterium tumefaciens; identical to SEQ ID NO: 27581
  CDS (1)..(1158)

SEQ ID NO: 49164 - protein, 385 aa, Agrobacterium tumefaciens; identical to SEQ ID NO: 27582

SEQ ID NO: 49165 - DNA, 903 bp, Wolinella succinogenes; identical to SEQ ID NO: 27583
  CDS (1)..(903)

SEQ ID NO: 49166 - protein, 300 aa, Wolinella succinogenes; identical to SEQ ID NO: 27584

SEQ ID NO: 49167 - DNA, 1110 bp, Gloeobacter violaceus; identical to SEQ ID NO: 27585
  CDS (1)..(1110)

SEQ ID NO: 49168 - protein, 369 aa, Gloeobacter violaceus; identical to SEQ ID NO: 27586

SEQ ID NO: 49169 - DNA, 1170 bp, Gloeobacter violaceus; identical to SEQ ID NO: 27587
  CDS (1)..(1170)

SEQ ID NO: 49170 - protein, 389 aa, Gloeobacter violaceus; identical to SEQ ID NO: 27588

SEQ ID NO: 49171 - DNA, 1092 bp, Chromobacterium violaceum; identical to SEQ ID NO: 27589
  CDS (1)..(1092)

SEQ ID NO: 49172 - protein, 363 aa, Chromobacterium violaceum; identical to SEQ ID NO: 27590

SEQ ID NO: 49173 - DNA, 930 bp, Chromobacterium violaceum; identical to SEQ ID NO: 27591
  CDS (1)..(930)

SEQ ID NO: 49174 - protein, 309 aa, Chromobacterium violaceum; identical to SEQ ID NO: 27592

SEQ ID NO: 49175 - DNA, 1155 bp, Synechococcus sp; identical to SEQ ID NO: 27593
  CDS (1)..(1155)

SEQ ID NO: 49176 - protein, 384 aa, Synechococcus sp; identical to SEQ ID NO: 27594

SEQ ID NO: 49177 - DNA, 1155 bp, Prochlorococcus marinus subsp; identical to SEQ ID NO: 27595
  CDS (1)..(1155)

SEQ ID NO: 49178 - protein, 384 aa, Prochlorococcus marinus subsp; identical to SEQ ID NO: 27596

SEQ ID NO: 49179 - DNA, 1155 bp, Prochlorococcus marinus; identical to SEQ ID NO: 27597
  CDS (1)..(1155)

SEQ ID NO: 49180 - protein, 384 aa, Prochlorococcus marinus; identical to SEQ ID NO: 27598

SEQ ID NO: 49181 - DNA, 885 bp, Bordetella pertussis; identical to SEQ ID NO: 27599
  CDS (1)..(885)

SEQ ID NO: 49182 - protein, 294 aa, Bordetella pertussis; identical to SEQ ID NO: 27600

SEQ ID NO: 49183 - DNA, 1797 bp, Bordetella pertussis; identical to SEQ ID NO: 27601
  CDS (1)..(1797)

SEQ ID NO: 49184 - protein, 598 aa, Bordetella pertussis; identical to SEQ ID NO: 27602

SEQ ID NO: 49185 - DNA, 882 bp, Bordetella pertussis; identical to SEQ ID NO: 27603
  CDS (1)..(882)

SEQ ID NO: 49186 - protein, 293 aa, Bordetella pertussis; identical to SEQ ID NO: 27604

SEQ ID NO: 49187 - DNA, 1950 bp, Bordetella pertussis; identical to SEQ ID NO: 27605
  CDS (1)..(1950)

SEQ ID NO: 49188 - protein, 649 aa, Bordetella pertussis; identical to SEQ ID NO: 27606

SEQ ID NO: 49189 - DNA, 927 bp, Bordetella pertussis; identical to SEQ ID NO: 27607
  CDS (1)..(927)

SEQ ID NO: 49190 - protein, 308 aa, Bordetella pertussis; identical to SEQ ID NO: 27608

SEQ ID NO: 49191 - DNA, 1239 bp, Bordetella pertussis; identical to SEQ ID NO: 27609
  CDS (1)..(1239)

SEQ ID NO: 49192 - protein, 412 aa, Bordetella pertussis; identical to SEQ ID NO: 27610

SEQ ID NO: 49193 - DNA, 921 bp, Bordetella pertussis; identical to SEQ ID NO: 27611
  CDS (1)..(921)

SEQ ID NO: 49194 - protein, 306 aa, Bordetella pertussis; identical to SEQ ID NO: 27612

SEQ ID NO: 49195 - DNA, 1038 bp, Bordetella parapertussis; identical to SEQ ID NO: 27613
  CDS (1)..(1038)

SEQ ID NO: 49196 - protein, 345 aa, Bordetella parapertussis; identical to SEQ ID NO: 27614

SEQ ID NO: 49197 - DNA, 1839 bp, Bordetella parapertussis; identical to SEQ ID NO: 27615
  CDS (1)..(1839)

SEQ ID NO: 49198 - protein, 612 aa, Bordetella parapertussis; identical to SEQ ID NO: 27616

SEQ ID NO: 49199 - DNA, 873 bp, Bordetella parapertussis; identical to SEQ ID NO: 27617
  CDS (1)..(873)

SEQ ID NO: 49200 - protein, 290 aa, Bordetella parapertussis; identical to SEQ ID NO: 27618

SEQ ID NO: 49201 - DNA, 930 bp, Bordetella parapertussis; identical to SEQ ID NO: 27619
  CDS (1)..(930)

SEQ ID NO: 49202 - protein, 309 aa, Bordetella parapertussis; identical to SEQ ID NO: 27620

SEQ ID NO: 49203 - DNA, 888 bp, Bordetella parapertussis; identical to SEQ ID NO: 27621
  CDS (1)..(888)

SEQ ID NO: 49204 - protein, 295 aa, Bordetella parapertussis; identical to SEQ ID NO: 27622

SEQ ID NO: 49205 - DNA, 876 bp, Bordetella parapertussis; identical to SEQ ID NO: 27623
  CDS (1)..(876)

SEQ ID NO: 49206 - protein, 291 aa, Bordetella parapertussis; identical to SEQ ID NO: 27624

SEQ ID NO: 49207 - DNA, 882 bp, Bordetella parapertussis; identical to SEQ ID NO: 27625
  CDS (1)..(882)

SEQ ID NO: 49208 - protein, 293 aa, Bordetella parapertussis; identical to SEQ ID NO: 27626

SEQ ID NO: 49209 - DNA, 876 bp, Bordetella parapertussis; identical to SEQ ID NO: 27627
  CDS (1)..(876)

SEQ ID NO: 49210 - protein, 291 aa, Bordetella parapertussis; identical to SEQ ID NO: 27628

SEQ ID NO: 49211 - DNA, 930 bp, Bordetella bronchiseptica; identical to SEQ ID NO: 27629
  CDS (1)..(930)

SEQ ID NO: 49212 - protein, 309 aa, Bordetella bronchiseptica; identical to SEQ ID NO: 27630

SEQ ID NO: 49213 - DNA, 873 bp, Bordetella bronchiseptica; identical to SEQ ID NO: 27631
  CDS (1)..(873)

SEQ ID NO: 49214 - protein, 290 aa, Bordetella bronchiseptica; identical to SEQ ID NO: 27632

SEQ ID NO: 49215 - DNA, 957 bp, Bordetella bronchiseptica; identical to SEQ ID NO: 27633
  CDS (1)..(957)

SEQ ID NO: 49216 - protein, 318 aa, Bordetella bronchiseptica; identical to SEQ ID NO: 27634

SEQ ID NO: 49217 - DNA, 1950 bp, Bordetella bronchiseptica; identical to SEQ ID NO: 27635
  CDS (1)..(1950)

SEQ ID NO: 49218 - protein, 649 aa, Bordetella bronchiseptica; identical to SEQ ID NO: 27636

SEQ ID NO: 49219 - DNA, 876 bp, Bordetella bronchiseptica; identical to SEQ ID NO: 27637
  CDS (1)..(876)

SEQ ID NO: 49220 - protein, 291 aa, Bordetella bronchiseptica; identical to SEQ ID NO: 27638

SEQ ID NO: 49221 - DNA, 888 bp, Bordetella bronchiseptica; identical to SEQ ID NO: 27639
  CDS (1)..(888)

SEQ ID NO: 49222 - protein, 295 aa, Bordetella bronchiseptica; identical to SEQ ID NO: 27640

SEQ ID NO: 49223 - DNA, 867 bp, Bordetella bronchiseptica; identical to SEQ ID NO: 27641
  CDS (1)..(867)

SEQ ID NO: 49224 - protein, 288 aa, Bordetella bronchiseptica; identical to SEQ ID NO: 27642

SEQ ID NO: 49225 - DNA, 873 bp, Bordetella bronchiseptica; identical to SEQ ID NO: 27643
  CDS (1)..(873)

SEQ ID NO: 49226 - protein, 290 aa, Bordetella bronchiseptica; identical to SEQ ID NO: 27644

SEQ ID NO: 49227 - DNA, 930 bp, Bordetella bronchiseptica; identical to SEQ ID NO: 27645
  CDS (1)..(930)

SEQ ID NO: 49228 - protein, 309 aa, Bordetella bronchiseptica; identical to SEQ ID NO: 27646

SEQ ID NO: 49229 - DNA, 942 bp, Rhizobium leguminosarum; identical to SEQ ID NO: 27647
  CDS (1)..(942)

SEQ ID NO: 49230 - protein, 313 aa, Rhizobium leguminosarum; identical to SEQ ID NO: 27648

SEQ ID NO: 49231 - DNA, 861 bp, Bacillus cereus; identical to SEQ ID NO: 27649
  CDS (1)..(861)

SEQ ID NO: 49232 - protein, 286 aa, Bacillus cereus; identical to SEQ ID NO: 27650

SEQ ID NO: 49233 - DNA, 933 bp, Streptomyces avermitilis; identical to SEQ ID NO: 27651
  CDS (1)..(933)

SEQ ID NO: 49234 - protein, 310 aa, Streptomyces avermitilis; identical to SEQ ID NO: 27652

SEQ ID NO: 49235 - DNA, 891 bp, Streptomyces avermitilis; identical to SEQ ID NO: 27653
  CDS (1)..(891)

SEQ ID NO: 49236 - protein, 296 aa, Streptomyces avermitilis; identical to SEQ ID NO: 27654

SEQ ID NO: 49237 - DNA, 897 bp, Streptomyces avermitilis; identical to SEQ ID NO: 27655
  CDS (1)..(897)

SEQ ID NO: 49238 - protein, 298 aa, Streptomyces avermitilis; identical to SEQ ID NO: 27656

SEQ ID NO: 49239 - DNA, 1005 bp, Tropheryma whipplei; identical to SEQ ID NO: 27657
  CDS (1)..(1005)

SEQ ID NO: 49240 - protein, 334 aa, Tropheryma whipplei; identical to SEQ ID NO: 27658

SEQ ID NO: 49241 - DNA, 918 bp, Pseudomonas fluorescens; identical to SEQ ID NO: 27659
  CDS (1)..(918)

SEQ ID NO: 49242 - protein, 305 aa, Pseudomonas fluorescens; identical to SEQ ID NO: 27660

SEQ ID NO: 49243 - DNA, 867 bp, Azoarcus evansii; identical to SEQ ID NO: 27661
  CDS (1)..(867)

SEQ ID NO: 49244 - protein, 288 aa, Azoarcus evansii; identical to SEQ ID NO: 27662

SEQ ID NO: 49245 - DNA, 894 bp, Vibrio parahaemolyticus; identical to SEQ ID NO: 27663
  CDS (1)..(894)

SEQ ID NO: 49246 - protein, 297 aa, Vibrio parahaemolyticus; identical to SEQ ID NO: 27664

SEQ ID NO: 49247 - DNA, 1314 bp, Pseudomonas syringae; identical to SEQ ID NO: 27665
  CDS (1)..(1314)

SEQ ID NO: 49248 - protein, 437 aa, Pseudomonas syringae; identical to SEQ ID NO: 27666

SEQ ID NO: 49249 - DNA, 1590 bp, Pseudomonas syringae; identical to SEQ ID NO: 27667
  CDS (1)..(1590)

SEQ ID NO: 49250 - protein, 529 aa, Pseudomonas syringae; identical to SEQ ID NO: 27668

SEQ ID NO: 49251 - DNA, 1266 bp, Pseudomonas syringae; identical to SEQ ID NO: 27669
  CDS (1)..(1266)

SEQ ID NO: 49252 - protein, 421 aa, Pseudomonas syringae; identical to SEQ ID NO: 27670

SEQ ID NO: 49253 - DNA, 924 bp, Pseudomonas syringae; identical to SEQ ID NO: 27671
  CDS (1)..(924)

SEQ ID NO: 49254 - protein, 307 aa, Pseudomonas syringae; identical to SEQ ID NO: 27672

SEQ ID NO: 49255 - DNA, 882 bp, Pseudomonas syringae; identical to SEQ ID NO: 27673
  CDS (1)..(882)

SEQ ID NO: 49256 - protein, 293 aa, Pseudomonas syringae; identical to SEQ ID NO: 27674

SEQ ID NO: 49257 - DNA, 882 bp, Pseudomonas syringae; identical to SEQ ID NO: 27675
  CDS (1)..(882)

SEQ ID NO: 49258 - protein, 293 aa, Pseudomonas syringae; identical to SEQ ID NO: 27676

SEQ ID NO: 49259 - DNA, 882 bp, Pseudomonas syringae; identical to SEQ ID NO: 27677
  CDS (1)..(882)

SEQ ID NO: 49260 - protein, 293 aa, Pseudomonas syringae; identical to SEQ ID NO: 27678

SEQ ID NO: 49261 - DNA, 915 bp, Pseudomonas putida; identical to SEQ ID NO: 27679
  CDS (1)..(915)

SEQ ID NO: 49262 - protein, 304 aa, Pseudomonas putida; identical to SEQ ID NO: 27680

SEQ ID NO: 49263 - DNA, 1308 bp, Pseudomonas putida; identical to SEQ ID NO: 27681
  CDS (1)..(1308)

SEQ ID NO: 49264 - protein, 435 aa, Pseudomonas putida; identical to SEQ ID NO: 27682

SEQ ID NO: 49265 - DNA, 1041 bp, Pseudomonas putida; identical to SEQ ID NO: 27683
  CDS (1)..(1041)

SEQ ID NO: 49266 - protein, 346 aa, Pseudomonas putida; identical to SEQ ID NO: 27684

SEQ ID NO: 49267 - DNA, 882 bp, Pseudomonas putida; identical to SEQ ID NO: 27685
  CDS (1)..(882)

SEQ ID NO: 49268 - protein, 293 aa, Pseudomonas putida; identical to SEQ ID NO: 27686

SEQ ID NO: 49269 - DNA, 924 bp, Pseudomonas putida; identical to SEQ ID NO: 27687
  CDS (1)..(924)

SEQ ID NO: 49270 - protein, 307 aa, Pseudomonas putida; identical to SEQ ID NO: 27688

SEQ ID NO: 49271 - DNA, 1257 bp, Pseudomonas putida; identical to SEQ ID NO: 27689
  CDS (1)..(1257)

SEQ ID NO: 49272 - protein, 418 aa, Pseudomonas putida; identical to SEQ ID NO: 27690

SEQ ID NO: 49273 - DNA, 861 bp, Pseudomonas putida; identical to SEQ ID NO: 27691
  CDS (1)..(861)

SEQ ID NO: 49274 - protein, 286 aa, Pseudomonas putida; identical to SEQ ID NO: 27692

SEQ ID NO: 49275 - DNA, 879 bp, Lactobacillus plantarum; identical to SEQ ID NO: 27693
  CDS (1)..(879)

SEQ ID NO: 49276 - protein, 292 aa, Lactobacillus plantarum; identical to SEQ ID NO: 27694

SEQ ID NO: 49277 - DNA, 963 bp, Lactobacillus plantarum; identical to SEQ ID NO: 27695
  CDS (1)..(963)

SEQ ID NO: 49278 - protein, 320 aa, Lactobacillus plantarum; identical to SEQ ID NO: 27696

SEQ ID NO: 49279 - DNA, 876 bp, Bradyrhizobium japonicum; identical to SEQ ID NO: 27697
  CDS (1)..(876)

SEQ ID NO: 49280 - protein, 291 aa, Bradyrhizobium japonicum; identical to SEQ ID NO: 27698

SEQ ID NO: 49281 - DNA, 1770 bp, Bradyrhizobium japonicum; identical to SEQ ID NO: 27699
  CDS (1)..(1770)

SEQ ID NO: 49282 - protein, 589 aa, Bradyrhizobium japonicum; identical to SEQ ID NO: 27700

SEQ ID NO: 49283 - DNA, 1026 bp, Bradyrhizobium japonicum; identical to SEQ ID NO: 27701
  CDS (1)..(1026)

SEQ ID NO: 49284 - protein, 341 aa, Bradyrhizobium japonicum; identical to SEQ ID NO: 27702

SEQ ID NO: 49285 - DNA, 879 bp, Bradyrhizobium japonicum; identical to SEQ ID NO: 27703
  CDS (1)..(879)

SEQ ID NO: 49286 - protein, 292 aa, Bradyrhizobium japonicum; identical to SEQ ID NO: 27704

SEQ ID NO: 49287 - DNA, 1665 bp, Bradyrhizobium japonicum; identical to SEQ ID NO: 27705
  CDS (1)..(1665)

SEQ ID NO: 49288 - protein, 554 aa, Bradyrhizobium japonicum; identical to SEQ ID NO: 27706

SEQ ID NO: 49289 - DNA, 882 bp, Bradyrhizobium japonicum; identical to SEQ ID NO: 27707
  CDS (1)..(882)

SEQ ID NO: 49290 - protein, 293 aa, Bradyrhizobium japonicum; identical to SEQ ID NO: 27708

SEQ ID NO: 49291 - DNA, 855 bp, Bradyrhizobium japonicum; identical to SEQ ID NO: 27709
  CDS (1)..(855)

SEQ ID NO: 49292 - protein, 284 aa, Bradyrhizobium japonicum; identical to SEQ ID NO: 27710

SEQ ID NO: 49293 - DNA, 867 bp, Bradyrhizobium japonicum; identical to SEQ ID NO: 27711
  CDS (1)..(867)

SEQ ID NO: 49294 - protein, 288 aa, Bradyrhizobium japonicum; identical to SEQ ID NO: 27712

SEQ ID NO: 49295 - DNA, 867 bp, Bradyrhizobium japonicum; identical to SEQ ID NO: 27713
  CDS (1)..(867)

SEQ ID NO: 49296 - protein, 288 aa, Bradyrhizobium japonicum; identical to SEQ ID NO: 27714

SEQ ID NO: 49297 - DNA, 882 bp, Bradyrhizobium japonicum; identical to SEQ ID NO: 27715
  CDS (1)..(882)

SEQ ID NO: 49298 - protein, 293 aa, Bradyrhizobium japonicum; identical to SEQ ID NO: 27716

SEQ ID NO: 49299 - DNA, 918 bp, Bradyrhizobium japonicum; identical to SEQ ID NO: 27717
  CDS (1)..(918)

SEQ ID NO: 49300 - protein, 305 aa, Bradyrhizobium japonicum; identical to SEQ ID NO: 27718

SEQ ID NO: 49301 - DNA, 870 bp, Bradyrhizobium japonicum; identical to SEQ ID NO: 27719
  CDS (1)..(870)

SEQ ID NO: 49302 - protein, 289 aa, Bradyrhizobium japonicum; identical to SEQ ID NO: 27720

SEQ ID NO: 49303 - DNA, 1890 bp, Bradyrhizobium japonicum; identical to SEQ ID NO: 27721
  CDS (1)..(1890)

SEQ ID NO: 49304 - protein, 629 aa, Bradyrhizobium japonicum; identical to SEQ ID NO: 27722

SEQ ID NO: 49305 - DNA, 930 bp, Bradyrhizobium japonicum; identical to SEQ ID NO: 27723
  CDS (1)..(930)

SEQ ID NO: 49306 - protein, 309 aa, Bradyrhizobium japonicum; identical to SEQ ID NO: 27724

SEQ ID NO: 49307 - DNA, 873 bp, Bradyrhizobium japonicum; identical to SEQ ID NO: 27725
  CDS (1)..(873)

SEQ ID NO: 49308 - protein, 290 aa, Bradyrhizobium japonicum; identical to SEQ ID NO: 27726

SEQ ID NO: 49309 - DNA, 1044 bp, Bradyrhizobium japonicum; identical to SEQ ID NO: 27727
  CDS (1)..(1044)

SEQ ID NO: 49310 - protein, 347 aa, Bradyrhizobium japonicum; identical to SEQ ID NO: 27728

SEQ ID NO: 49311 - DNA, 1011 bp, Bradyrhizobium japonicum; identical to SEQ ID NO: 27729
  CDS (1)..(1011)

SEQ ID NO: 49312 - protein, 336 aa, Bradyrhizobium japonicum; identical to SEQ ID NO: 27730

SEQ ID NO: 49313 - DNA, 1047 bp, Bradyrhizobium japonicum; identical to SEQ ID NO: 27731
  CDS (1)..(1047)

SEQ ID NO: 49314 - protein, 348 aa, Bradyrhizobium japonicum; identical to SEQ ID NO: 27732

SEQ ID NO: 49315 - DNA, 903 bp, Bradyrhizobium japonicum; identical to SEQ ID NO: 27733
  CDS (1)..(903)

SEQ ID NO: 49316 - protein, 300 aa, Bradyrhizobium japonicum; identical to SEQ ID NO: 27734

SEQ ID NO: 49317 - DNA, 906 bp, Bradyrhizobium japonicum; identical to SEQ ID NO: 27735
  CDS (1)..(906)

SEQ ID NO: 49318 - protein, 301 aa, Bradyrhizobium japonicum; identical to SEQ ID NO: 27736

SEQ ID NO: 49319 - DNA, 1170 bp, Bradyrhizobium japonicum; identical to SEQ ID NO: 27737
  CDS (1)..(1170)

SEQ ID NO: 49320 - protein, 389 aa, Bradyrhizobium japonicum; identical to SEQ ID NO: 27738

SEQ ID NO: 49321 - DNA, 1608 bp, Bradyrhizobium japonicum; identical to SEQ ID NO: 27739
  CDS (1)..(1608)

SEQ ID NO: 49322 - protein, 535 aa, Bradyrhizobium japonicum; identical to SEQ ID NO: 27740

SEQ ID NO: 49323 - DNA, 876 bp, Bradyrhizobium japonicum; identical to SEQ ID NO: 27741
  CDS (1)..(876)

SEQ ID NO: 49324 - protein, 291 aa, Bradyrhizobium japonicum; identical to SEQ ID NO: 27742

SEQ ID NO: 49325 - DNA, 1011 bp, Bradyrhizobium japonicum; identical to SEQ ID NO: 27743
  CDS (1)..(1011)

SEQ ID NO: 49326 - protein, 336 aa, Bradyrhizobium japonicum; identical to SEQ ID NO: 27744

SEQ ID NO: 49327 - DNA, 858 bp, Bradyrhizobium japonicum; identical to SEQ ID NO: 27745
  CDS (1)..(858)

SEQ ID NO: 49328 - protein, 285 aa, Bradyrhizobium japonicum; identical to SEQ ID NO: 27746

SEQ ID NO: 49329 - DNA, 1617 bp, Yersinia pestis; identical to SEQ ID NO: 27747
  CDS (1)..(1617)

SEQ ID NO: 49330 - protein, 538 aa, Yersinia pestis; identical to SEQ ID NO: 27748

SEQ ID NO: 49331 - DNA, 936 bp, Synechococcus elongatus; identical to SEQ ID NO: 27749
  CDS (1)..(936)

SEQ ID NO: 49332 - protein, 311 aa, Synechococcus elongatus; identical to SEQ ID NO: 27750

SEQ ID NO: 49333 - DNA, 870 bp, Synechococcus elongatus; identical to SEQ ID NO: 27751
  CDS (1)..(870)

SEQ ID NO: 49334 - protein, 289 aa, Synechococcus elongatus; identical to SEQ ID NO: 27752

SEQ ID NO: 49335 - DNA, 1170 bp, Synechococcus elongatus; identical to SEQ ID NO: 27753
  CDS (1)..(1170)

SEQ ID NO: 49336 - protein, 389 aa, Synechococcus elongatus; identical to SEQ ID NO: 27754

SEQ ID NO: 49337 - DNA, 1158 bp, Synechococcus elongatus; identical to SEQ ID NO: 27755
  CDS (1)..(1158)

SEQ ID NO: 49338 - protein, 385 aa, Synechococcus elongatus; identical to SEQ ID NO: 27756

SEQ ID NO: 49339 - DNA, 870 bp, Streptococcus mutans; identical to SEQ ID NO: 27757
  CDS (1)..(870)

SEQ ID NO: 49340 - protein, 289 aa, Streptococcus mutans; identical to SEQ ID NO: 27758

SEQ ID NO: 49341 - DNA, 957 bp, Streptococcus mutans; identical to SEQ ID NO: 27759
  CDS (1)..(957)

SEQ ID NO: 49342 - protein, 318 aa, Streptococcus mutans; identical to SEQ ID NO: 27760

SEQ ID NO: 49343 - DNA, 870 bp, Streptococcus agalactiae; identical to SEQ ID NO: 27761
  CDS (1)..(870)

SEQ ID NO: 49344 - protein, 289 aa, Streptococcus agalactiae; identical to SEQ ID NO: 27762

SEQ ID NO: 49345 - DNA, 954 bp, Streptococcus agalactiae; identical to SEQ ID NO: 27763
  CDS (1)..(954)

SEQ ID NO: 49346 - protein, 317 aa, Streptococcus agalactiae; identical to SEQ ID NO: 27764

SEQ ID NO: 49347 - DNA, 987 bp, Oceanobacillus iheyensis; identical to SEQ ID NO: 27765
  CDS (1)..(987)

SEQ ID NO: 49348 - protein, 328 aa, Oceanobacillus iheyensis; identical to SEQ ID NO: 27766

SEQ ID NO: 49349 - DNA, 864 bp, Oceanobacillus iheyensis; identical to SEQ ID NO: 27767
  CDS (1)..(864)

SEQ ID NO: 49350 - protein, 287 aa, Oceanobacillus iheyensis; identical to SEQ ID NO: 27768

SEQ ID NO: 49351 - DNA, 885 bp, Corynebacterium efficiens; identical to SEQ ID NO: 27769
  CDS (1)..(885)

SEQ ID NO: 49352 - protein, 294 aa, Corynebacterium efficiens; identical to SEQ ID NO: 27770

SEQ ID NO: 49353 - DNA, 870 bp, Brucella suis; identical to SEQ ID NO: 27771
  CDS (1)..(870)

SEQ ID NO: 49354 - protein, 289 aa, Brucella suis; identical to SEQ ID NO: 27772

SEQ ID NO: 49355 - DNA, 888 bp, Brucella suis; identical to SEQ ID NO: 27773
  CDS (1)..(888)

SEQ ID NO: 49356 - protein, 295 aa, Brucella suis; identical to SEQ ID NO: 27774

SEQ ID NO: 49357 - DNA, 870 bp, Brucella suis; identical to SEQ ID NO: 27775
  CDS (1)..(870)

SEQ ID NO: 49358 - protein, 289 aa, Brucella suis; identical to SEQ ID NO: 27776

SEQ ID NO: 49359 - DNA, 885 bp, Brucella suis; identical to SEQ ID NO: 27777
  CDS (1)..(885)

SEQ ID NO: 49360 - protein, 294 aa, Brucella suis; identical to SEQ ID NO: 27778

SEQ ID NO: 49361 - DNA, 909 bp, Brucella suis; identical to SEQ ID NO: 27779
  CDS (1)..(909)

SEQ ID NO: 49362 - protein, 302 aa, Brucella suis; identical to SEQ ID NO: 27780

SEQ ID NO: 49363 - DNA, 1077 bp, Bifidobacterium longum; identical to SEQ ID NO: 27781
  CDS (1)..(1077)

SEQ ID NO: 49364 - protein, 358 aa, Bifidobacterium longum; identical to SEQ ID NO: 27782

SEQ ID NO: 49365 - DNA, 927 bp, Bifidobacterium longum; identical to SEQ ID NO: 27783
  CDS (1)..(927)

SEQ ID NO: 49366 - protein, 308 aa, Bifidobacterium longum; identical to SEQ ID NO: 27784

SEQ ID NO: 49367 - DNA, 822 bp, Pseudomonas resinovorans; identical to SEQ ID NO: 27785
  CDS (1)..(822)

SEQ ID NO: 49368 - protein, 273 aa, Pseudomonas resinovorans; identical to SEQ ID NO: 27786

SEQ ID NO: 49369 - DNA, 1080 bp, Corynebacterium glutamicum; identical to SEQ ID NO: 27787
  CDS (1)..(1080)

SEQ ID NO: 49370 - protein, 359 aa, Corynebacterium glutamicum; identical to SEQ ID NO: 27788

SEQ ID NO: 49371 - DNA, 885 bp, Corynebacterium glutamicum; identical to SEQ ID NO: 27789
  CDS (1)..(885)

SEQ ID NO: 49372 - protein, 294 aa, Corynebacterium glutamicum; identical to SEQ ID NO: 27790

SEQ ID NO: 49373 - DNA, 927 bp, Fusobacterium nucleatum; identical to SEQ ID NO: 27791
  CDS (1)..(927)

SEQ ID NO: 49374 - protein, 308 aa, Fusobacterium nucleatum; identical to SEQ ID NO: 27792

SEQ ID NO: 49375 - DNA, 858 bp, Fusobacterium nucleatum; identical to SEQ ID NO: 27793
  CDS (1)..(858)

SEQ ID NO: 49376 - protein, 285 aa, Fusobacterium nucleatum; identical to SEQ ID NO: 27794

SEQ ID NO: 49377 - DNA, 873 bp, Rhizobium leguminosarum; identical to SEQ ID NO: 27795
  CDS (1)..(873)

SEQ ID NO: 49378 - protein, 290 aa, Rhizobium leguminosarum; identical to SEQ ID NO: 27796

SEQ ID NO: 49379 - DNA, 885 bp, Burkholderia cepacia; identical to SEQ ID NO: 27797
  CDS (1)..(885)

SEQ ID NO: 49380 - protein, 294 aa, Burkholderia cepacia; identical to SEQ ID NO: 27798

SEQ ID NO: 49381 - DNA, 1827 bp, Ralstonia solanacearum; identical to SEQ ID NO: 27799
  CDS (1)..(1827)

SEQ ID NO: 49382 - protein, 608 aa, Ralstonia solanacearum; identical to SEQ ID NO: 27800

SEQ ID NO: 49383 - DNA, 900 bp, Ralstonia solanacearum; identical to SEQ ID NO: 27801
  CDS (1)..(900)

SEQ ID NO: 49384 - protein, 299 aa, Ralstonia solanacearum; identical to SEQ ID NO: 27802

SEQ ID NO: 49385 - DNA, 882 bp, Ralstonia solanacearum; identical to SEQ ID NO: 27803
  CDS (1)..(882)

SEQ ID NO: 49386 - protein, 293 aa, Ralstonia solanacearum; identical to SEQ ID NO: 27804

SEQ ID NO: 49387 - DNA, 942 bp, Ralstonia solanacearum; identical to SEQ ID NO: 27805
  CDS (1)..(942)

SEQ ID NO: 49388 - protein, 313 aa, Ralstonia solanacearum; identical to SEQ ID NO: 27806

SEQ ID NO: 49389 - DNA, 936 bp, Ralstonia solanacearum; identical to SEQ ID NO: 27807
  CDS (1)..(936)

SEQ ID NO: 49390 - protein, 311 aa, Ralstonia solanacearum; identical to SEQ ID NO: 27808

SEQ ID NO: 49391 - DNA, 1137 bp, Ralstonia solanacearum; identical to SEQ ID NO: 27809
  CDS (1)..(1137)

SEQ ID NO: 49392 - protein, 378 aa, Ralstonia solanacearum; identical to SEQ ID NO: 27810

SEQ ID NO: 49393 - DNA, 870 bp, Ralstonia solanacearum; identical to SEQ ID NO: 27811
  CDS (1)..(870)

SEQ ID NO: 49394 - protein, 289 aa, Ralstonia solanacearum; identical to SEQ ID NO: 27812

SEQ ID NO: 49395 - DNA, 1617 bp, Ralstonia solanacearum; identical to SEQ ID NO: 27813
  CDS (1)..(1617)

SEQ ID NO: 49396 - protein, 538 aa, Ralstonia solanacearum; identical to SEQ ID NO: 27814

SEQ ID NO: 49397 - DNA, 948 bp, Ralstonia solanacearum; identical to SEQ ID NO: 27815
  CDS (1)..(948)

SEQ ID NO: 49398 - protein, 315 aa, Ralstonia solanacearum; identical to SEQ ID NO: 27816

SEQ ID NO: 49399 - DNA, 960 bp, Pyrobaculum aerophilum; identical to SEQ ID NO: 27817
  CDS (1)..(960)

SEQ ID NO: 49400 - protein, 319 aa, Pyrobaculum aerophilum; identical to SEQ ID NO: 27818

SEQ ID NO: 49401 - DNA, 960 bp, Pyrobaculum aerophilum; identical to SEQ ID NO: 27819
  CDS (1)..(960)

SEQ ID NO: 49402 - protein, 319 aa, Pyrobaculum aerophilum; identical to SEQ ID NO: 27820

SEQ ID NO: 49403 - DNA, 873 bp, Pyrobaculum aerophilum; identical to SEQ ID NO: 27821
  CDS (1)..(873)

SEQ ID NO: 49404 - protein, 290 aa, Pyrobaculum aerophilum; identical to SEQ ID NO: 27822

SEQ ID NO: 49405 - DNA, 888 bp, Rhizobium meliloti; identical to SEQ ID NO: 27823
  CDS (1)..(888)

SEQ ID NO: 49406 - protein, 295 aa, Rhizobium meliloti; identical to SEQ ID NO: 27824

SEQ ID NO: 49407 - DNA, 891 bp, Rhizobium meliloti; identical to SEQ ID NO: 27825
  CDS (1)..(891)

SEQ ID NO: 49408 - protein, 296 aa, Rhizobium meliloti; identical to SEQ ID NO: 27826

SEQ ID NO: 49409 - DNA, 903 bp, Rhizobium meliloti; identical to SEQ ID NO: 27827
  CDS (1)..(903)

SEQ ID NO: 49410 - protein, 300 aa, Rhizobium meliloti; identical to SEQ ID NO: 27828

SEQ ID NO: 49411 - DNA, 897 bp, Rhizobium meliloti; identical to SEQ ID NO: 27829
  CDS (1)..(897)

SEQ ID NO: 49412 - protein, 298 aa, Rhizobium meliloti; identical to SEQ ID NO: 27830

SEQ ID NO: 49413 - DNA, 942 bp, Synechococcus sp; identical to SEQ ID NO: 27831
  CDS (1)..(942)

SEQ ID NO: 49414 - protein, 313 aa, Synechococcus sp; identical to SEQ ID NO: 27832

SEQ ID NO: 49415 - DNA, 1011 bp, Rhizobium loti; identical to SEQ ID NO: 27833
  CDS (1)..(1011)

SEQ ID NO: 49416 - protein, 336 aa, Rhizobium loti; identical to SEQ ID NO: 27834

SEQ ID NO: 49417 - DNA, 897 bp, Rhizobium loti; identical to SEQ ID NO: 27835
  CDS (1)..(897)

SEQ ID NO: 49418 - protein, 298 aa, Rhizobium loti; identical to SEQ ID NO: 27836

SEQ ID NO: 49419 - DNA, 909 bp, Rhizobium loti; identical to SEQ ID NO: 27837
  CDS (1)..(909)

SEQ ID NO: 49420 - protein, 302 aa, Rhizobium loti; identical to SEQ ID NO: 27838

SEQ ID NO: 49421 - DNA, 900 bp, Rhizobium loti; identical to SEQ ID NO: 27839
  CDS (1)..(900)

SEQ ID NO: 49422 - protein, 299 aa, Rhizobium loti; identical to SEQ ID NO: 27840

SEQ ID NO: 49423 - DNA, 906 bp, Rhizobium loti; identical to SEQ ID NO: 27841
  CDS (1)..(906)

SEQ ID NO: 49424 - protein, 301 aa, Rhizobium loti; identical to SEQ ID NO: 27842

SEQ ID NO: 49425 - DNA, 882 bp, Rhizobium loti; identical to SEQ ID NO: 27843
  CDS (1)..(882)

SEQ ID NO: 49426 - protein, 293 aa, Rhizobium loti; identical to SEQ ID NO: 27844

SEQ ID NO: 49427 - DNA, 963 bp, Rhizobium loti; identical to SEQ ID NO: 27845
  CDS (1)..(963)

SEQ ID NO: 49428 - protein, 320 aa, Rhizobium loti; identical to SEQ ID NO: 27846

SEQ ID NO: 49429 - DNA, 867 bp, Agrobacterium tumefaciens; identical to SEQ ID NO: 27847
  CDS (1)..(867)

SEQ ID NO: 49430 - protein, 288 aa, Agrobacterium tumefaciens; identical to SEQ ID NO: 27848

SEQ ID NO: 49431 - DNA, 1716 bp, Pseudomonas resinovorans; identical to SEQ ID NO: 27849
  CDS (1)..(1716)

SEQ ID NO: 49432 - protein, 571 aa, Pseudomonas resinovorans; identical to SEQ ID NO: 27850

SEQ ID NO: 49433 - DNA, 873 bp, Streptomyces coelicolor; identical to SEQ ID NO: 27851
  CDS (1)..(873)

SEQ ID NO: 49434 - protein, 290 aa, Streptomyces coelicolor; identical to SEQ ID NO: 27852

SEQ ID NO: 49435 - DNA, 900 bp, Streptomyces coelicolor; identical to SEQ ID NO: 27853
  CDS (1)..(900)

SEQ ID NO: 49436 - protein, 299 aa, Streptomyces coelicolor; identical to SEQ ID NO: 27854

SEQ ID NO: 49437 - DNA, 26 bp, Primer
atgtctgagcagtttttgtatttctt

SEQ ID NO: 49438 - DNA, 24 bp, Primer
ttatactttctctacctccgggcg

SEQ ID NO: 49439 - protein, 43 aa, consensus; identical to SEQ ID NO: 28576
  MISC_FEATURE (1)..(43): consensus for the disclosure of xaa see table XV

SEQ ID NO: 49440 - protein, 80 aa, consensus; identical to SEQ ID NO: 28577
  MISC_FEATURE (1)..(80): consensus for the disclosure of xaa see table XV

SEQ ID NO: 49441 - DNA, 1059 bp, Escherichia coli K12; identical to SEQ ID NO: 21544
  CDS (1)..(1059)

SEQ ID NO: 49442 - protein, 352 aa, Escherichia coli K12; identical to SEQ ID NO: 21545

SEQ ID NO: 49443 - DNA, 897 bp, Bacillus halodurans; identical to SEQ ID NO: 21546
  CDS (1)..(897)

SEQ ID NO: 49444 - protein, 298 aa, Bacillus halodurans; identical to SEQ ID NO: 21547

SEQ ID NO: 49445 - DNA, 954 bp, Yersinia pestis; identical to SEQ ID NO: 21548
  CDS (1)..(954)

SEQ ID NO: 49446 - protein, 317 aa, Yersinia pestis; identical to SEQ ID NO: 21549

SEQ ID NO: 49447 - DNA, 885 bp, Listeria innocua; identical to SEQ ID NO: 21550
  CDS (1)..(885)

SEQ ID NO: 49448 - protein, 294 aa, Listeria innocua; identical to SEQ ID NO: 21551

SEQ ID NO: 49449 - DNA, 903 bp, Nostoc sp. PCC 7120; identical to SEQ ID NO: 21552
  CDS (1)..(903)

SEQ ID NO: 49450 - protein, 300 aa, Nostoc sp. PCC 7120; identical to SEQ ID NO: 21553

SEQ ID NO: 49451 - DNA, 1056 bp, Salmonella enterica subsp. enterica serovar Typhi; identical to SEQ ID NO: 21554
  CDS (1)..(1056)

SEQ ID NO: 49452 - protein, 351 aa, Salmonella enterica subsp. enterica serovar Typhi; identical to SEQ ID NO: 21555

SEQ ID NO: 49453 - DNA, 939 bp, Xylella fastidiosa; identical to SEQ ID NO: 21556
  CDS (1)..(939)

SEQ ID NO: 49454 - protein, 312 aa, Xylella fastidiosa; identical to SEQ ID NO: 21557

SEQ ID NO: 49455 - DNA, 918 bp, Neisseria meningitidis; identical to SEQ ID NO: 21558
  CDS (1)..(918)

SEQ ID NO: 49456 - protein, 305 aa, Neisseria meningitidis; identical to SEQ ID NO: 21559

SEQ ID NO: 49457 - DNA, 906 bp, Clostridium acetobutylicum; identical to SEQ ID NO: 21560
  CDS (1)..(906)

SEQ ID NO: 49458 - protein, 301 aa, Clostridium acetobutylicum; identical to SEQ ID NO: 21561

SEQ ID NO: 49459 - DNA, 990 bp, Streptococcus pneumoniae; identical to SEQ ID NO: 21562
  CDS (1)..(990)

SEQ ID NO: 49460 - protein, 329 aa, Streptococcus pneumoniae; identical to SEQ ID NO: 21563

SEQ ID NO: 49461 - DNA, 993 bp, Vibrio cholerae; identical to SEQ ID NO: 21564
  CDS (1)..(993)

SEQ ID NO: 49462 - protein, 330 aa, Vibrio cholerae; identical to SEQ ID NO: 21565

SEQ ID NO: 49463 - DNA, 936 bp, Lactococcus lactis subsp. lactis; identical to SEQ ID NO: 21566
  CDS (1)..(936)

SEQ ID NO: 49464 - protein, 311 aa, Lactococcus lactis subsp. lactis; identical to SEQ ID NO: 21567

SEQ ID NO: 49465 - DNA, 882 bp, Clostridium acetobutylicum; identical to SEQ ID NO: 21568
  CDS (1)..(882)

SEQ ID NO: 49466 - protein, 293 aa, Clostridium acetobutylicum; identical to SEQ ID NO: 21569

SEQ ID NO: 49467 - DNA, 891 bp, Bacillus subtilis; identical to SEQ ID NO: 21570
  CDS (1)..(891)

SEQ ID NO: 49468 - protein, 296 aa, Bacillus subtilis; identical to SEQ ID NO: 21571

SEQ ID NO: 49469 - DNA, 1008 bp, Pseudomonas aeruginosa; identical to SEQ ID NO: 21572
  CDS (1)..(1008)

SEQ ID NO: 49470 - protein, 335 aa, Pseudomonas aeruginosa; identical to SEQ ID NO: 21573

SEQ ID NO: 49471 - DNA, 894 bp, Caulobacter crescentus; identical to SEQ ID NO: 21574
  CDS (1)..(894)

SEQ ID NO: 49472 - protein, 297 aa, Caulobacter crescentus; identical to SEQ ID NO: 21575

SEQ ID NO: 49473 - DNA, 933 bp, Haemophilus influenzae; identical to SEQ ID NO: 21576
  CDS (1)..(933)

SEQ ID NO: 49474 - protein, 310 aa, Haemophilus influenzae; identical to SEQ ID NO: 21577

SEQ ID NO: 49475 - DNA, 1026 bp, Pseudomonas putida; identical to SEQ ID NO: 21578
  CDS (1)..(1026)

SEQ ID NO: 49476 - protein, 341 aa, Pseudomonas putida; identical to SEQ ID NO: 21579

SEQ ID NO: 49477 - DNA, 969 bp, Erwinia carotovora subsp; identical to SEQ ID NO: 21580
  CDS (1)..(969)

SEQ ID NO: 49478 - protein, 322 aa, Erwinia carotovora subsp; identical to SEQ ID NO: 21581

SEQ ID NO: 49479 - DNA, 933 bp, Photobacterium profundum; identical to SEQ ID NO: 21582
  CDS (1)..(933)

SEQ ID NO: 49480 - protein, 310 aa, Photobacterium profundum; identical to SEQ ID NO: 21583

SEQ ID NO: 49481 - DNA, 753 bp, Bdellovibrio bacteriovorus; identical to SEQ ID NO: 21584
  CDS (1)..(753)

SEQ ID NO: 49482 - protein, 250 aa, Bdellovibrio bacteriovorus; identical to SEQ ID NO: 21585

SEQ ID NO: 49483 - DNA, 903 bp, Corynebacterium diphtheriae; identical to SEQ ID NO: 21586
  CDS (1)..(903)

SEQ ID NO: 49484 - protein, 300 aa, Corynebacterium diphtheriae; identical to SEQ ID NO: 21587

SEQ ID NO: 49485 - DNA, 855 bp, Thermus thermophilus; identical to SEQ ID NO: 21588
  CDS (1)..(855)

SEQ ID NO: 49486 - protein, 284 aa, Thermus thermophilus; identical to SEQ ID NO: 21589

SEQ ID NO: 49487 - DNA, 894 bp, Bacillus cereus; identical to SEQ ID NO: 21590
  CDS (1)..(894)

SEQ ID NO: 49488 - protein, 297 aa, Bacillus cereus; identical to SEQ ID NO: 21591

SEQ ID NO: 49489 - DNA, 951 bp, Geobacter sulfurreducens; identical to SEQ ID NO: 21592
  CDS (1)..(951)

SEQ ID NO: 49490 - protein, 316 aa, Geobacter sulfurreducens; identical to SEQ ID NO: 21593

SEQ ID NO: 49491 - DNA, 969 bp, Vibrio vulnificus; identical to SEQ ID NO: 21594
  CDS (1)..(969)

SEQ ID NO: 49492 - protein, 322 aa, Vibrio vulnificus; identical to SEQ ID NO: 21595

SEQ ID NO: 49493 - DNA, 888 bp, Porphyromonas gingivalis; identical to SEQ ID NO: 21596
  CDS (1)..(888)

SEQ ID NO: 49494 - protein, 295 aa, Porphyromonas gingivalis; identical to SEQ ID NO: 21597

SEQ ID NO: 49495 - DNA, 975 bp, Photorhabdus luminescens; identical to SEQ ID NO: 21598
  CDS (1)..(975)

SEQ ID NO: 49496 - protein, 324 aa, Photorhabdus luminescens; identical to SEQ ID NO: 21599

SEQ ID NO: 49497 - DNA, 882 bp, Gloeobacter violaceus; identical to SEQ ID NO: 21600
  CDS (1)..(882)

SEQ ID NO: 49498 - protein, 293 aa, Gloeobacter violaceus; identical to SEQ ID NO: 21601

SEQ ID NO: 49499 - DNA, 909 bp, Chromobacterium violaceum; identical to SEQ ID NO: 21602
  CDS (1)..(909)

SEQ ID NO: 49500 - protein, 302 aa, Chromobacterium violaceum; identical to SEQ ID NO: 21603

SEQ ID NO: 49501 - DNA, 894 bp, Mycobacterium bovis; identical to SEQ ID NO: 21604
  CDS (1)..(894)

SEQ ID NO: 49502 - protein, 297 aa, Mycobacterium bovis; identical to SEQ ID NO: 21605

SEQ ID NO: 49503 - DNA, 939 bp, Haemophilus ducreyi; identical to SEQ ID NO: 21606
  CDS (1)..(939)

SEQ ID NO: 49504 - protein, 312 aa, Haemophilus ducreyi; identical to SEQ ID NO: 21607

SEQ ID NO: 49505 - DNA, 909 bp, Bordetella pertussis; identical to SEQ ID NO: 21608
  CDS (1)..(909)

SEQ ID NO: 49506 - protein, 302 aa, Bordetella pertussis; identical to SEQ ID NO: 21609

SEQ ID NO: 49507 - DNA, 918 bp, Streptomyces avermitilis; identical to SEQ ID NO: 21610
  CDS (1)..(918)

SEQ ID NO: 49508 - protein, 305 aa, Streptomyces avermitilis; identical to SEQ ID NO: 21611

SEQ ID NO: 49509 - DNA, 921 bp, Nitrosomonas europaea; identical to SEQ ID NO: 21612
  CDS (1)..(921)
